United States Patent 9,328,346 (POLYCOMB-ASSOCIATED NON-CODING RNAS) - sequence listing, part 161

SEQ ID NO: 192984 - RNA, 133929 nt, Homo sapiens
uuagagugcauuaaauaaauauaaauuuuauuaaaaacacucacauagcauuaucaggaaugauauaauaauaaacagcuuucaaauaaccugcauucauaacauuacaauacuuacaguauuuauaaccauccucagaucuuauaaaccaaacaucucaugaaaaugaaaugaaacuaguuuuuaaaaaagcauagaaaaaugcacacagaaguuaucuuagugucaaacugcaaaaguuuccuacacaaguuaaccacuagcuucagaagugaacuguacaucacugugcgucaaucaagaugaaaaauucauucaaguaaaguugacaccacucagaagcauuuucaaguauggcuauauagucaaccugauauuccuauauuagcaaauuguagaucugcuuuccauucauucuaacugaggcagguuuuauauuuacaauuauagaucugauauuuacaauaugccacucaauuucuucucuuccuuauguaaacucuccccaaccccccaaacuauacuuccuguucuuguuggccagcaguuuaacaaaugacaguaggugacacagaaaucaaauauuaagaauggaugaucaaaaucaccaaugcacauguaguaaucaaauguuuggggcuagauauuaugguauacaaaaaacauuaaaaucaugugguuuguaagcaaagcaaacauuuuuggaaauguuugcaaauuggacacaaccacaaauucaagaaauuuuuuaaaaagacaaaagccagcuuacaaagauuugaccaauaaaacccaaaggccuccucugauuaagaauuuauuuuaaauacuaguaagcaaaaauguauuuaggccaaaauguaauuguacaaucuguugcacaccauaccuguagguguuugccuguuuaagggaaguccacauggaguauguaccuucagugauuacaggaucaaaaaaacuucauuuagagaguuacaaguaagucucuggccaacagccacuugccaaacuccugccuuacaauuuuucccuuuaucaacucagugcauucuauuuucauguaauuuuuuuuuccugcuugaaacagucaaaagauuccucaaacuuuuaaaaugcuuuucuuuacaauaaaaagagccaacagauuuacaaaauuaguuuuaguuacaucagcacauguacaaguaaaauagaagggauucaaaauaaaaggguuaaaucccugacaaagaauauauuuauuaaccuacaacaauuuuacauaaacacaggugacauguuggcauagggagagcaugagcugaaauaucccugaauuuuuagaacaaaaagguugaaguucaaguuauacuugcuaagaaaucaaguauugaaaaaagguaugcuuuuuuuuuuaacaauaaaaaaaaggacuuggaaaaaaaugaugguacacaaugcuuucacucucaguucaauauccuauugccaaacuaguguugagguauaugacaaguaggaacaucacucaaacauuuaaugaauucuuagcucacauuaugauauauuuguagcaggcugaguagcaccaucaugaugugaauucugcuucaaacucauauauauauauauauauauauauauauauauguauauauuuaauuuuuuuacaguacuaaaauacuaaagcauugcauuaaaaaaguuuuguuuacaauuuaauuuacuauacaacucuuucacuucuuuauacaaauuaaugauuuaaaaccaccacagcaaaccagcugccuguuuuuguuucuuuuuaacugacagauucacauggaacuaacccuguuuauucaucuuaugcaggcaucagucugcucaauccucuuguuaaagaggacacuuaagcuaagaaaugacaacgucacaauguacauaauuaucaacacaaaggcagacugccauucaguucucugaagagccuaugauccauaaaauagcauaggcuucagugaacuagcuuuguugagucugcagcaugcagcuaauuauuaccugcaguuaauagaaaauucuuaaaacuguacauuuuugagcaaugaacuugucauacaauuuuguauaaaacuguuuuacaguauagcaugugagaugagcaccagaaaacauguuuuguggacuaacguauucccuugaauccaguaagccccaugguggauuuaacuggcuguguuaaaaauggacacaauugcucaucagcagaugcauggcuaaaagcaaaaauauuuuaaaagcuuucuuuguuuccuuaaaaaaaucaacuuugcauucuaaaaugaaaguaaacuuguuuuuuaaacaucucaguaccuuagcauuguucaaguugucaaagcuuagguagacaaagugcuucuaaaacaccauuuaaaauauuuauacauauacaugugugugcacauauacauguuuguguauauauguacauauauacguuuauuguccuacaaggacuucacuggaugagcaaaauccagaggccuuuaaaauguccacauuuuaaaaacuaagcuuguguaagaauagguaauuaugauaaaaacuugaaugaaaagguaccccuauuauucaagggcacuggaguacacugauagcaucuugaugauauaaaggcauuaaauuuuuagcuauuaaagacaccauuuucuuagcaccauuucuuagaacauccaaacaaauucaguguuuuccugcuauucauguuuccuguagcuauuuugauaaauaaaaguuaagauuacaguaaaaacugcauuucaaaaagccauaauuccaguauuucaguacaucauauauucagcaccagaugguauuuuaagauuccugucacuguaauacuacaguacuuguuugauuuguguuccaugacuaugcaaacuugauauuauuaaaaguggucacagauguguagaguuguaagcgggggggggggaucacauuuacauaucaucucguccaauaauagaaccaguguuuaaaaauguaaauugcggaacacuuucuuccccaccuucuuuuugcauagaaugcuuuggucuuuuccuagaugccaucugugaccacuugggagccagugaaaauuaagugcuaugguaagauaaccucuuuuguugcuggugagcugagguuuuucccaccacauuugucaugaauacugugaccuuuccccacugcccacgucaugagaacuauacuacugacagguugguuguggucuuuucaagugagguaaccaacaaaagggggugauaucauauauaucuguuguaaggcccugugacccgagugaaggcauauggagauguaguuacuguggagucuguggucacggacaugguccuuucggcaagagacuugaugaaacgcagguaagugggcucugaaguuucauguggcucagcaggcucccguuucacuuuuuugccaugggauuucugaggcacauagucugggccauacuuuucacacucuuccucuuucucacgggcuuuuucagccauuuuggcuucccaaagagccaagccauguuuuggcucauucaugcucuuaugcugguaaaagacgagggagauccugguggggugauuccuauugggauucuuuaaagggguuguggcaugcagcucacgcuuugcacacucaaugagaauugacccaugaguuggagccacggccacucccccaaugucaggauccagaaagcucugcucgcugucugaccagaccucaucguuguccucugcaccagaagccacacccuggacuagugccaauggcugcuuuuccugaccauuagcaucacuuaauuuguguaagccuccuuggacacaagcaguucuaucaugguuaagagcuggaagcaucuuugauaacccauuagcugugugggaaagcaugucauucuccuuguuuuggagaugcagggcaugaagagagcuguugaacaugcccggagcugcacuguaguuauggauuaugugagaaggugaaugauguucaccauuuuuauaguccauguuuggauugcucagauugggugguaaucuagagguggcucccaugaaguggccauccaucucaugagugggauaaggaggcaauuucccuacaugauguacauuuggucuaaugguacaacugcugaaaccaucucccugcauauuuugguuuccauaaccuaaguauuuagauguaaaacucuggcuauuuccaaaccuuggcugguaaaguguauggaugggugguagacugagcuuagacagagggucuuggcuuggauaccuauacagauccaucggcugagacuggggagaauaggaacccagauauggggagcaguuguccacugauagguuuccauugcauugauaugauggauauuggguauucugauucaaaagcccaggguaaggguucaugggauuagaagaauucaaauaugaaccugcagcuugagaugagguggaauagaaguucauagggcuggugcuuccauagauaucugaagugugugaagaguuuggauaaggacuaacuggauugggccgucucauguauggauugguggauccagaagcagaauaagaguugacagacucugucugagggugauguggcugcugcugcuggggucucugcugcugcuggggcugugguggcugcuucuguagaggcuggggcugcugggacugcugcaugacugguccugaaagucgcaaaaguucuguggacaggguaagagagaacagaaacagguaucuuugauguugaugauuauuuuaugaaggcuagugaggauacuuaaauguagguaagaaacuccacuagugauauacgacacccauuaagcaaagauaagagcaaagucaggguucugaucauuguccagcacaauuuuuugucuaaggcauuagaaauacaaaacuuagugaaaaaaaaaauguaauaaacauccaaagccauuccauugagagcaaaauguucuuuggaacuucugaacaugccucugcuugaagugccucccuuuuccucccucucucccuauccuuccuugguguagucaucccuuccucaagggaccgcuuugaccucaucuucuagugcuuuuguaauacucaacugcaaagauagaucugauaaagcaauacucacaauguauuauaguuauguuuuuagcccucucuucacccccacugguaaguaaauuccuaaaugggaaggaaaauguuuuauuuuacuuacuucuucauugccuggcaugcaauggaauuugcuaaauaauuaaaauaagauuuauuauguaagauucgggaauguugugaaaaaaaagaaugacacguauuuaaacacaaaaagcaucuuauauaaucaacaagugcuacuuuauaagcaggcuuuccagaaaggaaguuaacacaguuguagauaacacuuuaaagaaacuuucagcuuuguaaaugaaacuuuuaaaagucauacuucuguuuugaccucacuuuaaaaagucauaugaguuaagaacaaauagaugaaacugcaauggcaguucugagaacagaagggauuauuaccugcagaagccaguuaaaagggagcagagacaagguucuaucuaauuauauuucacagcuaaccuaagugaacaguauuuacuuaguguuaagucaaccagucaauaaacacuuaucaagcaucuuuagcauauucuaaauuauuuaacuuaguuccucugagcuuggaaaugaaucaguagagaaauuugacuucaugaagcagcaaagauggcuaguuuuaagcaaacugguuugcuuuuguuaauggccaggccaauaccaucccaaauuuuggauuuuuuuucuuuuuacaaacugcagacauaaagcaggaggcuauggaaagacaauaacuuaguauucaugaauaauguucuauuguuauuacuacagcuguaaucuauuuugauggguaaaaguuuuguagcauaaucuacauguagaaccccuccuaaaccacagacucaacaugucuaaggaaaaauguuucauucuccccucucucucucucaaucauauuuucaaacuuacuuauuucaauaaauaguacuguuuuagaaaccuaaaacaguagguuaaguuuagguuuaaaacuuuggggucaucuuuaaacuuuucuucucuuucauuccaguguuuugucaccaauguauuuucuuuuucccauuuuggaagagcucauuugcaucauuuugcuauaucuuugcuacuaaccaacaaaauucaaggucuuguuaccucaguucugguuuacuguguuuaucuccaaacuauuagcuccucuacuaauuuggccuacugccaaauuacaaugaauuucaucguaucacuuaccuguuaaaaaaaguugcuguuuauuauagaauaaaauccagacuuuuccauguuuuccauguugauggugcaauaucucauuaccaucucugagaacaaagccuggcccuugcuacuuuagagaagacucuggcacagaacuaagaccaugauugauauaacuuuccaaaauuaacaauguucauuuuacaauaagagcacauggacacauggugggggaguggggacaacacacacuggcgccuauugguaggggugcaucaggaagaugcugggcuuaauaccuagguaauggguugaucugugcagcaaaucaccauggcacauguuuaccuguauaacaaaccugcacauccugcauguguaccccagaacuuacaaguugaugggggcaaaaccaaaauaauuuucauuuuuaauauaccacacaacacauuuaucuacaaaugcuuuacauuaaauuuaccugccaacuguuuagccuggcuugcguuuucaguuuguuuuguacgugauggggcugacuuuuccuuuucauuuuuauuugagcuguucuccagggaggaaagcuuuucagcugcagcuuucuuggcuucuaguuuccuuugucggcaagucuugacuggcucugcuaacauccugacuuuucgccgaaaagaacucaguaccugaauggcaccacuccguuuuuucuccuccugagcuuccacacucccaaacucauccacgucagagacuuuguauaaaggcagaacgugaagcugcucauccucagguuuuccuccaaauucucgauugucuucucuagugagagugcauaccugguagggaaguaagacauuacagccucaacuacaggucccaaagaaaacguguguguguguguguaucuuucuccucucaguauucagauuuguguugguggccuaguugauccagaucagugacauauauauuaccauaaaaccauccuaccuguuauuaaugaaaauagcaacaaaaugguacagggagauaagacaaauugacauugcccacccacccuuucucugagucuaucaggaacaguuagcuguggugacccuuguucuucacauauguuucugucuaugggaagaagcaacacucccccaaaaugaagcacucucuugcuuuucacacuucaaaaauagaugugcuagaugugaagccucuucaaaaacaggcuaaaaguuuuuucuacgaaaugacuuccucuguuuuugguaguaucacauuugccucaucucauacuucugaacacaaauuucaugucuuuucacauaccugacaccuaacucucucuguuuaagaaauuuccauaagauaacugaaguaaaaauauaaaaaaugaaaagguaaagauuuggcugauacagguaauaugcaacuuaauacuauuuucacucucuugucucuccuccuuuguacucugucaaaccuaacuuucucuuuucuucauuucuuuucugaaauaugaccauauaaguggguacucugaaaaggguaagggguggagggaggaaagcuaccucuguugcuuugauaauuaaaugguacuuuuugcuuuaguuacuacaauuacacuagcuuugguaaaagauuauuugugguuuuuaaauacuaacuuuuuaguauuuaguguuuuugaucaauggagacaaugugaucuaaugugaucuaaaauaaaauuagaagauauucuugagagaaaugugaucacaauggacugacuuuagaaauaacuucaacaugagaugguauuaaugagccugucacuuucugcacagaagucuucaaauucaugucucugagcaccuuguuacuuuucccauacauauuuaacccuauucaguucuuaucuagugcuccuuuccauuuuacuucacagaacccaugcucuaucagaggcaaauucuucuugauucuaaacauccuucucaucaucuuacucucugucaccuuccuggaaugaaacaugguuauauuaggaugcacuauagccccaguuaucauuuacuacuucugcuuuucagaaacuagcauagccuccuaauaaugagcaggugcugaguacaugauuagugaugauuuuagauguuggggugguugguaggccuuguguuuguucuucuggaucagaaguuaggaaaccagaaccuacggcuaaugugccucacagcuuguguuuguauggccaguaaacuaagaaugguuuuuacauuuucaaggaguuuuuaaaaaacaaaauaaacaaaaaaaccccaccaaacaaugugacagaaauccuauguggccugcagucccuaaaauauuuaccaucuugcccuuuauagagaagaguuuuccaaucucugaucuagaacauuaaauuaauaucuucucugcuucucaacaaaaacuucacaccagcuucuucaaauuacuucagcuaucaucuaauaccuccaugaaugcuuuucugcccuagaauaugacuuuaauuccugauaucuguuuccauauucucacugaccaucuucuucaacuacaccuacauccauguugauaauucauuagguugauugauucauaguuuuuucaacagaauauuuuguucuuuaucucuacucugggucaccccuuuacaugcaaaauuauacccugaacccuuuguugguauagaacauauauauauauauauauauauauaacauguaucuauuuuccccucaccacugccuccaauuacaagaccgauccauuuuacccacuguaauauguagucaggcucuuuugcacugugaaucuuuuacaauagguuaccacaguuacugugacaaugaugauguguuucucauuuaugcuucucucucuguaaggugaauaugcuucucucucuguaaggugaauggcuuguauuuggcuuuuugcuuaacugauuacaaucuaccagguaacuggcacugaauuuugagauuuuccuggaaguuaacuguaacuggcaaugcauagucacugguuuagauuaacaccaaggauuuccaugauucucaugugcuugucaacacaauugacaggaaacuaaugugccaaccuaucaugagagugcuaguuaugccaaagcaggucacuuugcaacaggaauucauucaugaaaauauugcuguccagugaaaccugcagacaacauauuacucuaaccgaaugcuacuaaauuccaguguucugcuccucaacaugagaugcugcugauauggucuggcugugucccuaccuaaaucucaucuugaauuguagcucccaaaauucccauguguuuugggaaggacccagugggagguaauugaaucaugggggcagaucuuucccaugcuguucucaggagaguaagucucaugagaucugaugauuuuauaaaggggaguuccccugcacauguucucuugccugccgccauguaagaugugacuuugcuccucauuugccuucagcuaugauugugaggccuccacagccauguggaacugugagucaauuaaaucucuuuccuuuauaaauuacccagucuugcauaugucuuuauuagcagugugagaacagacucaacagcugcuaagcuguccucagcccaacuuaccaaugugcugccauucugcauguugugcaagucucugugggcaugagcacagaaguccaaacaugcagugaccccugagaauggacggccuuccuucagacccagacggcacucuggugcucuguguucauauucaaucugaaaaauaaaagugugugugaaugcgaaaguaguuaguuuuacucuuacaccgaaaacucacuaguauuuagaccauuuagaacuuuaaaaaaauguuuugaacuuaaauauauauccagaaacaaaauggaaugacacaaaauagagcaaauaucuugacaugguaaaauuuuuauuuuauaguguuauugaggccauaaaguaugcuauuugaguuuugauauauauuugucacaaccaaaauaaaguacauauucauuacucuuaaaaauuuccucaugccccuguauaauucaugcuuccugcuuuguucucagacaacuacuaaucuaucacuacagauuuucauuuucuagaauuucauauaaauggauuuauuuggaguuaauuuuuauaaauggugugaaauuaagggucaagauuaccuuuuuucccuuauggcuuuccaacuguucagauacuacuggauaaaaugguuaucccuucccaauugaaucaucuuuguuaaaaaucaauugaccauauuauauauguugggucuacuuaaggauucucuauucugauccacuuguguauaaugguguguauguagguaugucaauaucaaacuuuuuaaaaauuuuauuuauuuauugagacagagucccacucugucacccaggcuggagugcaguggcacgaucugggcucacugcaaccucugccuccuggauucaagcgauucucaggccucaaccucccaagcagcugggacuauaagcacgcgccaccaugccccaguaauuuuuuguauuuuuauuagagauagaguuuugccauguuggccaggcuggucucaaaacuccuggccucaagugauccacccaccucggccuccgaaagugcuggaauuacaggcgugagccacugcgccugggcaauaucaaacugucuugacagacaguagcaauuauagauuucaguaaaucugaaaaccaugcaauauauagucucaaauucugcccuuauuuuaaaauauuauuugacuauuccaaguccuuugcauuuccaaguauauauauuuuacagccaucuuguccaauucuuucaaaaaaccugcugggguuuugaaacaucauguauugaacauauugauuaguuuggggagaacugacaucuuaauaauauuuagucuuuugauccauuaacauaguguaucucuccaguuacugaaguuuucuauaauuuaucucagcaauguuuuaguuuccaguauauaaucuuauacauuuuugucaaauguaugucuaagaauuuuauauuuugaugcuauuuuaaugguuuauuuugauuuauuuauugcuaguauauaaaaauacacuugaauuuuguauuucacaacuuugcuaaauucauauauuaauuucauuuucugguagauuuuuugagacuucuuauguagacaaacaugucaucugcaaauaaguacaguuuuauuuuuuccuacccaaucuugacugcuuuauuuauugccuuacugcacuuucuaaaauuuacaguuugauguugaauagaagcaguugguuaaaaauggacauuguugucuuguuccuuaucuuaggggucaaguauuagucuuucaccacuaaguauagcauuagcuuuuggcuuuccauuuauguauuuaauagguugagaaaguuuccuuuuaugaauguugaauauuaucaaaugguuuuucuguaccuacugcaauaaucauauuuuuuccuguuaugucuuuucaacaucauuuuuuauguuaaaaauaucuuuuuaauuuauuuguaucuuuauauuuaaagugguuuucuugguuuuugcuuuuuuuucaauaucacaagcucugccuuauaauuagggguguuaaaaccauuuacauuuaaugugguuguugauacaguuggguuuaaauaaaccaucuugcuauuuguuuuauuuuuauauuuaucuuuuuuugguccuauauauuuuuaaaaacauuuuuggauugauuucauuuuucugucuuuacuggcugauuagcuauauacuuuuuuuuuuuuuuuuagugguuuaagguacacaguguacucuaacgucucacaguuuacagccaaguaauauacccaguccacauaucguauaaguacuuuacaauaauauacuuucaauuccucagccucugugcuacuucuacguguuauaaaccucauaauacauuguuaauauauuuuuaagauagcaaguuaucauuuuuuuaaaagucuuuuaaccauguuuacuauuuuugauacuguucauuucauuauguugaucuggauuucugucugguaucauguucuuucuuccugaaggauuucguuuaacauuuuuaaagugcuaguuuguugguggugaauucuuucagcuuuuguauguaugucugaaaaaauauucuuuauuuugcugucuuuuuugagaguuguuuucauugguuauauauuucuggguggagagucuuuuuucuuuuaguauguuaaagauguuucucuuacaucuucucucuugccuuuuucugaaugaagucuccugucuuauuuuuucccaccuaguguaauauguccuuuuuucuccauuugccuuucugaguuucucuuuaucacagauuguaagcaaguugauuauaaauuuuugauagucuuuuuuuaugucuuuguuuuuuaaucugggguuugcugagcugcugagaucuguggguucacaguuuugaacaaaucugaaaaaaauuuggccauuguuucuuuaaauauuuuucugucucccaccuccuucugguacuccaauuacacauauauuaguguaacaauauuggcuaauaggucuuuuauauauucauuuuuuucaguuuuuucuuuauacugaaaaauuucuauuacuaugucuucaaguuccuuaaucuguuaauuccgccuaguguauuuuuaaucuagauauauauuuuucacuucuagaaggucauuguaggguauuuuaauaucuucugaucuuuccuuaucacucucaugcuuuccucuggcauuuuaacauaugaaauaugauagccauuuuaaugaacuuauuuacauauuguaucacauaugucaguucugggacuauuuuuauugauugauuucugccuguuccccaguaaagguuauauuuucuuuuuucuuuguaugccuuguauuuucugauggaaugcuagacuauaaauuuuaccuuguugguagauuuuuuuuuuaauuuuuguacugugaugcaguuaaauuacuuagaaucaguuuggcccuucuauguuuucauuuuaagcauuuuuagaugaggucagaacugccaaauuuacuucuacuaccaaggcaauacaauuaugaauaguauuaugaagucuucuccgucuggcugguaugaucaagaacuauuccagguccugugugagaucaagggauuauucugccugcuucuucugaugguucuuucccuaccuagccuuggcaguuuuuucacaugcaugugcuguuuaauacucagcugaagacuggaucagaacccucugcaggucucuggagcuuuucucaauaacacucucuccucucugauauucugaauagugaacucucgucaccuuggccucuccaaauuuugaacuuugucuccuuaauacagagauaaggcuggguguguuuggguuccuacuggcuacacuggagccuaauacucucuucaggaaguaaacugggguauuuauagguucaccuuuuuacuuccuuucucucuggugccacugucucuugaauuucuuauucuaugucuaaaaaccauuguuucauauauuuugucaguuuuuucuuaaauguguaacggcauauguagucucuguuuacuccaucauggcuagaagaugaacuugcauuaggauaaaaguuugugguggcuucauauuauuuacuguuggauucauauauguauuugucuaucuaaccucauaaaacuuuggccaaaggaaaaugaagguaccaacuacucuuuaacauagaugugugcuuuguggccguucaguucaugcuguggucuaguuagcuuuauucuguuucuugaacaaaaacagauauacaaucagcuagaaauuacacuuaugccaucuccuaaaaaauaccaugcaggauuuugugaaugaauuacuggaaauccaucuaaaugucuggaagacaauucuaaaugcauaacuuucucauggucuaagguugugcuguucacuaugguaaccauuauccacauguggcuguuuguguuaauuuuuacauuaauuuaaacucaauuacacuagccacguaucaacuguuaaauaauaaccacauguggcuagugccuauuacacugaacagcauaaauagagaauauuuccaucuucauagaaagcucucuuagaagcauuugucuaaaaugucaucuucauguaugauaaauagcacacgauuuugagauugacaccugcuauuucaggucuacuguuaaauuguaaggcaggcauagaaaagacagagccaaauauaugucuacuggauagacacgaagaaaggacauuuaaguugagaaaacugaagcucuaauuccaugggacugacagaagagaugcuguggagagccaacuaaacuuuagcaauaagacuucaugaaaucaaggaauaaagcaaggaagaauauucagaugugagaaauagagauacgacacucaguuggggaaaggagguaaagaucaaauaguagguuuuaugacagcaucuauaacaucaaauggucuucccguguacuguguggaaacaucacauggcuauuauuuugaucucuaaagcauauuaacauacauggaugaauauuaccaauaguaccuaccaugcaauauaaaaauauuuuauccauucagaagcaucucauccauuuacaacuauuaauugacuuaauuuaucuagacauuacaucaacacauuuucauauauaaauauuaaaacuugaacauauuugauggcuucauauuuuggguacuuaaguuuuaggaaauguauaaaauaguuucaaguaugagacgguccauaauaagaaucaagggagcaaaaagaacaucaaugcuuuguuauucugccucaaguaaagccauuugauuaacagcaccuauuaaaaauucauuuaauagaaaaugacccaacuuuaaaucuagcaacauagacucauucauuuauuuauuuuuauagcuugauuuauuucagaaguucuugcugagaauuaaacuuuuacgacaguaucaaagcacuccuuauacuuugugauacuagcuaaacaaaauaacaguauuaauccaacuauuaauaguguuuaaaaacuuuucauagauauucauacacauuucuaaaaacauaauuugacauaaaauaacuuacaaauagaccaucguuuaauuugccucuauuguucgaaccaaaaaaaaaaaaaaauguuugggacguuaaaguccacaguggaaaagaagaguagcuaaaucauuuuaggauuagucccuuguccaugucugcuguguaaacuaaucuaaucccacgagagucuuuaauauuaucaaguaaaugacagagcacccaucccagagccccauaccuauugcuccuguauacucugcucugggugucuucucaucauuccagcuuuccuccauccauccaucucccucuuucacuuuuccuacuacauuucuucuacucccucccccaguucuuacuucauuggcuucucuuccuccacucaugccuaaaaugauugauggcuccagaaucccaucaucagcccuuuguccucuuuauaaucucuacuuugaaaaccuccuuucauuccuauguauucaacuuuaaguccugccagcauucugacucucaaaucuacagugcuagccugaauuuuucuccugauucuccaucuaauuaaccuagaagccuagcauguccaaaauuuugauaucuucuccccaucccaaaacuuacuauuucuuaccaauuucugauacuaguuaauagaacuaccuguccaaacuggaaauuuguuguaucuccaaauucuuuucucauccauacaucuagucaccaaguucucuaagcuccaccuuaguuaguguacauacuuaauuccugccauuucuuuagguccuuaaaaucucuugcccaaugauugcaauagcuuucuucucucucuaaucuuacauagauuuaaguuauauuucccuuacuuggcuuuuaaguaaauuuuucaaaauacgaauuacaucacuuuacccuuccauccccaacacacacuugaaacagcccaaugguuaccuacagaauaaaguucaaagaucuuuauuuagcgucuaaggcugcuugugacaucuagucuacuuuuggguuuuguuuuuaaauuuuuuuagaaaugugcacauucuucuauuccagcuggaacuguguaauucuaaaauugcuauuuauuuuauaugucucugucuccacuaaagaaggaauucuuuuguuuuuugcuuuuuuuuuagaaucugggucaucuuugucacccaggauggagcacagugaugcaaucauggcucaccgcagccucagacuccuggucuccuggguagcugggauuacaggcauaaacuaccgcacccaguuaaagaugaauuuuuuuuuuuuuuugagauggaguuucgcucuuguugccuaggcuggagugcaaugguuugacuucggcucacugcaaccuccaccucccagguucaagcuauucuccugccuuagccuuccgaguagcugggauuacaggugccugccaccacacccagcuaauuuuguauuuuuaguagagacaggguuucuccauguugaucaggcuggucuagaacuccugaccucaggugauccaccugccuuggccucccaaaguguugggauuaaaggugugagccaccguacccagcaaagacggaauucuuaaagacagacagagauggcacugcucaccuuuauguucccagugacuaaacacaguguuuaguuuguaauagacuuucacuuaaugcuuuuguuguugauguuacugaaacagugaagauuuuaguuuuuugccuucaugaugagagauuucugaccaaaucaucuaccugucuuaacuagcuauaguuuagaauacacauguaaaauagaaaaaaaaaauguuuuugcuugguguaugaagucaaggucaaacaaaaaaggaagaucagcaaaaucugacacaucuggaccgaaauauauauacuuacaauguuaguauaugcauagcuuuaugugaauauuuguaagucuauaaauucuuaugaauacucauuuauacuuauagacuugcaguaaaaauagguaguuagaaccuauagcuugggccacauaauuuugauguaaucuccauagucuguuuacagaaacaaaauuauucauaugagaacaagauuaguagauagaacagccugugacuuuuagaagcgcaugucuuuacagcuaaaagacaaaaaaaauguacuuuuguaugguauaauuuuuauauacucgaaacugaacacugcagugguuucaacaauuaagaggaaaaguuagaauaauauuuaaaaaucauuguuucaaaaauauuuuuggacauaggucauuaguaacaaguaaguuguuacaauugcugccaaugauuauuuaaacuuaccugauuauuauaugcaucaggugcaaguuucuuauauguuggugccauaagaguggacagguuuugcaaaugagacuccaguuucucuuccuguauaaagugaauaauucuacauauuaaauucuaaguccauuuucucuauguaaaagagacuaucaguuagauuauuccccuuacauuuugaaucccaaacacaauauauggugccuuuauuacuaaauaaagcaucuuuaaaacaugacuaucauuuaauuucauaugugcuaguaaauaucuagcuauuuguuuuuuucauaagauugauuuucuaacugcaugcagauauuuugcauuuuauacacacaagccugugccaggaguaggguuaggggaauuaagccguauggucuuaaagaggucacauuuuuuagcuaccaaggaagaugaacuauuaaaagaacuucuuuagcuuaauuugucuauuucuaaucuuuacauuuuauguuuauaaagauaguauuuaaauaauuuggaaugaucucuccauagagcaacuaaaauuuacuggacacuucaaauauggauaaaaugcuucagaacuagaaugcaggauacaugaaaaccuuugcagaauuuacuugaaaggggaaaugcucaguuacacccccaccugcccugcucaugaagaacagauuuuccaaguaauauacuguuaaaaaaugguaggugaucauauuuagcugcuccauuuauacuuagaagucuucauuucagauugauauuucucuaaaaaaaaaaaguugugagacauaaccaccuggcagagauguaaauuuuagaaggugaggagguuucugaacagagcucuccuacccaacagaggcaauaaguuacuugguauccucuggauuugguuuacaugaaaccucgugaaagugauaaacauuuaucacuugauaaaacagugguuaaaaaaaaaguuaucuguagaaaauuaaaaugacagcaagcaaaaucaguacuuuucauuaaguuauuaauauucauauucuugucuuaugaaaugaugucucgcacauuuaaguaaacuuuaauuauugaaaacauccuuuaaaaaacuuauacugugauuucaggaguuuuugcacuugcuuuauuaacugugacuauaauaguaagugaaagcuuaauaagguuaacaaauucuucauuuaaagggacucaucaauguuauaauaucuauaguauggaaauauuuuaauuguauucgaaauucaaaagauaauuguaaguguauagaaugacugaaaauguggucauagcuaaaugcuaaauauacugagguuuucucaucauucaauuaguacggagacagucccugaccuauaauggcuucguuuuuuuuuuacuuuaggauggguuuauuggggguauuaaauggauuuucauuuuacaacggauuuauaggaauguagucuccucauaagucaagaaguaucuauacucuagacuacaugccacccaaaaguuguuaaauuuaucaauuugcaaauuauaagaaauacguauucuacagacaagacaaaaaccaaugacuucagugagaaauuaguguccauuuauuuccauuacagaguuauauuaaaaucuaaauguuuuaguuacuuaaaugcauucauuacagugacuuuauuaaaugcauucauuacagugacuuuaaauuauuugaaucucauugcacauaaaugugacuaaaaauggucuuuucugaauguaguacuuauguaacuuccauaauucagagucaaaauaugaaaaacaucaccaauucucauuuaguuuuaacaaugaagugacaccccuuuaaaacuuuggaauuaacauaaaagaccaaagaggaaguuuuuguugcucaaauuuuaucuauuauuuuggcauaauaugauuauuaugccaacuuaaaaaauaguguguaucuacaguuugggaaaaacuuugauuaauaagagcuuaccaagauaugucauauuguucacuucaucuaagcuaaugaauucucuaugaaaaauaaagcgauuauacaucaggaaguaaacaaaccucuuuugggucauccccaagcagcuuaaacuuccuugggaucuugcuucuggcaaacuuacauccauuguaguacaugcuccaugaacaaccaaaagagaaggaggcaccacagguuucuggauccagccccugacaggcgcaaguucuccugaaaaaucaaaagaccaaauucauugcuauggauagcauuauauaggcugugcagcugauauuauaggugucuauaugcaaaaugaguuugaaaagaagucuaaucuaacucuguauuaagcuguggcauaaccacacacagaacuauuucaauugacuuuuaaacaauuuuauugcaauguaauacacauacagaaaagugcacauaauuuuacaguuuacaaauggaaaauacccaguuaaguagaacccacacuaagaaacaaaauauuuacuauccccuggaauuuccccucauuuugccuuucagucacucacugucugucucccuaacaguaacuucucuaagaauauaguaguucugccuauuuuuauguuaauaaugcuuucuuuuuuacagauggggucuugcuauguugcucagguugaaccugaacuucugggcucaagugaucuucccgccucagccucccaaauagcuggaacuauaggugugugccaccaucaguagcuuguuuugccuacuuuuauacuugauauauacauagguauauggaauuauauaauauaagcuuauuugugugugcuuuuuccauuauguuugggauauccauccaaaucacugcauguaguuguacuuuauucauuuucauugaguaccauauuccaucuuauaaaaaugugaugaauuauucuaccauugaugggcauuugagugcuagguccuaguuucuggcuaaaauauaguauuacagcuuuauagcccuaguuugauacauucuaaugacaauaaacaaacauacaaguaagcaaagagagauaaaacaacuuacaagaaaaaauauucagguagcacuguaaauuauuuuuaaauuaauguauguauauugugauauaaguaaauaauuguuaauaucaaaaaccaagaauuucaguguacaagagaagcagaacaaaagauaauaauacucugucaacuaugaauaggaaaaaucaguaugaauuaaugauuugaguuaaucucagauuuucuuucuaaaaaauaauuacuucauguauuugcccauuaaaaaagccuaaaaguaaugacaccuccauagcagggagcacaucuagacacugauugugaucucuaaauauaauuucccaucaaaaucucugaaauuugagaaguaaagauucuugccaugcauuuauucuaucauucuuacaaacuauauuaaaugguaacuaacgguugaugaggaaaaguccuguaaaguauuccagcuaauaaaugcaaaaggaauuuuacaauuagaaaugaucacuuuacacaugucagcaaaaauggcagaauaaggaucucugaaaauuuuauccuccauaaaagcaauaaaaguacugauaaauauugucagaaucagcuuuuucagaucuggaaauuagcaaaaagcuugcagcaauauagggagaauuuguucaagggaaaaaaagacaggauuucagugagaagagugagcucugugguauuuuaacuuuccccacagcucuaugguagccuucaaaucaaaacagcccacauuuauuaugaaaagcagcagccaggcugccacuagaggaggccagauugguuggauauacucuagacugguuggauauacucuaaagucccauucacagagaccuuacauuauuugaccuguuugguaguuuccuggaagaucccacuaguaagguuaucuuuacuuuaucuaacuuggaguucaccuagugugaaccaccuuuuccacagaggcauuugucaaauaaucauaggcagcuguugaauauugucacugacucagguguagcuaauaacuggagcaaaacauaagauaacuaaaaaagcuuaaaaguaaauuaccugggaaaugagaugauccacaggaggcuuugaaaauauauuccugggaauuuagaaagccacaugcaacuguagggcccacaaaagaccucagaaagcccuaaacucucaccacagucuaaccuugagacucugcacaagcagggaauaaaggcuaauccagagcugcaaauagccuggcugaguguugaaugcaugccccaacacacauacagaccccuuugucaaagacugacuuauugaucucaggcaccuaaggaauucugucuaauccuuagcugaccucuaaguuaaccaagcaaagacuucgauggcuaucuaugagaaacaauacaaacuuuauaggaguaguuaaaaagaaauaaacaacaaccaccagaaacaguaacauauucugggcaggggguagaaucugauuuucagauuuaccagauuauauuauuuuauuuauuuuuauuuuuguagagacagggucucacuaugcugcccaggcuagucuugaacuccugggcuuaagugaugcuccugcuuuggccucucaacgugcugggauuacaggcacgagccacugcucucagccauuacauuaguuuaaaaugucuaaacaauuaagagaaacagaaacaaaguauggccccuauaaaguagucaauagaggcuauuccugaaaaaguccagauguuaggccacuggacaaagacuuuaagucagcuauuucauguaugcccaaauaaugaaagaaaacuguauuuaaauaacuaaaguaagacuacagcauuuuauuaaauacaugagauaaacucaagaaaaagauauuauuaaauagaauucuaaagcugaaaguguaauaacugcaguaaaaauuagagggguucaauagcagaguugaaaaggaggggaaaaagggacuugaagauaagucaauugagauuauucagucugaaaaaugaaaacauaaacagaaccucagagaucuguggaagaccauaaagcauaccaacauagacauaaugcagguccccaaaguagaggaugaagaauaaagaauaggaagaauauuugaaaaauaauggccgaaaacuucucaaauuugaugaacaacaucaaucuacauguccaagaagcucaacuaacuccauguaacauaaacccaaagauaugcauacauauaaacaucauaaccaaacugcugaaagccaacacaagaaaaucaugaaaacuguaugauuaucauguaugcaggauucccaauaagauuaauagcugaucucugaucagaaacaaugaagaccagaaggcaguagaaugacauagaaccacaagaaaaagacugccaaccaagaauucuguauuuugcaaaacuaucuuucagaaauguauuauauaauaaauuaggacauucucugauaaauaagaguuuauuguuuucaggcauguccuacaaaaaauacuaaauguauacuucaggcugaaaggaaaggacacuagacaguaccucaaauacaccuaagaacuuaaagagcaccaguaaagauaauuacauagguaaauaugaaaucauauauguauuuuuuuguaacuauuuuucucauauuugauuuaaaugacaauaucaaucugauuuaaaagaaaaaacauaaucuguguuaaugggcauaaaauaaaauguaauuuguauaauagcacagaguaaaaagagggaauguagcuauaugggaacaaaguuuccuuauauuguaaugaaauugguauuacuucagacuagcuguuauaaguuaguuguaauccccagggaaaccauuaagaacaucaaaaaauuuaguaaaagacaagggaauuaaaacaguacacuagaaaauaucuauugaacacaaaaaaagacaagauacagacaaaauggcagacaaauccuaccuuaucaauaauuauguuaaauguauauaaauugaaaaauuaaaaggcaaagacuagcaauaucaauuuuuaaaaagauuuaacuauacgauaucuacaagauauacacauuuuauaauaaaaaguucaagccauuaaaaugauguaacaaauguaaacauacauguaauaagcaacagagcaccaaaauacaugaagcaaaaaauggcagaauuaaaggaauaaauagauaauuuacuaauccacuuucaauaauggcuaaaaguagauagaagauuaaaaagaaaacagaaguuguaaaaaacacuauaaaccaacuaggucuaacagacaucuauaaaacaugccacccaccaacagcugaauauacacauucuucucaagcacacgugaaacauucuccaggauggacuguaugucaaguuauaaaacaagucuaaauaaauguaacacugcaaaaauugugcaaaguguguuuucugauaaaauuauacaugaauaacaagcaaauuuggguaauagguaaaaauauacuccuauacagucaggaaucaaaaaaacaugauagaaauuagaaaauaccuuguuguaaaugaaaacucgacauacucauauuuuauuggauggagcuaaagcagagcuagagaacaaacuucuagaaaaacacaaacuacuaaaauugacugaagaagaaauagaaaaucugaauauaccuacaacagguuaaaagauguaaucaagacuacuuagaucugucagagaaaugaggucacagggaaaaucacugcccucacaaccaaggaagcagauggauaaaaagaauuacagcuuacuggagcagaaaccucuguaggaaccaguguugggauaggaaaaucugaaauauaauugaugaauugcuggagguucagugugaacaacuccaaaggcauccagucauaauagguuccucacaguuuugugaguuuucuacauucaggagccagaugagguucucacaaugaauacuagagaaaaaucccuucaugcuuccauaggaggaggggaaaacaauuuuugaaaaugccauauaccauucuauuguuccuaaaaaguucugccaucaggcuaggugugauggcucaugccugcaaucccaucacucuuuggaggcugaggcaggcagauugcuugaguccaggaguucaagaccacacugggcaacauaggaaaacuccaucucuaauaauaauaaaaaaauuagccaggcaugguggcaugugccuguaguccgagcuacuugggaggcugagguggguaaaucacuugagcccaggaagucaaggcugcagugagcugagaucauacuacugcacuccagccugggcaaccagagugagacccugucucaaaaacaaaggauaauaaagaaauauuaugaacaaaugugcccacacauuuaauaaucaaggugaaauggaccaauuccuugaaggacacaacuaccaauauuuaugcaaaauaauaaucuaaauaggccuauaucuaugaaagaaauugaaucagcaauaacuuuucaaaacaaaguaccagacacagaugguucauucugauuucuaccaaaguuuuaaggaagaaauuauaugaauucucuacaaucucaauuaagacagaagcagagaaaauacuucauaacuuauucuaugagggcagcauuaccuuaauaccaacaccaaagucuuuacaauaaaagauaacuacagacuaauagcaaccaugaccaugaaugcauucauaaauaauguaucacaaccaugugggauuugcuccagguaugccagucuaguucaaaauuugaaaaucaauuaauguaauccauuucguuaauaagcuaaagaaaaaucauaugguaauaucaauagguggaaaaaaaguauuuacaaaauccaacacugauuaaugauuuucaaaagccucucaguaaacuaggaaaagaggggaacuaccugaaccugauaaagaauauauacaaaaccauacagcuaacauauuuaauguaaauaaagaauaucuacaaaaccauagagcuaacauaaaauugaagauuuccugcugagaucaggaacaaggcaaguauguugccucucaccaaugccuuucaacaucauacuggaaaugcuagcuaauacauuaagacaagaaaauaaaagguauacagauuagaaagaaguugucuuugcuagaugacaugaucaccuagaaaauaugaaagaaugaccaaaaaaaaaaaaacuggaucuaaagugauuauauaacaugguugcaggaaacaaguuuaauauacaaaaguugaucacuuuucugcauaccagcaauguacaagcagaaucugagauaaaaauacauuaccauuagcacccccccaaaugaaauauuuauguauaaaucuaauauguacauggucuauauggggaaaaugcaaaauucuaaugaaggauauccaagaaagagauguuccauguucauggauaggaagauguguauugucaagauggcaguauuucuaacucaaucuagaaaugcagugcaaucuaucaaaauuccugcaagauuuugaggauacugacaaaguaauuuuaaaguuuauaucaagaggcaaaagaccaauaaaugacuguauauauagccuuuucagacugcuuuuuuuacuuaguaauaggcaaaagaauagccaacucaauacugaaggagaaaaacaaugucagaggacugacacuacaugauugcaagacuuacucuaaagccuaaguuaacaagauagugugguauuggugaaagucuagacaaauauaucaauggaacagaauaaagaguccagaaacagaccacuuaauuauaaucaacugaucuuugacaaaguagcaaagguaauacaauaaagcaaagauagucuuuaagaaaugguacgggaacaacuggacaacuccacaugcaaacaagugaaucuauacauagucuuuauagcuuuugcaaaauuaaugcaaaaugggucacagcccuaaauguaaaaugcagaacuauaaaauuucuggaagauaacacagaacauauagaugaccuugguguugacuuuuuagauacaauaccaaaaacauuauucaugaauuaacugauaaccuagacuucauuaaaauuaaaacuuucuguuuguucugcaaauggcacugucaagugaaugaaaaaauaagacacagacugagaaaaaauauuucuuacucuuacugucaaucaagcuacugugcucuguguuauuuacucaaaggagcugaaaacuuuuguccacacaaaaaccuacauacuuuuauaacagcuuuauucauaauugucaaaacuuggaagcaacuaagaugucuuucacuaugugaauggauaaaucaacugugauaaaccagacaauggaauauuauucaaugcugaaaagaaaugaacgaucaugacaugguggaaaauuuaaaagcuuauuacuaagugacaaaaaccagucugaaaaggcuccauauacuguaucauuccaacuauaugacauucuggaauaggcaaaauuauugagauaaaaagaucauugguugcuaaggguuagugggguaggagagaaaaauagguaggguacagaggacuuuuaaggcagugaaauuacucugaaugauacuguaauggugaaugaguaucauuaaacauggauccagacucacagaauacauaacaccaaaggugaacucuaaacuaugaacuuucaucgacaauugucaaugcagguucauugacugcaacaaauguaccauucugguaaaggauguugauaaugagggaggcuaugcacauacaggggcagcauguacuuaaggaagcucugugccuuucauucaaugugcuuuuacccuaaaauugcuuuaaaaauaaucuauuuuaaaaauguuuaaaaauucccacaaaggaaagcccagggguagagaauuuccucaaacauuuaaaaaagaguuaaaccaauccuuuguaaacucuuccaaaagauagagaagggaacauuucccaaugcauuuugugaacucagaauuacucugacaccaaaaccaaagauaucacaagagaacuaaagaucaguauaccuuaucaacagagaugcgaaaguccucaaugaaauaccugcaaacagacuccagcaauauauaaaaaguaauacacacugaggccaagugggauuuauuccagaaauauaauguuaaucuaauguauaaaaaugaaucaauauaauauaccauauuaauagaauaaaggagaagaacgcaugaucauuucauuagauguagccacagcauuugagaaaaguucaacacccuuucgugauaaaauuauucaacaaacuagcaacagaagggaacuucugaacuugacacagucuuuuuuuaaacaaaaccuacaacuaguaucauacuuaauggugaaaaacuaaaaauuucuuucuaaaaugaauaagacaaggauguuugcaguuguuaauuguaccugacauuuucuggaaguucuaacuggguaaucaggcaagaaaaaaacauaaagccacccagauuggaagugaagaaacaaaacuaucucuacuuguagaugacauaaucuuguaugcagcaaauccuaaggaaucuaccaaaaaaaguuagugcuaauaagcuaguucagcaaguugguaggauaugagaccaauauauaaaaaugaaauuuaugaccauauauuaucaacaaaaaauuugauuuugcaauaggauaaaaaaaauacauagaaaaaauuuuaacagaaguacaggccaggcgugguggcucaugccuguaaucccaguacuuugggaggccaaggcagucaggucacuugaggccagguguuugagaccagccuggccaacauggugaaacccugucuccaccaaaaacacaaaacaauuagccaggcaugguggcgcgcaccuguaguuccagcugaggcaggagaaucacuugaacccggagguggagguugcagugagcugagauggcagcacugcacucuggacugggcagcagagcaagacucugucuuaaaaaaaauaaaaagugcaggacuuuguacauguuucauccaaaacauuacugaaagaaauuuaagaauaaauggaaaaauagccuguguucauaaauuggaagcuuuaauguuaagauaucaauacucuccaaauugaccaacagauucaacagaaccccagucaaagucccagaaggggguuggaugugguggcucaugccuguaaccccagcucucugggaagccuaggagggaggaucucuuuagccaggaguucaaaaccagcuuggguaauauaguaagacuccagcuccaccaaaaaaaaaaaaaaaaaaaaaaaaaaaaaaauccagaaaggaaacggagaagcugaucuuaaaaugcauauggaaacccaagaaacaugguaggcaaaaguacaaaguuggaagacuuaccugucuugauuucaaaauuuacuacaaaacuacaggaaucagcacagugugguacuggcauaagaaaagucaugcagauuaacagaauuaagaguccagaaauaaacccauacaucuuggucaguuaauugaaaaaaaacagucuuuuaacaaauggugcugagaaaacuggacagcuacuugcaaaggaaugaaguuggacucuuaucucucaccaucaaauuaacucaacauuaauuaaaaaucuaaauguaagaacuaaaguuauaauacucugagaagaaagcauagguguaaaucuuucagaucuugaaugaggcaaugauuucuuaaauaugaccccaaaugcacaagcugccaauuaaaaagaaauugaguuucaucaaaaucaauuuaaaacuuuuguacuuuaaggacauuaucaaagugaagcgacaaccugugggauaggagaaaauaucugcaaaccaggcauuugacaaaguucaaguaucaacauaacauauucuuacaacucuaaaaauaauacaauuaaaaacauauaaguagacuuuucucaaaaaaauacauggucaauacacacgugaaaagaugcccaauaucagccauuaggaaaaugcaaaucaaaaucacgagauaaacuucauacccacuuggaugguuacaauuaaaaagacaauaacauuuucuugaggauguggagauacacuggaaccuucauacauuguuggcagaaauguaaaagcauaaagcuacuuuggaaaacaguuuggcaguucuucaaaaaguuaaacauaaaguuaccauauuacuaacaaugucacuccuagguguauaucccaagguaacugaaaacauguucacacaaaaacuuguacaccgauguucauugcagcauaauuuauaaucgccaaaaaguagaaacgauccaaaugucaauuaacuaauaaauggaaaaagaaaauguggcugggcacaguggcucaugcuuguaaucccagcacuuuaggaggcuaagguagaaggaucacuugaggcugaguuugagaccagccuagccaacauggugaaacccugucucuacuaaaaauacaaaaauuagcugggugugguggugcacaacuguaaucccaacuacuugggggcugaggcaugagaaucacuugaacccgggagacagagguugcagugagcugagguugcaccauugcacccuagccugggcaacagagcgagacucugucucaaaaaauguggugugaauauauacguggacaaaaaaaaaaaaaagaaaaagaaaaaagguacuuuuuuuuuuuaauaaaaugaaugagacuugaaaacauugagguacaugaaagaagccagagagaaaggccaaauacaugauuucacuaauacaaaaugcccagaauagguaaauccagagaaacugaauguuuauuugugguugccacuuagaggaaggaagaaggggagaaggggaagugacugccuaauaaauacaggguuuccuucugggaaugaugaaaacguucugaaacuagguagaggugacauuugcauagcuuugugaauguacugaaacaacugaauuguauacuuuaaaaggguaaauuuuaugguaugugaauuauaucucaauuagaaaaaaacaugggggaauaacuuaaaguugauuuucuaauaaaguggcuacuaaaagguauauuuauuuugauaggggucuuucaaauauuguuagaauuagcacaugacagucauuuuaauaugacuugaaauuuggcucaugguaaaugauauaaagggcaaauauuaaaaugucaucuauauaacagauuucugcaaaaauucuuaaccuuugauuuacuauuuggacuucuaauuguaaaauauuuuuaaaguaaaaauuaggucaguuauucaaauguauacagcauagaaaaaauagcaaaauaauuuaacuuuauauaacuaaauuuacacaacaucaagugagagaaaacugucaacuugaaaacaaaauaauagaaacaggcaaugaucaucaauugaugugaaacuaucuggugaaaguuugaugaagaacauaaugauggaucaggcugacaacuaaacaugcuaaacacucuuaauaucacuaaaaugggaaacaaacagacauuaugugucuccugauguauauaaauaagaugauuuuagcacuacuuaugaaguguuuuugccaauguauacuauacaugcacacauacuuauauuacuuaaaaaucagcugggcgugauagcucaugccuguaaucccagcacuuugggaggccaaggugggcggaucacuugaggccaggaguuccagaccagccuggccaacauggcgaaaccccgucucuacuaaaaguacaaaaaucagcaggaugagguggcacaugcuugcagucccaguuacucaggaggcugaggcaugagaauagcuugaaccugggagguggagguugcagugagcugagauugggccacugcacuccagccuaagcgacagagcgagagccugucucaaaaaaaaaaaaaaaaaaaaaaaaagaaaagaaaaagaaccagucaaacuaccaguccacagaagauacuggggauagaggaauagguuaaaguaaacaaaagaaccaagaugaaaucggccaaauccagaauguggggaauuuuacagagaaaaucacaguuucuuuaaaaaacaaauucaaauucauaaagaaaggggaagggcuauuauaaauaaaaagaggcuugugaaucacagaauuuaucuucuaaauggagagaauuuuaugagaggaaguuuuauuuaauagcuaucccagacaauggacaugaacugggaucacacuacucagaagugucaaucauguggaagggcuuucuuuuucucauuaucauuuuuguuuauguguguguuuucugaaauagaaucuaaucagauaauuugaacaaacacagucuaaauauuaaaugauaaagucuuuaccuguuagaaauacauccugaaauguuaacagguaagaugguaaguuaucugucuucugcuuucaaacacuagugggaguggaugugggaaaaauauaugaaaaaauauugauaaaauguugauaaauauugaugcugugugauggguccauggaauucauuauauugcacuuuuccuuuuauguuugacaauuuuuauaauauaaaguuccuugaaauguuuaacaucacccaccauggcagaaggcauuucuggcuuugauuuccuuaugaugacagauacacucccacaacucuuacuugccaaaaaaauacugguuagacuuagucauaaaauggaaaucucaaagggaaaucuuuaaagaagaaacagcugguuuggcucaaaggaaauguaaaaaucaguuuuuacuuuccuacugaaagaugcacucagaguucuuuucugaacucacagugggugguuuggagcauguggacacagggauuuguaagaacucagugaugagguucacacagcuuugaacauaaaacugaguccgcagccccaauuugagauuauucuauucucuguucuuggcaaaaaguuguaauuuucauuucugccagccauaaaauaaaaucuauuuaugggguagaagaaacuucaaaagcuauuucugaguaaagucuguauugacauuggauacgugucuauuuuaaucauguauuuaaguauuaaaauuuuuuauuuuggagaauugcucuaaguaugcauaagcauagcuuaagcauuaucuaaaugauuauucaucuuuaccuugaaacuagacaaaaagcaaaaguguacagcugugcuuuuaaauugucuucauauuugaagcaugucuuuuaauaguuuuguaucugccugacauuuagagcaguuaaacuaacaaacuacaagcuuucugagacucugguccaacuauuuuucaugguuuucaaaugcaaaauaauaaaaguucuucauguaauuuuuuauaugucagauuccauuucaggcauuggcauuuauaagaauuauggaaaagcuggcugggcaugguggccuacaccuguaaucccagcacuuugggaggccaggguggguggguuaccugaagccaggaguucgagaucaaucuggccaacauggugaaacccugucucuacuaaaaauacaaaaaugagccgggugggugccuguaauucuagcuacucgggaggcuguggcaugagaaucacuugaacccgggagguggagguuguggugagcugagaaaaauauuagagaucuauguuaaugaaaauuaaauucauuacaaugaaugaaauauaguuuccaggaaacuucaagaaaaucaaacauuuugcaauaggacuauuuuugaaaagaaauuuuaaaacuaucauuuucacaagagguucuucagugauuuagaaucucaaaccgucaagucuaagagauauuaugcuuuaaagacaaugcaguauuacugaguucuugaaagaaaugcuauuaccaauaugagcacaaguugccuuaauuuuuaauuuuuuuucuaauuaaaggcaccuacauacauuuuuaaaaauuuuucuucagaaagagcaagaggagucaggguagauuaaaaaaauauuucaggcugggcacaguggcucaugccuguaaucccagcacucugggaggccgaggcgggcggaucacccgaggucaggaguuccagaccagccugaucaacauggagaaacccugucucuacuaaaaauacaaaauuagcugggugugguagugcaugccuguaaucccagcuauucgggaggcugaggcaggagaauugcuugaacccaggagauggagguugcagugagccgagaucgcaccauugcacuccagccugggugacagagugaaacucugucuuaaaaaaaaaaaaaaaauuuaugcuuaaaguaguccaucauaaguuuauaaguuacauguuaugaaucagcaauuucuaccuuccaauuaaucauuuguaaaaguggucagguacacaccauaaaauuuuuggaucauaauuaucauagaaagucaagucacacuuucauauagaaagaguaacuuuucuaaagagauuauuuauaauugauuugucuccccacaacccagagagagaaacuguguuaacauaaauuuaguaaaaccaugcuaguuagaguuuuaaacagcaaaggacaaauuuggcuagcuguugcaaugagcaguaugagcauuucuuauaagcucagcaaaugauucuauaguuugguggaugcagagaaaaagacacuaaaggaaauagugcaaaauuaaaauuauuuuaaaaccaaucgugggcaaaauaacuuguaagauuucuggccaggcgcggcggcucaugccuguaaggcacuuugggaggccgaggugggcaaucaccugaggucgggaguucgagaccagccugaccaacauggagaaacccugucucuacuaaaaauacaaaauuagccgggugugguggcacaugccuguaaucccagcuacuagggaggcugaggcaggagaaucucuugaaccugggagguggaggucgcggugaaccaagaucgcgccauugcacuccagccugggcaacaagagcgaaacuccaucucaaaaaaaaaaaaaaaaaaaaaaaaaacauuucuguguagcaccgugaacauucaucuauucuuuuaguguuauacaggauuaucagcacaguagaggaauauuaaaaaugaggcuuuuuccaacugaagguuuagacuucaugcaaaguggaugguguuuaaaacaaaacauuagcaacuggaugcacuaaauauauuuaagugcauacucuugcaguucuauucuaaauucuuauauuccuggaaaauaauauauauccauauccaguaauuugcugaucauuuagcagcaguaaaaguagaagcaguuuugauuacuauuguggaaauaaugaauaguuugaaugaaaguaaaaaucaguucuauuucuacagaacuucuaggcuuuguauuuuguuuuugcuacauacauauggaagguauuugaccugggaaucccaaaguuucucauuagacuuacuuucuguuucagauacugcaacauggaaguggagucaauacauacuaauauaguggccaggcacacaggagccgucacuuguagcaugugagcacauaaacaauuucaaguuuaugguauaacugaggccaugugguuacagacacucugacugcuccuaauuaauggcuaaacuguacaauucagauaaugaaaucaucucaaguuauucacauuagcaaauacaacuucuuaucgcaugacugccaaacaggcauuuugaugcccauuuuauaaauguaaaagugcacgcugaacucucuuccuuucaaccaaagauugggcuuuccuaucaguggccgcaaagaggggagaggcccugggcuucacuuacucuucauucaaggcacaccggcgauuggugagcgugccguauuuccucagcgucucgguaagcuccgaguagaguuugucagccagagacagcgggauuccuucccacaccaggaugagaaucacaaucacugcagccucacagguguggccagcucgcucccgcaccaaacacaguagcuucucuucacugcugcuucugcgaaccaccugcguggaucaccauuccaucccaaacaccccccaccccaaccaaaacaaaacaagggucacuugcagcagauaagggcacuuauguauguauauuuuaucauguuuagaucacaauuagggcaacauuuaucagcauguccaaugugccuuuugcugcccaucuauaaaaagugggcuuugacccuaguaucagaacaaggagagaugcaaaacuacuccuuaauguuuagcagacuauacccaguacaguggggacaauuaaaugcuaccugcauuaaaaccagagcuagaugaaagauacauaagucuuaguucaagguuuucauaaaugacaauauaaagauuaacugaagguauuuaaaaguuuaaggacaacuucacauucuaagaaggauuauacauuuagcaggcacuagaauggaccucuuccucaucacuaaauuauuucaauuaaauacaauuuguugauuuuagaacuaaucugccucuucuuaagagauaacacaugauaaaaaauacagguaauguucuuuuuaacuggcaugagucuuugaucuggguaacccaauucucagggucagauuuacaaaucaaaaugcccaagauuuaagaccaaaggcuuuaucaagucacacuuacccacuuagcaauaggacaucccugagaacuuuugccuucuuuaccaguauagaugacucuuucaauccuaauagcuuuacccuucuguccaaaccuuaaagaaacccacagaaacacacacacauacaauuagcaaaugaauucaagaggcaaucaaaauauuugaacauuugagcauaacuuuauucuaugaccacauccugagaaaugaacgguuuauuauuuuuuaaacaggucuacgccaagcaaacuggauaaugguuuuuaagccuuguuuuuccucaauaucaaaauguacagauaauuguaaugaacuauuuuguaaauuacaugugggugaaaaugggaaagcucauuucgauauaaaauuucacaaagcacaaaauucagguuaguuugcuaaguucagucuucuaaaacauaaacuauuuuuucccuuacuaaauuuagcuauuuuaaaacuuggggagucauaauagauuuuaguuagaacuguuccuccaagaaugucucacaauuuagaaaaggaggcuggcaaauaguuaguauccagccacauggaaaauauggaauaguccuagaaauagacuauaucuucccuuaugaccaaagcaccaccuacugcuuguuuaaaaaacaaaacaaaaaaacaacaaaaaaaaggcacuuagggaaauucacuauuucugccaggccacuagaugauuauuuagugaacuucuacaugcuaauuuagaaaugaauaauuuggaaauggagcaagaaugauacugaauauguccuagcugccccaauguauccuaaguacuuuaauaauaauacugccuaccucuuaaugaaaaggcacccuagaagaagaacagcucagagcuguauaaauuuauaugaaaggccuucucugcauuaucucgcucauaagagucuucuacaugcaggaguaaaggcaaguacuuguauaccugugauugauagcgaaaaaaaaaaaaaaaggcagcuguaaauaguauguuucucuuucuauucaacauaucacacuugcucucuuuuuaugguaaaagaaaacuuagagauaaguacucauuugcaacacuaggugaauuuaauucagugguucuuuucuuauaccacacuuuaccagucuuucugcuuugacacuuuauuaucaggugggaaagccagagugggaccucucguuggagccugugccaguaccuuguggcuggcagccuggcuggccgauuccuguucaugccuggguuuucuggcauccaucgcaaagugggcagccugugccagcuagcagacuauuaguccugucaaauauugugacucucuggugaauagcacaguguguaguguuggcaacccuagaauagcuaagccuacuaauaauuacucaauuuacaauuguuuacugcuuugugugugaaggcuggaaaaauucugacauauacaaaaggauaaacguuaaucugcccugugccuuugcguuaauuaccuuucuuccaugauuucucuaauagcugccacauuaggaccugcuccuagauggguauaaaaaggaccuucaucuuuuucaauaauuugcucuguugagauaauagaagauuauuauuuuagaccucaauuauacuaaauauaaaggcuacauccacaaagcuuaacccccaacuacacauuaagggcucuaaaagugacuuuaaaauuuuuuuuucuuuaaaaugaguagauugauggacugaucuauuagaaaaugugccacauaauuaaguauauguacaugcugguuguuggauaaaaauauauuacauuucagauaugggauaaaaaauuauuuuaaaccaaauaaaugaaacuaaacaaagaauacagugagggaauuagaauguauuauauguaguaucaacuacaauccaauuuuuugagcuggaaaaaaaaaacauuuaaagcuaacuggaagccuaccuauuacuuggauuuuaaaagauuaaaaauaaaauuuccugcucuaucccacccccagaauauugcuugguuuauugucaaggauaccccuuuuucuuccuacuucccuauaacauuuaauugcuguuuugcaaauaagaauagucaauccagacccauauuaguauguacuuuagaacaauuuaugaugagagaaaauccuggagagucaggcaaaaagaaggggcuguugcaaaccaacaaagauggaaaagugggaagauaggggugggugauaagagaagagugaagacgauuacaacuuaccaaauauuaucuaugagaugugugguguuuuagcccagugaggcaacuuaauaaccacacgcaaagagggacaguaggaguccucccuccauccuucuacacagugugggguaucucauugcaagagggaaaacauggcacggguaggucauuagccacacuaauuuaacauuugucuuuucaaaugucuuugacuaaaucuaugcugcauagcuauaauuaagaucuucaucucuauccacguauauaucuacauccaucagcaaaaauauuucacuauuccuacagaccuauuacauauccugaauuuuaacaaaaagcuuuuuuuaaaaauacaggcauaccucguuuuauugugcuuuguucuuuugugagucacaguuacugugacuuuuacaaacugaagguuuguggcaaucccacguguuaaguaugucuaucagugucauuuuuuucaacagcaugugcucacuucaugucucuguaucacauuuugguaauucucacaguauuuuaaaguuuauuauuauuuauguuauggcgaucugugaucagugaucuuugauguuacuauucuaauuuuuggggggugccacaaaccguacccauaaucugguaaauggugcaaacauaaucugauaaauguugugugcauucugccugcucuaucaaccagccguuugggcucucucccucucccugggccucucuauucccuaaaacacaacaauauugaaauuaggccaauuaauaacccuacaguggccucuaaguguucaagugaaaggaagaguuguaugccugccacuuuaaaucaaaagcuagauaugacgagcuaagugaggaaggcaugucaaaagccaagacaggcugaaagcuaggccuugcaugccaguuagccaaguugugaauguaaaggaaaaauucuugaaggaaauuacuccagugaacacaugaaagguaagaaagcaaaacggccuuauugcugauauggagagcgcuuuaguggucuggauagaagaucacgucagccacaacauuccuuaagccaaagcuuaauccagagcaaggccuugacucccuucaguucuaugaagagaaugaggaagcugcagaagagaaguuggaagcuagcagaaguugguuuauaaaguuuaagaagcgcagcugucucuauaacauaaaaggacaaggugaggcagcaagugcugauguagaagcugcagcaaguuaugcagaagaucuagcuaagaucacugaugaagguggcuguacuaaacagccuacuauugaaacaaggugccaucuaagacuuucauagauagaagucaaugccuugcuucaaaggacaggcugacucucuuguuacaggcuaaugcaguugaugauuuuaaguugaagcccauacucauuuaccauucugaaaauuccaaggcccuuaagaauuaugcuaaguguacccugcuuguguagaguaauggaacaacaaagucuggaugauaacacaucuuuuuacaacauaguuuacugaauauuuuaagcccaguguugagacuuacugcuaaaaaacaaaaaaaaaaaacaaaaaacaaaaccaaaaccuccuuucaaaauauuacugcucaaggcaccuagucacccaagagcuccgauggagaugcacaagauuaaugcuguuuucgugccuguuaauacaacauugauucugcagccuauggauuaaggaguacuuuugacuuucaagucuuaucauuuaagaaauauauuguuagucuacagcugccaagauagucuucugauggauccgggcaaaguacauugaaagccuucuggaaagguaucaccauuuagaaguuauuaagaacauucauaauucaugggagggggucaauauaucaacauuaacaggaguuuagaaguugauuccaacccucauggauuacuuugaggaguucaagacuuccguggagaggucacugcagaugagggagauguagcaagagaaccagaauuagaaguagagccugaagauggggcugaguuacugcaaugucaugaaaaaacuugauaagaaguugcuucuuauggaugaacaaagaauguuugagauggaauauacuuccaaugaagaugcuguaaacugcugaaaugacaacaaaggauucagaaaauuacaaaaacuuaguugauaaagcagcagcacaguuugagaggacugaguccaauuuucaaagaaauucugcuguggguuaaaugcuaucaaacagcauugcaugcuacagagaaaucuuuugugaauggaaaaaucaauugauacagcacuucacuguugucuuauuuuaagaaauugccacacacacagccaucccagcaaccuucagcaacuaccaccaugaucaguccacagcgaucaauacugaagcacgacccuccaccagcaaaaagauuagcacucacuaaaggcccagauaauuguuggcauuuuuuuaacaauaaauuauuuuuaaaguauauauuuuuuagacacaaugcuauugcacacuuaguauguuacaguauaguauauaaauaacuuuuacauacagugagaaaccaaaaaguccuuacaacuugcuuuauuguaauauucauuuuauugugguauggagccaaacccacaauaucucugagguaugccuguaucauauuuuuuaaucaaaaagaugaaauuuuagagaaaagggaaucaaaaugaauauaaaucacaacauuccaaauguauaaauggagaaaaggaaacuuuaggagcacuaagagugucagcauuaucauuucccccaacucaugaagacugaagauaauaauuucccuauuagccagaaaucuugugaaacuaauauauuuuaccuugaauuaaaaaauauuuaaaguucguacauuagacugccuauggucguuauuuucucauuuuaauagauuguuuuuuugcugccuagcugucucuccaggagauaauauacaaagagcuaaauaggcgaauugaucuaaaacagauacauucaaauuuuacaggaucugaagagagggaaaaauaaacaugcacgauuauuuaauucuuuuggaaaaacugcauguaagugaaguucucuuucacaagacacaagcaucgguaacuugacaaaaaauguaagcuucagauuuuuaugagccuuuacaaauugcugccagacucaagauuuaaaaaaagaaggaaaaucccauaucugaagauaaauuugcuaauucuggauaaacgccaugugucucaguacauuucuggcacuuaccuacacaucugcaagaugggaaaucauauugagucuugacagguguauccaauaaauuuuuuauaggaguaucuaguaauuuggaaggugacucuauaaaauuauugagaacagaagcagcuguucuuuugguuggugucuuuucugaagaaguuguuugcugcucuaaagcugggguguggcuaucaaguucugcagcagugguuugucuagucaaaacugugacuggcccugacauuucaacuuuuacuugcuucugugauuugagaguaagagccuuauggucaaauaacgacuuggcgugaaacugcuucagaugcugcuccauggucucaaugaugcucuuuugcugcacauuaucacagcuugcagguggauucucuugcuuaguuaccuuuuuccauguuuuguuuucugguggugcugugugcauacaggcauguggcuugcauccagguuccaccuuaauuggccugugcaucugacuauggcaagacucaguuugggguugcuguguuugcugcuguucuugcuucuguaagagaugccaccuuagagcagcaugcuuuugaguguccuucuggggaggggucugagugugacuuccucccuggucaggcacaggaaaaacauuugcaugguuauguaucaaguaccuuugcugagcaaguugcgcagcuuguugaccagacauaucuugguuucuauuuuuauaucccuguagaacugaagcuuguugugacuucugcuccuguucuugaaagcaccugugaagaagaucuugcuuugggaucacauuauuuggaaaauauugcaugugaugcaaguuuugggucuuguuuccugcaaaaaguucaggauguguagucuguucuuuauucucugaaacuagguguguauuguuugaacaagaaaccuguauuuugcaugcacuugauuucauggucugacuauaaggggaauuucuacgauuuauauucuguacuuccuccagucccauuuggacauuaugagucucgaacucgcuugauuuugaauacugauuuucaccaugaaaacauucuuccacuuuagucuggccaaagaaugauccuucucuuugcugaucauuguugcuuugggggugaggaaaagucuggaguauuuccucuuuauucuuuauuuguaauuuuugcugcuguugcugguuuugagggagaugugaacucugggaugguuguguuugugcugccuguuuaugaggcuuauguugcaaaaggugugaguuugaaaauggcucagucucugaagccuguugauucaagugcuguuucaacacuggggacauaaguuuuucaguuugggaaucugcucuuuguugaaaaugaaaucuagugccacacagugacugcacaugagcuuuugguaaauggucuguuuuggagaagugcaccuggugugaggguuuuuggaacuggagauguugguccacuguaccuugggacugcccuugauucauuucaacuugguacauuugugacuugugcuccagcuguguuguuuucuggguguaagcuugccuugggagccccccaggcauguuggaauuuccaguguauuguuuggaggucauuugauuggagagauuggguugauacugaagaauugauggcagugaugccucauuacguuuuagaugggauuccgcuuggugaaaacgaggggccuucaauucaauccauccugguuucagauagugcuguguugggggcacaagaucucguguuugcuccuugucucgacccuucagaaucucuugcucuuuguuucucaucaacugcuggcaguuguccuguagcucuccacugcuaccaaaaauugguggguuaugcuugagguguucugacauuggucuuguuuucucagaacacaauggaacagucauugucccugcagucuguaugucauuccuguucacacaauuauucugaggccuuucagaaagcaucggagaagggcugcauacauguguagauggauuaggacucugggaagguggugccucagguuuacccucuauuuucacuucccuuaaaaguguuguguuacuuugguugggguaguggugguguucuucuaaaacuccaccauucagagugcuuuuuccuucugaaggaagcugaggaaccuguggaagaggaggagggggagaaagaagcaauugugaugguggugguggugugguaguggcagaaaaggaauccuuagugaacacugagcuuugcuugaaguaagcaccauucauuucauuuuguuuuaaauaccguucagagcugccaccaggagcuugcaaauugcugcuggaaccugaacagaauucuucaccagacgcuagcuuugugguucccuggauguuauuuucugcaggagaugggcauaucucaaaaacugauuuuuguuguuguaguuguucugguuucugaaaggaacagguauuuagcauugcagcuaguuuacuggcauuaucagcaucaucagcaucacaggccucacucaccacugcagcuggcuuuggaggcagcucagaguuagaggucugugcggaauugaucugcccugagguaugcgaugggugagugaucucacaggacaacucauuaguagccugacuguuaauggcauuuaugugagaugugguuuucugcaccgcaauggaaacacaaucuggauaauauugagacaguguuuuuuccaggaguucaccauguguguguuccacggaagaggcagaaacuguagcaccauuaggcauuagcacugccuuguuuuuaaguaauacaauguucuugucaugguaauuagcacuuuuccccuccugcucauucagaaucugaagcucuggauuuucaggcccacugcaguuauguguugaaaaacuggugaaaucuuuaacugcauuuucuugggcuacagaacucacagauucuuucuuaucacucaaaucggagacauuugguugacugcuuucaccuggauuucuuucuuggcuuaccccgaaguuacgucuuucuccauuagccuuuuggucuuguuucaauuucuugaucugaaggagcccagagagagaagguucacuaacugugcguuuuauuccuccauuuugcaaacacuuggaauacccucuacuuucuuguguaaagucaggacucacacgacuauucuggcuucccuucauacaggguauuccauaauaacuuuugaaagagugccacuuggugucuccauuuacuucuggaugagcucucucaggcagugggcuuccauucuggagcuuuguagccagagguucugucuggcaaaugggaggugaugguaucaggaauggacuuagucuguugcccucaacaugguugguucuauccuguuccaucaggcuugcuucggggccauccacaaggcugcccucuaguugaauucuaaagagcauggaaacaaaaauuaaaauguguuuauuucuaucuaucuaucuaucuaucuauaaaaauacuaauauaucuuaaggaauaauuguggauaaauaucggaauaccuagacauagcaaacugauauuuauuuucauguuucauagugacaacugacagcuacucaggaaauaaacauucuugucuucauagcaacucuaaaauauuuauggucauggagaacaagggugaucaaaauuaccagcuaaugugggaaguucauacucuuaguuacuagcaucaauuucauuccuaaauaauuuuuugccaaaaugcuaaaaacaauugaaaaauauccccuuuauuuucucuagcacuucauuuaccuaaucacuugcuaaguucuaucaacuguacuuccuauauauuccuuuaaucaucuugacugccacuucauagcucagaucuucucuuuaucacugugccuccuccugaucuacugcaguagcuuuuuuuuuuuuuuuuuugagauggagucucacucucuugcccaggcuggagugcagcggcacaaucuuggcucacugcaaccucugccucccagguucaagcaauucuccugccucagccucccaaguagcugagauuacaggugccugcuaccaugccuagcuaauuuuuguauuuuuaguagagaugggguuuuacuauguuggccaggcuggucuugaacuccugaccucaggugaucugccugccuuggccucccaaagugcugggauuacaggugugagccaccgcaccccaccugcaguagcuuuuuaaaaggguucuccuccccuagccccgucugcccuuccccuccagcccuuuaagguucccuuuguuaucaaaaggaagauuguaaaaugcaaaucugaugucauauucucuuuaacacacuggcuuaaacuugccugcaugguucucaaacuauuucauccaaauacaccugagagauaaggcacacucccuucaguguuaucaauauuccaggugacagaauaggggugaugaaaaguguacuuuaugaaaaacccuuucuaggugauucuauguuuuucucuagaggggcuggcugcccaaaucuuuugagaauuucuguuuaaauguuuucuuccccccgcauacaggcuguuuuuucuguccuccuacucucucuuacaguuuauacuccaacaauaacaacagcuuauaaauauccaaacauaguaagcuguuucagagcuucaugccuuugguuuucugucugccuagaaugccuucuuaauccccuuauuugcccaaugacucuaaaccugccucagauaucaucuucccuaggauuccaucuuugacucucuaaaagaauuaaucauuccugcagagaaaagggaacacuuauccccuuauugcuugugggaauguaaacuaguucagcuguuguggaaagcagugcgguaauuucagaggacuuagaauugccaucugaccgagcaaucccauuauucggcauauuacccaaagggauauaaaucauucuaccauaaaggcauauugcacacguauguucaucacagcacuauuaaugauagcgaagacauggaaucaaccuaaauguccguaaguaguagacuggauaaagaaaguguuacauauacaccauggaauacuacacagccauaaagaaacacaaaaucguguucugugcagcaacauggauggagcuggaggccauuauccuaaacaaacuaacaaaggaacagaaaaauaccacauguucucuuaaguggcagcuaaacagcaagaacacauggacacaaagagggggaacaacagacagcagggauacuuugaggaugggagaagggagaggaucaaaaaacuaccuauuaaguacuacgcuuauuaccugggugacaaaauagucuguacaccaaacccccaaggcaugcaauucaccuauauaaccugcacuuguacccuugaaucugauugcauucauucgaacauuuuugagaguaguacuaacgaagauuucagagucccaauaauagagaaagccagaagaaauggcacuaaaaaaauuaauccauuguauaaggugucugcuuuauuuucccacagucuuucucauuacauuuauuuuaaagauauaaguagaaaaagaaagacuauuuucuuuuugggcgaaaaacaacucuauuaaaacagcuauuucuugauaaacaagaaaaaugaaauagaauaagaauauagauguugaaagcaacgcuaaaguuauuguuuacagauaaaaagauuauauacuggucaaccuagagaaucaaguaaaaaaugguuacaguuugugagaauucagcaaaguagcugaagaaaaauuuauagccuugauuuauaagagcaucaaccagucagaaguuuuacuggaauaaaauacuguaguuauaauagaagaaauuaauacacuaggaauaaguuuuuaaaauguggaagaccuauuuuaauauaacuuuaaaacuauacuaauauauaaguacaaaaacaaaacaagggaaaagcuauaauauguucuuagauaguugucaaauuauucacuuaauauacucuuacuaaaaguacuugcagaauauuuugaggaauuaaggaaguugacuccaaaguucauuuggaaaaauaaacaaauuggguagccaggaauauucugaaaaagaauuguauggggccuaguagccaaauuaaaagauauuuaaaagcaacaaagcuacuauacuuaaaauaguuuguguuugcacauauaauauuaauaugaucaauggaauaaaacagaauguucaaaaauagacccaaaccacagaaauaugcuacaagauaaggaugggauuucaaagacauacuugauauuagaacaacuggguaaucuccugaaaaaaugauaaagugggaucauucccuuacacuuuaagauaaauucuagaugaauuuaauauuugaauacaggaaauaaaacccccccaaaaguuaaaaacaaucugagaaaacuuaaaaaaaucuaaugacuggcuaagcucuuuuuuugugaaacaaaaucuagaagucauaaaagaugggaaaguuugcuaaaauuuauaugugccaaaauaaacauguaaaaagaguuaaaaguuguauaaaacuuuucuuaacauauaggacgccuacaaauaaaugaauaaccacauacuaaaaaauggacaagggacauggacaguucauagaaaaugaaaugugaauggcucuuaaguauuuaagaagauaucuacuauugcucauaaaaagaaaugcaaauuaaaacugcaacaagguacaguuuuuuucucuucuccaauuagugaagaucaguaagcuugauacuauacuauguuuggcaagcaugugggaaaacagauacucucucauguggcuuuugagagucaaaacugccacaaauaucauguaggaugacaauuuggcaauauguauaaaauuucagaaacacuuuccuugacccuuuuaagaauuuaucugacaggcugggugugguagcucacgccuauaaucccagcacuuugggaagcuaaggccaguggaucaccugaggccaggaguucuagaccaaccuggccaacauggugaaaucccgucucuccuaaaaagauacaaaaauuagcagggcauggugguaggcaccuguaaucccaguuacuugggaggcugaggaagaagaaucaccugaacccaggagguggacacugcagugaggugagauugugaugcugcacuccagccugggugacagagugagacacugucucaaaaaauauauauauauauaucugacaaauaugcucauauauacauuaaaugauguaggcacaaucuuuugcaguaauaaaagguuagaaacaaccuacaucaauaaggguuauguuaaauaauuuaugguacagccacacaauauaauaccauguagcuauuaaaauuaguaucucuauauuuucagauggaaguaucucccaguaauuaaauggaauaaaggaagcuacacaacaguuuauauaagaaugcuacaaccuauaccuuuguaaaauaaaaaaaaaucaucucuggagaauauauaaugaacuggccauaauaauuugccuccaggaaaaggaauggggcagcuggagaaaagcacugggagggggauuacuuuuaacuauuccuuuuuuuuuuuuuuaaauaacuuccaagcauguguauuacuuaauaaauaaaauaaaaggccaggcacgguggcucacgccuguagucccagcacuuugggaggcugaggcaggcagaucacgaggucaagagaucgagaccaucuuggccaacguggucaaacaccgccacuacuaaaaauacaaaaaguagcugggcaugguggcgcaugccuguagucccaguuacuugggaggcugaggcaggagaaucauuugaacccaggaggcggagguugcagugagccgagaucgcgccacugcacuccagccuggcaacagagcgagacucugucucaaaaaaauaaaguuauaacucauauuggacaaagaaaacaaagugauguuuuuauuucugcuagauuuacuuccuuccauacauuaagagauggucuagauauacaucauccaacagugacuagucacauauagcuauugagcccuuaaaaugugucuaguccaaauugagaugugguaucuaugaaaacauuuaguuuggauuucaaagauuuaguguuaaaaaaacacaaaaauacucaaaaaauauuuaauacauguugaacuauuuuaaauguauuggguuaaaucaaacguaucaucaauuuguuucuuuuucacuuguuuuaaugugaguacuagaaaauguaaaauuccauguggcuuacauuauguuucuauugaacaaguagaaaauuugggugagacaauggcuuuuaaucaucaauaacaccuaauaaagaaacuuuagguuuuaaaaucaugaaaauugauuuguagucuuugauaugagaggcuucuccaaaaucaggacacuaucacuuuucaaaaauuaaggagcauagacauaaaucuaaauaaauccugcagaaagaaagucaauuaccuguccagauacuaccaaaaaaaggcacuuuucuuuugguaacuguaaaacaccaauucauauacagagcaaucaaaagguauuuacauguauauacauguguacauuuaugauaaauuauauaaaauuuguaggaucuguacauaauacauguuuuucuacuuucuaagguauaaaauauuuuaagcauuuaauauauuaucuuuuauuauaauccauuccacauaauuuuggacauucuuuaaagugucaagggcaaauccuuugaguauaauaauagcuacuaagaaaugaaggugacuaaaaaagaaauguauuucaauauggaguuuuaaacacaauggccauuuuuaaacauuauacagaacuauuuugucugugacagcaaguccuuuauacaaccauuugugugaaaaguuuaaugguuaacuuuuucacaagaagggcaggaaaguuauauguuagaaugaggaaaauuuguuauuggucuuuaaaucuuauuucaggaaauuuaaacuaauaaacugccauuuuagaaggagaaaaaugcaauauuuucuuuuacuuuaauaugugcuaaaucacacuuuuuauauacauacccuggaauauuaugauccaguaacccacuugcacaguacucuuucaagcucuuagugcuugcauacugauguugauaaaguauuauuuugcuuaauaaaagagaaggaaaugagaccuaugcauuuugcucauuguagaaauacugaaaaagcuuucaugcuguaguuuuuauggggucauuuacacaguguuuucaagcuugcauaaaaagucuacaugaagucaauaauuuuugcguaagauaaaaaaaucuucaaagaugaauuuuuguagauauugaccugcuauucaccugcuauucagugaaaguagaguuaaugaauuuuuuuuaugaauuuaaaugauugcaaagaaaaguuuuucaaaguuaaacuguuuuucagauaaauauaaauuuuugcuauggagauuauuugugugauuuuugcuucucagagacuaagaacaaaaauauaauuuuaauucauaucugcucuuauaaaugacucaucagaaauauuuugaauuaucaugauugauuuuuuaguugaaauuaaacauccuucuauuuuuucuuacaccagagaacacaaaauuaauaugguauacaauauuaagauacugcucuauugugcaacuaaauauucaaacaccuugcuauugaaggucuacacauuguaauucacuguaugcaaaagaguccaugccaaauaagauucuaccuauaaaaaucauucccuagauggaaacaauucuuauuuuagaaugagaagcaacuuuacaagaggauggcaaugucuuuccuaagaggaugcuggccaaucaaaauuaaggccuuuuuugggguuguuaaacugguuacgaaguuuauauacaagaacagagacagaagaaccuuugggaaaaccuggagugacuaauuguuuacccagggaugauuuucaugaugucaauacuucacucauugcauuuaguuaaaauuuaagaaugaauacaguuuuuaacauauuccucaggagaugcucuuauggguuauagcuggcaucauguuaucaaccuacagcucaugcaauuccugaaaguuucacaaugugcucuugagaacugguucuaagcacuguuagagcuaccaaaauauuaaaaaauuauauuacucuuuuuuccuccuuuugaaaaaaugaaaauucccugagaucaaauacaugccauauuauuuuggcaucuuuauuuccagaauucuggacaaagagaucuugcuucuggaaugacuaaauagcauuuuaaccuuuugaaagguauguuaggcuguuuuugaguugcuauaaagaaauagcugucuggguaauuuauaagaaaauagguuuaauuggcucaugguucugcaggcuguauaggaggcaaagcacuggcaucugcuuugggugaggccuuacaaaacuuauaaucauggcagaaagcaaaaggggagcaggcaucuaacauggcuggagugggagaaaaagagagaggaagagggaggaagagggagggaaggacagagggagggaaggagagagggagggaaggagacagggagggggacgugccacacacccuuaaccagaucucuugagaacucacuaucaggaggacagcaccaugccaugagggaucugccccaauaauccaaacacuucccaccaggcccccaccuccaacacuggggauuauauuucaacaggagauuuagaggagccaacaaccaaaccauaucacacggcuaagaaauucuaaggugacacucaaauauaaguaauaauauguaacaaugguccuaacaauguauaaacauuucagaguagcagcaaggaucuaguaccauuuucucauuuuaaagaugugaaaacugaggaaucugcccauggugaagcaccaaaacagaggcucccacagggacuaggccuaagcacucuggcagcucucuaaagcucuucccaccacacaauacuaagacaagugcauaauuaaaggaguaaguuuuguuauuaaauucacauuuagccaacaauuuaagcuuuuuuuuuaagguuuaggauuaaaaaacaaguauuuuggcuacguaucuguaggucuguaauuauuaagaugauuaagggcauuuugcaugucuuuugccaacaaaucauuucuuuaugugguuugggauagaauaaaaaagaaaacguaaacuuuuaggacauggaauuugaagcugccacagaguuauucugaucccuucuuugccaccuucccagauuaucuuugcaaugcuggacugcugaugauuuuucucuagaauauuugaggaugauuuaugaaucuccccugauaaugucacucagagaauuggagcucaagacacauuaguucauuuauuuuuucaguccugcugcacugaguugaauccucacucagugcaguugccauggcauggagcuaacacaaagaugcaaacauccucuacugcccugaacugugguuauguugaggcaaugagacuacugaagugccaugggaauacaggagaggggaagacuagagcucuugucccugucaaugugggcauaucagccacccaagucacucuuguaaaauuuaacuucauuucuucuugccguaguaugagagaaaaacacuaagucaaagguaaaaggcugacaacgaauguucaucaaagcuaccuacaacauugcugagggaggagaaccagugaccuaaggagaaaugugcaucaguagucagcaaguacagagaacaccacauaaaaaacucauagagcgcaauuucaaaaaaacuagugagaaggcaaaugaguuguagaagcucuucugauuauugaacccuuaaccuaggaaaauacauggcauguuuaucugcuucacuauaaacuuaucuuugcuuaucaaaauauaacacauagcucauuauucaaaucacacacacacacacacacacacacgauuuuuuacuauauggugcagcaugagauuucuucauagguuuaccaaaaaggcaacaaagugaauuaaacuuuaagaaugaacaaaacauaaugcuaaaguuauaagaacuuugguauuuuuuuaagucuaaaaaggcaguuuuagaaauuaucauuugccuaaaugacagacuaauuaaauuacaauuuuaaaagguuauaauuuagaucccacuagucauauuauguaugucuauccuuuuauuccaauaaucuaauguucuuuguaaugcaugggcuuccaaggaaccaaaaagaauauuucuauuuacuauaaauaccaccauuuuuuucagaaauucuaaaggucaaauuauaaccaggcaauuuaacauaaauagaaacaugcaacaauuauauggccacucaauaauuucagcuaaugccccagaauaaauuuucauaagcuacgagacagagagagagagagagagagagagagagagagagagagagagacuggcugauaugucaauuauguuaaccuuuaucuucuaugucagaggcauguauuaaugaagcauguuuaucucaguugaaaauacuggccuuuugacuacuagcuaacauuuugguuuccuaagaccaaaacagguuuuagccacagcaguuuuccuuugauuuuguuccuucucccgccucucugaaaauaauuuauuauaaauucuagucgcauuggcagcaucugugaaacaauuacugcaucuaggacugacucugcagucuaauccaucauaauuaugacaggccucuuugaagaugcuaugaugcaugacuuaaaaauagcacauuagugugcaaauggaucagcaucucauuucaccaauaugcauuuaggacuguaauuuugcuccauaccauuugacucuucggauuacucaagaaugguagcuguaucucucaccacauaaagcuguagauaugcucaaauuugugaagagggcuugauuuuguuuuuguuuuauuuuuugguuuauugcuuuucuagguggggguauaucuuuuauugcucuaagaaaaaauacacaucauuuaaauuuuaugucagcuuuuuuucaaggggacaaaagagucaauuuauagauuuguauaguugccauacuauaagguaguaaauuauuuuuuuccauaaaauaaguuuugcauguccuaauacuacaaguauauauaaauuacucuaccaucaugaauccuguuuauuuauacauucagauuacugaggguaaauacuucagacugcuugcuuaugggaacuauaucugcuaaaggcacuguguuucaggaucaaacuuacgggaaucacuguguaucucucugucacuuccacugacaggcuucaccucuauuaguaauucagaguguuaggaauuaaauauuuauugacaugaaaaacacugaguaaagaugauguauauggccacaccuccugcauagauggcauuauucuccaaaacuauuuuggauucuuccuaucaacaugggacauagcuugugucaauuauacacuuauuucaagaugugugcaaugcuauggacuucauuauugucuacuaaauuucccucuguauaguguucuaaaaucccgagcaaaauguuaguuuaaauucuuaucuucuguaucuauuaaguucucuccauuucguuugacuuuaaaauuacuauguaauauugguaugguugccaagucucacucuugagguaaagaaaguguuuuuuauagggcauuucuuauaaaauuaaaaacuauucuucguuaauuuaaaguuaacauuauuuaauauuuaaauauuaaagcuaaaauuuuaaaaacauaauccaaaacauauauuuuucaacagcaaaauuaauguaagcaagccacauguuagaccuggaauauaauguuuccuauauggauuaaguauggagaauauaaggugaauuaauauuuuuaaggcaaagcuaacuuuuuauuucucauucuguaagaacuuucuaucuaaauauuuaaaaaucugugaagauguacuucacaucucuugaaaaaggacugcugagcaugguccuggugcugguaccaaaacagagauauagaucaauggaacagaacagagcccucagaaauaaggccacauaucuacaacuaucugaucuuugacaaaccugagaaaaacaagaaauggggaaaggauucccuauuuaauaaauggugcugggaaaacuggcuagccauauguggaaagcugaaacuggaucccuuccuuacaccuuauacaaaaaucaauucaagauggauuaaagacuuaaacguuagaccuaaaaccauaaaaacccuagaagaaaaccuaggcaacaccauucacgacauaggcacgggcaaggacuucaugucuaaaacaccaaaagcaauggcaacaaaagccaaaauugacaaaugggaucuaauuaaacuaaagagcuucugcacagcaaaaggaacuaccaucagagugaacaggcaacccacaaaauggcagaaaauuuucgcaaccuacucaucugacaaagggcuaauauccagaaucuacaaagaacucaaacaaauuuacaagaaaaaaacaaacaaucccaucaaaaagugggcgaagcacaugaacagacacuucucaaaagaagacauuuaugcagccaaaagacacaugaaaaaaugcucaccaucacuggccaucagagaaaugaaaaucaaaaccacaaugagauaucaucucacaccaguuagaauggcgaucauuaaaaagugaggacacaacaagugcuggagaggauguggagaaauaggaacacuuuuacgcuguuggugggacuguaaacuaguucaaccauuguggaagucaguguggcgauuccucagggaucuagaacuagaaauaccauuugacugagccaucccauuacuggguuuauacccaaaggacuauaaaucaugcugcuauaaagacacaugcacacguauguuuauugcggcacuauucacaauagcaaagacuuggaaccaacccuaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucacaagaacaaaaaaccaaacaccgcauauucucacucauaggugggaauugaacaaugagaacacauggacacaggaaggggaacaucacacucuggggacuguugugggguggggggacgggggagggauagcauugggagauacaccuaaugcuagaugacgaguuagugggugcagcgcaccagcauggcacauguauacauauguaacuaaccugcacauugugcccauguacccuaaaacuuaaaguauaauaauaaaaaaauaaaaaauaaaaaaaaagaaaaaggacugcugaacacacaaauaugucaaaguccucagagaaaguuccuccauuucugaaaagguguuaauuggacaaguagcugcacauacacauacagcgugugcacugcuccuaaucuaaaucaugugcauaggagguuuugucagguuuuucauaauccucaguagggccuauuuaauucccauguuuaaaguuuuaaaaucuguuucuuaaaauggcaguauaaacaaaauuuaauaauauauagauuauuugagggagaaaaauucagaggaaugccauugaagaugagaggcagauuaacucagagauagagaucugcauuuaagaucuggagacaccugccaguuuaguauaaaucugcuuucaguuugcaacccaaguuaaccaaccaguuucuuauugguaaaaugagcaugaucuuuugucaauucucuauuauccacuuaucuguuaauccuggaauuguuuuuugaauuugggcuuauuccuggccuuucuccaagucucaccaaacuaguguguacugaaggaaacgauaauaauaauaauaaagauaaacauaauuagaaauguacugugucacaaauauuuguuucucauaaauuauuuuaaaaaucuauauuuuucuauuucaguugacucccauuauuagaauggauaauugugagcugguuguccuuacuggaacacugucuaggauacauuuauauuauccaaugcuugaaacuuucaauuaaauaaaaguguacuuagaaaaauugcagaaguuguuuaggcuuggucaugcucuaagaaucuguccagggcaaggaugccccagcagaaagagacugugggguggacucagcaggcaaagcugaaguagcuauggugauagaagaaauaaggacagaucucuccuaucaggguacugugcagugagagcccuuguaggccucucuaaagaacgcuccauauaugucaagaaagccaguauucggaugccugccucacagagggcguccaauagccagucaaugccaggcagaaaaauagcaacauccaaaguccuccagucuuguucaggugcuuaaggagcccugagcuccuuuucauccuuccucaguccugcccaaucuccuaggcacuggugcucacgguagagggggaggggagguaucaggagugaggcuccccuacuuucaacuccaaggguuggagccaguguuuaaguuugugcugggagaagaacacugacucaggcuugaguugggaguuuuaaaaugaauaggacugaguuugaaagacaaauaaaauuguucuaauaaccaaaaggugcuguaaaaauuauguuaccuggucaagaagacauuaauggcugaauggggugaaggagacuauaauaguauauaugaggggcaauuguagaaaaaaaauacuuucauuuuuauauacggagguaugauuuuuccaauagaaccauuacauaaggccaacaaauggguucuaauaauauauaagaacuuuauguaauuucuaggagggcucauaaucauucaguguaguuauauaaugacacugguagaguuauaaaaauaaucugucaagguauucauucuuucaugcaacgaauauuuauugaacauauucuaugugucaggcacucuaguagucaccaguaacacaccacugaacaaaagagauaaauacuccugucuucuuggaccugauauucuaaugaggagaaaaacaauaaacacaauaagaaaguaaauuauguggugugguaagaaaauguugagugcuaagggaaaaacaaagaaauaauagggcagcuaacgaggaaucaagaguaucggggagugguugcccuauuaaauacuauauaaugaggguaaaucucauuaagauagugagaucugaacaaagucuuaaagucgaguuauauaauaaacaucuaauucaccaagaugaucuuaaucaaugcauaauucuuuacuguuugauacauugucucauaucuucagcccuaaaaucaagaauggcaaaacaaaaaacaaacaaacaaaaccccacaaagcuaucaaaagguagaaauuaacuauauuagaguuggucaacuaaauugucacauccccaggggacucuacaauauuaaugugaaacaaacaugacauaccuagcauuuuauuuaaaaacucuguaccaggaauccuuguaacacaagcauuuuggcaauuauguacuguacuguaucccuaaaaucugcuccuucucaaaaauauuuuguucccuaccauugccucaaaaggcaugccaucuauguuuuggagaaguuuuguacagacuugaauaaauucguuuuccuauugaucuagucuuaaucaacugguuaccauaacaaucuggucauuuuuauucuuccuauuuuggaacaacuagcaaugaucauguuuuaguuaauuuguaggauauuacgguuauuuuugagaguaagaugaagaucuucuuaaagauuaauaauggagaugccauuaaaccaacugcacauccaugagcuaucaauuuaagaaauuucaauauguaucaguucuaaugaaaagcugccaacauuauuucauaacauaaacaaaauaaccagucuaucagaagaaagaguaauacagaugcuuuaaaagaguaucauauaaccauguguucaucagaaaaauacaucaauguucccauacaugaugaagauuacucuaauuuucuuugaucugaaaagcucugauaaauagguuaagaucgccuaaaauuauauagcauguuuuagauuaucaaaauaguaauagacuauauauauaauauagacauuauauauauuuuuucauuacaaaagguucuucuggaaacauaauuuaugggauccagaaguugcauaaaauauggucucuaucuuuaagaaucuuuaauuauuuaacugagaagacaagacauauaccuacaggacauagacacagucagaacaagaaugcugaguuuugguucuaaauguggguuugugagcaagucacaaccaccccacaucucaauuuuuaaaaauuuauaauacgaggggaaugaacaugauuacaucuaaggucaucuuguguucuaaaaugcuaugauucucuaaaacuggcaaugauaaauaucuacuggggcuucaauuaaauaacucaucacgaagaccacuuucgguuugaaggguguaauuuuuaccucauuuuacacauaaguaaacaagcuaaaagaacgaaacggcauggcauagccgacaugaggaagaaguagauauaaaaugcagccuuguccaacuucugagccaaacuaugaauagauggagaugaucuguucaggacaaagagguagauuuggugcuccuuaucaguacuguccuuggaaaagaaacacuggauuggccaauaugaucacaucacuaggaacauaaauucuucuauggggcaggaugauuaaaaagcuuucuucauugaggucuagaaaauaaauauuccuaagacucuucaucuucaagaaucacugggugcccuuaaagcaaguacccuggacaguggacauaaauaauauuuugaaaauuaaaaaucagaauucuugauuauuaauugauaaacuuacaauuuuguuuaaacaucaaucucaugugaguuuaauuaaaacaacucaauuuccuucacucgagucaacucugcgggagagauaaaauuggguuucugaauuuuugacauuaagaagcagguccuaggcaaugguguccacccuaaaaugaugucuucuugaugucucuaccaugucucuuuauaagugcaguauuaauaaacuagagauguguccuaauguguagguaccugaacacacauguacaccaacaccauugaaacagauucuuaucauaugugauaucuaucuaugggacugguucuuugggauauuaacguguaauuuuaaaaaaggagaaccagccugagaaaaaauaaaguucugugcucaagcaagaaaacuuauuuuuuuucuaauuuaaaacuuucuuuaaugcauggccucaaagucuuuaauaugaugauaggaugucuggaaaggugcuguguggcauuuccuggacauaaugaaacacaggaucauuguuuauggagcacccugaauaaacaguauuuccauggaauagcauacuuuggaaaacccuaauucagauguaguauaugauaucuuauguaauuuuaaucugugcauagaucuugaggcacugaugagaaccuguggacuaggagaguauaaauucauaaaaccacucagauguagaguucugaguucauuuucaagagcaaaggacacauaccuaugcaaguuuugcuuuagcuucaaauuuaacuuguaaaaacuaaacuaucuucuuccaguuauauugcuguucuaaugauucacgcucuucaccuguacuuugcccaaauacaaaaucauaacuuuuuuuuuucaccaugagcuaaacagaccauccaaguuaugccuuugaaaugaagagaaaggucuguucauaggauauaauuugguugauuguuauuuuaguguugcauagugcugacauguaucuucauagagaaugcagggaggggcaagaacaaagaaagaacacacaaaaaaauuguaaacucaaaaaaucuaaacauuuaggacaaacaaaaaauacacuuccacguauguauugaaaauaacauuugaauucaaaauaagacuuaacuaccugcaaagaaauuuccauauaaccuuaacauuaccuaggaaauaucauaaauucacaucacgcuguaugaugcauuuaagauugaugugaccaacaguuuguccaacagacuuagcuauacaucuguuaucacgauuauaacuaaauccgcuaaaagaugaauuagcuuuuuguuugaaaacagcuucaaauuaauuagugaaugauccaaguuuauggcauuuuucauagaacaaaaacaggauuguagaggaaaacaucuaggaaauaucauauaaauguucugcuuuaaccuguggcaaaucauuacuuuuaaaguuuauauuugaauauaauauauaaauguaaaucagaagcaauaaacacuucaaauaucaccaacaaccuaaaaguuguagcuuacccccuuuccccucuaucguauccaucuuuuaggaguauaaaaaaucugauuuuaguugccaucuuauaaacauaauaccauaaaauaaguccaccaguuaagacaagcacugaauuacgaugaagaaaaagagcauuucagauuaacucacaaagauuauagaacuguuauuaccagaagcaccaacaauuccaugaaagaacuuugauuaaaauucaaagcaauauuuuaacucuccuccccccgaccuguuucaaagaaguacuaugaaauaaacauguauaaaacauuccuuuuguuuuagucagcguggcuuuaaaaauacucauuuguacucuaugucuccucuucuaccucccccagaaauacuagccaaacuccaaguauacuagcucuaauauucacagcauggaaauguuuuacauugucuucuaaagacccacaguuaguaaucaagaucauaaaauauuuugaagcugaauuaacuuuauuuaaggggagaacaaagaguagaaggaaauggugguugaucucuuaauagaaaagguacuuuagucacacauggagaaaauagaacucugaguugucagacaugucucuucaaagguauugacuuacaguuaaaauguuacucaggccgaccauuuaugguaucguauaaaaauucuacacugcucugcuaaaaaagguuaugguuuagaaccccagaaaugaguuggcauucugguugaaaucaaagcaaacucuuucccauguuucaauguucucuuugugguaagauguagcaugaagagaugguaaaaucacugcagauaagggggaaaaaaaaacuggcugaucucaucuguacugcaguuauugcuuugagaugaugcugaagacugcauuauugaagcagugcugggaaaaauguuguauuccuuucuguuucuuuuuucaaaauacuuucaaaacucuaaaucuuuucucagaggcauuucuaacucuggaagcccacacagcuaccaaucuuauaaacauuuacaaguauuucaucucuaauuuaaauuuuaaauaaaauuauaaugugcugaauaauaauucaggcuuuuugguaauaaauauaagucaaaugucacaaaguuuaaaaagcucuuucacugauuuucuagaacauuauuucauggucugacaagugauuguaagauguuauuacagagagacacugaaauaaccuauucuuuuuaguuuaaaugcuacucaguugaagaaaauuagauuuuauaaaaaggucucauguagcauuuucuggaaaaaagcaucauauucuuaucacugccuauggcuguguaggaaaaaaccucuccaaaaugcauuuuuccucugcucucacaucacaacaauauucaaaacagaaaacuucucucuugugaccaaaugugugaggguuucuccccaauaacaagcagcagacacuagcuggguguccuccaauuuaauucccggagacagugucagaccccguagauuaaacgcucaguucccaagaugcuccugccacagacacaagucacaaauccaggccuccagaacuucugaccaaccagcuucgaguugggguucccacaacacccucuuuggguucaauacguuuggucaagcagcucacauaacucaagaaacacuuacuuauauuugcugguuuaucaaaggauacagaugaagagaugcuuagggugaaguauaaggaaagugcacggagcuucuaaguccucccuggaugagccaccuuccaggaaccuccacugguucagcuauccagaagcuccccagacucaauccuccugaguuuuuauggaggcuucaugaucaucagcauuccuuuccccagugcaaagggugggaccuucucugggguuuuaagacucaaaaucagaaggguggggaagauuagaaucucccucaggguuggguguggugguuugagccaagguggguggaucacuugagcccaggagcuggaggccagacugggcaacauggcgaaaccucucuacaaaaaaaaaaaaaaaaaaaaaaaugccaggugugguggcaugugccuguagucccagguacuugggaggcugagaugggaggauugcuugaaccuaggaggcugaggcugcggugagcuaugaucacaccacugcacuccagccugggugacacagggaagucuugucucaaaaaaaaaaaaaaaaaaaaaaaucucccucgggggacaagugaaaggaaggcaggagagauucuguuuucuaaggccugccccgagguccaacacaccccacauucuaacaaaagacuguaaaaagggauauuggagcuaugaaccagaaaccauggacaaaaaccaauauauaucguaacaugacaauggcaaacuuuuguccuagcacuuuaugaggccaaggcagguggaucacuugaggccaggaguuggagaccagccuggccaacauggugaaaccuuguuucuacuaaaaguuagccaggcaugguggcauggugguauagucccagcuacucgggagucugagacaggagaaucacuugaacccagcagcagagguugcagugagcagagauugcaccacuguacuccacccugggcgacagagggagacucugccuuaaaaaaacguagcucaacucauuacuuauugagccugugagcagaguacuguacuaggugccaugggaaacagaaugacaauuggucauaguucucucugagagcuuuuaucuaauuuagaagcagaucauagaguuaaaauaaaugccaucagacaugcaacuauggagacucauaggaaggugggucauccaaaugaagggcuuuugguagugugcuuuaggaauuuuuagaaugucuucacuugcagugaaagaagaacauccuagguaaagggaaaugcuugagaaaauuuguagaaagacuuaaaacacagaaaaauaucuuaaaauagcaggaaguccauuuggucaagcauagguauauguaacaucuuacaaugagaagaauacagaugugguagaaauuagugugucauuuugaauaaggcuacuuuugacgaucauuacaagcuuugaagcauaauccuguaaguuucaaacucaauuugauuaaaauuggcuaaagaaauuuuaguaugcuuccucucaauuuuuccucuucugcauauuugaaaagcugugaauuuuuccaaauucugccuuuaugacuuagaauaacaaaagaacuauacugacgugucaaacuucagcagguuauaucauuaugcuuauaaauauugaguuacagcccuagaaaauagucacuauuagcuauuucauaaugcaccuguauauuucuaugucagaaaaagaauugaggaguuaagauuuaaacucaagcuuguaaaacuaguuuaugcacuuaaaaagaaguagaugagcagaugcauuuguaaaauaaaacuccaauggagucuuuuggugggugggugggggaauggggaaaauuaauuuuuuuuuuuccucugagacagauucucacucugucgaccaggcuagagugcaguggcacaaucucagcucacugcaaccuccgccuccuggguucaagugauucuccugccucagccauccaaguaucugggacuacaggcacgugccaccaugccuggcuaguuuuuguauuuuuaguagagacaggguuucaccauguuggccaggcugguuuugaacuccugacuucaggugauccacccgccucagccucccaaagugcugggauuacaggcgugagcuaccgcaccuggcuggaaauuaauauuuuuuaaucaugaaaaaaauagaaaauuaaaagagacuaauaucauuaauucaauuuuuaauuucauuuaaaccagaaaggacaguccuagaaaauauagaccagccauacacaauuugaaaauuuugggacucucaaauuugauuuaguaugcauaaaugauuuuacucuaguuuaaggcauguauauauguguguauacccacaaauaaaggcaaauacaggugaauaaucuauuauaacucuguuaaguugccagucauuauauguaaauauuauugacuacauuaaaaacaaaucaacaccugaaacuaacaugagcuuauuauuuuauuaguuggguuucuguaauuaaauguaguguucugaaagucugcuggaccucaaucugaaagguacacugaguaaucuuuauagaucauuuggcaaagcagaacauuaagaagauaaagaggagguauucauuacaacuauggguaaccuggacuucucaaccaucugacuagauaaaaacugcauggcuugaacauuuggaauuucucauguuucaggacagauaaagugcugacaugggaagaguuacuuuauccucaaacucaauuucccuugaagcuaccaaaggaauaaucaaggugagaauauguuucuauuguuacccugcuuauucacgccucauuccuacauuggcauacuguuauaugcagggugaauaugagguggccauaaggaaucucaaugacuuaaguuacaguaaguagucuuugcagucagauagaucuccauuuaaauccauauucuucuguuuacugugugauccugauggagccuuuguuuuuuaaucuagugacaacauuaacacuaaaaggauuaaaugagaaguauuaaaugagauaugugaaagacaaaugggaugacuauuccccaaacaggcaugcaucuucugccucuaugccucuaugccuccauuuacuccuucauacagaauuucccuaucuuucacggcucaauuaaaaauucaccuccaccuuacagccuuucuuguucucuuucagccagcugcagugcccucuucugaacuauccuuucauuuagaccuguguuaggacacucucacuuuagggacaccuuguucuuaguuuuccucuaucucucauugcuccuucuuaauggcccuccucugccucggcuuauucccuaaaugcuggucaccucagggggcuggacuggacccucuucucuucaacauucuuucaucuauuuauuuauuuaucuuuaacauauuguucuagguucuagggauguagggaugaacaagauagucuggauuccuucaccagugaaguuuaucuagacaaacaaguagccaaauaaacaaacaauuucagacugaugagugcuaugagggaaauaaaucugagugaugagauaaagaggacuaaaacaggacuauuuagauagagcagguaaggaaagacucucuugauuugcugauaucuaucugaacugaaugaaaaagccaaugauagaaugaccuggaagaaugauucagcuagagggaacaaaaguacaaaaggcacugaagcauaaauuagcaugauauagcugaggagaagagaaacuggucuaguuaguucucagugaacaagaggaguguuuugaggugcggcuagaaguauguaaaggccauggaggaguaaaguguuaagauuauuauuuaaauccagugggaagccauaggugcauuauauauaaagcagugacaugaacugauuuagaccuuuaaaagaucacucugguagcuguauagacaaugaauuaaaaguauaaaacauagauacaugaaguuuagagaccgcaguaauacaagagaaaggauagaauguccugaacuagagaauagcaguggcagagaaauggauaaauuuaggacacauuuugaaggcagaaacagaacaacuugguaauggauuagaugugagaaaguacaugaaaggaaugaaagcaagauaaugccuagaguuuugucuugagcuaaaagguugaugauggugcuauuuguuaggauggguaaaugggaacaauaugacugacagaaaaauuaaggcuucuauuucgaauaagcucaguuugagauguacauuaucauuaaaguggguauauuaggcaggcaguugaguguacaagucaggaaaucagcaaggggucuaagcuggagaaaauugugaacuguguuaaccuaccaaugguauuuaaugccccaugacuagauaagaucaucccaaguaagaguacaguuggagaagccagccugagauuggggccuuaaaaacaccagaauuuugacauuguaaagagaaugaaaagucaacaaggugacccaagagauggccaggaagauauugagauaacaauuuacugaaugaccuauuuuauucccaugaacucaaguagcaauucaaucucagaucuauacuucuaaccuucagcagaguucacaauuuggauuuucaaucgucuccuagucaucuguaccuguaugucccauaggcacuucaaacucuacuuauccaaaauggaauucauucuuucacuccaaaccugucaucuacauuccccaucagugugagggguacuaucauccacgcaguuacuuaagaagaaaccauggauguuuaauucuuucuucccguuuaaaaaauaaccuaucgguucuauguucuuauugucuguagaacccacaaauuauccauguccuuacuuuuacuaccauggcucaugcugucaccaucucauugcuggauaaccgcaacagccuauugaaugaacuucuugucucuaagccuugcucaucuucuaccuauucauacugaagcccaaugcugaacaccaucucuuccacacuuacuuaucacccuucaguagaucuucacaccucuauacuaauucuguuuaaaauaauucuuucauggcuaccuacaacauuucuuaauuuucuuaaacacguccucuuauaaaagcaucuucaccaaggaagaguaaaauuauguauuuuagcccauucagaaacauacacacaaaaaauuagagaaaucuguugucagauuucuguuuuguucccauugugacaaaccaacuugguauauguacuguuuuaguuaaaagaaaguuguuggaagcacauuacaucagccacugaccuauaucaagagguguagaacauuuugaucucuagucuagaagucaaccccacugacuacuuaacauaaagauccaaaguuggugagcucugaguccaggcucauccagagcaucucagucaacacuggaacugaaauuucagauuuccucccuauuuggauggaaauucauuuugauauagaaaauguuauugcgcuugagucaucuuagaacaaauucaaacuucaaauacuguuaaucagaugugaccuuaaacguuauuaaucagacucaaacuuagugagccugguugaauaacucacagcuggaauacacaccaaaagugaauggauaaaaaaauuuucacgcagacauuuauaccaguguauucaguuuugcuagaagugccccucgcucaaacauauauauauauauauauauauauauauauauauauauauauauauauaccaugccuugaggcaucuauuucauuucugaugugcaaauuguaucuuauuaaaugccaaacuuaauucuacuggcaugcgcuuuguguuccagcagauguuaaaauuuaauagccuugucucuuuauccuuguuucacucuaaaacacuuaucacuuugaauuugagauuguuugcugacaguucguucuuugggggaagaagacuguuuuaauugguaccaaguuuccugcuguuuccuuuuguuauggcagguuaccacgucaaaaagcaggaagacacaaaagaacagaauucacgcuaaauuaauccuaaacuuugagauuaauuggaaacacugacuacucaccacugugccuuuauccacuccuauuuuacucuucuucaugcuauaagcuaguaaguaaagcugcgcaugcucagcaacuuuuugaugacuggaaaagauucaagaaguauaaacugauuaaauggcaaagacgccuaauuaaauuuuuuaacuuguuguacauaaaaaucaaucaagucucuaucccuuauacuuaaaggcaagaaaaauaauuagaugaugaaaauaaaugagaaagcuacaguuuccuaguuugagauauugauccuucagauaacucaaaauguaauucagaggaguauguuggggaguccugcucaaugcuagccauuuggguuguuuacaaaugaauguuugcuaccaguucccaccaaaacagagaagccagcuugagaauggggccuuaaaagcacaaauuuagagacuguaaagagaaugaaaaguuagcaaggugacccaagauaaguuggccuaagaugagagccuuaaaaacaugagaauuuagagauuguaaagagaaugaaaaguuggcaaggugacccaagagauggccaggaagauauugagauaaccauuugcagaaugaccuauuuuauucccaugaacucaaguagcaauuuaaucucagaucuguacuucuaaucuucagcagaguucacaauuuggauuuucaauugucuccuagucaucuguaccuguaugucccauaggcacuucaaauucaacuuauccaaaauggaauucacugucuuucacuccaaaccugucaucuauacuccccauuggugugagggauacuaucauccccccaguuacuuaagaagaaaccauggauguuuaauucuuucuucccuuuuaaaaaauaaccuaucaaucaccaaguauugauucuaucuucuuaucgucuguaggacauaugaaagcauaugaaaauauucuaaaucagaagagugauaaaguuaaauuugguuccuagagcugugaacuuuauuuguucugcuaaugccuaacugcauaaugaaugacuuccacagcaguauagguuaacaaggaaaucgcuaaacucuuuucacauccgaaaucauacagguacagagcugccauugugaccagucuuuccaguuccuuuuaugaucccuuaaauacagacacugaaauggaagccauagccaaaacaagcagaaagggcuuuccacuugucuuuuaaaacucccuccuccuuucuccuucaauguauaucccaaagaaacuaugcaauaaaacucuuguuuaaaaucuguuggcuauucugaaaggacuucaaaucauagcaaauucaauuuucuacauuuccaguuugaguuauucacuuuagucucccuuuguacuucaaaaggagaguucucaugcuuaagguuuucauguuugugcuaaagcaauuucuugugaaauuaaguucauuauccaaacuaaaaacucacaagauaguaaaucuuugucuuaauuuccccguauacuuacaauauuagucccuaagauuugagaucuuuuugagaaucuuauaaaagcaacuggucagucaccucuucuaguaaaauuuauguaaaauuuucagugagcucauacauuuccauauauuaauguuuggaaucuuuaucaguuaaaguuuuuuauaucucugaagcuucacuugaagaguucaacucgaauuugaaauguaaaaacaaguuuacuccaaacuuguuuuauaugacuuggcuuauuuuuguucuugcgagacuggcugauaauuuauucucucuucuugaaagccugcuugcuauuuuaaauuuccuugaaagcaguauccaauauuaaaggcauuuaagaagcuuauuuccaucauguucaugaacaaaaucaggcuggaggacuuguagacuagcaggagcauaugagcagauaucuaagcccucuuuccaguaaaugauuuaaacagucaaagaaaaacaaaaauuagaaaagaucccccauuagcacuaaaauaccauggaauagugccagcugagaggcagagaguuuaaagaauuucuagagaaaaugcagaugaauccacauuaaaagucaucacuaagagcccaaucccagucccucuuuuaaagucaguuguggagugcuacagaaaauaagcagacugcuccaucaucucuuauuuggagggcaugggcugugauagacaaaacuaacaggacaaagguagacugcaguugaagcccuccacguuuguaccauuugagggagacaaagaaacacuaaacagaaacucaacaguaggucacugucugaguuacauaccuguguagcaggcucacccugacauaaggaagcugucuucccaaccaaaagguccccagcaucaaggacuaaaggcgaaggaggcuuuaggaaacauggguaugucuuacuuaaucacaaagcagccaaaggcagcgaagcuggggaaaggaaauauauacaaacucagcaaacagaaugcuuaugggcagcaggacccuggcgucacucaugaggaaagggagaggucccagugggauagagcuguuccccaaccagaugggcugaagcacuaacaaagaaaaucagacauuaccaaacuauaaaucugaacuagaggccaagacaaguaaaagagaaauacaaaggguguggguuguggggugggcaugaccugaucuuuuaagcaguauuuucaauagaaaaaaguuugucagugauaacguucuaaaugcuccauuaagauaauguuuucggcugggugugguggcucacgccuguaauccuagcacuuuaggaggcugaagcagguggaucaccugagguugggaguuugagaccggccugaccaacauggagaaacuccgucucuacuaaaaauagaaaaaaauuagccaggagugguggugcaugccuauaaucccagcuacucgggaggcugaggcaggagaaucucuugaaaccgggaggcggagguugcagugagcugagauccugccauugcacuccagccuaggcaacaagagugaaaaacucaaaaaaaagaaaaauaaaaaagacaauguuuugaauacucugagaaaauuauauuauaauuuuguggguacagauaaaucagcucuccuucaagaaugugugaauaggagaacaaaucagaauaguaccuauuggguugggggggacuucaacuaaaagacaaaaauaaacauguuacuuaauaguagaagaacacacuuucagaaaugauuugcuuacuguucuagaaauaaaucuuagaccucaugugccuuauccugacaaagaaaauuuucuuagguauucauugaaacaacagauaaaugauuaacuuggaaaacaggcuaaaauuaagaaguuaaggaaaauauuguuaggugacauaauuccacaacaaaauauaaagaaguauuagaacaaguaaaaaacagaauacugcaaauaauaaagcuagucaaguggagaauaaguugagauuuuuauuccuuucuuuuccuaaauaacucuuuguucaaagaaagcaaagcuuugaaauaaggaauuucugaaaauaauuguaauauguaagcaccucucaaaaugcauuggcuauagcuauaguauaacuagagucuuaaaacucuuuuauugacaaaacaaaacaaaauaaaaacaauuaaguauuccaaaucacuaauuuaggaaaacaaagcaaauuuaagcaaagaaaggaaaaguaauuuuuaaaaauaagagaauuaguuaauaacaaaauauauauaguaggcuuaauaaaucuaagaguagguuccuuggaaaauaaucuagugaauagcaaaacuaaggcaauuuuaaaaaaauacauacacuaacuuaguguacacagaggugcuguaccuacagauacagagaauauuuacguaguaaaaugccauguauuuuaaaccaauaaauuagaaaaccuagagugcaugguguuccagggaaauauauacugcuaaagucaucucaagaggagacacagagccuaaauaaacuuauaccuauugaaaauauucuuuaaacuuuucaaauuauccugcaauuauacccagagcccauugugccacagauauucuuuucaauuuuccaagaaacguaacucuuaaugucauuuaaauuuuauaaagcaaagaaaaagaagggaaaacuaacaguuuucuccauugguaaauuauucuuaguugagaauacuuuuucuaucaacuguaggccugauauuacaugaugucuaauauuuuuaggcaauaguagcucacuauucauuuaaauaucuauuaaguaccucauaugcacuaaggauucaagauucuuguccuugaggaagagagaugcuuaaaacauuuuaagaaaacaauguaauuaguuuucuaauguauguauguauguguguguguguguguguguguguguguguguguauauauuuuuuuuuuuuuugguuuguuuuuguuuuuugagacggagucucacuccgucgcccaggcuggaaugcagugacgcgaacucaacucacugcaaccucgccucccggguucaagagauucuccugccucagccuccugaguagcugggauuacaggcacuugccacuacgccuggcuaauuuuuguauuuuuaguagagaggguuucgccauauuggcuaggcuggucucaaacuccugaccucagguaaucuacccgccuuggccucccaaagugcugcgauuacaggcaugagccacugcacuuggccaguuuucuaauagauuauacauaacauccuuuagaaacauuaaaaaacaggggugggaggagacuaaauuugccucgaagaguuugggaugacuucacagaggcuguagauuccuuauuauaauuaaacaaaaauuauuuaaauauuucccaagacauuuccucaagguuguuaauaacggcccugauuugucuugguauuaccuaccguauggcagcauugugcuauguuaagaguuuagguagauguguuucccaaagccaggcacucccuucuguguaauguaauguauugguauacaaaacguaauguauuguauacaaagccaggcacucccuucuguguaauguaauguauugguauacaaaauguaauguauuguauacaaagccaggcacucccuucuguguaauguaauguauugguauacaaaauguaauguauuguauacaaagaccuuugucugacacaaagcacauucaauucccaagugauuacaguacuguuuagaacauuuuuaaaaaagaaaacaugacuuuuuuucccaguaaauacauagcuuaaaacccucuccuacuacuacuuccuuuuccaacuuuuggugcuuuguuuauucuaauguaauuauauaggccaaauaugaguccacauggucaauguaggaauggaagcagcucuuaguaaagcauaaucauauggugcucuuuuacuuuucucccaaaucuuacguaaaaaugucuuaaaggaaccaauuugaaauugauagcccuuuccaacucucuuagucacuaauugaaugacaaucauuauucauccaucacacauuuauuaauuaccuaccaugugccaagcacaguguuaggaaucaaaauaagaauaagagacaaauccaaguacuccagucuuuccagugacauuucuuaagacauuuaaaaauauuuggucagguauccaauuauauuugauaccuuauuacucauacucugcccuguuccaggaaauguuuauauuuccuguuuuuauuuugccugauguauaguuaacagccauuucauguuuucacaaugaaaucuuuauaacauagugcauccacuacuuuguugacagcaauucuauuacaaaacuauggaaagagugguacuuucuuuucauuaaauuauaaauaauaaaaggcaagccagauaugaaaaguaggcauauguugcaaaaugagggcucacuguggccacugaaguuaugauguuacuaaaaauacuaagugucauuuagaagagaccaaaaaaugacugccuuuaaggaaaacagaauuucagagaagaaaaauaaucaccaauguauucaagagcaaugaguaauuuaaaacuguuuccuguauuuguucaauaaaaauuuaauaaguuaugaaaaagaucaaaaaauaaauuugcgaauuacagauuuuuuaggguaguauguaguagugggaagcgaccuaggauuuagaggaccugaagcgugaacccagccucuagaaauucgcugcuucacuuuacagcagucaucucacaucucagaggcucaggcuuuucaaaggugagggcuagaaaaaaagagaacuaauuugacauucacauuauuuucagcaucaguuauucauuaacuaagauaaauauauguuauuuauccacaguuuuuguaagccuucuauaauaaguuaaaguauauuuaaguauauuuguaacucagggaacuacuuaauuguauauauaucuguguucacaauaugucaaggauuaggaagaagaugaggaugggucuuaccucuaaaaauaugcauaaauuuccaaggacauaaaaaccuggaagacagaaguugguaaucuaaagauuccggaggggcuggguguggcagcucauucccauaauuccagcacuuugggaagccgaggcagguggauugcuugaggccaggaguuugcgaacagccugggcaacauggcaaaacccugucucuacaaaaaauacaaaaaauuagccaggggugguggcaugccccuguggucucagcuacucuggaagcugaggugggaggaucaccugagccugggaaguugaggcugcagugagccucaaucaggccacugcaccgcagucugggcaacaggagugaaacccugucugaaaaaaaaaaaaaaaaaaaaaaaaaagguccuggaugaagauguucuguuaaugauaccauuuuaacuguauuggcacuaauugaauucuagccucaacuugguaaccuucuauuacuuuauacuuugcuuaguacaaucuauaauuagcaguccuuaaaaccccucaguaagguuaaguuuaaaaaaacacaacucucacaaauaagcaauacuuccacuuguggaacuguuugauuuaaauguuagcaacugauaauuuuauuuauuagaagcuacaguaauugagcacugaaaugggaacaaaaacaagcauagcacaaaugcacccccuauuguauuauuuacuaucauacaugaaaauaaaguuauacuuuccuuaaacuuuuuaggaaacaccuugcauuagagcaacuaaaauauauaagcgugaaccacuccaauagaaaacaauuccuaaauuacacauuugugggggaagugaugccuuuuuuuugaagaagagauaauuuuguuuaauagguuaauuuauccagcuuuaaaaaauguaucaaguauaacauuucuaaauugaacucuugauuuacaaguauuuaaugauucagacagauaauuaaagggaauucucaguccucaagggguugaaggauucaacaacauggauuucaaccgugguauuaucaaguaacucaagauguaauaaucucaagaacauaaauuuaaaacuugaauauaaaacaagacauaagcacuccagugaagucaaucuuuuuucucauuuugauuaaaaguaugaccuggggccaggugugguggcucaagccuguaaucccagcacuuugggaggcugaggcgggcagaucaugaagucaagagauagagaccauccuggccaacauggugaaaccccaucuuuacuaaaaauacaaaaauuagcugggcaugguggugugugccuguagucccagcuacucaggaggcugaggcagaagaauugcuugaacccggaauguggagguugcaaugagccaagauuguaucaccacacuccagacuggugacagcgugagacuccaucuccaaaaaaacaaaaacaaaaacaaaaacaaaaacaaaacaaacaaaaaaaaacagugugaccugggaguuaaaauuaaacauaugcuuauaucagauccaguucauagcaaaaauucacaaaugggaucuaauuaaacuaaagacauucuucauagcaaaauaaacuaucaacagagaaaacagacaaccuacagaaugggagaaaaauuuugcaauuuauguaucugacaauaguauccagcaucuauaaggaucuuaaauuuacaggaaaaacaaacaaacaaacaaacauccccauugaaaaagugggcaaaggacaugaacagacacuuuacaaaagaagacauacaugcggccaacaaacauaugaaauaaagcucaacaucacugaucauuagagaaaugcaaaucaaaaccacaaugagauaccaucucacaccagucaggacggcuauuauuaaaaagucaaaaaauaacacguuagugagguugcggagaaaaaggaacacuuauaugcuauuggugggaauguaaauuaguucaaccauuguggaagacaguguagcgauuccucaaagaccucaagacagaaauacuauucaacccagcaaccccacuacuggguauauaccaaaggaaaaaaaaauuauucuauuauaaagacacaugcacacauauuuucacugcaguccuauucacaauagcaaagacauggaaucaaccuaaaugcccaccaauaauagacuggauaaaaaaaaacuguguuauauauacaccauggaauaacaugcagccauauaagagaauaagaucauguuuuuugcauggacauggauggagcuggaggccauuauccauagcaaacuaacauaggaacagaaaaccaaauacugcauguucucacuuauaagugggagcuaaaugaugaggacauauggacacagaggggaacaacacacaccggggccuaucagaggguggagggugggaggagggagaggaucaggaaaaauaacuaauggguacuaggcuuaauaccugggugaugaaauaaccuguacaacaaacucccaugacccaagguugccuaugcaacaaaccugcacguguacuccugaacuuaaggaaaaaaguuaaaaagaaauaagccacuugaugguauggaaaaagauuuccauaaauuuccuuaaaggagggacuugaagaaacaagauggaaauuaauaaauuguaaguuaaaaucuccaacauuuauuuagaaaaucacagucacaaagugaaggauaguagagauucauucaucagcugcuugccugaaaaaaagacaaaaaccuuugcggacuaacuucaaugugauuaaaucguacgcucuuacuaucaaaaaagcaagugugcuuugagacuguauuaauagaugugcaguauccaggcaauuagaagagagcccuauaaggauguaaucauguuuaagauaccaaacaccaaacuuuaauauuuaagggaccaguaaguuauaaaugaauccaacauucuuuaauaaagaguagaagaccuagagugacagauucuugcucaacuugcucucaaacuucucuuucuacaguaaaacauuuauguucaucaauacuauuggaauuagaacacuaaacauaucccuaaaguuuccaaauagcuaaaaccucacaacucucaacugcaacacauuuaauuuugguaggacacuuuagugaaaaaaaaauguaaguaucaaauguucugcaaguguuaauuauaauuaaguaucucugagguucaagcucuaauauaguguaacuucgcaaaugagacuaucauguuuugacacuugaaguucugacuacucgacucccacacugauguaccagaucagugaguucccaaauauuaccacaaguauccaauuaggugcuagacuaguccucuuaggaaugcaguaaagaagguuccugcaugguauggaaagggaauguucauuuuuucagccuacaaggcauauuuuuuccagaugauaauaauagcaauuuuguaaacauucugauucucauaaauuuagaaaacauuuucuugcccuuauuuucuggcuacugcuucuuucuccauaacuuccuucugucuccuuuaacuggucucaaauauuugauguuagcauuuuauaacauauuuuaguuucugacuuagguuaauuaagagaaauaucuuccauaucauuaucaaaagcuaaguuuuaaaaaauauauuuugauaguuuuccuuuucauaggacaaugacaccuucguuaaaucaaaaagcauuuauuuauguauuuuauuuauuuauuuauuuauugagacagaguuucacucuuguugcucaggcuggagugcaacggcacgaucucggcucacugcaaccuccaccuccugaguucaagcgauuccccugccucagccucccgaguagcugguauuauaggcaugcaccaccacccccagcuaauuuugcauuuuuaguagagaugggguuucaccauacuggucaggcuggucucaaacucuugaccucaggugauccacccgccucggccucccaaauugcugggauuacaggagugagcuaccucaccuggcccaaaaaacauuuauuaaauacuuacuauguaggcauucagagaugcuuuucuacguugcuacucuaggaagacuuacuaauaaaauaaacaucauaguaauucuaauuuuucaaaugucuaaaaggugacucacuuucaaaaaauaaaacuuuuggaaaaacagaaagggacaauuaaaauauaaauuaaaaaacaaaacuacucuuccuugccuuacucugaaagugaguaaagggaaaaaccuuucagagaccaucugguuuuauauuucauuagugaauauaugauuuuauuuuguucuaaaugaaauacacuugaaaugccuaaauauuuaauucuacauuugaugugggaaguguauuuacuuuccucuauagcuauggauauuaagaaucacuuuuuacucuuuggucagggaaccuaaagcuuagaagucuuuccuaaaaugcucucuagagaucuacaguauuaguuuuucccugcaagccugcauccauucucagccacaucacaaagcaccuggacagcacucucaaacauauggccuccuacaagagccuacauucuaaaguccacugaccacuuucugcuucucugacagugaaaaacagaacacaaccaaaaacugcuggauaagaaaaucuauaaucaaugauaaacuucucauaauuuucaaaauauuuucuguauucauguauuucucacuaaggucuugagcauguuuagucaucagaaauuaucaccuaauagacaucaaauaucauucacaacagcucucaaacuucucuuucuacagugaaacauuuauauucaucaauacuauuagaauuagaacacuaaacauaucccuaaagucucuaaauagcuaaaaccucacaaaucucaacugcaacacauuuaauuuugauaggauacuuuagugaaaaaaauguagguaucaaauguuccacaaguguugcuuauaauuaaguaucucugagguucaagcuccgauauaauguaacuuugcaaaugagauuaucauguuuugacacuugaaguuccaacuacucgacucccacaccucuucccuccacuuagugggcaagugcuguaucuauuuuaagaaguaggaagaaguugccaguagggggagagggaaauaaaacauaugaaaaagaucacaaagucaaccucuucuuuuaaauuguaugauugaaugccuacuauguaaccagauacuguguaaaauauuaguaauaagaagacaagaugcagccuuugcccuaggaauuucagaaucugcaaaggagacaagcauaaacaaaugacuacaguaaguaggauguuugaggaacaacagugccacaacaaauaugaagcuucccuuaugagaaaucugagcuguguaguuaagagaaaagggaaguucaucaggagaggaacagcgguacaaagguucaguguguaaaauacgaugucacgguaaagauuuacaaaucugaagggacaauauaguaaggaggaauuugaagaguaaccaggagccagaucaggaauaucaagcauagaguuugaucuacuuucuguaggcugaugguuuucuguacugaguucuucagauuccuggguucacagagcuauucagggccacucugaaaaggggauaaguagguguccccaagaauucuacaucacaucuauuuuugcauuaaccaaauaaacuccauucuaauugcaaaaacuucaaguggugagguggggagggggaagcuuccacuccuuuaauaaagucugaaauggguauccauaaaagaaaggauauuaagaagggguauagauggucagauuugcacuuaagaaugggcauacagagguacuuugaacugaucaucagaaaaaaaaaaaagaacagaggcagagggaacaauuaggaaauaauuuauggaaguggugagaugacucugaagaaugaaaagaauggauaugucuaaacuguguuuugggguagagguggaaaaauaugguagaaguucuuggucuacagguugaaugcucucaaugcaauaggaagcaagcuggugagcaggacuuaaggaaggguauugugugugagugugcacaaguaugugcacguguacaaguggggguaggagucaagaucuugagaagauggucaaaauauuuuaagaaaaguccccaagacuccuaccaagauucaaggacuauacguguccuugguugagaauuacaaaauugcuacgcacauagacaacauuauagucagccccccauggguauucauggauuccagcaucuguggauucaaucaaucacagaucaaaauacucagaaaaaaaauggauugcuguguuuguaaugaacauguacagauuaauuuucuugucacuauucccuaaacaauacaguguaauaacuacuuacauagcauggacauuguaguauuauaaauaaucgagagaugauucgaaguauaugggaggguauauguaaaucaugugcaaauacugcacuauuuuauauaagagacuugaggauccacagauuuugauauccaugggggguccuggaaccaaucucccacagauacugaaggacaacuguaauuauaugaucauagauucuucuagaacaucauuacuuguuuuucuagucuuucaauauuaaaugagcuaagaaaauccauacuauuuucacauuuugagaaaaaugucuggucagauuaacaucuguaaagaugaauaaacguuuuuagugccuguauuuacauugcaauuuucuuucagaauacaaacuguuuucacuaagacucuuccauuucuacuuaaaagauccugagaucaacagaggcagcugauauuucaccuuuugaugaggaaacugaaacacaagaauagugaaaaugacuuucauaaggugcagucuauuuuagcaugcuuuacuuguucuaaaaucaaaggacacaucauauguggauaugcauuaaaugcaaaaaaugcuauacagcuauuugugaauuuagggauugccaagguugucagauaaaugccacaagaaggucaacagucuuguuuaauucagucucuugggacacagagacuacugauaccacucugggccuuaauauauaugcaagacaccauguauaagagugguuuugcuuucacauaguugaguuaugacuuguaucauaccauguggcauguguaauggagagaguaaagaaguguauaaagaauuguaaagcuacuguaaauacaugucugcucacuugcuagguaauuauauuuuauuagaauaaaaaacaacugauaaguaguagaaaaauugaagaguacaguuugaagagcacuguauuaugaucucuaaggucuauuuuuucuuuuauaauccugugacucaaagaauaaacugcucaggcuugcuagaacaaugacuauggauuuuaguucauaagaaugaccuguaaggaaguaacaaugaagucuuaaagucuaaguauuggcuuaaauuugaagagaaaucaguagccagaucaggaaaaucaagcaaagagugugauuuauuuccuguagggugaugguuuuuugggccaauaagaaaagcuauuuuucuucugaaagauaaacagaaaaauaguacaacaguagaaauaucauuccuccuuauacuacugaaaagauaaaaagauaacauuguaaaucaggaaacuucaacaaugacuaaaggugggagaaagugauuaauuaaaucaagaagacugaagcuucuaaacaaguuagaucuguuucaugagaaaggguaaaauguguauguuaauuagaaaaauggcuacaagagagugcuaacaggcaagucaaaccuucuaauccuauucuccacaagcaagccagcaaaauacaaaccacuaauacuuuuuuauuauuuuuuuauuagcaggaggagagucucaguauggagaccugggcuagaccaaguuagauacuagcuagaggcauggcuauaaagucauguaacaucucuggguauccuuuuuccuuccacaaaaugaacuaauuggacuagcugaugucuaaugguuccaaaucaauaauuuuuugauucucugucucuccaacuuauuauaaaaauacaaaauuuggauagcaaacaacuuuuguacuauguuaguauuacacggauuuaaugcauaguaaaaacagcucuuagaaacuuaauucagccuauaugacaaauaucaaaugaacuuuaguugccuuaagaauaucugcaucugauugucuuaacugacucaugcugaauucaaacucauaugucccaacuucccuauuucuuuuaauaccaacacguaauuaaucauuuugaaaauuuuagagaaaucuuugacuccucucuuuuaucucuuacgugcagucagcaaauaaauccucaugauuuuuccuuaaaauauauaaaaucuaucuucccuucucucuuaacaaaauccauuuucaauuuaucuccuaaauuacuccaacuacugccuccauuuccuuauuuguuuaaauuuguaaaaauaaugauauagcuaaauacaagaauucaccuuucuacucaucugcucuaauuauuccccaauauuuucaggauagcaugcaauaaucuuuagcuugacuuuaggauuuuacuaaauuuggccuuacccugcuuucccaucuucucucuauuugccaacaugaacuuuauacaaggucgccuuuuuccugcuucccacuugcccucugccuggcccauuccugcccuaaaggccaacauucuuauuucacuccauuucaugcuguuuccccuccacuucucuccacugggaugucauucuuuguuaucgaucccaauucuuccuguccuucaggauccaggccaugcccugucaccuuccuuugugaagccuccucuguuauaguccagauggaccuugcuauucaacuuccaaaguucuuguccauaucacuuacuuaaguguauguguaaauauuuacugauguauaagauacugugauucuuuuuaaaucacucugcauaaaaccuuuuacuacuccaggucuuuuggcuguucuccacuaccugcaauuccuucagauaacuucauggcuuguuuuuauaucuuuaucagauuuuuauuuaagacauaaucuucucuugaagcugccuuacuugacuacuauaucuucaauuacuaccuaacccugccacucaauuuccuuuuucugcuuuacauuuuuaaaacuuagcacuucuugguauuuacuauauuauacauuuuauuuuguaugugucugucucuuacucuaauggauucuaagcucaacaagggaagagauuuuugccucuuacucauuaaugccacucuaguuccuagaagagugccugguauuuggcaggugcucaagaaauauuuuugaaugaauucauauuucaaaaacuaaaagcaacauuaauaaaagugguuaauaauaaaacaaauaccaauauaaaauugagaacuuacuauauguugggcaauguacagguaaugcauaaaauaauccuguuauuaucuauuauuaccuacuuucuucuuugccauuuaaagcagggcuuacagagguuaaauaauuuucccaagaacacauuccuaauaaauguacuaaaaauaaacucuaggcuuauuugcuauugaaaauaugucaagggcugagcuuauccaacuguaaaaaauuaaaugcaaaacaagauuuuugaggagauaugagggaagaacuccucagagagcuaccuguaaaaccuuuucccucaauggcuaauauuuuaauuuguugucuucguuuuuuuuuuaaguuaucuuauaauuuuccauaaacuucugcacuuuauuccuuacccaggcuuaacguucaagaagagaaaaucuucugacuaauguuaugacuucauuaaggaggaaaauuccaucuuaaaaaugcgcucucaguucucauguaaaagacaagagcagaaugaguagucacaguucucacagagugagguaaagcaaucaucaagggaggaggggaaaaguaaagaaugcuuuauucauaauuaccuaagauuuuccagcaugagaggggaaagaggaagucuauuuucagugacaaugauuacucuaaaaauauuaacaugcaaggggaaaauuuucauucugagaguuacuacuauacugaguucucuuucccucacagagugacuuaaaauucccaagguagagagguaaucuagacagaugcgcuugcccugugucuugaaaauggcaacauccaggaaucaugggaguucaacugaggacacacuggaaaggauuucucagcaccagaacagucucugagaaguaucaaguggcagaguggauacuuauauccucaggugucugcaguaaggcagagauuagagcuauacaggcuuauuagaagauuuguuaugcugaaugcauaaacaagauuuagugaaacugaagcugaauuaccuacuaaaaggauuauagacaaaaaaaaagccuaauucuuccuuuuuucuaucuaauccagagucucuccugcaaugucucuauaauuuuaacugucuuauauaguucaggcaaaauuauauauuguagaauucauucucaucuucaucuuaaacauuuuagacaaaaauauauuaguucccuacuucuauacaugcauauaugagaaaauggucugacaacccuuagguugggacacucagcaggucauggcauucagagcaaauugauuuuuauuaagauaauuauaagaacaugauuaaaaaaguauuuuguaucucccucuuucuuuuguauuuucagaaaaucauaugaacugggccugggggcaugcaccuguaaucccagcuccuuaagaggcuaaggcaggaugauggcuugaacccaggaguuucagagcagccugggcaacauagccagacucugucucuauccauuaaaaacaaaccguauguaaaaucacauagcugcuccugagaucugccauuccauaauuuaguucucugcuaguucuauggcaccaaauugucacaagacugacuagccaggugcaggagguacucacuuuucagaucagcaaguaaccacaaauaccauuuauuugguccuuaacaagauugagacgaaguggcuacaagugaagcaaaauggaggcgauaaauacucuaacaacugguuauagauaucacauuuucuuauguuuauaguuacauuugaauaauccuuaccucuuuuuaaaaacuccauagacauugagaauugauaaaaaucuaucuuucuccagaaaaauacagcuauacauaagucaguacacaacuuuaguaaauucacaaaucuuaacaaucuaauccauguguccuaagcauagacaauaaagaaaaguauuugagagggugcaggguaacuugaaguugaaguuugggagagagauuaccauuacauuaggaauaaauucauacuugacaaacaagugucaacugucuccacugucuuaccagcagcucagucccuuacugcucuuccuggaucauguccuauuggcugcugcugagcccaucuccugcuuccaagcguuguaacucaacaggagcaaaggcaaguaaacaaucuugagagggugugcugcugaauguuugccagccuagagaagacagaguuugaacauuuuuaaguuagcaaaaaggaacaggguauauacaccugauauaaagaguuuaaaagguuuuggauaccuauaauuggauauuuccauuacaguguggcuguuaaaaaacuuagagaaucuuucucaaagcaaugacacucucaaauguaccauaauaacaauucuaauaucuguagaacacuuugccaugcccaaagcaucuuuagucuucacaucuucaccgcaauaaucaaugaggcuuaagagccaguggcuuauauuacuucaucuguugaauccagugguucacaguguggcuuacaagaguaucaccuagguaagaaguugaggauuuugcucagagauucugacuuguugagcuaagaggaaacuuuauucuccaggugacuguaagaugaagucaggauugagaaucauuaagucccuguacuucaugagauguggcacuaacuaaacucauaaauagcaagcauucauucaguauaugccaugucaagguaacaugcuaagugcuauggaaaagguaaaacauuauaacauguggucucugugcucaaggguuuuaauuuagcuggagagacuggacauauacuuuaaaaggaccaccuaauaagauaccuacuuuaaaaacauaacccaaguaagacuuaauuggucaaagauguaguaaaaauauugggugcuacaaauaaguggagaugacaugcacugauaaaagggaguagguuaaaaacaugagagaaguccacagaguuccaagggcagagagaaaagaggaauggggagaaagcguuguuuugaggcacagauacagcugcagcaaauuggaggagauuaaaaagcucucucugacugaagagugucuacaaaggagcacaagaagacuuuggaaagaccgauuugaaacagaaucuaaagaguuuugauaaaauggcuaaaggaguugguccauuguccugaauauauggaaacaguauuggaauauccugaaauaguaucuggaauaguaucagaagcaguugaagcucagguucccgggguucuugguaaaugccagacacuaugcuagaugcacuacauauguuaccucauuuaacacucaaaaaaaucugguaagaucauuauuauuaucauuaucaucauuauuauuauucccauuuuacagaguaagaagggaggucucuuaauuuuuucucaaagucacaugccuagaaauaguaagcugagacugggacacguugcuucuuuagaaacauggcaucauaaaagccauacguuaaaauuuaagggguguuuugagauauaauucacauaccauaaaauacauccuuguaaaguauaugagucaguggguuuuaguauauuaaaaaaaauuaugccacucucaccuaucauuacuaucaaauucuacaauauuuucaucacucugucccccucgccccaaaaaacccaguacccauuaggagccaguuuucauucauuccucccccgggccuuggugaccacuaaucaacuuucagucuuuauggguuuuccuauuuugaacgacuuuauauauauaaaaccauacaaaauuuggccuuuuacgucugguuucuuucacuuaguguaauguuuuuaaggugcaucuguauugcagcaugugucuguacuuuauuccuuuguaugacuaauauucuacuguuuugauaugccauguuuccuuuagcuaucaaugaugaacuuuuggguuacuuccacuuuuagccucauaaauaaugcuucuuuggauauucauuucaaacuuuuuaauugugauaaaauguauguaacaaaguuugccauucaaaccauauuuaaguauacuauucuguggcauuaaguacauucacauugcugugcaaccaucacugccacccaucuccagaacuuuuucaucuuccuaaacagaaauucuauacucauuaaacaauaacuucccauuugcuccuccucccagccccuggcaaucauuauucuacuguaugccucuauuaauuugacuauucuaaguaccucauguaaguggaaucauaauauuuuucuuugugugauuggcuuauuccacuuaguagaauguauacaagauccauuuauuuucuagcaugugucagaauuuucuuccucuuuaagguugaauaauaguccauuguaugucuauaccacauucuguuuauccauucauccaucuguaggcauuuggguugcuucuaccuuuaggcuauugugaauaaugcugcaacaaacauggauauacaauguuuauaaguuuuuguaugggcauauguuuucaauucucuugagaguggaaucccuaagagcgaaacuacugggucuuaugguaguuccaugcuuaaucuuuugaugaacugccaaacuguuuugcaaaguggcugcaccuuuuuacauuccacuagcaaugugucaggguuccaauuuuuccauauccgcacuaacaccuguuauuguauguuuuaaaaauuauauccaucccagugagugugaagugguagaagauuuagguguuauaaauaaucauaugcaagauauuggcuuauugcaguacucaaguauaagcaauaguuggaaugagaggguggcagaauaaaugaaauaaaaugaucaaacagaaauauuacugauaaagaaaugaauggcauuuaguaacauuuuaaauguaagaagaaaaaagaaauucaauuauagugauaaagcuuuugaguuugguugucugaaagaaugaugcuacuaaugagauaaauagauaauucuagaaaggaaucugaaaugacaaauucuugacaugaugcauuugaaaaaacuuauguauuccaaauaaauauucaucaggcaggugaaguacaggaggucaggguuggagucaauaggcuauuucauuuuucuuuuuaaagaaaugaucaaagaaacauuauuaagauuagaagaggguuauugccuguauaugauuagacucuuaaaucugaguucagcaacugacaaaccaaauacugaggaaggcagaggaguuuuuaccuucuguuuucuguuuaaaauaguaaaacaaaacuuaaaaaguaaaaaauauaacuuuauuaagcuuuauagaacuuguuuuuaucagaauuugaguugguaucacauuuuuaacuauaccaagguggugcuugugguucuuggaauggugugagcaguucuagggggauuucccucucugagcuggcacaagauugggaguccuggaggacaugagugucacuaccagcaguuaucugguugacugggaaucaagcuggcaaacuaucaaggagaaaccaugaauucuaguuuuauaugcccaaaacaguccccuuuaguaaaaagaggugauccccaacaaauagaauagucucuugcuagaauauaguuccucaguagccaauaauucuggcuuuguucagcuuugcaaagucuccaauaugauaauauucugauaaauacagugaugacucacaggcuuauauacauguuuugaaagagaagcuuaaugaugcuauuuuggaucaugaagccaggccgcgguggcucaugccugcaaucccagcacuuugggaggccaagguggguggaucacuugaggucaggaguuugagaccugccuagacaacaugaugaaaccccgucucuacuaaaaauauaaaaauuauccaggcaugguggugcaagccuguagucccagcuacuggggaggcugaggcgggagaaucgccuccaggaggcggagguugcaauaagcugagaucgcaccacugcacuccagccugggugacagagugagacuccaucucaaaaaaaaaaaaaaaaaaaagaaaaugcaaaauacagucagcuuauacacugaguuuuccuucugccaugauacauugagaguuauaaaaaaaucacuuagaagauaaaacggaacaaacauaugaaggguagugcugaagacagagguuaagauaagggccaugaaggggguuaaagaaaaaucuaagccgaugagcacauuuaaauguucucauucccacacacauaucuacuguuguuuuuguuuuuuuguuuguuuucuugagacagggucuugcucugucacccaggcucaagugcaguggcacgaucucggcucacugcagcacugaccucccagacucaagcuauccuuccaucucagucucccaaguggcuaggacuacaggcauguaccaccacacccagcacauuuuuuguuuauuuuuuguagagaugaggucucacuauguugcccaggcaggucucaaacuccuaaccucaagugauccaccugcgucaaccuuccaaagugcugggauuacaggugugagccaccacgcccagccauaucuacauuuuuaauugaauaaaauacacuucaccaucaaaguugcaaucauuuugagcauaauaucauuccuaaacauauuuuccuuuguucccuaaauugaagccuauucuauuuuaucuuuauaaacuauucacuguucuauuuuuauuuuuuauuuuuuagagacagagucuugcucuguagcccaggcuggagugcaguggugcgaucuuggcucacugcaagcuccgccuccccgguucacgccauucuccugccucagccuccugaguagcugggauuacaggcgcaugcccccacgccuggcuaauuuuuguauuuuuaguagagacgggauuucaccguguuagccaggauggucucgaucuccugaccucgugauccgcauaccucggccuccgaaagugcugggauuacaggcaugagccacugcgccuggucucacuguguuuuagaaagguauuaucuacuuuaucugcaauauuuuccaaauagauuuagaaaaaaaagacaauaaaaauagcuaaaauuuauugaauggauucuaagucaucuaauuuucaaaauacuaucaguuguuuaccuuagcacacccuuuguggguggcagggccuccagagccugugcucuuauucaacaugcuucauggccuccacaagcuuguaggagauucagugaaacauuucauuuuggggaaagguaaauaauucuacauuucaaagccuagagacagacaaguuuucguucaaaaaugaaggaaaaaaaaaaaccucuucucuaaaaaccagucacucuaccuauaaacaugaauauaucauuacaagcuaggcaccuuauauaagaauccuccauuugggguuuaaaugcauuuuccuuucaagagauagauccaccauugaucaaacaucaucaaacacuuccguuacaaaaaagggacuuuguuuaucaugcugaauuuaguccuucccuucccuuugugauauuaguacaccuucauggcauguuucuucaaagccccaguaauagauguuuccuuccuguugaaaugcugcuuuggcugcuucugugcuugaugugguucuccuccagguuuaaaugggaugagacuggaguucacuaaucagcacguuacucaccucagcaggauaugcccacaaaguguuucuccuauucuuauacacaugaguacacacauaaauacacacacacacacacacaccucucugcaaguaaaugauuccaacuguacagugccuaaagggaagugcuauuucagaaugucagcuacuuggcagugauggcuauucuccuguuaaugcuuuaaaaaaccacuacaguagucaaaguuuuaagaagaaaauuaaagaccuuaaauguauucacuuccugcuccuccuaacauagacaaaguggugacucccaguaaagaacucaguguuugcagaacaaauuccaugaagauaaaaacaagcauacaccauaugagguuguuucuaauuaacagucuuuauauaacuacgauagccaaacaaggcugaaauaucaaccaccaguuauaaacaauuuaacauaguauuuccauuauacaaagugauuauuuaagaaccaaacacuggaacaugagagguacagguauaaauucacaaggcauuguguauagauuaucagaucaauuuauauaguuuccgaaaauaaaaagaaguuaugagggaauauuuuuuaaaauaauagauauuuuuaaaaaccaagauggaaaacauuucagaagaaaauacccuauaaacaucacacagaaaaugcaaaaaaaaauucugcaucugaaacacaaacuuuucacgacauucugacacuggcuaauacuugaccucacuggucagagacugggccaaugaaggaugugcucaaaaucuuaacuuugaaaagccucuuaaggguaugguuuauuuuucauccacuaaaauagaaaauauaauucucuacaauagacuuaccauuccuaacauccaggcauuuuagagauccccgcuagaaauuucaaguaguauaggagaagaaaggagugaaaggggaagaaaggggcaaagaaagguaacuugcauugauuuugaugcuuuaauagucauuuucuuuuucuucacacaaggaacuucagguauuugugauuguauuugcgcggcugacuacagggcaauaauucuauugggagcuagguuuuuagcugaaucucagaaugucucuccuguaacuuccauaaacccacaggcaaacuaaggggguaggcuguagaagagauaacaaaguauaaauuaaucuuggguucuaauucugacucuaauccuccauaaauucaugaucuugagccgaucacuuagggaaacugaggacuagagagccuauaagauguuaaauuguauuauuucuguuccaacccagcuuuaagguuuuaugauuccaugauuuagauacuaucgaauuugagauaaaaaauauauauaggaaaaagaguuauugaaaugaauagguauaaaaacacaagcaaaauuauauuaauggaauuauucuaagucuacuugugugauauuaaguuuauaaaaggauaucccuuacauuguaauauauaacuauaauugauagccacaauacuuauuauugauuccaaagcaauuuuuacaauauauauucuauuccuuauauuuaguaauuuaauauuacaaaaugauguaaugguuucuggggaguaaugagucuacuaccaugguucucuuagacugaacugcuaauugcauccauuuaaaacagccacagauugaggaucaauaaacugguagacuuuaagugcuuuuuaaaaacugcuuccaaucuauagcauuaacccagauauuuuaaaaaugauuuuauuuuucguauuuuggggggauaaguauuagguauacaugaacccuaccuuacaauuucuucaaaauggauggaaagaaugaauuuuuaaaucacuuaugucauaaauuauuuauagcccaaauaucuucaucuaaggaugcuuuaagucauaugaccuauaugagcuaagguuuaaagacauuacauuaauaucaugaauauaaacaucaaaggaucaauuauaaaaauucuaaugcuuaaugggauggcaaacuacaaaauaaaauuuuacacuauaguauaaagcugcugacauuugaucagucacuauuuuuaaaaaaauuccuucaguaacaauauucucuaauguucauucuaaaaauugaaacaaggaaauuuuuaucuaaucuauuucuaauagaaaggcaaauaaaaaauacuuuuuuaaagauuucaaaacguauaggaaaacucugcaguuauguuuaccugguuuguuaaaaacaaacuaugcauucugcaaaauugcaagugucuacuuuuaucauaagguaaucuuaaaaguaguuuaguaaacaucaaguuacgacaaguagacgucucccuuaccacacaggagugauaaucaaaauauuuaacagcucauauguccaggcaugagacauagugcuggaggaggauccuagaggaaccuacaugccauuuauuauucuagcugcaggaugguggguagacccagggaguaauggggaaggagcuauaguggcuuaggguagcagaauuacuagcuaccuuggaaaucuuucaguaaccaucagcacagccacacucaugugcaccugcugccuaucagcucugguuguuugcaugauucuuaaauaagggauaaaaaaguauuaagcaacuguuacaagucuuugcaaauuaccauuugucacuggaaaaaaauguaacuauuaacuuugguuguagccagagaacaaaugauagggaaaauuugauaaaagaaauaaaaauuuaaagaugcaauauuuaaaaauguuuucgaauuauacauaaaauuacauaaaauauuuucauaauauuaaaauuauauaaaaaugaaaguaugagguugaacuuucaaguaauaaccgagauaacagaauuuaaauacacuccucccuaaauaaagaaaguaguauaaaaagcuauaaauucaaucauacuuaagguuggaggguaauauaagugaaucagaaauccaaaugaguauuuuuauaacaaauugugacauaguauuuuucaucaaaguaacucauuaucacauuaaacuggauuuucacaucuucgauuuccuagaaggggcuacacuauugcuacuuacaaguugauugccuaugaauaagcauaucauaaugcucaagaaauagcauaaguaaaaaauauuuggggcagggguuacagauguaggagauuguacagaauuacacauuuuaaagaaguuuuaaaccauuuuuuauuugcuagauuuucuaagugaaauaucugaaucuaaagaaagaaggaauuuguuguugauuguccuguguuaaaagggauuaaagucgcuuagcaaccucuguguuguagaaaccaagauaaaagaagagucgguugucuaucaccagcucuucuaagauggaagagugcaaguaaauagaaaagcacuauuucugcaguggugcuuugacauacauucuucaucacaugacaaaauaaaaaucaucaagaaauucccaggaaaaggaaaauccucaaaaagcauauugugacuaaauggagaauuuacaaaccacuacuauacagacacacacaaagacaaacacacacaauaacaaaagacauggccaaggaguauauagaucguagcugagaaagguagacugcauaguagaaacuuuguuacaaaggauuuaaaauauucuagauagaaauauaaaugagcauaagagugaugauuuacagaaucagagacuauuuuuaaacuugguuuuauagaggcaaacaaggaaugaagauuaaacuaggacaguacauaauuagggaaggcaacuucacauggagggauauauuugaggauuugaguuaaaagaaagauaaaagggccagaugcagugccucacgccuguaauuccagcacuuugggaggcugcgguggguggaucaccugaggucaggaguucaagaccagucuggccaacaucgugaaacccugucucuacuaaaaauacagaauuagccaggugugguggcacaugccuguaauucuagcuacccggcaggcugaggcaggagaaucgcuugaacucaggagguggagguugcagugaggcaagaucgugcuucugcaucccagccugggcaacagagugagacugucuccaagaaaaaaaaaaaaaugauaaaauggcaauaucaauuagaacgugaaauacuguuugugaccauggagaucauggagaauauuuacguuuuagaaagguuuuuuaagugucaugagauucuaaaugcaguaaauaagcucugaaauaaacauaauuuugcuuccugguaaaacaaaaaaagauaaaacuuaaaagaacucaauaauuauagaacacaauuguauauauuuuaucuaucuacaacagccgagaagcacaggcauguaauaauuuguauuuuccuccauguauuaaugacugagauuuuggaauaugaggaaguauuuuuagacuaggaaugaaucaaaucaccauuuuaauguuaucacugagcaaaguggaguuuggcaaaaagaagccacugacucugcauuuagagaagcuugucugaaaaguccuuuaugccaaguugacucagguucauaggccaugagaaaucaauacugaaaguuuugucauugauuuuggaugagaaacaaagugaaggcuggaacaucuaauuccuuacacuugaagaugugaaagugucauuucuaugauaggucaacagccagcugaccagaaaggcauaacuacuguaaccuccaagaaaaaaaacagugaaagaagggagacagacaaaugaacaacccuuaguaggcacauuuuauuucagcucaguagccauuaaaaaccagauacucugcaugcuagaaaaacuuuccucuugggcaugacaaguaauacuccagaaccuaauagugggauaaacuuaaucaugccucacuaggaaugcagcugcuuuagaggaucucacuguagauagucuuccagugggaugucaaucuucccucaaacaugugccacugaaaugacuuaauacucuagugguuuaugccaggucaggguacacaggucaccuagagagccaugaaugaagucaugcauuaucagaaagcaggucagaggugacacaaaucaucuaaguguaacagcugacuacaaauuacuuucuauuauaagcacucauuucccaaaugaagaggauauuuuucauuuuuugaggauagauggugaaaaaaauccucacauaaaaugaaacaagauuuuuuaucuugaauaguuugagaaaaaggauggagucugucuguagguacaugaauuugccuuguaggcuuugcaguaucauuggcauugaaugaaggcaacugaauuaugcccauggacacucauggauaucccccaucaccuccccuauuucuuuuaaugaaagauuuguguugauucuucauugcaaacaagguugugggucaauuaaggaggagacaaaguuauuuuuccuaaccagaaauuggaaaauggaggucaaaaagacaacuugaaaugaaacacuauagcaccccauaaaagaaaagacauaguuuuaucacugauaugguuaggcuuuguguccccacccaaaucucaucuugaauuauaauccccauaaucuccauaauacccaugugucaaggcagagaccagguggaaguaauuggaucaugggggcaguugcccccaugcuguucucaucauagggagugaguucucaugagaucugaugguuuuauaaguguuugguaguugcuucugcguucauuucuccuuccugccacuuugugaagucaccugccaugacuguuaaguuuccugagaccuccccagccaugcuaaacugugagucaauuaaaucucuuuccuuuauaaauuacucagucucaggcaguacuuuauagcaguaugaaaaugaacugauacauucaacuaguuuauuuucuuuuuuauuaacauuuuuucagauugccuaaauuuauuuuauuauuauuauacuuuaaguuuuaggguacaugugcauuaaauuuuuuaacauuaauaaacuuuacaguaaaauugauucacaguaaaacaguagaaaguucccauauaccccuguccccacagacccacaaccuuccccauuaucaacaucccauaccagagugguauauuuguuacaacugauaaaccuacauugaugcauuuugauacccaaaccccauaguuuacauuaggguucacuauuggugguuacauccuacguguuuggacaaauguauaaugacauggauccaccacuauaguauuacauagauucauuucacugcacuaaaaauuugccuauacauuccucccucuggaaaacacugcucuuuuuacugucuccauaauuuuggcuuuuccggaaugucauauaguuggaaucauacaguauuuagccuuuucggauuagcuucuuucacuuuauaauaugcauuuaaguuucauccaugucguuuuaugaugugauagcucauuucuuagugcugaauaauauucuuacaucuggauguaccacaguuuauccacucaaauauuaaaggauaucuugauugcacccaaguuuuggcaauuauguaaagcuguuaaacaaugugugcagguuuuuauguggagauaaguuuuguuuguuuguuuuuguuuuugcuuuuuuuuuugagauggaguuuugcucugucacucaggcuggagugcaauggcaugaucucagcucacugcaaccuccgccuccugggcucaagugauucuccugccucagccucccuaguagcugagauuacaggcgcacacugccacacccagcuacuuuuuuguaucuuuaguagagcugggguuucaccaugggauuucaccaggcuggucuugaacuccugaccucaaaugauccaccugccugggccucccaaagugcugcaauuacaggcgugagcuacugugcccggccaggacauaaguuuucaaguccauaccaaggagcgcuauugcugaaucauaugggaagaguauguuuauuuuguaagaaacugccaaacugucuuccaaagugacuaugccauuuugaauucuuaccagcaaugaaugaagguuccuguugcuccacauucucaccagcacuugguuucaucaguguucugacuucagccauucuaacagguauguagcgguaucucauuguuguuuuaauuuucaauacccuaaugacuaugauguuuaacaucuuuuccuaugcuuucuugacacuuguguaucuucuuuggugaguugucuguucagguuuuuugcucauuuuuuaaguugaguuguucauuuucaaacuguugaguuguaagaguuguuugcacauugugaacaauaguccuuuaugagaaguaucuuuugcaaauaauuuuuccaucuguggcuugucuucucauucucuuaauauugucuuucacagagcagaaguuuuaaauuuuaguuaaguccagcuugucaaucauuuccuucauguaucgugccuuuggagcuguaucuaaaaaaugccacugccauaccaaagucaucuaggauuuuuccuguguuaucuucugggaguuuuauaguucugcauuuuacauuuaggucuaugauucaaguuaauuuuugcaaaggguauaagaucuguguuuacacucaauuuggauuuaaaaaauuuuuguuguuguauguuaauguguaguuuuuccagcauuauuuguugaaaagaccaucuuugcuccauuguauugccuuugcucccuugucaaagaucauuugauuauauuuacauggguuuguuugggcucuuuauucuauuccauuggucuauuugaauauucuuucaccaguacccacuacauugauuaucugagcuuuauaguaagcuuuaaagccagguagugucaguccucugacuuuguuguucuccucaaauacugaguuggcuauucugcucuuuugccucuccauauaaacuuuagaauccuuuuguugauauccauaaaauaucgugcuguguuuuuuaauggcauugcacugaaucuauagaucaaguugggaagaacugacaucuugacaaugaacauguaacaucucuucauuauuuaguucacugguauuuuucauuacacuuuuguaguuuucuucauauagaucauguacauauucuguuagauuuauacaaaaguauuucauuucuuggggugcuaauguaaaugguaauguguuuuuaauucaaauuacacuuguuuauugcugguauacaggaaagugauuggcuuucuuuauauuaaguuuguauucuguaaccuuacaauaaucauuuauuaguuccaguuuucuuuuuucugauccuuuggauauuccauauaaacaacugucauccgugaacaaagacaguuugauuucuuccuccggaaucuguaugcuuuucauuuucuuuccuuugucuuauugcauuagguagcacuuccaguaggaaacaaagugguaagaggagacaccuuugucuuguucuugaucuuagcaggaaagcuuugaguuucuaaaaauuaaguaugauguaaacuguagguuuuuuguguauuuucuuuaucaaguuggggaauacuacuauaucccuaauuuuauuuuccuuauguggaucugaguuucuaaccuguaucauuuuaccucucucuaaagaacuuuaaacauuuuuugcaagggugguccacuggcaacaaauuccugaaauuuuuguuucuuuaagacagacuuuauuucuuaacuucugaaggacaauuuugcaagguccagaaucguacacugccggauuuuucuuucaacaucuuaaaugucucacucuacucucuuauuuguaugguuuaugaggauaugucagauaaaauuuauuauuuuugcuccucuauagguguuuuuuccuucuggauucuuucgauauuuuuuuaaucuuugauuuucugaaguuugaauauaauaugcccaugaguaguuuugggacauuuauccugcuugguguucuuugagcucucuggagaaguaguuuggugucugacauuaauugggggagauuuucacacacuauuucuucaaauauugcaucuaauccuuucuuucuuuuucuaguaugcccauugcacguacauuauaccuuuuguaguucuccugcaguucuugaauaaucucuucuguuuuuuucacagucuuuuuucucuuugcauuuuaguuuugaaguuccuauuaucauauccuuaacuucaaagauuuuuuccucggcuauguucaaucuacuuaugagccuaucaaagacauuuuaaucauuucuguacacuaugcuugauacuuggcauuucucuuugguucuuuccuaaaauuuccgucucuauauuuacauuauccaucuguucuuguaugucauuuuuuuaaucccucaccauauuaaccauaguuuuuuauaaaguuucuggucugauaauuccaaugucacugccauauuugacucugcuucugaugcuuauucagugucuucaaacugcauuuccugccuuuuagcaugccuuauaauuuuuugguugaaugacagacaugauauacucaguaaaagaaacugcugcaaauaggcuuuuaguaauaugauaguaaaaggugugggaaagggaagcauucuguagccuuauaauuuggucucccucuuuggugaaacuguacccauggacuaugaacuucaccaguuuucucaguuccccuaggcccccuaacguggacaggaugguuugaguuguccagaguuauauauuuuccuuucccuauguggaaagcuaaaagggggcugaacuuagguauuucccuucccuuugggagguuacacucuuauaaaaucccaaaaguuuaggcucugguaaaauaguuucacuugagagcaggcuugaguccaacaaaaugcucugacauauuucaagaugguuccuuuucuucuccccuuagggaauuuucuccaguagucacugugaacacuccuggagguuaaacucacaaaaguacaggcccuuccguaagugaguccuccuggaguuuuuaacccucagacuugccacacugaacaaccgcccacacugaacaauuuuucaauuacaguucauguuuuccuaccuggcaccgguucccacaaaaauuuuccuuguagguuuuugccccacuaaguugugauucuuucuaucuaccugucugcuucucuaauauuugaugcagugguuugcccuauaaucucauuuuucugacagaucuaagaagauucguuaauuuuccaauucauucagcuuuuuacuuguuguguuuuuaaagaguuuuuuguuuuguuuuguuuuuuacuuuuuaaccauaugucaucccagaaaaauaucgaucuucuauuccaaauaaaucuuaggaaauacuaguggcaagaaaaucugugaucauagucuacuucucaaaaaggguuguuuugcaauguacaaauacauuucuuuagaagaaugcagugauaaaauaucuuuuaagaucuaucaaauuaagggauaggcuuaucaaauucauacauguauuugcucuuuucuaacucucucugauaccccuaaaauuuuacuuauauaugaacaguauagcuauagaacaaauugaggcuuuggguagaaauauaauuagcauacuaagcucauguuucuaauuguuuuguuaauauauauguugauagggacagcuaugguccuuugaagucauugcuaccuacucuuuuaagaaauacauacaucauuuuugcaugcauggguaaaauauauauuuccucacauauaucuaccuaagucaauauuuuauuaaacugaagucuuaaagaagucucaagauuuuucucaaccaauauuaaucuccauuagauuauaaucuuguuuauaugucacuuuguuaacaggaauucuaagaauaugagccuaauuuuauaaauguuuuaauuuaccauguaauaaauauuugaauaaauggguuccuggccugcauuugcugaguaguagagaaaacaaaucagcaaaccccuuuuuuccucaugucaucaccuuugcauucuuguagcaaauuaugucauuuucaaaacuagaauuucuuuauuuccuuuauugacuaaaaugacucauucuucucugcaguuuuuuaguaagauugagucuuuuuuguuuguuugagagagagucucccucuuuugcccaggcuggagugcaguggugcaaucuuggcucacugcaaccuccaccuccuggguucaaucgauucuccugccucagccucccaaguagcugggacuacgggagcacaccaccaugccgggcuaguuuuguuuuuuuuuuuuuuuguauuuuuaguagagacggguuuucaccauauuggccaggcuggucucaaacuccugagcucgugaucugcccaccucggccucccaaagugccgggaucacaggcgugagccaccacacccaaccaagauugaguuggaacuuaucguuuugguaacuggcacacagcagauggaaauuuuaugcacauuuuccucuuagaaacuaaggauagguaaacuuuuuauccuuuguguuggcaugcaagaauaaauuuccucuuaagaagaaaauuuauauuguugagaggucugagaagcaaauacuuuuucauauuuucuauucucuaaagggauauuuaaaauuugguuuauaaaaauaaaacuaauuugcuuucugcucugaaaaauaguaucauuguauaauaagagaguagcagcauagccaacuuggaaaaagcuguuaauugcccauaucaauuucauuaccaaaaauaugucaucuacuagaauacuucugaugaauacucuuuccucacugaaagauuuucuuuuuaaguugcuuaaagaguuaaucaguuaaucaguuucaaguuguaagaccauuaguauucucauuauaugacaaacauuacagaaaguauacaaacaaucugcaagaaaccuugaauucaacuuucauaguucugaaauguuucucauaaacauacaggcauuugaauggaacacuauuuuuuucauugaaaaaaauuaacaaggucacuuacaaaaugcaauguaacaaauaccguugaccuuaaaauacagguuugaacugcauggacugcuuauaugugaauuuucuuccacuucugccaccccuggaacagcaagaccaacccauccuuuuccuccucuucuucagcauacucaaggugaagacaacaaaggaugaagaucuuuaugaugaucuacuuccauuuaauaaauaguaaauauauuuucuuuaccuuacgauuuucuuaauaacaguuucuuuucucuagcuuaguuuauuguaagaauauaguacacaauacauaucauagaaaauauguguuagucaacuguguguguuaucagcagggccuccagacaacagcaggcuauuaguaguuaaguuuuuggggagucaaaaauuacauguggauuuuugacagugcaggggguuggugcucuuaaccuccauguuauucaagggucaacuguauuuauuuaaggucugugaugcauugcaaauagacacacacacacgcaucccuacuuugcugagcucaaaguucagugaaauuucacagaauguuaucuugcccagguccuucauuuuauagaugaagaaacaguaggcuuucuccccaguaccacaugaaaaaccaaggauauaaucuaaagacaaccuugacuuuuugcuauaccaaauauauaccaauucuaucuuaccugucugagaaaugcaugcuauggacauaugaaggugaugauaaaucuuggaagauuaggaaauaggcuuccaaagcagauaaaggcaggcauaugaaaaugaauaaugcaaucuggaagaaagagaauagucuguuucuguagguuuacccacagcuauuuuaaauuuguugcuucaccuucuucaccaucccagguacuauauuguacauuccacuguaaaugagcaaacauuacacuggcagcagggaccagcauccuuuaucaagaggcaguuguagcucaagaguugcaucuugguagcaucaauacagaauuuaaggauuacagaagauaucucaguaaguuacacuacugguuugaagaaaacuguuuugaccucuaauuuuuucucuuauucuaaucuuccugucauuuuuuaaagaacaaaagauggccuguguuaucuuauuugguuauaugauuacauauuauuaugaucaauaacauauauuaaaacuuauuaaucaaugcuucuuuaauuucagaaaguucucuauacuuggaagaaaaauaaagaacgauuugcacuucauuuccuuagcauggaguagagcauuaaucauuaucauuuuuucaugccacuaaaucuuugcaaugauaauucuuuaauaguauuggucuacauccacuagauaaacauuauaggcuuauaaugugccaggcacugugcuagacacuggagauaacacuuugaauaaaacagaaauggaacucccaucauggagcucagaaauaacacugaaaugcuccuggauuuugagccagcaauaacagcaggaagaaaacugcacucaaaacacuaugaauuuauuuccgccauuuaaaaaaaaagaaugaagaagguauuucaaauccagaaaagauauuuucucaucaugauagcagauguuaaagauauuggaaacagugcaauuucuccuaguguagaaggaggaggaaguugguagacacacagcugaaauaaaggaagcagaaggaagaacacaggcagugcucaucuugcaggaggcuugagcacccuaagucuauuuauaaaucaguuguucaaaacuaacaaguagugucgcacaucauguuuauauuuugagguagccgcaacagccuuuuaaaugcacaauguaauugaaacacuagcaucggaaaagaguacaguugccaauauaaaugguauuuuagugaccaauguuuccucggcuccagaagcuccuggaagauugucucagcuauuccucauggauccaaaagccuaauuucaccuauaaauaaucaauggauauuuuaucuaucuucaauuuccaaugaggauaaaucagcagagaaaagacaacacuggcagccuuaaagagaaaagcaguaaaaauaagauuauuucauugccauuuuuuuaaagagauggguucucacuguguugaccaggcuacaaugcagcagcuauucacaggcacaaucauagugcacuacaaccccaaacuuuugagacucaggcaaucuuccugccucagccuucagaguagcugggacuauagucauugccauuuuagaaaccauuuucauucacugcaacuuucaccaaauauuuauugagugcucaccaugugcuagccacuguuugguaugcugacaauacaugucagugacccaaacaauguuccucaucucauagaacucacaucuacuggagaaagcagacaauaaaaauuguuuaagaaaagcagaaacacuuugccaaggguugauaaacuaugcaauucccaucaaaauaccaccaucauucuucacagaauuaggaaaaacaauuuuaaaauucauaugaaaacaaaaaagaacccacagagccaaagcaaaacuaagcacaaagaacaaauugggcagaaucacauuaccugacuuuauacuagaaggccauagacaccaaaacagcaugguacugguauaaaaauagguacagagaccaauggggggauagagaaccaagaaagaaacccacauacuuacagccaacugaccuuugacaaagcaaacaaaaacauaaauuaguagguaaaggacacccuauucaacaaauggugcugggauagcugguaagccacauauagaagaaugaaacuagauccucaucucucaccuuauauaaaaaucaacucaagauggaucaaaaacuuaaaucuacgugcugaaacuauaaaaauucuagaagauaacaucagaaaaacccuucuagacauuggcuuagguaaagacuucaugaccaagaacccaaaagcaaaugcaacaaaaacaaagauaaauaggugagacuuaauuaaacaaaagagccucugcacagcaauaggaacagucagcagcguaaacagacaacccacagagugggagaaaaucuucacaaucuaugcauccggcaaaggacuaauaucuagaaucuacaaggaacuccaacaaauuagcaaggaaaaaaacaaacaauccuaucaaaaagugggcuaaggacaugaauagacaauuuuaaaaagaagauauacaaaugaccaacaaacauaugagaaaauguucaauaucacuaaugaucagggaaaugcaaaucaaaaccacaaugcaauacuuuacuccugcaagaacggcaauaaaaaaucaaaaaauaguagacguuggcauggauauggugaacagagaacacuucuacacugcuggugggaauguaaacuaguacagccacuauggaaaacaguguggagauuccuuaaauaacuaaaaguacaacuaccauuugauccagcaaucccacuacuggguaucuacccagaggaaaaaagucauuauaugaaaaagauacuugcacacacauuuauagcagcacaauuugcaauugcaaaaauguggaaccaacccaaaugcucgucaaucggugaguaguuaaagaaacugugguauauuuauaagauggaauacuacucagccauaaaaaggaaugaauuaauggcauuugcagugaccuggauaagacuggagacuauuauucuaagugaaguaacucagggauggaaaaccaaacaucauauguucucacucauaagugggagcuacgcuaugaggaugcaaaggcauaagaaugacacaauggacucuagggacucaggggaaaagggugggaagggggugaggaauaaaagacuacgaauagggugaaguguauacugcucgggugauaggugcaccaagaucucacaaaucaccacuaaagaacuuacccauguaaccaaauaccaccuguuccccaauaaccuaugggaauaaaaaaauaaaauuuuaaaaaaaaagagagaaaauaaagcaaggucaauagucagaguucuguuagauagaaugguuagggaauuuaucucugaaaaaguaacacucaaggagagauuagaaggaaagauagaaacaauaccuguggcucucugaaggaagggugcuccaggaagagggaacagcaagugcaaaggccuggaggaaaaaggaugcucuucuuguugccaggacagcaagaaaaccaaggaaauuagaauagaaugagggagaauaguggcaagaaauggaaucagaaacacaaauagcagccaauucacuugaggacuggugggucaugaaaagggcuuuggcuuauauucugagugaaacagagacccauuaaugguuuuaagcagaggagaggcaugaccugacuuaauuuuuaaaugaucacuugaauuuuuguuuggguaaaaacccacggugagguaagaagggggagcaaagcuagaaacagggaaacccaugacagggaaacugcacuuuucaaaguaacacaugaaggugguuugaauggagauggaaauuggugaaauggugugaaguagucagauccugaauauacuuuacagguagagucaacagaacauguuggaggaucaguuauuccuuuucucucuguuguuucuaguguuuccuucauuccuuaaagcuaggcaagauuacguccuuacggguuucacauuuauuuuuaaagacuguuaagcagugggaaaugaugacauuuaaguuuuaucuccuuuucuauuaccuguuauugaacagcaagauagguaaaagauaugaagacaaccaaagaaucuccaagggcccagaaaugaaaauaguuacaccuuagaucuguacaggaugaacugcuacugcuaggacuauuagcacagucacugacuaugccugggcacuguaauacuaaagcauuauuauugagggcuuaauaaacaaccauacacaccaaguucugaaaauuagucagucaugaacucuagcacuguuauuuuuaaaaggggagcaaauaaaguacagugaaacuauuauauacauauuuuuucuuuguacauauacauguauauagauauacuacauguguauauacauacauacacacauauacuacauguacauauacuacauauacauguauauguagcauauguguacacauauacacgcauauguauauguguacacauauacgcacuuuucuuaaguuuaguuguauuguuuuuagauauaguuagguaaaauuuaauuuucuuuguuugccuaauuuucccacaaaauuuaauacauuuuauaugauuugagccacgaaauaggcuaccauuaaaaagaaucaaucagagaauagaaaauggacuucuuggaaauuaaauuucaauuaacaaaaauaucaaaaguugagaaaauaaaauauacagagauaaacagaugaaaaauaugugauggaauuuaauaaauaagaaaaaucaguucacaaguucuaaugcaccauuaacaugaguuucauaaagauagggugaaaaaaagaaggaagaaauaaucaaagguacaauggaagaaaaguaccuuaagcuaaauaaaggcaguuguuuccagauuguacagaaucaucaagugcugagaagaauacauuuuaacagagccauaucuggaggaauuucagaagugaaaagauaaagauccuaauaaacauaugaauagggaaaaaaguuaucuaaaaaagacagaaucagacuggcaucagauaucuaucucauaagcaauccuagaugaaggguaacaacguaccaauguuucccaagcucugagagaaaauuacuuugaauuuaugguucuaaucacaauaauuuaugaauguacuauaaggaaaaauauaaggcauuuuggacauguaaagacucagcacaauauuuguaaaaaccccuguuuuuuuuucuuuuuuuuucuguaagaagaaaaacaguaguaaaaagaaaaauaauaaucaaauacaaagacaugagacuaaagcaauaauagacauagccaggagaaaaaugagaagaaacucuaaauuagaacagaaaaaucagacuucaagaagaaaguguauuucauucaucaaaugguauaauuaagaaaucugaaaaaaaauugugauaugaugaaaauguuucuucugucaacaagaauaaaaaaaugcaauuaaaauuuucaagaaaaauugaaugcuuacaggaaaaucuaaguccaaaugugaaagaaacaaaaauguggcauaauuuugaggaacugaaagaauuuagcaaaagggaauccauuuuacccuaaugcuuaaaguagcauccuuagaacaagcuaaauuuuagugucacaggaucacuuuuuccuuuucuacauguucaaccauacugcuagguguuacagugaauuuuauuuauuacaaucauggcauuguaagugauguguuuucuuuuucaauuagcacugagaaaugaagcacaagagaauuaacuauagaugcaaaccagaauauaaauauuauaaauuuagcaauaagaaguaaugauauggaauacaggaguugacagaaggcaggaaaagaaaaguagcuggaauugaagaauauuaacuuucacaucuuacauaguagagacucagaaagguauggucugacacugauaaacaauuuuuuaaagcaaugcauuauuguggguaagaauaauaaaggcauacuuaagauuguaguauuuaaaauaguuuuguuaccaugcuccuauacauuuugaaaagucacuguggaaacuaagcaaccaaucaaacauuucauuuuguguucuguauuucccuaaaugcagacuuagaaagguacucaagaguaucccaacuuauacauggcaauaaucaucaguaaguguuauugagggucugcuauucauuugcuugcgugauaauuguugugggaaauucaauagauauacaugauaugauccuaguucucaaagaaacuucaauuucaaugaaagcaguuucugacacauaaauaauguauuuuuaaaccguuaacuauuuugagacacucaaaaacaucuuucacaugggccuaaaauuucaugacacugccauguaaggaauuuccacucucacaggaagcuccugauuagcacaccaagacaauuauuuuuuauuuuuauuuuuugggagacgaagucucccucugucacccaggcuggagugcaauggcacgaucucagcucacugcaaccucugccuccuggguucaagugauucucgugccucagucuccugaguggcuggaauuacaggcgcccaccaccacgccuggcuaauuuuuguauuuuuugguacagacgggguuucucuacguuggccagguugguuucaaacuccugaccucaggugaucugcccgccucggccucccaaagugcuggaauuacaggucugagccaccacacccggcuaucaucuaucuuuaagcaagguaugccaaaauguugucucuucuuccugaaaauaugauacaaaauagaggaaaaacaguaauaucuauaguccuuaguacuuuuuaaaucaugccugcuaucauuuaauauuucuauggacaaauuuguaucuuuucauuguaucuaauaaagacaauaaaggaugaucaugaaaggaugguacuaugagcucauaauauauaucuugauugaaacaauaaaagggauggaaguaauccuucaucucuucccccuugagccaaucuucagaggcugugcuguuacacuugugcaaucucccugucaggucccaauacugagaaagcuaugccaacucuggcgccuauucaggcaacugggaauucacaccuuuugagcagaggcuggaagcauccugggaaauuccucaacugaccagucuaugaguccuauaauuuucaucucauuaugcuuuaaaaaaagaucaaagcauugauuauuuccuaugagccuguauauuccagaaggguaaagaugauggcucucuucuugccugauacauagaugcucaacacaugcuugaagaauaaacaaauauuuauucaaucacuacaauuuugccaaguaacaugcuggauguuuuauuuauguuacuucaucugauccucucaguaauccaugagauaagaauuauuaguuguucucauuuuacagguagagaagcagauucacaaaugcuaaggcaaccugaauaugacauacacagcuaauaaaaaggaaagucaggaugcuaaauuagaucuuccuauugcaugaucucacuuauauguggaaucuaaagaagucgaacucauaaacgcagagaguaacauggugguugccaugggcuggguaguaggggaaauagguuugucaaaggauacacaguuucaguuaugccagaugaauauuuaauacauucuggagaucuaauguacagcauggugacuacaguuaguacuguaugguauccuugacuacauuugaguagcucuuaaguguucucaccguaaacacaaaaaaugacugagaggugauggacaugugaauuagccugauaguaauaaucacuucacaauguauauuaaaacaucacacuguaucucuuaaauguguacaguuuuguggacuguuuacuugucaauuauaccucaacaaagcuggaacacacacacacacacacacacacacacacacacucucucucucucucucucucucucucucucucucucucucucucucucgaaacuuucgagcuccaaacaccagacugcuuguuggcauccaacuguuuaagaguugauuuacauugauuacgaacaaagagacaauggagauuugcaaauagggagaugaugccaaagauaauucaaaauuuauagggaaguuauuuaaccccaugucuugguuucuuccuuaguaaagugaggagaguaauagcaccaacaaaaauauagaugacauaagaauuagauaaucuuuggaaagugcuuagcaugguacuuaacccaacauaagaacuuaaucaauaguagcuauuauuagaaauauacauagcuuguuacgcuauuugaggcaacugacuuuacuuucccaugccuccauuuucucaucuguaaaugcaaggaaugggguuacugagucucuaaaguccuuucagcuuguagcaauccaugauucuauguuugaaaauaaacuauguuuuugaugaaguguuuauugaaauacuggagugaaagugguggcaauccagguggcaaugucuuauaagcaguuagaaacagcucuaguuuacaaaucuagaucuaaaauauaaaaauauauucaaacacacacauacauacacagaauuaaaucuauaauucagggaaaaagaugaaaagcucaaaaaagguagauuaaaaagucugauaauuuguuacaaguaggaaaaaguuuaaaauacauauuuaaaauguucauaauuugugacagaaaauuuauucuucacugaaaaauuuauagucuccugauuuuuacuuuuuuuucucauccuuuuaggcaauuauccaugcuaagcacagcugcugguguuuaguucaauaaauaccacuaguuuaucauugcauauuucccaaaauuacuucucaccuuuucuuucucuuuaucauuaaucuaucacacaaaaggggauuuucuccccguauuauugcagauauaggcucuucaauagaauccuaauguuaagcaaaauaguucuauacaaacagugauuuugggaaguauuucuauauguaauaggaauggcauguuuucaaaaauaaaauguaaauaauaaacacuuaaaaaaaagaaaaugcagcucuugcuccaacuguuucuaugaaggcaugcagcaacauuauuagagaugguuaaguuacuacacuagcuucuaaaagaguuugagucagcuugguuaugaaagagaguaacacuccucagggcuugucaccuucaguucuugaauacuaaagugccuacuugcuugucaggguuaaaagcuacuauuuuaaguucaaagugaaaagcuccuuucaggugauaaugauaguuuaaaauaaacaguguggggcagggaaaagccuccuuuaggcaucuaccauguuuccccugcagucaggccagugcuuucuuauucuguaucaguauucaugauccaggucauuaaacaguuaguaagauagacaccacucuuucucccuguaucccacugauaaacaacugcaggcuucagaauucuggagcuguguguaaauaugaaagcuccauguguuugaccaugugggaaggcauuaggguaaccugggacuccuaugcaagagagaacucccuugcacgaauguuaucaucaccaagcaagcuguuuguuuuguguguguguuuggugccucagcugucuucuacaggaaccauauaaaaacaguuuauacaaaagaccccaaggauucugugcacuuucaacauauuagggaaaaugcaagauaucaguauuuuuucauuuuauauuuauagacagaaacuuuuacuauagucuauuuaaccauuucuaccaaagaggauucagcuuaaauaugaaaaguucaaaacacauacacaccacauacacacacuuaguaguaacugaaaaaagacgaacagccuaaaauuuccacauugcuccuugguaugcaucagauucaaucuaccauucugauauuuuauaauacacagacaacugucacucagucucaucuuuaugaagacagccuaugcauugaauaagucaauguuuauugcaugcuugccccuucaagugaaacuacaguacagccaaaugaaaguucuauuugaaucccuuuuuuaguagaaauuaacuuauagccuuaaucaaauucugagcacuugcagcuuauauccauauaugauuuacugugaaacaaagguccgagaaagagggaaaauauuaauauucuaauauaagauaggaugauuuuuguuaaagcucgagaguguucaguaauggcucugcucugugcaggaaaaguauacucauaaguaauuucacccaagcuuuuacuauuuaggccgaggauaauugagagaaauacaucauuuauaguccgacacuaaaaaagcaaguagauaaaucacgcaaauaagaacuuuuaaaaaucuacaaccuacucucaucgcaucuuaauucaguguaucagaaauguacaauaaauuauaaguaauaaacacuaaagaaguaauaucuuuucauauccagaaggcugcuuuugcucugcaacagaaugaaaaaauaucuauccuuagauuuuauuguuaguuaaauaagucacucuuuugguaauuuccucuaaaugagaacagcuuuagauguuaaauggcuaaaaccugaguuucuauaugugaauaauagauucggucagauaauauuuaaauuauuccagauauaaaguucucuuauaccaaguauuacuuaaagaaaaacaccuguaaucccagcacuuugggaggcugaggcgaguggaucaccaggucaggaguucaaaaccagccugaccaagaugguaaaaccccgccucuacuaaaaauacaaaaauuagccgggcgugguggcgagugccuguaaucccagcuacuccgaagccugaggcagagaauugcuggaacccaggaggcggagguugcggugagcccagaucgcuccgcuucacuccagccugggcgacagagggagacucugucaaaaacaaacaaacaaacaaaccaacaaaccaaaaaacccccaaaaaacagauuuggugcuugguuuagcucuugggaaaagauccuuuauuuuaaaaaauacauauuucacuuauaguauuacauuucagagacucugauuuuuccuaucuuuagaaagguaguguaauuacaaaaacacagucuaugaaagaagcagucaaaugagcuaacuuuucaauuacuauaaauuucaucuuugaugaucuaauuacaauucuuuguuaggcaagaaggcuucuauuuuggaugauaaaugaugacauccaucucaaaugauccuuagaugcaauacaaaaagaacucaaauucuguucauauuuuaaauauucaaaccagucugcuuacagcuaauacauagcaccaguauacauauaccaaauauacgugguuagacauuuaaauuuuugaugccuuuuuuuuuauuucaacuugcuuuguauugauaaaaauaaaugaaaagcucuaaaaaucaauuugggauaggaggcacauucccuaaauauagagacuuaaagcuuuguuguuguuguuuuagcucuaggucuugguaugaaauuaaaaaugagagaagguugagagaauuuacagaggauggggaaaggggagaggcagguauaaugguauacuaaggagcaugauuaaccaagaguuuucuugaguguuuucuggucagaccguuuaguuugggaagucaaucaugaauucucuugcuuuuuaagaugcauacaaauaucaagauuuuuuuuuuuucugagacggagucucguucugucgccaggcuggagugcaguggcgcgaucucggcucacugcaaccuccgccucccggggucaagcgauucuccugccacagucucccaaguagcugggauuacaggcgcccgccaccacgcccagcuaauuuuuguauuuuuagcagagacggguuuucaccguguuggccaggaugaucucgaucucuugccacccgccuuggccucccaaaaugccgggauuacaggcgugagccauccuggccaagauguaauuuuuuaaaggcauuuugugaggcugggaggcagguaugcaaaucucacguaaauuacaagagcacugugaauuauaaucagauccaaagcaucaucugcucauguuuccccaaaucacaaaaaugguuuggcaugacuaguuguuugcugcagggcauaaaaagauuaaucuuagcugggcgcgguggcucaagccuguaaucccagcacuuuggggggccgaagcaagcggaucaccuuaagucgggaguucaacaccaggcugaccaacauggagaaaccccgucuguacuaaaaauacaaaauuagccgggcgugguggcgcaugccuauaaucccagcuacuugggugucugaggcuggagaaucgcuugaaccggugaggcggagguugcagugagccgagaucgcggcgccacugcacuccaaccuuggcagcaagagcgaaacuccgucucaaaaaaaaaaaaaaaaaagaaagaaagaaagaaaaagauuaaucuuguauuuaggcacagcuuuugaggcuuugguaggaaaaccaugcguuagggaauauccugaccuaaacaccuugaucuuugguucaugacccuaucagagccagacaagggcucccggacaaugaauuaaacuguguugauuccuccgcccacagacacucaaagcuuacucucuccacuguuacauaagagucucuggaauccuaggaugguguuuguaaauacugcugccacgugcacgguacccacgugucaaauguugaugugaccgcguguaacuggaaggagagaaagcgucuacaauuuccaaagagaagccuacuauuuuuuggcccuaaaaaugagcauacagaugucaaggaauuaucacuaacuaagggugauuuauuugucuuuucuuucuuuuuuuuuuuccaaaaaagaggaagaacuguaauauuuuuuuccuguugcauuucuuguaaucuaaauuaacugcucuaccuaauucaauuuaggaucaguuuuacaauuucagcaaugcauucugaaugcacuuucuacuuccucuauuugcaggacuuauuccugcuugcuuauuuacuucaguguaaacugagauauuaugggagaugaauuacauaaaaaccagagauauacacuaaguaggcaaaugauuuacaaaguuauaauuuacacccaauuaaauuacaacaugacccauucaguauucaauggcuuuccuugggugaaggaaaaaaaaguagcauuuuaccucucuuccuaucucggauuucaccuucaucuacauucauuauaucuuuuacaauggguuugugaacagaaaacaaguaaacuccauuccuuaaacaccugaauucuuaccaauacugagaaaaauuacaaugucaauaacuaaguuuuuaaccccuaaauauaguuucccaaaaaccccgaggauuaaggcaugacuaauuauaacaaugcaaaaaaaauuaaagaaaaucugucaguaguaaauuaaacucauuguauuuuuaaaaauauucugacuucaacaaaacccaagaagugucuuuaaagucacuuuaaaaugccauacccuagauuucccaugcucuugaaaaauguugguaaaaauguuuuaaaauuacaauauauguuuaaaaaauuaguugauguccauaaaaucuuauuugaaauaagaaccacauuuuuuaacaguaaauaaguuguuucaaaguaaguaaguuguaacaguaaauaaguuggccaggccgauggcucaugccuguaaucccagcacuuuaggaagcagaaggggguggaucacuagaggucaggaguucgagaccagccuagccuacauggcgaaacgcuguuucuacuaaaaaugcaaaaauuagccaggcaugguggcuggugccuauaaucccagcuacucgggaggcugagacaggagaaucgcuugaacccagaaggaggaggcugcagugagccaagaucaugccacugcacuccagccugggcaagagagugagacucuaccaaaaaauaaaaaauaaaaauaaauaaaaauuuuuaguucccacaguuaguaaccaaacgucuuuuucaaguuugcuuuucaguagaaauacauaauuaaaucuuagccauuaauaaggugagccaacagcaaaaugucuauuagcuuugcuuucugccaguguuuuuccacaagcguaauguggcagacaacugcaaaauuaaaauacaaccuuguuuuaaauucaacuuauguagauaauauaacuucacuggagaaaaaaccauuucaguggcuagauuggaagaaagauaaaaucuauaaaacaagguuuaaaguguguuuuuuccugcuaaaauguaucuguuuguacuaaaauaauuauuuacuaaaauaaauaauuuauaugguaagaaucuuuaguugugagauuuuuuuuuccuucauuuuugaaagguacccauuuaugguauucuucuuuucaucaguuacauuugguacauuaaaauaggaauguaaaugaauuaauauuuuaauaauucacuuuuuaagaugcucauucugauuugaugaacuaucagacacuguauuuguagaaaugguuuuuucuucuguuauaauguauauaggagagugcacaguagaacaaacaaaaaagcuaauaaucaucugaauuaauuacagggugcucaaagugauccuuuuaaugcaaauauaaugaaaaguuauaaaagagcugagauaacuuuacagccaauggcaaauauaaaaauucuauaacuucaaagcaagagacuucaaacaaaagcaggaaaagugcuaaaagaacaaacagguuaaaaaaauuaauaagaccaggacaguauguuauggauagaaucuggguguggucucauuguauuacucucacauucuggugcucuacuucagaggcagcacaacuaauaauuaugguauuuaaugggugcccuucuuagugcagacagguaagaaaaacgggaggaauaacucauauaccaugcuauguuaucuggcuuucauuaucccuauugaagcuuuuuuacuuuuuuuuaugcaucaucuauuucaggagaaaauacuauaauaacccauuugagagaugggugaauguucucauuaauguauaaccuggacauagaagcuagauuuaacacugcaucaagaaaauaagugauuugguaaggcagguuuuagcaauggcuaaugaggcacgacaacuguaauuaaaauuaccauuacuuuuacccacccacagaacaaacugugacaaaucucaaaauguuaaaaguagcaaauuaaaaauaucaauacucuguauggcauaccuaaaugucagacugccugcauuucuaugccugaacauaggcaauucccuuugaagagaguaguacaucagcaaaaauucacagcccauuuuucuucuuuugaauaugguguaccuucuguauaaauuacuuauaaaaagcaaagcuaaaaauaaacaacaaaucaaaauguuccuaauaugcgagaacagauuuacauuuuuuggaagugcauuaaaaagcaaagaugaaguacuacacucaaacuugugaacaacuuuuuuaaaauuauggagauacuaguacaaaaauuuauagucagcugaggugguucacaaaguuuugagagaaacaagagagagugaagacaaguaagcuagucauuucuccaguaaggagaacagaaccuaaauucuaucuuacugcuuuccauaaccaucacuacaccaacuucuuaaugggucuaacaugagcaucuaucuugggcuugucaaacauacucaacaaaccuacaaguagaugcuaugaucauacucuuaaaaaguaaaauucuauaguuacucauugaacaagugaucauaacaauuauauaaagccaauauacuuccuuauuggguacaaucacauguguaccuuaaauaagucucugaacccuaaagcucaaccuuuccagaucagugaauuuucuccacuccaguuaucagucauggucccaagguaugggauccaaccggcugcaacccagcauucucaugagaauaaaaagggagagaagcauugcacaacaagaaugucugguaucuagaauuacauaagguuagaaauucaaauacaaucaaccccaaguaauucacccuguguguccaaaacuacaagucauaguuccauagggacuaguguuaaaaaucugcacucauuuuaccuguaagugguuuguagaaguucugcugguauuuguaaauacuugcagccauguguagcaaagauggagagccaucaucauucugacccuguuucucacuuuguccuggcauuaugaagacugcugcaaagcaauuuccuuuucaaccuuauuuuacaucuucaacaugccacaguaucaguuaacaggaaaagagucacuuguuuaaacccuaugagauacuuugucauuuuaacuuuaaaaucugaaacaugacaaguggagauauaaacaguuaacaaacucaaaguuuugaaguuuauucucugcccugcauugcccuucuguuuucacauagauaagacauuaauaaccccccaaaucuaguaauuuguuauuauuucuagauuaaacugcacuuuguaguaauuuaaacaagaacagcaauuuuuauaguuuuuuuuugagagagagggucucauuuugucacccaggcugaagugugggggcaccaacauggcucacugcagccucaacuucccaggcucgagccauccucccgccucagccccacaaguaccuggaacuacagggaugugccaccacacccagcuaauuugugcauuuuuuguagggaugggguuuugccauguugcccaggcuugucuccaacuccugagcucaagagacccacccacuuccgccucgcaaagugcugggauuacaggugugagccaccgcacccagucacauuccuuuuaacacuuggguuacaucuccugaacugaauggcuagguaacuaaagacaucugagaaaguuucuugcaccuauacauuaagcccucuuuaccaagucauauaaccuaucacuaucuauugaaucuucccauaugagcucuaaaggcuauuguuaucacaaaacacaaugccaacuuuugagugauuaaguauccuucucaucuauaagaggauguugcccagacuaaucucaaacuucuggucucccgccuuggccucccaaagugccaggauuacaggcauaauaaaacuccuugaugccaucuuccuagaaagauaugcuuagccucauucaauccaaauaguuccugcauuucuuuugcaugagauguaagacauuuucugacauaaaauaaaccaaauaacucaacuacauucauuuuuauaacaacagcuuuuugaaauauaauucacauacaauaaauucauccuuuuaaagcauauaauucaguggguuucagcauauucaaagaguugggcaaucauuacuaucuaauuauagaacauuuucaucaucaccaaaagaaaucucauacuuauuaggagucaccucccucccaucccuagccccuaguaauaacuagccaacuuucugucuccuuagauuugccuauucuggacguuacuuaaaauugaaagcauaucauauguggccuuucuugugccucucagauucaccuaugugacagcauuuaucaauaauccauuccuuuauacuacuuaauaauauuucacuguauggauauaccacaauuuguuuauucacucaugacaugauagacaucuggguuguuuccauuuuuuaccauuauuaauaaugcuguaaugaacauuuggcuacaaguuuucaugugaacaacuguaugcauuuuaaaucuccuuuuaugacuuucucuacauaguccacauuauacacuuuuacagcuaucaaugauaaugaugaaguauaauauagugauuaaaagauuuggcacuagagacagacugcuuaacucaaaugcuggcuaagccuaagccauguauaggcuguaugaacuuaaggaaguuauuuaaccucacugggcuucaguuuccucacucauaaauagggauaagaauaauaccuaucucuaggguugugaugagaauuaaaugacaucgacuuacacugucacaaaacaacuuaaaauauuuuuaacauaaaggccauucuaucaaaaaaaggacuuuuaagaaaacaaaaacuuacauucugacacacauuuuaauauggcauaacagcacaaucacaagauugauaaauugcuaaacuuuugugcuaaacuucucuguuuugagaaaaaaagguuuaaaaauaugugaucaugugacuaaaugguauaaaacaaaacacacacaaaugaguacaaguuaaacugaggacaucugaauaagauuaguaggccacaucaaugucaguaucaugguugugauaugauauuauaguuuugcaugugaugugauaugauauuauaguuuugcaaaguguugccacugggggaaauugagcaaguauacguggaaucucucuguauuauuucauacaauggcauaugaaucuauaauuaacucaaaaaauauuucaauuaaaaauauaugaucccauauaaguuuacuaaaaaccauucacuuuugugcuuaaaauggguggcuuuuauagggcaauugccauagccuguagaaauuaaauguaaggaaaacacaccauuacuccuaccaucaucaccaucaccaagacacuuaacacuauuuuucucuuauacauugaaaauagauuagaccaggugcaguggcucaugccuguaaucccagcacuuugggagacccgggcaggcagaucaccugagaccaggaguacgagaucagccuggccaacauggugaaacccugucucuaauaaaaauagaaaaauuagccaggugugguggggcacgcuccuagucccagcuacucugggggcugagaaagagaaucacuugaaccuggaaggcagagguugcagugagccgagaucacaccacugcacuccagccuaggugacagagcaagauaccgucucaaaaaaaaaaaaaaaaagaaagaaagaaagaaagaaaaaggaaaagaaaauagauuauacuuuuuuuuucuaguuaaauugcaugguuuuucacuaguucuauaucauccauuaaauauugacugagaggucaacaguagguucuauuagggaauagaaagacauagaaaucagugccuaccuuccaauagacaaaaaagaaauguaauuugaaagaaacauuuguaguauuuuuagucaaacaaccaguucauuuuauauccuagacuguccuucaaaaacacuuuaucccaauuuauucaucuccuauuuauuauuauuauuuuucuuuuuuugaggcagagucucucugccucgcccaggcuggagugcagcagagccaucucggcucaccgcagccucugccucccgggaggguucaagcaauucuccuguaucagccuccagaauagcugagacuacaggcaugugccaccacacccagcuaauuuuguauguuuaguggagaugggguuucaccauguuggccagacuggucucgaauuccugacgucaggugauccaccugccucggccucccaaagugcugggauuauagguaugagccaccaugcccaggcucaagugauucucgggccucagccuccugaguagcugggauuacuggugugugccaccaugcccggcuaauuuuuguauuuuuaguagagacaggguuucaccauguuggccaggcuggucucaaacuccugaccucaggucauccaccugccuugucgucccaaagugcugggauuacaggcaugagccaccacaaccggccucgucucuuacuuuaauucucaguuuauuuggaacaugauuucaagucaguuuagaggaacaacuuucagugaguauaaagcauugaguucugaauuauuuuuauuuuuauuuuuauugaauagagacagguaucucacuauguugcccaggcuggucuagaacuucuggccucaagugauccuccugccuuccccucccagaaugagccaccacaccuggccugaguucugaauucuuaaaacugcagguaggaugauauuaucacugaauuuauuuuuacauauauuauauauugaaaauauauauuaucuauaucuaauauauauuauauugaaaauccaccuacuaucuguuucuucuuuuugaaguaugacacauuuaacuacaugucauuacaaaugaagaaaacauaaaucaaagcugauagaaugugcuuuuuuguuuguuugguuuuguuguugucgcuguuugagauagggucucucccucuugccugggcuggagcgcaguggugugaucagagcucacuauaaguuagaacacuugagcucaauccauccuccuaucucagucuccugaguagcugggacuacaggaauguaccaccaugccccacuaacuuuuuaaauuuuuuguagagacuggggccugacuguguugcccagggugguuucaaacuccuggccucaagugaucucucaccuuggccucccaaagugcuaggauuacaggcaugagucaccacgcccauccaaaauuuguuauuuggaauggacaaccaaauaucuauucuuuugagaaaaagauuauauaucuauuuuaagucagcaagucucugcaauguacaauauaggacaaaaauaaugcuggaaauagcagacauacauaauucuuuuuggauuguagucacagugauucacaugcucugacuuuccccuuucccuccuggaacccuucucuccuacuauauaccaaaccaacagauguacugcauaaccuccuucaauaaugucacaguauucacucaguuuuggcagugaguagaaauagaaauuggagaucuagaccaaguaaauacuguauauuuggcaaaaucauuugugguuguguucuucagcacaguuucccagauaaccaccagcucuacuuggcaacuggucuuucccacagugaaggcuccaauuguaaaguuggcuugggagauauucuauugcugcuggcuuugguaccauuacuauccuuaagaacuacugugcaaugguagaauaaucauugacaaaguguuauucugaugaacaaauacugacagcugguccaaaguuuuagccuguucccaagguaggaaacaauaacauuaaaacagucuacaugguuauuuauauaacaaagaugacucuuuccagcgauuugaaauugcuagauaagacuaugaaauucuauuaaaacaauaacaacaaaaacaauuuaacuugcauuagaagcaauuaaagcauaaaaaguagaucuaagauuuucuaaauauuagauauucuaaaauauugacauuauacaaugucuagcauccguaacuuuugaagauauuuuauuucaagguaauuucauaagaauucauaagaauuuaccuacucagacuuugggcaggauggaaaauagaguuucugugaggugugccuaugaaucauaagaagggcuucuuaaugaggucaguaauuaaggaaauacauuucaauagugacauuugacuuacaacauuguuuggggguggagucuuagaagaauugauagggaacuuuuaacuucaacaagugaaacuaaaacauuaacuccaguuguuguuaccuaauacaagaccagugcccaauaaggacuuuggaauucuuucauaacaacuccuuggcaggugcacuucacuuguucuggaagugauauucacuugccaaugucuaguaggaccaugugccacugccucaaaaucauaucaauuccuccggcuucuggcauaaacuggcacaucagaccuaauuaaagccuuaagaagaguuuggcaaauaugacaauuuaaacaaagcaagggauuucucucacugcaacuuaauuucucauugaugauuaguucaauaagaaaauaagcaaaacaaugucauaguuaagaaaagcuaucuaucuuguuauuguccauuaucauguuccuaaaauucaauaacccaagacaguccuauggaauuuuuggagcaccuagguaguaugaucacauauaugguaaagaaagaacugagguuaugucuuuuauuguaaacuaccccauacuuauuaaaauaauuucucuuuuccaacaaaggauaaagugacuaacauacacaucucuuccuuauaaucacugaaauacuuuauacaguauuaauuagcagcuauuuucaguauaaaaguaggaugcacaaaauaacaagaaucuaaauuugaugacaggaaaaaacaagccuucauaguuguauucaaaauuauuaaccaauguaguuauucuuauuuauugaguggaaaauguuguaucuauuauuaguugaguagccugaagacaguauauaccacaacauuugaaaaguuguccccaaaaaguaaauauuaguuuguuagcaaaaggaauuguuuuuaauucugaauugcuggaauaauuaaccauaguuuucucgauaguuuaccaugaacagcauuaaugguaaaauccuaauuuuuguuuuaauuuuagggcaaauaagaacuaaccaaugaaccguuucuauuccacagagaugaguaaugcuucucccuuguaaucaugugaaagaaccccacguaucaaugauuaaagcaaacuacauuaaauuaacaaagaucaaaauagaaaguuacaaagugaacuaucgaggacaaauaguuuuggaaauucgacuuauggagaaauaucuauuauuguguuuuuccuucuauccauuuuuuaauccuauaaauugucuucuaaacuucaguuugauuauccaacacuucauuaaccguucucugcuuauuaacauuuaaaaaaaucaauauuuauuguguuuaaauuuauauucuauuccaaacauuauuaagcacacauacaaacauguaaaagaacauaacuccccuuaguauuucaacuuuccauuaaaaugcaaauguaaugauuucauuagccaggcaacaauacccacaguaucacaccaaaccaaaccaaugucuuuucucugugaaucccaacuucccuuaagauacaaucuuauuccuaugauggaucauuuguugaugaauaucuuugaauuuggguuucccauuauaaucccugacugaaggggaaaaagcacaaugugugauuugagauauuaaauucaugaauguauuccacucccuagacacguaaauauauaaauauuucacuaaauuuuaugcacuaaauuuuaccgcuggaaaauaagccuuuucucaauucuuaaacauuagaugaagaagggagaacucccucaauguaauuaaaaguauaucaugaggggaauaaccagcaaauaacacuuauauuucauuuucggccuuuccaggagucuauccaggccacacuucauuaugucauagguagaaaacucuccauacaaacccuauuagcuuaauaaaacuagacaagcagucccagugaaaagauucagcaagaugcgagugagguguguguguguguguguguguguauguguaugagagagagagaagaaagaguagagaggagacacagagagaaaggcagagagaugaaagaccaaagagagaagccaaagagaaauuuggaugggacuguuauaaaucugcucuucacuucuuugcugggauuggguuucauuucuuuaggcgccccugaccuugcagucuugcaacuccaacgcugcgcuccccacccccucccgcccccuccccgggccugcgccugccuuugugucugccugucacuuaccaaggaaccaaacgaagcugauucgggagaagcacaaagccgggacacagauuuguccauaaauucucuuacauacauuccccaggcuggaaggcucagcccagcgcugacuuauguaccuugagaaaagugaguucuggucuuguuuggggaaccagagaaacuauucuuuccucuuucacucagcgccgcuaacaaaacgcgcggacuuaaggaaaaaaaaaacccacucaguguacuccaauuccacucccugugacauucacuucguacagcccccuaaagggggauaagaagguaggaggaggcagacacaaacccagacccagacccuacagcugauaaaagggucgaaaaacacccuaucaguguucucucugagguuguucaggauaaacgggagacucguuucacuuacacgaaagaaacaggggaagaggauuaaagggaaaaguagugcccccaaagcugaacuauuuuagaaaggaaagcaaauuuaaaaaucacuuuucugaggauuaaaaaaggccgggaaaccggcucgucggaggcacaaagguaaguuuucugggagaugaggggacgagcauuaggaggagagaagagaacacagaacuacagguuuaaaagggguagagggaauuaaaacuauauuugucagccauguugaagaggcuccaguaauuugugaagcuucccucuucccucuugguauuugugggugacacuacaggguuugcuccccagucccuggaagcccgagaaaaagcgaaggggagaagaaagggagaguuucgcggcauaagagaagcgcucugaccucguucucgucccucagccuugcagcaauccagcaguugcagucgggucuccuuucuaacaaauccuaaagggcagccaucuugcuuccuucugcuucucuacgaaagcagccuagccuccgcaucaauauucauaaggcaguuugacgucuguucucaucacucagcggggccggcgucucggggcggccgcgccgagggggcggacgugacuugcaugcgagcgggacccgggcgcgcggcgcucgcgaggaggcggcggcggccgcccaagcucucgccgcugccacugccgcuaccgccggcucuccuccuccgcccgggccuccuccugcuccgccccggccuccucccgcuccgccccggccugcgccgccgcccuggggcccucagccccggcucccagggaauuagccccccgcaccgggcguccagcacaaaggccggcggcaccuggggccguacagcggggcgcgcaguggagaccugggcugcccucacgccgugcaguggcgcggggggaguggugcgcccggaccagcgcggaguaggggccagggcuggcgagcgcggggaagggugcagcccucgggaaccccggggaccucggcgggucuccaccccugggagaagaagcagagcaagcgcgaagguugggggcgaggugggagguugggauggcacgggugccuggacaaagacgugacaucuaagauuucccuuugaaacuuuuugcuggucugcacuccaccaccacuucgaggucccgcgcacacgcccccgcgcgcacccaccuccuccggaguguacccgcacgugcccucgcucuggcccccgccuccacccacuggcaccucuccccgcaccacaccuccgcuugcgcccaccuuacccucagaggcccgcgucucuaucucccuuuagaucccguugcccgcgcucuccuuucccuuuucugucgcuuuaaucucauucagcagaagcgcuccccuguuucaccgagggcaugcccuuagugcuuuaggggccuguauuuuuaaagacccgacaaacugggaaauugaccgaguucuguuucuccccgccccggcccaccuucuguuu

SEQ ID NO: 192985 - RNA, 454786 nt, Homo sapiens
auggcugacaugauggucugugaccugaaaguuguugaauaguuggaguguucugcauucauguggaagaggcuaaaggauguuugaugaagcacuaugggcugcccuggaagaggacugaagaagcagcugcaggugagugcugcucugaacauaauccaggacacuuuguacauaguuggugguucugucacacuuaaagcaauguuaauuucuuuauuuuuauuuuuuuagaaucaaggucucuguugcccaggcuagagggcaguggugcaaucacaccucacugcagccucaacaucccaggcucaggugauucucccaccccagucuucccaguagcugggauuaccagugcaugccacuaugccuggcuuuuuuuuuuuuuuuuuuuuaauuuuaaauuaacuuuuuuuuuuuuuuuuuuuuuugagacagagucucucucucucucucucccacccaggacagagggcaguggcgcaaucugggcucacugcaaccuucaccucucagguucaagcgauucuugugccuuugccucccaaguagcugggaccacaggcaugugccacgacaccugacuaauuuuuguauuuuuaguagagacaggguuuugccauguugggcaggcuggucucaaacuccuggccuuaagcgaccuacccgucucggccucccaaagugcugggauuacaggcaugagccaccaugcccggcccucuuuuuuuuuuuuuuuuuccugagacggagucucgcucuuuugcccaggcuguagugcaguggcguggucucggcucacugcaaccuccgccucccggguucaagcaauucuccugccucagccuccugaguagcugggauuacaggugccugccgccacgcccggcuaauuuuuuguauuuuuaguagagacuggguuucaucauauuggccaugcuggucucaaacuccugaccucauuaucugcccaccuuggccucccaaagugcugggauuacaggcuugagccaccgcgccuggcccauuuuuuaauuuuuguagagauugggucucacuaugcugcccagguugguguugagcuccugggugcaagcaauccucuugccuugaccucccaaagaucuggaauuauaggcaugaaccuccaugccuggccuaaaagcaauguuuaaauccaauuaaaaauuaaaauuuguuuuuguaguuguagaggaacuguuccgugcugguuccccaauagccuaggacaacucuguuagccuugacaaauuuggcauccaaccugagccugguaaggucacgaagccuuuuuggaagaaagagggaugugggccagguuaagggcugugauaagacucccugggaucuuguagugcauguucuugccuaagcagugaauugggaggauucaguuuccucccaguguccuaguuguuacuagacagugugggcuggguuagaugaaauggaaaagauuucccugggucugauaguacaugcuacccaucagugaauauuuagagauuuggaggcugggcuugguggcucaagccuguaauccuagcacuuugggaggcugaggcgggcagaucuguugagcucaggaguuugacgcaagccugagcaacauggcaaaacccuaugucuauauauuuuuuuuuuuuugagauggaguuuugcucuuguugcccaggcuggagugcaauggcgcgaucucggcucacugcaaccucugccucccagguucaagugauucuccugccucaggcucccgaguagcugcgauuacagacaugcaccaccaugcccagcuaauuuuguauuuuuaguagagaugggguuucuccauguuggucaggcuggucucgaacucucaaccucaggugauccgccugccuccgccucccaaaaugcuggaauuacagguaugagccaccgcauccggccuacaaaagauuuuuuaaaaaauuagcuggguguaguggcacacaucuguggucucagcuacuuggaaggcugaggugggaggauugcgugagcccaggagguugagguugcagugagucgaaaucgcacgacugcacucuagccugggcaacagagcgauacacgacagagcaauacacugucucauaaaaacaaaacaaaaacaaaaacaacaaaacucaaacagcaagagauuuacagugguaggauugaagcagcugccugaauggugucuuaguuguaaaaguuuguagaugcuuggcugggcgccauacacuuugggaggccgaggugaguggaucuccugagaucaggauuucgagaccagccugcccaacauggagaaaccccgucucuacuaaaaauacaaaaaguuagccaggcgugguggugggcgacuguaaucccagcuacucgggaggcugagguaugagaauuccuugaaccugggaggcggagguugcagugagacgaggucacgccacugcacuccagccugcgugacaagagcaaaacucugucucaaaagaaaagaagaaaaaaaguuuguagaugcugagcagaaggcaacuuaaaucugaaaguaaguccaaaacugugcuuauugguguggaacugcuccugucacacccccgaucucuuccucucucuuacccugaccucuguuccuuuaaggaaagaaacguccacucugcuccagucaaccccacugcugguguccucugcacugccuugcacucccugaagagagccugggcaacagagcgagacuccaucucaaaaaaaaaaaaaaaaaaaauuggggacuauguauauagauuuacuacacugaagcccuccagcagucuaagaacugaugccucuaacgaaggaaaggacugcauguuucugaugaagcuaccaugaccuaccagauuuccaacgccugccaaaauuaaucuauuugucugugguagaagaggccauaccauuguggcccuugaaacuuacuguaugauguuuuauuuagugaacaguucacauacccaaaugguuguaacugauacugcugaauauauuguaagaacagaaguguuaaguauguauaacacuucuuuugauuguaaggaauguucccaguggggaaaugccauaauuaaaacagugaucgugggaugaauacaugauuaagagcuuaccuucauaauaguaaaacaguacaggaugccagaaggaagggaggagaggggauaauacuacuauacugaugaaguagcuagaagaaagaggagugcuuaaggaaacuauccagcaggcuauucagacugaccucucauuuggaacaguucuaaugagccuuuucagcuacaagugauggugacugacaguuacacugauuggagccuguggcaauaggcaguaagugccauuuaggguuuugggcacagcauuugccugacaccgcugccugguauacuccauuuaagcagcaauuguuggcuuguuagugagugcuuuuggacacuuagacacuaacaaagaaagcaucagcagguauuguuauauucugacauguccauucuuggauggaucaaaaaugaaaacaucaacaaagaagguaaugcucagcgagcauccauuauuuaauggaaaugguauauccaagaaagaaguaaacuggacauauuauuauuauuguuauuauuauuauuauuuuugagacggauacuuguucugucgcccaggcuggagugcaguggcacgaucucggcucacugcaaccucugucucccagguucaagccauucuccugccucagccucccgagcagcugguacuacaggcacgcaccacaacgcccagcuaauuuuuguauuuuuaguagagaugggguuucaccauguuguacaggaugaucucgaucucuugaccucgugaucugcccaccucggccucccaaagugcugggauuauaggugugagccacaguguccggccucuggguguauuacuuucuuauugccacuauuacaaauuuagugacuuaaaaugacauaaauuuauugucuugcaguucugaaagaaguccaaaaugaguuucacugggcugaaaucaagguguuggcaggacugcacucccuccagaggcucugggggaggaucgguuuccuugccuuuuccaguuucuagaggcucuccucauuccuugggucaugacaccuuccucacauuguuucaaucucuugcuuucaucaucacaucuccuacuuccucuucuggagucaaaucucucucugccuuuuuguuuuaaaaaaucuaaugugauccccuuauccuugagggagaucgaggccgaggccacugugacaauguuccaccagguagcauguugcagggguagagcgcaguguguuuggagauggugcaggagggacgacuuuaacuugcagcaacugagggugaacacauugggcucuugcuggagugcaucuagugugugugugugugucuuucucuguuuccacucgaguaucagagacuugcuuauaaccuuuaugauauuuuucuggauagugguaauugccuuguauaauguuucuuuugcugaauaauuuuccaucuucucugucguaugucacagauucucucuuuuuuauuuuuauuuuuauuuuuugagauggaguuuugcucuuguugcccaggcuggagugcaauggcacgaucuuggcucacugcaaccucugucuccccggaucaagcaauucuccugccucagccucccaaguagcugggauuacaggcaccugccaccacaucuggcuacuuuuaaaaauauuuuuaguagagauuggguuucuuucuuuucuuuucuuuucuuuucuuuuuuuuuuuuuuuugagacagagucuggaucuguugcccaggcuggagugcaguggugcgaucucggcucacugcaaccuccaccuccgugguucaagcaauuccccugcuucagccucccaaguagcugggauuacaggcaacugccaccacaccuagcuacuuuaaaaaauauuuuuaguagagaugggguuucuuucuuuucuuuucuuucuuuauuuuuuuuuuuuugagacagagucucgaucuguugcccaggcuggagugcaguggcgcgaucucggcucacugcaaccuccaccucccugguucaagcaauuccccugcuucagccucccaaguagcugggauuacaggugcacaccaccacaccuagcuaauuuuuuuauauauuuaauggagaugggguuucgccgucgcggccagacuggucucaaacuccucaggcaauccgccugccucagccucccaaagugcugggauuacaggcgugagccaccacaaccggccagauucucuuuuuaaaacuggucagccccucaaaccagaauagguucagagagacuuccgagauucucuauuugucugaaguguaaauguuuugaagguuuucucgacugacucaaugugaucaagaaucucuaauaguuugugucccccugacacugcucgcucagucagucccacugucagcaaguucucuuucccuguccuucuggccagcuaagucagugaugacacaucuggcuaucaccagcucaaagcugucuccucaaccacuuuuaccagggaaugaaugcuucaagaccacagugcucuccugccuuggaaacaccuucgccuuccuccgcuucucuuuggcuaccauggucacccuccacacugcuuuccucaacucucgggcagguggucccaucaauaccuccuccuccuccaagguuaccucccaaggugccauucaucacugacaaucauguuugcacuacuaaaagaauugccuuaaucuuuuuauccauuuuuggguuuuuggggguuuucuugagacggagucuugcucugucuccuaggcuggagugcaguggcucaaucugggcucacugcaagcuuugccucccagguucaagcaauucuccuccuucagccuccugaguagcugggauuacaggcauacgccaccacgccuggcuaauuuuguauuuuuaguagagauaggauuucgccauguuggccaggcuggucucaaacuccugaccucaugugguccuccugccucaaccucccaaagugcugggauuauaggcaugagccacugcaucuggcccgauucuuuauauuuguaaaaagcguacuguacuucaauauauucaaaauuagacuauuauuuagaaguauaucaauuugcagccagggcaguggcucacgccuguccuuuacacauauaagaugguaauacacggccgggcacaguggcuugugccuguaaucccagaacuuuggaaggccgagguggguggaucaccugaggucaggaguucgagaccagacuggccaacauggagaaaccccgucucuacuaaaaauacaaaaauuagccaggugugguggugggcuccuguaaucccagcuacuugggaggcugaggcaggagaaucccuugaaccugcgagguagagguuguagugagccgaaauugcaccauugcacucuagccugggcaacaagagcgaaacuuuguaucauuaaauaaauaaauaaaaggaaaggccggcgcgguggcucaugccuguagucccagcacuuugggaggccgaggcgggcagaucacgaggucaggagauugagaccauccuggcuaacacggugaaacucagucucuacuaaaauaaaaaaaaaacuuguacuaguguuguaacuuuccaaguaaaaguaucccuaaaggccacuuccuaucugauuuuucccaguaaaugaggcaggcaauucuaagaucuuccacaaaacaucuagccaucuaaaauggagagaugaaucauucuaccuauacaaacaagcuagcuauuagagggugguugggguaugcuacucauaagauuucagggugucuuccaacugaaaucucaauguucucaguaugaaaaaccugaaaucacaugccuauguaaggaaagugcuauucacccaguaaaccccaaaaagcaaauggauaaugcuggccauuuugccuuucugacauuuccuugggaaucugcaagaaccuccccuuuccccucccccaauaagaccguuuaaguguguguuaaaccacuacagaauacuaaauaaaaaguuuggccaaaaccaaccaugaagcugcaaaaaaaaaaaaaaaaaaaaaaaaaaaaguguuauacacuuguaauuuuaugaaugcuaugggaaccaucccaaucagggacagcugcaaagaaaaaguguuagugggauacauaaauaauugcuucuugccauugguggguggguucguauuuaaauucucugaguauuaaaaaccaaguauucuuggccggaugugguggcucacgccuguaaucccagcacuuugggaggccaaggcggguggaucacaaggucaggaguuugagaccagccuggccaacauggugaaacucugucuuuacuaaaaguacaaaaauuagcugggcacaguggaacgcgccugaaauccccacuacucaggaggcugaggcaggagaauugcuuaaacucaggaggcagagguuucagugaacugagaucacgccacugcacuccagcccgggcaagcaagacuccuacucugaaaaaacaaacaaacaaaaaacgaaguauucuuggccgggcucaguggcucaugccuguaauaccagcacuuugggaggcagaggcgggcggaucacgaggucaggaguucgagaccagccugaccaacauggggaaaccccaucucuacuaaaaauuacaaaaauuagccagggaugguggcgcaugccuauaaucccagcuacucaggaggcugaggcaggagaaucgccugaacccgggaagcagagguugcagugagccaagauuguaccaccacacuccagccuaggugacagagcgagacuccaucucaaaaaacaaaacaaaacaaacaaaaaguauucucauuaauguguggccagaaaaaaauuguaugaaaaaaaggaagaaggcugggcgcggugguucacgccuguaaucccaguacuuugggaggucgagguggauggaucacgaggucaggaguucaagaucagccuggccaagauggugaaaccccaccucuacuaaaaauacaaaaaauuagccgggugagguggugggugucuguaaucccagcuacucgggaggcugaggcagagaauugcuugaacccgggaagcagagguugcagugagccgagaucacgccacugcacuccagccugggcgacagagcaaagcuccgucuccaaaaaaaaaaaaaaaaaaaaaaagaagaagaaaagaaauaaauggaagaaacagggccagacguuguggcuuaugccugcaaucccaguacuuugggaggcugaggcagguggaaugcuugaguacaggaguucaagaccagccugggcaaauggugaaacccuaucccuacuaaaaauacaaaaaacuagccagguguguuggcacgcuccuguugucccaguuacuuaggaggcuuuggugggaggacugcuugagcccaggggaguggggcggagguugcagugagccaagaucacgccacugcacuccagcuuggaugacagagacccugucucaaaaacaaaaaaaacaaaucuccauaacugauuauuuuugcuguaugucuugccuauuggagccucuggaaaaaaggaaauaacauuaaaaaggagguacucuccauauggaaauauacuuuuagaguuuuaaaaaacugauuuuaguugcuaaugagcucuuguaaaaucagaugucugacccauaaaagcuaaugauuuccagccagaugugcauauuucugagugggucacuuugggccuaaauacugacgagauaaaaaaggcuuaauaaagccuuccuuaggccgggcaugguggcuuaugccuauaaucccagcacuuugggagggagaggcgggcggaucaccugaggucaggaguucaagaccagccuggccaacauggcgaaaauuaaucucuacuaaauauacaaaaauuagcuggaugcgguggugcacgccuguaguccgaacuacucugcaggcugaggcaggagaaucgcuugaacccaggaaauggaggcugcagugggccgagauugugccacugcacugcagccugggcaacaaagcgagacucagucuuaaaaaaaagaaaaaaaaaaaggcuugucaguugcaccuggaauauggccaugaggccuugcagcauuuuggcuuugcuucugcgaagaaaaagcaacagggcuuuucggaauccugauccuaauuuccuggaccugauucuaagcugaaacuugauacuuuauaguaugggcuuguuaauagaaaaacuucaacugaauuaaauuuaaaauaauuuaauugagcggcugggcgugguggcucacgccuguaauuccagcacuuucggaggccaaggcaggaggaucacaaggucaggaaaucgacaccauccuggcuaacauggugaaaccccaucucuacuaaaaauacaaaaaauuagcugggcgugguggcgggcaccccuaguuccagcuacucgggaggcugaggcaggagaauggcgugaacccgggaggcggagcuugcagugagccgagaucgugccacugcacuccagccugggcgacagagcgagacucugucucaaaaaaaaaaaaaaguaauaauaauaauaauuuaauugagcaaugaaugauucaugaaucagguagcccccagaaucacagcagauauucagagagacuccagggaugccucauggucagaacaaauuuacagacaaaaaagagaagugacuauagaaaucagaggugagguccuuaaguggauucguuacagcuccgcguuugccuuauuugaacaguuugaacacuccgcaguguaugagugguugaaguauggcugcugggaugggccaagacucagcucuuguuacaggcaaauacuccuaauuuaguuuucaaucuuguguaccuauuuaguuagguugcagcuugaccaaaaggacucaaauacagaaguacagaguccuucucaggccauccuuaguucgcuuuaacaaucacccucuuuuggucauuuucucaauuuuuagagauugaccaaaacuugagucauugaugucacuaucaccgucauaaauguacuuauuugauauugaaacucacugggaaacagaacacugugggcuuugcaaggugggaacaaggacucaguagaggguaccuucuuauacugggaacgucauguuuacaggagaaaaacaaaacguggucuguucuaggaucuaugaguuuccuuaaagucuucauuugauuaugucacauuuaacagaagcaacuacauuuuuuuuuugcuuuuuuuuuuuuuuuuuugagacugaguuucacucuuguugcccaggcuggagugcaauggcacgaucucagcucaccgcaaccuccaccucccagguucaagcaauucuccugccucagccuccugaguagcugggauuacaggcaugcacuaccuaccacacccagcuaauuuuuuuuuguauuuuuaguagagacgggguuucuccauguugaggcuggucucgaacuccugaccucaggugauccgcccaccucggccucccaaagugcugggauuacaggcaugagccacugcgcccggccaagcaacuccauuuuuguuugguuuggucuguuggggccuagcgcaugagcucaguucaaaacaauggccuuccauaauuuuguuuaaaaaaauuaucccuuucuggucagguucucacuuagcugacagugugaccagaacuuagggccuuagcgccauuuuccguuaccaccauuuuggguuucuggccucagugugucauuuauagguuacuguguccucaugguugcacauuucuuucagcucuugucauuccaguugaacagagaccauuugacauucuagagauggcugcauguaaacauuuaaaaccuuugggagaauacagugcaccagggagacuauuaucaucacuaucaggaggauaauaccaacaguuuggaguauguuccuuacccaggguccccauaaaccaaaccaccuaaaaucaaauagaucaaagaaugaggcuggggcugggugugguggcucacaucuguaaucccagcacuugggaggccaaggugggcggaucacgaggucaggagauugagaccauccuggcuaacacagugaaaccccaucuuuacuaaaaauacaaaaauuagccgggcgugguggugggcgccuguagucccagcuacucgggaggcugaggcaggagaaucgcuggaacccgggaagcggagguugcagugagcugagaucaugccacugcacuccagccugggugacagagcaagacucugucucaaaaaaaaaaaaaaaaaaaaaaaaaaaaaaaaaaaaagaaugaggccggaaguuguggcucacacaccuguauauaaucccagcacuuugggaggccgagguggguggaucaccugaggucaggaguuggaaaccagccucccaaagugcugggauuacgggcaugagccaccgcacccagccagaaaggaaaauuuaagaagguuaaggagggaagccagacauuguucaugcaggggaagagaaucaacaaauggugaaggucacacagguaucaaccagaaaguacucacuuccuaaaccgggauugaacccagcccucuauuguaaaauggcagagaccaaaagaaaguaccaccacgugguggcugggugugauggcucacgccuauaacugcagcacuuugggaggccgagaugggcagaucauuugaggucaggaguucgagaccagccuggccagcauggcgaaacccuguuucuacuaaaaauacaaaaauuagcuggacgugguggcacacgccuguagucccagcuacuggggaggcugaggcaggagaauagcuugaaaccaggagguggagguugcagucagccgagaucaugccauugcacuccagccugggugacagggcaagacuccgucucaaaaaauaaaaaaaagaaaguaccaccacgugguuacaaggucaagcucccaaggacauaaaagaagauagagaccucauccaguuuuguuuuguuuucagagaaaguuuguaacugacaaguuuucugggcuggcuugccuauuagcuagcuaagacaaaccaaauuugacaaaguugcucugcuuaaaaaacaaaacucaggcucugggacaguugcagauuugacucgaaagacaaagcugugaaaacaucauggaugcuggcuggaccagcugggucacaauugccuacagaaaggggcuuauuucugaugggaccaucugaaauugaucugcucauuggcucuuuguuucuguuacagagacuguuugcauuucuaaguagugauuccugcuaaagcugcacacugugggagggcacaucucagcaagugugacccuuucacccaguacugagagaucagacucuggacccugucucagggccaucuuacugcugcuaacuucuugcguuuggcuuuugguauuagaugcaguuugcaacagugaacugauaccuugacucuacuuccuuucuccugguauacauguuacaggaaaggggucccgauccagaccccaagagaggguuguuggaucucgcgcaagaaagaguucagggagaguccguaguguaaagagaaagcaaguuuguuaagaaaguaaaggaauaaaagaauggcuauuccauagacagagcagccccaagggcugcugguugucuauuuuuaugguuguuuuuugaugguaugcuaaacaagggguguauuauucaugccuccccuuuuuagaccauauagguuaacuuccugauguugccauagcuuuuguaaacugucauggcgcugcugagaguguagcagugaggacaaccagaggucacgcucacaucuugguuuugguggguuuuagccggcgucuuuacugcagccuguuuuaucagcaaggucuuuaugagcuauaucuugugcugaccuccuaugucauccugugacuuagaaugcguuaaccgucugagaaugcagcccagugggucucagccuuauuuuaccagccccuauucaagauggaguuggucugguucaaaugccucugacacacacaacuuaacaaggcaccuuaauuuagugauuaaaugcagcuguccccagaaagagauugaucuuuucuaggcugcuaccuggauaagugaucaggaugaaaaaggaguggaaaguuauguaaacccauguuugguuuuuuuuuuuuuuuuuuuuuuuuagauggaguuucgcucuuguugcccaggcuggagugcaauggcguggucucagcccaccacaaccucugccucccggguucaagugauucuccugccucagccucccgaguagcugggauuacaggcaugcgccaccacgcccaguuaauuuuguauuuuuaguagagacaggguuucuccauguuggccaggcuggucucgaacuccugaucucaggugauccuccugccucggccucccaaggugcugggauuacaggagugugucaccaugccuggccugcauuccucuguuucuugcccuuuauuagcauuuggagauaacauacuugccaucaguccugcaaaguaauugccgaggcugacuccuuucacagugauuauggcuuccugagucaaaauaggauuuuuucuguguccugaggaugugacuuguauauaagccucucaccuacuuaaaauauguuuguaaaugaaauguugguagauuccuguuccauuguuuucucuacaggaucaacuacugaauguucuuacacaaauguuuuguuucuugcaccaauaagagacuucacaauggaagguaguccccagucugugcuaagucuguggcugugcaacuuuucagagggaucuauaugucugucuaacacaucaacuccaaccacacucaaguugauaggguuuggguauuacugcauugcagcuauuguaagaguuucucauggguggucaaagagaugcuccaaaguucaaaucuucaugguuccagcagccuaugcaaugacugggcagugcuaggggacaauuaggcaaagaggcuacaccuguccccgcccccaccccccagcaucccaucaaacugcuuagugugaaauuggcucugcagaaacagagcucccaucacccauguugcauuaucaccugaccucuuuuguuuugguguugucugguaggaaaauggacacagggcgcuggcaucuuugccaaucuuaguauugcuaucaguauuaaacugccugaaucuaaaaagggcuuguuguuucuuuaccaauuaaaucucucagcuuugcuugacagcagugauaugcuuuggcuguguccccacccaaaucucaucuugaauuguaacucccauaauucccacauaucaugggaggaaccuggugggaggugauugaauuaugggucagggcuuuccugcacuguucuccugauagugaaugagucucauuaggucugacgguuuuaaaaaccagaguuucccugcacaagcccucucuuuuuugcaugcugccauccaugugagacgugccuugcuccuccuugccuucugccaagacugugaggccuccucacccauguggaacuguaaguucauuaaaccucuuuuucuucccagugucagguaugucuuuaucagcagcgugaaaauggacucauacauuaaauugguacuaguagagcagggcacugcuguagauacccaaaaauguggaagcuacuuuggaacuggguaacaggcagagauuggaacaguuuggagggcucagaagaagacaggaaaaugugggaaaguuuggcacucccuagagacuuguugaauggcuuugaccaaaaugcugauaguauuauggacaauaaaguccaggcugagguggucucagauggaaacgcggaacuugcugggaacuggagcaaaggugacucuuguuauguuuuagcaaggagacuggcagcauuuuaccccugcccuagagauuuguggaacuuugaauuugacagagaugacuuaggguaucugguggaagaaauuuccuagcaugaaagcauucgcguggugacuugggugcuguuaaaggcauucagguuuauaaaggaagcagagcauaaaagacuggaaaauugcaaccugacaaugcaacagaaaagaaaaucucauuuucugaggagaaacucaauccagaugcagaaauuugcauaaguaaugaggagcugaauguuaauccccaagacaauggggaaaaugucuucagggaaugucagagguauucauggcagccccucccaucacagguccagaggccuaggaggaaaaagugguucugugggcugggcccagaguuccugugcugugugcagucuagggacuuguugcccugcaucccagacacuccagccaugacuaaaaggggccaagguacagcucaggcuguuccuucagaggguggaagcucuaagaguuggcagcguccaugugguguugagccuaugggugcacagaagucaagaauugagguuugggaaccucaauuaggaagucagacuaucucuguuguagacaaugugauucuauaccuaaaaaaccccaaaggcucugucccaaagcuccuagaucugaaaaagaacuucagcaaaguuuuaggauacaaaaucaguauacagaaaucaguauccaccaggagcaguggcucacgccuguaaucccagaacuuuuggaggccuagucugggggaucacuugagaccaggaguucaagacccgccgggccaccauggccaaaccccgucucuacaaaaaaauacaaaauuagccgggcaugggggcacacacauguagucccagauacuugggaggcggaggcacaaguaucgcuugaaccugggagggggagguugcagugagccaagaucacaccacuacauuccagacugggcgacacagcgagauucugucucaaaaaaaaaaaaaaaaaaaaaaaaguuuuucagucccacuggacuagccugggcagcauagcaagaucuugucucuauuuucaaaaaacaaacaaauaaauauaauuaaauugaaacagaaaauugacaaacgggaccuaauuaaaguaaagagcuucugcacaguaaaagaaacuaucaacagaauaaaaagacaaccuacagacugggaaaaaauauuugcaaacuaugcauccaacaaaggucuaauaucgagaauccauaaggaacuuaaacaaauuaacaagccaaaaaacaaacaaccccauuaaaaaagugagcaaaggacggucaggugcaguggcucaugccuguaaucucagcacuuugggaggccgaggcagauggaucaccugaggucaggaauuuaagaccagccugucuaaccuggugaaaccccaucucuacuaaaaaaaauacaaaaauuagcugggcaugguggcaggcaccuguaaucccaguuacuugggagccugaggcaggagaaucgcuugaacccgagaggcagagguugcagugagccgggaucacaccauugcauuccagccugggggacaagagugagacuucaucucaaaaaaaaaaaaaaaaaaaaaagugagcaaaggacaugaacagauaauuuucaaaagaagacauacacuuggacaacaugaaaaaauguucaacaucacuaaucguuaaagaaaugcaaaccacaaugagauacaaacucacaccagucagaaugacuauuauuaaaaagucaaaaaaugacagaugcugggcugggcaagguggcucacacuuguaaucccagcacuuugggaggccgaagcagguggaucaccugaguucaggaguucggagccuggcuaacguggcaaaaccccaucucuacuaaaaauaccaacaauuugcugggcaugguggcaggugccuguaauucuagcuacucaggaggcuggggcaugagaaucacuugaacccgggaggcagagguugcagugagggagaucacaccauugcacuccagccugggcaacaagaccaaaacucccucucaaaaacuaaacuaaacuaaacuaaacuaaacuaaacuaaacuaaacuaaaaaacagaugcuggccgggccugguggcucacaccuguaaucccagcacuuugggaggccgaggcagauggaucagcugaggucaggaguuugagacuggccugaccaacauggagaaaccccgucucuacuaaaaauacaaaauuagaagggcaugguggcacaugcuguaaucccagcuacucgggaggcugaggcaggagaaucgcuugaaccugggaggcgaagguugcaguuagcagaaaccaugccacuguacuccagcuugggcgacagguccucacucugucccccaagcuggagggcaauggcaagaucagaggucacuggagucucgaccucccaaggcucaggugauccuccugccucagcacccuggaguagcugggaccacaggugggcaccaccacgcccagcuaauuuauucauuuacuuauuucaagacagagucucgcucugucaccaaggcuggagugcaguggcaugaucuugguucaagcaauucuccugcuucagccucuuggguagcuaggauuacaggggcaugccaccacgcccaacuaauuuuucuuuucuuuucuuuucauuuuuuuuuuuugagagacaggguuucaccgugauggccaggcuggucuugaacuccugaccucaggugauccaccaaagugcugggauuacaggcaugagcuaucacgccuggccgcccagcuaauuucuauauuuuuuguagagaugggguuuccccauguuugcccuggcuggucucgaaauccugggcucaauuuauucucccaccucagccucccaccugagccucccaaagugcugggauuacgggcaugagccuccacauccggauuuuuuccuuugcagaucuauauguagauauuccuaauuauuauuauuuugagacagagucucacucugucaccuaaauuggagugcaguggugaaaucucugcucacugcaaccucugccuccuggguucaagcgauucuugugccucagcuucccgaguagcugggauuacaggcgcccacauccaugcccagcuaauuuuuguauuuuuaguagauaugggguuucaccauguuggccaggcuggucuugaacuccuguccucaggugaccugucccccugcaccucccaaagugcugggaucacaggugugagccaccgugccuagccauuuuuuuccuaauuaauuugugacccagaaaauccuguuuaaaaucugccaucuagugugggauuuguaaaaugacaaaucacuggacacaaucauguguuuacacuaaggcuucacuccuggacaccagguuuaaaacuucucagcaucaaauaacauuauccaguaaaguagcauuaaaugugguuacccauuugguuuuacucacaguuuuagauagcuagauagauagauaugaguauauugauaugcaggguagauuuuuuuuuuuuuuuuugcaaguuagagcuuuugaucagcaggauaugguaguauuagaaaccuuuaaauagcccaguaagcuggaaggaauguggcucacaauuguaaucccagcacuuugggagaccaaggaggaaggauugcuaggaguucgagacugcccugggcaacauagcaugacccccaucucuaaaauaaauaaaaaugaauaaauagcaaaguaaaagcuaucucauaauuaauuuuuauuauuuauuuuuauuuauuuauuuuugagacggagucucacucuguugccaggcuggagugcaguggugugaucuuggcucacugaaacuucugccucguggguucaagugauucuccugccucagucucccaagcagcugggacuacaggcgcgcgccaccacacucagcuaauuuuuguauuuuuaguagagacgggauuucaccauuuuggccaggauggccucgaucucuugaccucaggugaucugccugccuuggccucccaaagugcuggaauuacaggugugcgacaccacacccagccuaauuuuuuguuuuguuuuguuuuguuuuuuugagacagagucuugcucuguugcccaggcuggagugcagugaugcaaucucgucucacugcaagcuccgccucccggguucacgccauucuccugccucagccucccuagcagcugagacuacaggcgcccgucaccccaccuggcuaauuuuuuguauuuuuaguagagaugggguuucaccguguuagccaggauggucuugaucuccugaccuugugauccgcccaccucggccucccaaagugcugggauuacaggcgugagccacugcgccuggccuuucacccggccuaauuuuuauuuauuuauccuugagaugaagucuugcucuguugcccaggaucuagugcaguggcacgaucuuggcucacugcaaccuccaucuccuggguucaagcgauucuccugccucagccuccggaguagcugggauuacaggcgcgcgccaccacauccagcaaauuuuucuauuuuuaguagagauggggauucacuauguuggccuggcuggucucgaacuccugaccccaagugauucgcccaccucagccucccaaagugcugggauuacaggcaugagccacuguauccagccaguaguauaauuauuuucuuuuuuuuugagacggagucucacucuguuguccaaguuggauugcagugggaggaucucggcucaccacaaacucugccucccagguucaagugauucugccucagucuccugaguagcugggacuacagacgcaugccaccaugccuggcuaauuuuuguauuuuuaguagagauaggguuucacuauguuggccaggcuggucucaaacuccugaccucaugauccgucuaccuuaauuuuuguuuucaacuaugaaauauauuuuuaaaaacucaggccaggcacaguggcucacaccuguaaucccagcauuuugggaggcugaggcgaguagaucaugaggucaggagaaugggagcauccuggccaacauggugaaaacccaucucuacuaaaaauacaaaaauuagccaaggugguggugcgugcguguagucccagcuacucaggaggcugaggcagcagaaucgcuugaacuagggaggcggagguugcagugggcagagauugcgacacugcacuccagccugggcaacagagcgagacucuaucucaaaaaacaaaaaacaaaaacaaaaacucaagaggaaaagaauauucuauuuacccggguacaugcuauuuacucggguauuuagccuuuuuauuguucuucauucauuucuuauguuccuagcuuccuucugauguaauuucucuuauaucugaacuuauggcaauuuauucagaggaguuuuguuugcaacacauucucuuaguuuccuuguaucuaagcaugucuuuauuucaucuuuauuccugaagaauauuuucauugaauuuugagguggcagcucuuuuuuuuuuuuuuuuuugucuuuuggugacacuuuuuauucagcacuuuuuuuuuuuacuuuuuaaaaauaauagagacagggucuaacuauguuucccaggcugauuuugaacuccuggucucaagggauucaccugccuuggucucccaaagugcugggauuauccacgugagccaucaugccuggccuguuaagcauuuuaaaauguuguuacacacacacacacacacaaauacaguuuuuucuuuuuuuuuucuaauggcucaaaaacaauaauaaaauguuuuuauuuauuuauuaauuuuuuuuuggagacggagucuugcucugucacccaggcugaagugcaguggagugaucucggcucacugcaaccuccaccucccggguucaagcgauuuuccugccucagccucccuaguagcugggacuagaggugugugccaccaugccuggcuaauuuuuguauuuuuaguagagaugagguuucaccauguuagucaggcuggucuuuuuaguagagaugggguuucaccaaguuagucaggcuggucucgaacuccugaccucgucauccgcccgccuuggccccccagagugcuggaaugcagugggcaauacauuaucuuucccuggcuauuuucaagauuuucuuugucuauauuuucaaaguuugauugcaaucuaucucaauuuggauucauuuggaucugucuuuuuuauucauuuauuuauuuuauuaucaagcagcccccugaaacagaguuaguucagagagacucucuggguuuuuucuguuaagguucugcuggccuucgugaguaucaguuauugucuuuugccaaaauuuagaaaauuuuuagccauuguuucuucaacuuuuuuuuuuuuuuuguacugcacuuuuucuccuuuccuucuggaacucugaugucaugaauaucagcccuuugguauuguucacagauuccucaggcuccuuuauuuuggugggguggggaauuuuuuuuuuuuuagaaggagucucacucaauugaguaggcuggagggcaguggggcgaucuaagaaucgcuugaaccccggggccuuugacucuaaggcccuccuugaggcucccucuccuuccuuggggaguuugacgcagaaaauggggucaaaaacugcugccgcaaacaucuucagugucaguagccaaggucuggggagacccauggggucucaccaggaggcugaggcaggaaaaucgcuugaacccgggagguggaaguugcagugagccaagauugugccauugcacuccagccugggugacagggcgaggcucaguuuaaaaaauaaaacaaaaauccuaggucuaggucuaaaaaggaaaaaaucaaucagcaaacauaaguguggcuuuuaagagacauccuuguagaaaaaaaugcugcugacaaaggauuacuaauaugaaaauaauaagggaugaaacagacuaaacaauacagcugcuagguaaucaaucaauccucuugucuuaaguagagcuaaugaaauuaggucgacugaaaugguuuugucaguggugggggcuuuaccccuucaacgacaucacugaggcacuucguucaagcaaaauuacaucuaccuugcacauaacuauaaccagcaccccgcacaauucagggcacacgggagguaugaggcacauuuucauuuacugaguuaaugagcaacaaggauuaucaagagugugcaucuuuagucucacaguuaucuuauguuguuguuaacuguuauuaaguaaggagaagcuagaacaaagaauaacacaauauuuucugcuuccuuuuuuuuuuuuuugagagggagucucacucugucacccaggcuggagugcaguggugggaucuuggcucacugcaaccucugccuccuggauucaagugauucuucugccucagccucccuaguagcugggauuauagguguguacaaccaagccuggcuauuuuucuguauuuuaguagagacaggguuucgucauguggcuaggcugguuuggaacuccuggucucaagcgauccaccugccuuggccucccaaagugcugggauaacaggcgugagucaccaugccugucccagauuuucugcuuucuauauggaaucugcagcuagucaaauucacuugacuuguuggggugggggacaccugacagcuaagugacucacuaaugugaaauccucuccaauuuuuuuuuuuuuuugaaauaaggucucgcuaugcuacccaggcuguucucaaacuccugggcucaaacaauccucccaccuuggccucccaaauuauugggauuacaggugugagacaccauauccggccccucuccaguucuauguaaaaaaucagcuucauccagauaacaacacuuuguuaccucuaaggggugggguggguggggaggcagacugacuucuggagccucaauagcaacagcguuuggaaaaaaauuauuuccaaacauaggagaacucaggaucuaauucacaugugaucuccuuaaaaaacuaguaacagcugccgggcacaguggcucaugccuguaaucccagcacuuugggaggcugagacgggcagaucacgagguuaagagauugagaccauccuggcuaacauggugaaaccgcaucucuacuaaaaacuacaagaauuagcugggcaugguggcgugcgccuguaaucccagcuacucaagaggcugaggcaggagaauugcuugaaccugggaggcggagguugcagugagcugagaucgcaccacugcccuccaguguggcgacaaagugagacuucaucucaaaaaaaagaaaaagaaaaaacuaguaacagcuuaauuuuuaaaaauauuuauaauagagacagggucuacuauguuggucagauuggucuugaauuccuggccucaagcaauccuccuucuuggccucccaauguacuaggauuacaggcaugagcugccacccucagccaacagcuuaauuucugccagguaagguugucuuuauuguccuuguuggagguuugggcacacagacuccaggaguggugugcuccaggguuguggggaagcagaagaguccuugggaugcugagagggagaaggacugcagaaggcaccagggcaaggugggggguggggagagcaggggauaccuggggcacugagagagcuagguggggcuaauacccugcagaaacaugccuccagcagauauaugggauggaggugcacggccagcccucuuccuccuccuauuccuccuccuccaccuccuggucccucuccuucccugcccuuucaccuuugacccaauaggucuccccagaccuugggugguggcacuggagauguuugcagcagcaguuuuugaccccauuuucugggucaaacaucccaaggaaggagaggccuuaaagucaaaggagcaucucaggauugagagucaaggaaaauuugaucuuuguuaugauaauguucccuccaaucuacaguucucaaacuuucuggucucaaaccuucuuaauguugaaaauugucuucauggguauuuccaucaguauuuguuauauuuuaaaacugagaaaaauuuaggccagggaugguggcucgcaccuauaaucccagcacuuugggaggccaaggcaggaagaucgcuugagcacagugguucaugaccagccugggcaacauagugagacccugucucuacaaaaaauaaaaaauucgcuggugugcuguugugugccuguagucccagcuacuugggaggcugaggcuggaggauugcuguagcucaggaucacagaggaggugugauggcaccucugcgcaagagaaugugguccugucuccaaaaaaaaaaaaaaaaaaaaugccauacuauauuuauuguauuauguuacauuacauuauauuuuauuuuauuuuuuugagacggagucucacucuguugcccuggcuggggugcaguggcgugaucuuggcucacugcaaccuuugccucacggguucaagagauucuccugccucagccuccccaguagcugggacuagugcaugccaccaugccuggcuccuuuuuguauuuuauuuuauuuuuugagguggaguuucgcuauuguugcccaggcuggagugcaauggugugaucucagcucacugcaaccucugccucacggguucaagugauucucccgccucagccuccugaguagcugggauuacaggcaugugccaccauaccuggcuaauguguuuuuaguacagacgggguuucaccauguuggucaggcuggucuugaacccccaaccucaggugauccgccugccucagccucccaaagugcugggauuacaggcaugagccaccgcgcccagcauacuuuuuguauuuuaguagagacgggguuucacuauguuaaccaggcuggucucacacuccugaccucaagugaucugcccaccucggucucccagagugcugggauuacaggugugagccacugugcccagccagccauuauauauauauauauguuuuuuuuuuuuuuuuuuuuuuuggagaccgagucuugcucugucgcccaggcuggagugcaguggagcaaucucggcucacugcaagcucugccucccggguucacgccauucuccugccucagccucccgaguagcugggacuacaggcgcucgccacaacgcccggcuaauuuuuguauuuuuaguagagacaggguuucaccguguuagccaggauggucuggaucuccugaccucaggugauccgcccgccucagcuucccaaagugcugggauuacaggcgugagccaccgcgcccggcccauuuuguauuuuaaaacagaaaaguuuaggccaaguguggugccucacgcccgaaaucccagcacuuugggacaccaaggugggaggaucgcuugagcccaggaauuccagacuagccugggcaacauggcaaaaccucgucucuaagaaaaaaacaggccaggcgcgguggcucacgccuguaaucccagcacuuugggaggcggagguggguggaucacgaggucaggagaucgagaccauccuggcuaacacggugaaaccgucucuacuaaaaauacaaaaaauuagccgggcgugguggcgggcaccuguagucccagcuacucgggaggcugaggcaggagaauggcgugaauccgggaggcggagcuugcagugagccgagauugccacugaacuccagccugggccacagagcuagacuccgucucaaaaaaaaaaaaaaaaaaaaaaaaaagaaaaagaaaaaaauuagucaggugugguggugcacacuucugguuccagcuauucaggagucugaggugggaggauugcuugagcccagggaguuggggcugccaugagccaagaucacuccacugcacuucagcccgggugauagagcaagacucugucuccaaaaaaccaaaccaaccaaccaaccaaccaaccaaagaaccugagaacaauuuaagacacaagaauauagauggccgggcacuguggcuccagccuguaaucccagcacuuugggaggccgagaggggcggaucgcgaggucaggagaucgagaccauccuggcuaauacggugaaaccccgucucuacuaaaaauacauaaaaauuagcugggcgugguggugggcgccuguagucccaacuacuccggaggcugaggcaggagaauagugugaacucaggaggcagagauugcagugagccgagaucgcgccacugcacuccaaccuggaugacagggcgauucaaaaaaaaaaaaaaaaaaaagaauauagaaauacacauuaucuuagcuuucagggcaauggaguuuucuggaaacaauccacuguaugcuccugagugaaugggaacggaaaagucagauaaugucauaguauuauuauaaaaauaguuuuaaccuugccaguuucuggaacaaauuuugagaaccacugcuccagaaaaucuuugccugcacaacuuagagcagggccuuugcugcuugagcagcccgcucugaucuagaauuuagagggagugcccuggaaugccgucccuaucacugccuuacuggcauuugcccuuuagucuguggaggauuucuuucuaggaaagaacagaggcugggcgcuguggcucacaccuguaaucccagcacuuugggaggccaaggccgguggcucacuugagcccaggaguucgagagcagccugggcaauauggugaaacccugccuccacuaaaaccacaaaaauuagcugagugugguggcaugcgccuaugagggaggcugaggcaggggaaucaccuuaauccgggaggcagagguugcagugagcagagaucgcaccacugcacuccagccugaguaacagagcaagacuuggucucaaaaaaaaaacaaacaaacaaacaaaaaacaacaacaauuaaaaaaaaacaacaggaauuggcugggcgugguggcucacgccuguaaucccagcacuuugggaggcugaggcagguggaucaccugaggucgggaguucaagaccagccugaccaacauggagaaacccugucucuacuaaaaauacaaaauuagccaggagugguggcacaugccuguaaucucagcuacuagggaggcugaggcaggagaaucgcuugaaccugggagguggagguugcggggagcugagauuacgccauugcacuccagccugggcaacaagagugaaacuccgucucagaaaaaaaaaaaaaaagauuuauuauuauuauuaguauuauuaguuuuaauacaaacaaucccacagcauuuauugccaucuuguaaaaacauaaguguaaucaaaacaauaugaauaaauguucauauuggacaaaggacgucuaaaaacaaacuguauccuucucaacaauuucucacuucauugaucauuucuaguuggagacacuuuguagcagaguaauauuaucuccuuuuagcaugauccgacccaguuguuuucuugacuuuguuuucgaaugaaucucuucugcaucaucuaauacaagguucauauacucaucaaaaccaaugauacagccuucuaucugcauauucacuugcucauagagccacaccugaaucugcgaucuauuuuguaaguaucugaagaugagguugaugggcugcaccauaaccuucugcacuuucuggcccuggccacuguaugccaugguggaauuucacaaagagcacacuugcaagcuuauuauuauuauuuuuauuuuugaaauggaguuuugcucuuguugcccaggcuggagugcaauggcgcgaucucgccuuccugcaaccucugccuccuagguucaaguaauucuccugccucagcaucccaaguagcugggauuacaggcaugcaccaccacgcccggcuaauuuuguauuuuuaguagaaaugggguuucgccauauuugccaggcugguuucgaacccccgaccucaggugauucacucaccucagccucccaaagugcugggauugcaggcgugagcuaccaagccuggccaggaauccuuaaaaaggugucaggauaucaauagaaguuucaugagcuaauaacuaauuugaagagaacagccaacaaaauaggacuacauguaucuuucucaugauggggcuggauaaaaucagguaacacuaauaaagucaucuaagugugggcaauauggugagaccccaucucuacaaaaaauaaauuaaaaaaaauuaaccagacaugguggugcaugccuguggucccagcuacuugggaggcugugacgggaggauugcuugagcccaguaauucaaggcugcaaugagcuaugauugcaccacugcauuucagccuggacaacagagugagagccugucucaaaaaaauaaaaaaauaaaauuaaaaaaagguaaccuggcugggcgcaguggcucaugccuguaaucccagcacuuugggaggcugaggugggaggaucaccuuaggucaggaguucgaggccagccugaccaacauggugaaacccugucuguacugaaaauacaaaauuagccgggugugguggugcaugccuguaaucgcagcuacuugggaggccgaggcacaagaaucacuugaaccaggggggcggagguugcagugagccaagauugugccauuguacuccagccugggcaacaacagugaaacuccuucucaaaaaaaaaaaaaaaaaaaaaaaaaaagaguaaccuaaagccagaggaaaauguacuugcugugguguaggccaagaagaaaauguaaggcaauuuguagacaaguuuaaguucauauuaaaauaaugaacaagaauuuagaaaauuucuuagagguaagacagcucuucauggccaggcacgguggcucauaucuguaaucccagcacuuugggaggcugaggugggcggaucacgaagucaggaguucgagaccagccugaccaauaugguggaaccccaucuuuacuaaaaauacaaaaauuaucugggcaugguggcacgcaccuguagccccagcuacucagggggcuacggcaggagaaucgcuugaaccugggagguggaaguugcugugagccgagaucgugucauugcacuucagccugggugacagauugagacucugucucaaaaaaaaaaaaaaagcucuucacgaggcaaaagcacuugaagcgaaagugaagcauagcuucugucuuauaggaaguugaaauagccaaaacaccaaguucaggaacaacugaaagcacaucauagguuuccaaaaggagaggaaagaaucucuugauuauaaaaacgaugaugcuaaaguuaugaauaauucucuuaaguuugacacugaggagaaaaguaauagaaaagaaauuguauuaucuggauuagucaaugaagagccaggggcucaacaaggucagaaagugaaagacagagaaggcaguucuagcugcuauuacugcauaauaaauaaccucaaaacguagugguuuagagcagcagugguuuaucauuuuuuacuauucucuggguuagcugacaguuaacugcugguuuugccugggcuugcucuuguggcugcauucaguaggaggugguugggcuggaaggucaagauggccucacuuacccaucuggcagcuggugcuggcaguccacuggguggguaccuugguuauuuuuucaugaaaccucucauucucugguaagcuagaagaacuuccuuacaugacagucucaggaccguaucauaagagagugaaagcagaagcugcaauguaucuaaugucuagcuuuggaagucauaucacaucacuucugucacauucuguugaucaaagcaagucaaaagaucagccuaggccgggcauggugucucacgccuguaaucccagcacuuugggaggcugaggcuggcggauugcuugagcucaugaguuagagaccaccuugugcaacauggcaaaaccccgucucuacaaaaaauacaaaaauuagccaggcaugguggugcacaccuguaguaccaucuacuagggaggcugaggugggaggauggcuugagccugggagguggagguugcagugagccaagauugcaccacugcgcuccagccuggguaacacacccagauccugucuuaaaauuaauaauaauaauaauaaucagccuagauucagcagguggggauauagcugaucucuugauggaaggaagggcaaagucacauugcaaaggaucaugggaagaucuuguggcuacauuuuacaauuuaucacaacagggaauggauaugacaaggacccaaacuauauuaacauuaguucaagaagagagaagccacuuacaacuuuagcugaaugaugagaucucaauuaugcauaaucagaacacuuaaggaagauggaacaggauaguuguucacaauagucagcucaaggccccuagaaaauguauuauaaagcugcaggcugaaaauugagcucauugaucagacagaauaccuucuggaagaauuugaguagaaaagaaaaaucagagcaauuagguagggagaaagggaaauauuaaaaucagugaauuugauaaauuugagguaaacuacagaaugugaaaauaucuuacaaggcaacauuuuguucugcagaagaaagcccaugacaauuagguucuuguuugugauaccaaaggagcuacugcuggagagauuaagcaagucacauuccugaguuaaaaauuaaggaggauggccgggcgcgguggcucacgccuguaaucccagcacuuugggaggccgagacgggcggaucacgaggucaggagaucgagaccauccuggcuaacacggugaaaccccgucucuacuaaaaauacaaaaaauuagccgggcaugguggcgcgcgccuguagucccagcuacacgggaggcugaggcaggagaauggcgugaacccgggaggcggagcuugcagugagucgagaucgcgccacugcacuccagccugggcgacagagcgaaacuccgucucaaaaaaaaaaaaaaaaaaaaaaaaaaaaauuaaggaggaacagguaaaacaaaaaauugguaacguucucaaaaccagggauuuuuuuuuuuuuuccgguggaguuucgcucuuguugcccaagcuggaaugcaauggcaugaucucggcuuacugcaaucuccgccuccuggguucaagcgauucuccugccucagccuccugaguagcuggguuuacaggcaugcaccaccaugccuggcuaauuuuguauuuuuaguagagacggaguuucaccauguugguuaggcugaucucaaacuccugaccucaggagauccguccaccucgccuucccuggaauuacagacguaagccaccgcgcucagccuaaaaccagggauuguuaaagcaacuuccaaaaaguuauauuguggucucuuuccaacuaauauaugaauuuuauuuauauaugccaagugcucuauuuccuauuauaaucagagacuuuauaaaaauagcaauaaaauaucuguguuccucaaugaagauaucuuuuaaguucaugccugagguggaggagcauuuuaucccucagugaugaaagauguccugugauauuccaggcacucuaugaucauuaauggaagaagugugcuuggacugaaacccaugccucacccuaguuccaggggaccacugaggagucagaaauagcagcugcuuuugaucuaagcucugauguaacuacaauacuaaucaguaucucaagaaguuccucuccuucuaccccaauggaugguuugguugacucuggcacaaauccuaauccuuaucaggaauggccaugauaagcucaccuagagcagaacuucuaccucuucuuagucaguuuggacugucuuuccaaugauaaggauuucauggaucuaaaacuuuucuuccacccuuauuucugaaagucuuccaacucaggccuaagaguaagcacaccaggcauuuaccugaaauaauggacuuguuccaugauuauuaaaucuauaaacacugacuucuaucuuuuaucuaucaugucuuggucuauuuuguggugcuauaauaggauaccacagacuggguaauuuauuuuuauuauuauuuuuaauugagauggggucucgcuauguugccuaggcugguguugaacuccuggguucaagugauccuccugccucagccucccagagugcugggauuacaggcaugagucaucucaccuggcagacuggguaauuuauaaugaacagaaguuuaucggcucgcaguucuagaagcuagaaaguccaggacugaggggcuguauuaggugagggacuuugugcugcauuaucccauggcagaaggacaaagaacaagagagaagaggaugaacccauuccugcaguuacggcauuaauucauuaauaagggcagagcccucauggacuaaucaucucucauuauuccuguauaaguaacauacauauuugauaaagguaaagguaaauaaaaacacuaaguauuacuaucauugaauucuuuuuuuuuuuuuuuuuuuuuuuugagauggagucuugcucugucacccaggcuggagugcaguggcacgaccucgacucacugcaagcuccgccucccggguucaugccauucuccugccucagccucuggacuagcugggacuacaggcaccugccacugugccuggcuaauuuuuuguauuuuuaguagagacaggguuucaccgugcuagccaggauggucucgaucuccugaccucaggugauccgcccgccucggccucccaaaguguugggauuauaggcgugagcuaccgagcccagccucauucaauucuguauauuuguuuuguuuucuuuucuuuuucuuuuuuuuuucugagauggaguuuugcucuugucaucgaggcuagagugcaguggugcuaucuuagcucacugcaaccucugccuccuggauucaagugauucucaugccucagccucccgaguagcugggauuacaggcaccugccaccaugcccagcuaauuuuuguauuuuuaguagagacaggguuuaaccauguuaucuaggcuggucuugaacuccugaccuuaggugauaugcccgccuuggccucccaaugugcugagauuagaggcaugagccacugugcccagcucaauuauuuauauuuguaaaaaguguaguguacuucaacagauucaaaauuagacuauuauuuagaaguauaucaauuugcagccagggcaguggcucacuccuguauucucaccacuuugggaggcugaggcgggaggaucauuugagcccaggaguuugacacuagccugggcaacauagugagacccugacucuacaaagaaauaaacaaauuagccaggugugguggugugcgcuuguagucccagcuacaugggaggcugaggugggaggacugcaugauccuagaaguggaggcuguauugagccgugauagugccacugcacuccagucugggcaacagugugaagauccugucucaaaguaaaaaaaaaaaaaaaaaaaaaaagcagcauauaaauuugcugcauuauauauauuuuaagaaacuuacaaguauuggccaggcaugguggcucacgucuguaaucucagcacuuuuggaggcggaggccagcagaucacuugagcucaggaguuugagacccgccuggccaauguggcgaaacccugucuacaaaaaauacaaaaauuaggccgggcaugguggcucacgcuuguaaucccagcacuuugggaggccaaggugaguggaucacaaggucaggagaucaagacuauccuggcuaacacggugaaaccccgucuccacuuaaaauacaaaaaauuagcuaggugugguagcacgcgccuguagucccagcuacuugggaggcugaggcagcagaaugccgugaacccaggaggcggagguugcagugagcugagaucgcgccacugcacuccagccugggcaacagagugagacucugucucaauuauaaaaaaaugcaaaaauuagcugggcauuauggcacaugccuguaaugccagcugcucaggagaaugaggcacaaggcacgagaauugcuugaacccgggaggucaaggcugcagugagccgauauggcgccacugcacuccagccugggcaacagaguaagacucugucucaaaaaacaaacaaauaaauaaaauaaaauaaaaacaaguauugucucugaggugaucugaugaucuguucguuaguucacauuacauauaaacuucaaggggaaucuauguauuguucauacagccuuccauuaauauauugcaauugggauuuaaacaauugaaucuaaauaaaaaauuuacuauauggcuaaaauguuuucacgauaauucauaauauggagguauuuugauacauuagggacacaagacugcccucagugccaugaguccaguugauuuucuaguaggcucucuucacuuuccaagacugugaagcacuuaauggauucacauagugcuuuacagcuuuugaaguguuuugacauuuuacauuaucuuccuuaaaauuaaaaagugcucagugaaguuagcaagguucguauauccacuucaguucuucagguuaaaaaaaagucauacucuaauucacaaugguaaagaaauguuauuugugcaucugcaaauucugaagaaaauggauuucagguuuccagauuuuuuauucuggugcacaagauuucuaauauagcauauggcuuccaaaagacccuagcugcuugauuguggacauauuucuuaaccgcuaugcuucaguuuccacaucuguaacaaugagguauuaauaguaccuauucauugaauuauuauaaguauuuauuaauacaugugaagcucugaagacaguguguagcucacauuacuguucuaaguaaguguuagguugcauauuuauuauuuuagcauauccaauuuacuuguaaggaugguugggauccugacguuacaugcacacauuuggaaaauucccaguugaguauacguuagccaaguucagaauuguguguggccgggugaaguggcucacgccuguaaucccagcacuuugggaggccgaggcgggcggaucaccugaggucaggaguuugugaccagccuggccaacauggcgaaacccugucucuacugaaaauacaaaaauuagcugggcgugguggcgggcgacuguaaucccagcuacucgggaggcugaggcaggagaaucucucgaacccgugaggcggagguugcaguaagccgagauagcgccauugcacuccaaacugggcgacacagcaagacuccgucucaaaaaagagugugucuguguguguagcggaacuuuguuuuuaacaacuaaagaaauauggugacccaauaaucccguuagccuuagcucaauuaaucacauuccaucuguccucacaauguucaccccagugagaaacgaguucaagcgcgugguaagcggugucgauauauuuuuaaaauucuguuaucaguauaauguaacagaaaauucagcauauuagcccaacuuugcucacuggugugaagauaugcccaaucuuucuuagcuaagacguuagagaaaacgccacaagggacccagcugggagcucuguaggaaguuuaaaaaaaaaaucauucagcuuugcaaaacaucugaugcucaaccaucugucuuuggcaguacaggggcuuaaggucugguugguuccuucugacaccucggaaggcggaguuacagaggaaaagcaacaaguuguaggaaguuaacuuaucuagucucagacgcuggaggcaccugcauuucuagucacuucaguucuggccaaacuguuaucaacucuaguuucugagggaccgccagcccaggauuccuauuggggucaccuuugugccucccuaucuuaagagcacacuugggcgggucggggcgggacgugcuggguguaggugacucaacaccggacaguuuugcuuccagaggcugacacgcuccugcgcgguaguuguuaaaggguugggacacgaagauacucuucgccuauucgggaucucccauugugggaaggaggcucaguggucccggccaccgggugaagggagaacgggaacacagcgcugucaucgccggagagcugcgagccccgacuuucucgccaggcucuccaguacauuccgaggcuccaccccgguaacgccacgcugacguccgcgcgucggaggccgccauaggugcgcgucggcgcccaggaggacguguggcgcguggacuacaucagguccagcccugcgggaccccagccagcgcuuccgggcaagguucugugcaccuguuuucuccuucuacgcgaguaucuuuccccuccggaaagaaugggauaugccuguguccaaaggacaagaagaugcgcgccagcaagccuaaguuaaccacagcgcggaaguugagcccaaagcaagagcgugccgggcaccuuuaagcuguuuguaagcccacgugacucaccaagugcgggccccagcggucacgugacggcgcgcgcgcccucgcgcagggagagccggcggugcgcgcgccuucgccgcugccucccacccacccccucgacgggagggugaggcgcggcgcagugaucgggcggccgggguccugugcgcgugcgcagcgaacagcugucaccuagugcggaacaagucucccaaauuucccaaaucucccugggccggaggccacugucuucucuuccuccuccaccgagucgugcucucgccccaacccgcgcgccagguaaccgcuuuuccggagucugggggccagggcggggggaggguccggagaggucuucccggcacugccccccuccgcguggggcacgggggugcgggcguccgggcgagcggcgacgcuggggcagagacgcuccguccgugacugcagcgacugucaagcuggggagggagcggccggccgcggccgcaggggagggaugcgggggccggugacagcccgcuccggcccuuaccgagguucgguacccgcgcucgccguuuucccgggauccggagucggggucgccuccuuggggcagaggagcgcucgggcgguccugggaugcggaccucuuaacgccgccagucggcuguggcggacuccaggaaggccgggccuggugcaccccucggggcccucccuucccugggagugucacgacccgcggggugagggugggagcuccucuccugaccacccguugcaggcagucaucccgucauucggggucgucuucagcccucgcggcuguccuuuugguguuucuuucccccggcauggggccauuucuuccugcagugccuggaggaaccaugaugcgguguagacggcgggugcuuaaauaaaugcgaguuggauuagggcgcguggacugccaggcacagaacguggcguggaguggggacguggaggagggagccagacaggccggggcuguaggcaggagcuugggguuuuccucugugcuccgccaguaaagccagcagccgggauucagaugcuuuccgcguggacuugaugcugggcucccccuuugcugcgcggugcaagccugcgcuggcuggcucugauugugggcaauacuaccgggagggguuuugucagguuccuucuuccggaagagacaagguaaacuuuuuuuugcgcuugauaaacuaaccccgagaggugauuuauaaagcacuguucggaaauguagguuagaaaagcagagucacuuuuauccuggugaaaguuacuaguagguuccggccacuuagguucacacuaaacucugcccuauuuucacccauuucaguuugcgguauuuaaaaaaaugucuaaauuccgggcagcuuggcuuuacuguuucuauggcaacggugacuaauauucucauuucgaaguguugugguugaaaacuagugguuuuaauuuuuaaagguccauuuuuuauuaggaagcagucggcucugcuuugcgauuaucgcuugcuuucuuaccuugcuggccuccgcgcaacccgcccauaguuuguuuuggaacggauuacacgguuguucggguuuuuuaggugcuuuuucucccaauuucaguguuaugaaaaguuuucacauaagcuuuacaguaucccgcaaacuugguaauacaguacaauuuaaaccgaagacuuauuucuuuuuauuaacagacuuuagucaguugcuuuucuaaaguugaaaaucagacccggcgccguggcuccugccuguaaucccaacacuuugggaggccgaggcggguguaucaccugaggucaggaguucaagaccagccuggccaaaauggcgaaaccucgucuguaccaaaaauucaaaaauuagccaggcaugguggcaggcgccuguaaucccagcugaggcaagagaaucacuugaauccuggaaguggagguugccgugagccgagauggcaccacugcacuccagcgugggugacagacugagacuccaucucaaaaaaaaaaaaaaguaaaaauauaaauaaauaaauaaauaaauaaauaaauaaaagcuuuuaguaaaugaauagucuugugcaaccaucaccacaaugaauuuuugaauuuuuuuaauccccaaaagaagcucuguuccuauuagcugucauugccuaguucccuccaauucuauccccuucugucccuaggcaaccacuaaucugcugucugucucaauagauuuggcuauucuggacauuuuauauacauggaauaauacacuaucuggucuucugugagugacuucuuucacuuggcauaauguuuuuuaagguucauccauguugcagccuguaucaguacuucauuccuuuuaauggcuaauauucuauuauggauacaucacauuuuguuuauucaucaguugguagacauuuguguuaucucugcuuuuggcugaguaaugcuaugaauauuugugaacuaguuuuuguguggacgcguguuuucucuacucuuggguauauauauauauauauauaauguaauugcuagguuaaacaucuguugaaugacugcaugcguaaggagggauaguuagucuugggugauacucuuuuuuauuuauuuauuuauuuauuuauuuauuuauuuauuuauuuuuugagacgaagucucacucuguugcccaggcuggagugcaguggcacgaucucugcucacugcaagcuccgccuccuggguucacaccauucuccugccucagccuccugaauagcugggacuacaggcacccaccaccaugccuggcuaauuuuuuuuuuauuuuuaguagagaugggguuucacuguguuagccaggauggucucgaucuccugaccucgugaucugcccaccucagccucccaaagugcugggauuacaggcgugagccaccgugccuggcuuggugauacucuuucaagccuugaaggggccuguugaucuuucccuauuccacugccaacuucaguucuccaguucucuaaaguggggcuuuauucuaugguuaaugcuguguuuuccuuuccuggaugucuuuuuuuuuuuuuuuuugagacggaaucucgcucuguuguccauggagucucacucugugccaauggcgcgaucucggcucacugcaaccucuaucucccagguucaggcgauucuccugccucagccaacccaguagcugggauuacaggcacccaccaucaugcuuggcuaauuuuuguauuuuuguagagacaggguuucaccauguuguucaggcuggucucgaacuccugaccucaggugauccgcccaccuuggacucccaaagugcugggauuacaggugugaaccacugugcccggccucuggaugucaguauuaagaucauccuguucuuuuuuuuuuuggagacaggguguaacucugaugcccaggcuggagugcagcagugacagucucagcucacuguaaccucucugucugcugugcucuggcaguccaccagccccagccucucaaguaggugggacuacagguacaugccaucaugccuggcugauuuuuguggucuugccaugguaccccggcuggucugaaacucccgggcucaagcaguccgcuugccccagccucccaaagugcuaggaugacaggcgugagccacugcaccuggccugaucaucccuuccuguuagcacagucuuuauacugcucaugguuauucccuugauauucacuuauuugcucuauauuuagugauaagauagguacauucuguacuuugauuaagcucaauaucuacugaaaaauguguguucccuuuuguuaaauauuaguauuuaaugcuucucucccaaccucugucucuuuuuucuuuuucuuuuugagauggagucucccucugucgcccaggcuggagugcaguggcaugaucucggcucacugcaaccuccgacucccuggagugauucuccuccucagccucccgaguagcugggauuacaggcacgcccaacuaauuuuuuucguauuuuuaguagagacgggguuucaccguguuggccaggauggucucgaucuccugaccucgugauccgccugccucggccucccaaagugcugggauuacaggugugagccaucaugccugcccauuuuucuguuuuuauuauacuuuaaguucuaggguacaugugcgcaacgugcagguuuguuacauagguauacaugugccauguugguuugcugcacugaucaacucguuguuuacauaagguauuucuccuaacacuaucccucccccagccccccaccccacaacaggcccuggugugugauguuccccucccuguguccauguguucucauuguuccuucuuuucuuuuucaguuaaaaaaauuucuguuuguagagauggggucucaguguguugcucaggcuagucucaaaauucugggcucaagugauccuucugacuuggccucccacaguucugggauuacaggugugagccacugugcuuggccugcaagcucuauuucuguuaugaauuucuuaggagguguaucauaauuaaagucacaguaucuuuuuuaucgcuacaaauguagaccauuuuguggagccuaaaauauaauuuuauaauauaaauacaauauauauuaggucauugucuuuauauuauauaauauauaauauaauauauuaggucauugucuuuuuuuuuuuuuaagauggagucucgcccuuguugcccaggcuggagugcaguggugugauuuuggcucacugcaaccuccaccuccuggguucaagcgauucuccugccuuagccucccaaguagcugaaauuacaggcaccugccaucacgcccagcuaauuuuuguauuuuuaguagagaugagguuucaccauguuggccaggcugggcucgaauucuugaccucaggugauccacccccucacccucccaaauuacugggggauuacaggcaugagccaccacacccggccaggucauugucuuuuuuacuccccgacccucuaaagauucccuacuuccucauccuccuuacccuuccgcugguggggggggauggaugggggguagagggggcgugguuacgaucuucuaaauccacacuuucugggccuaauccuuuucccauacuaacagucagaauaauuccuuuaaggaagccuauccccccugcuccugcuucaaggcugcuuucucuagggaaaaaguccuaacucucagcucugugugugacugcccagccagucuccuuccuaccaaacucaucuuucuuccuaguucccugaaugggcuugguacucugcccaugcuguuguucccugugccuggacugcuaccccaguugcacuucuuugauugauuccaucucauucuucaggaagcucagcucaguugucaacuucuucaaguuaguguucucucaauccugcacacuggccauagcagcauucuguagucuccuucauagucuuaagcaaucaugccauuacuuguguaucucucuucccucccuacccucaugcaagcccagagaaagguucccacaaaaauauugacaguaguuaguaacuucugggugauggaauuguggguaauuuguuuccuuuguguuuaugugcauuuucuaaauuuucuccuaugaaucaguguuaccauugugaagagggaaaauaaguuaauaaaaauucauguuuguuagaaaagcugggaaacaggagaagauagaggaaaaagaaaaauaaucaguuauugcccuuuucacauuggagaaugcacuuuuucuuuuuuugagauagaguuucgcucuuguugcccaggcuggagugcaauguagcgaucuuggcucaccacaaccuccgccucccaguuucaagcaauucuccugccucagcuuccugaguagcugggcuuacaggccugcgcuaccacgcccagcuaauuuuguguuuuuaguagagacggaggguuucuccguguugguuaggcuggucucgaacucccaaccucaggugauccauccgccucggccucccaaagugcugggauuacaggaaugagccaccgcucccagccagaauacacuuuuaacaguuuuuguuuuguuuuaauaacuuagaugagauuuuguuauaguuucagcaucaagcuuuuauuacauuuuaguuguugcuuguauuacucagagauuucuagagaaugguaggaguacuuacaauaggcugcccaguuggaauuuccgauguugaaauucagcugauuauuagagaacagaauauagcauuagauauauguagcauagaacagaauauagacuauuaggguaugagcacuuaagugcuaaauaacucuuuucccuuuuuccuugaaaaauguccuaauugguucauuuauauguuucauaguacaaagauuucccuugcacaguugcucauuauuuguacuguuuguuuuauuuuugaugggugguauauuuugcauaguaguggauacauuucuucaguagauuaacuuguacuaugugccauacacugugucagauguggacagcagugaacacaauagacuggauucccuaugauuucauggaaguggauuauuuuaagagugugaauguuuaguuaacuguugcacuguauacuguucagauacacaugguauuucagcuacuaugguauuuaugaacugcuacugcauaaagccucaaauuuauucuggauucuucuggguuuauauuguauauuacuauggguggauauuuaaggagcacaaugaugagucaucaaagccuuugugcuaaugacuucuuuuuuuauaucuccauccaguuccagguauuaauuuggcaucucuacuuguuaaguauaacaaauguaacucugaucuuuccucucagcucugcuucucuggaauuucuccugcaucucaucucauuucauugcucacucauuucauuaugaguuauccaacacuucaugguuccucagcccucacauccaaaguaucacuuaacaccuuguaacuucugcuucaggaauaauauuguggggaucaauccgcuugucuccaccuccaaugcauuauccuaccauucacucccauccucccuccaaucucuuuccagcaugaucuuuaaggccuauugccuuauuggauuguucucauaggccucaggauauuuaaaauuccugccauaucucuuucuaccccaagcuccacccaugucuuaucuagaugguuuuucauguucucucuaccuauuggcuuuucuuuucuucaaacuguauacaaccuuccugaaugugcuguuuuuugccugacugauuucuccucucauuuucccccuuuucauacaucuuucugaucucuacuugaaaguacuucuucagagaaaccugaccuguuacucauuucucuucucugauuaaaucagcuucccuaaugaugagcugucuuaauucccuguauuuuucccuaacacuuagugguuuauaauuguauauuuuugugauuauuugauuguuucuacacuguaaagauucuacaagggcagagaccaaguauuuuuauuuccuucuauucuauauagcacacuguucccucacuagcacuauaguauaggugcucaacgaacauuuauugugcaaauuaaugacuuuuacauauaugcaaaaaugaaggaacuguaaaaccaggacacgcauugggaaauacaucuuacccaucgugacccaacacacauaaauauauaaaauugaaacaaaaguuucacaaaacuuuaucaacuaugcuguacucuauuuucuuuuucuuuuuuuugcagggggauggagucuuucucugucacccaggcuggagugcaguggugugaucucggcucacugcaaccuucaccuccuggguucaagcuauuccccugccucagucuccugaguagcugggacuacaggugugugccaccgcaccaggcuaauuuuugugcuuuuaguagagaugggguuucaccauguuggccaggcuggucacuaacuccugaccucaggugauccgcccaccucagccucccaaagugcugggauuacaggcaauagccacugugcuuggcaaaguaaauauuuuaaaauauaugaaaauauauuguauagguugaguauuccuuaucugaaauacaugaauuuuauauuuuuuucagauuugggaauauugcauuuuacuauacauuacagaugcuauaguuacaacugagcaucuguaaucugagaauuugaaaucugaaaugagcauuuacuuugagugucauguuugcccucgaaacuuucagauuuuggaguauuucagauuuuugguuugagaugcucaacuuauguaugauaaucguacaaaaagcuauaauuucaaguauugauuugcuguuuacugggaaggaaugggaaaauuuuugaaauuagaaaugucagacuuaggacaguuggcccccuuuagugggggucucggugugggacauuuuaguggaguucauaguccugcuuccauuuuuagcauuguacauuuagaaauaugaacuuuuucagucgaccgagagugucaggcauuggaagacuaaugucuucagugugguucccuaauuaaacuggcaagaagaacuagaaucuggaucugaaaugcuugugucugcucauuagggcucuuucuagaaagucucggucccugggaaagcacauaaaugaucacauaguuuuuggugacagguaggcaggccccagcugauggguagugcugaacaggauuuuuuuuuuuuuuaaccugcugggcuucccugacccuugagcauucaccucugcuuaucagaacauucuucucugccaguacguuuucucuuguugaauaagguuaaagaagcgauaaauuccuucauuuggcucccuuuuuaccuccaucuuugcauuuguuuuuuguaccagauguuuguuuaaauuccaguccucaggacaggcuuugucugaucauuaguauauuguugauucuguucuguucugagaguccaucagauacuuugaauggucacaggcaucccuuugagugggugaacugaaguguuuuuuuugcagguaguuuaucucauuuuguuuuuuaucuauuuaacuuucuuuuuugcuuuuuuuuuauucuuuuuugagauggagucucgcugugucgcccaggcuggagugcaguggcacgaucucggcucacugcaagcuccgccuccuggguucacgccauucuccugccucagccucccgaguagcugggacuacaggcaccccucaccucacgcccggcuaauuuuuuuguguuuuuaguggagacaggguuucaccacguucggcaggauggucucgaacuccugaccuugugauccgccugccucagccucccaaaguguugggauuacaggcgugagccaccaugcacggcccccuuuuuuuuugagacggugucuugaucugucaccuaggaugcagugcaauggcaugaucucggcucacugcaaccucugccucccagguucaagcgauucuucugccucagucucccgaguagcugggacuacaggcaccugccaccaugccuggcuaauuuuuguguuuuuaguacagaugggguuuugccguuuuuaguagagaugggguuuugccauguuguccaggcuggucuugaaguccugaccucaggugauguccgcuucagccuuccaaagugcugggauuacaggcgugaucuucugugcuuggccaucuggccaucuauuuaacuuucaaaaaggaauccuucccuaaaauuugggcacauaaagugauaccucucagucuauaauauucaggcagcuuucauuagcaggaagaaucuggcccugagauagguaaaaucauuuuccuuuuuuuuuugauaauuuuauuuauuuuucuaaguuuguauuauauauacacacauaauauuucuuuuaguauuuucaaauaggcaauacaagguauguaacaagauauaaaauucagaagguauuaaaggguaaaauguguacaugguucucacuuuuagccuuuagacagcuaguucccuucugucuaaaauucccuuuuagggaauaugaacuuuuucagucgaccgagagugucaggcauuggaagacuaaugucuucagugugguucccuaauuaaacuggcaagaagaacuagaaucuggaucugaaaugcuugugucuucucauuagggcucuuucuagaaaaucucggucccugggaaagcacauaaaugaucacauaguuuuuggugacagauaggcaggccccagcugauggguagugcugaacaggauuuuuuuuuuuuuuuuaaccugcugggcuucccuuuuagggaauuuuagagauauucuauauaaauuuauguguguguuuacauuuuuuuacacaaaugguugucuucaugcucccucacuccucaguaacucaauguguauuuccuacauuuuucuccauaacugcaguauauccaucaaaaucaggaaauuaacacugauacauuacuaucaucuaauuuuuagauucuucauauuucacuauuuguuauaguaauuaauguucuucauagcaaaaguauccaguccagaauugugcaauauguauucuuguuguaggucuuuuaagcauccuucaaucucaaauauggauuugagaaggauuuucaugaucuugauuuuuuuuuccuugaucuucauggucuugauuuucaugaucuugacacuuuuuguuuuucuuucuuuuuuuuuuaaagagggaguuucacucuguugcccaggcuggagugcagugaugcaaucucugcucacugcaaccuccaccucccggguucaagugauucuccugccucagccucccgaguaacugggacuacaggugcccaucaccaugcccggguaauuuuuguauuuuuaguagaggcgggguuucaccauguuggccaggcuggucucgaacuccugaccucaaaugauccacccaccucagccucccaaagugcugggauuacaagcgugagccacuacaccuggccuggaguuuguucauuuuaaaaaaggaaauuuucaucaauacucuuaagugaagcugguuugcaguuuucuugggucguuuuuaaguuuuguuacucauuuuaggcuucuuaagaaaggauuucuaagcuugcuguuuuuuuuuuccaugcaaucuggaacaucuuaaauaacaugucauacauuucuuaaaaauugaucagaauuguuuaucuaguggagagaagauuuguuccuuauuuagugggcuuuggugugaucuuuuuccuuuuuuucuucucuucucuuuucuuuuuuggcagcuggagagccuagcaaagaggucaguuauauuugggaucuggguccgggauacaaaacuuggagucaguucauugcaccuauuugcuguuugaccuuagaaaauuuauuuccauuucuaagucuugguuucaucauuucucaaaugggaauaaucacagccugcuaacuaacaucacagagaacuuuuaagaaugaaaaugaaguaacauauguuaaagcacaguaaagaaccaagcaaaugcaagacuuuuuuuuauaagaagguucuuuuuaauaagacgucaguacucaaagaguugucaaugaggauagaucucaauaucaugcuacugaaggaguuuguguagauggacaaugccuccugcuccaagagcaagcacauggagaaagggucaauggacacauuuguuuugcuguuuaacaacaaagaaaaauuaugaauuagacaaaauguagucuagauagaauuuauuuuugugaacauuaaugaggguuuggucauguauuuauuaaaaccauguguuacgccaugcccgguggcucaugccuauaaucacagcacuuugggagguugaggcggguggaucaccugaggucaggaguuugagaccagccuggccuacaugaggaaacccucucugcuaguaauacaaaaauuagccgggcaugguggggcaugccuguaaccccagguacuugggaggcugaggcaggagaaucgcuugauccugggugguggagguugcagugagcugagauugugccauugcacucuagccugggcaacgagagugaaacuccaucucaaaaaggaaaaacaaaacaaacaaacaaaaaacaccaaaaaaaaaaaaagaaccccguguguuguaaaucaaggaaaaauguuggguaacagacuaugacuugacuuugugcuuauaucaugauuguauuuaauuuuauuauaaguugguuaaauauuugagacuuuggggaaauuaaacuugucaagcugucaacuuaucaguuuggauuuaugguuuccuauuucauuuuguagauauugaaaauacaugucaauaucuguguauuucaugucaaggaagcuguguauugguaucaggauugagggaauacaugaucaacaaauacuuuuccaaguuucagugucacagauugcauauggcaugauaauacaucacauucauuucccucaaguuuguuuuuuuuuuugacagguaguuaacaaaaaaugugcaaauugccauaauucucuaaaauaguauuucuugcauucauuaauaaugaaaaaagcaaggauggucagauuauuguguuugauguuuuucaacgucuuuuuuuuuuuuuuucaauauagccgguaucguauaugguuuuugcgauuuugauccuuuuuuuuuuuuuuuuuuuuccuuuugagauggaaucucgcucugucgcucaggcuggaaugcaguggcgcaaucuuggcucacugcaaccucugccuccccgguucaagugauucuucugccucagccuccagaguagcugggacuacaggugcaugccaccacucccagcuaauuuuuguauuuucaguagagacgggguuucaccauauuggccaagcuggucucaaacuccugaccucgugauccacccgccuuggccucccaaagugcugggauuacaggcgugagccacugcgcccgacugugaaucuuuuuuuuuuuuuuuuuuuuuuuuuuuuuaagagaugaggucucuccaaguugcccaggcuggucucaaacuccugagcucaagugauccucuugccuuggccuccccccaaagugcuaggauuacaggugugagccacugcaccuggccugauugugaaucuuuaggaauaauuggaaaguuugcguauuaaauugucuugaaauauguuuucuaaguauuucaauuuuuuuaauuuauuuauuuuuugagacagagucuugcucugucgcccaggcuggagugcaauguuacgaucucagcccauuguaaucuccaccuccuggguucaagugauucuccugccucagccucccgaccagcuuggauuacaggcaugcgccaccaugcccugcuaauuuuguguuuuuaguagagacgggguuucuccauguuggucaggccggucucgaacuccugaccucagguuauccaccugccuuggccucacaaagugcugggauuacaggugugagccacugcacccggccaguauuucaaauuuaaggcuuaguuuuuauguuugaaacuaaggaugaguagucuccauggccucccaugaguccuucugauaggacuaaauaggcuggauaaucucauaaaagucacaauguagaauugcuggaaagcgcugguccaggccacagcugggugcaggggcaguacaguccaguauuuggugaggggcucgcugcccaggcugagugcuggagggccucaaugggugaccugcaugguaguugccaggaagccaaagcaggcccaagggguugugaccuaccugggagacucaaguagcucuugcagguguugggaagccucuccccauuccagccccccugagggagacagugcaagcccagcaggcuuucagugugaacuuaacacuccugugaaaugcaaauuuuggaaacuguuggaauggccuuguuuggcugccuucucccuuuaucaauccaguuacauaaaaauaaggauuuagaaaguaaaugaguuagguuucuaaauuaauauucguaggagaacagucuguuuuucuuuuuuuuuugagacagagucucacucuguugcccaggcuggagugcaguggcgcgaucucggcucacugcaagcuccgccuccuggguucaagcaauucugcugccucagccuccugaguagcugggauuauaggugccugccaccaugccuggcuaauuuuuguauuuuaguagagacgggguuucaccauguuggccagacugguccuuuuuuuuuuugagacggcgucuugcucuuguugcccaggcuggagugcaauggcacgaucuuggcucaccgcaaccuccgccuccugcguucaagcgauucuccugccucauccucccaaguaggugggauuacaggcaugcaccaccacgccugguuaauuuuguauuuuuaguagagacaggguuuauccauguuggucaggcuggucuugaacuccugaccucaagugaucuguccaccucggccucccaaagugcugggauuacaggugugagccacugcgccuggcacagauuauuuucuuugauuuuuuuucuuuuacuuuuuuuuuuuuuuuuuugagauggaguuucguucuuucacccaugcuggagugaaguggcgccaucuuggcucacugcagccucugccccccggauucaagcaguucuccugccucagccuccugaguagcugggauuacaggugcgugccacccccaugccuggccaauuuuuguauuuuuaguagagaugggguuucaccauguuggccaggcuggucccgaacucuugaccgcaggugauccacccaccucggccuccccaagugcuaggauuacaggugugagccacagugccuggcuuuucuuuuucuuuuuuguuuuuuugacaaggucucacucugucacucaggcuagaguggaguggugagaucauggcucacugcagccucgaccucccagacucaagugauccuccugccucagccuccugaguaacugggauuacaggugcacacuacuacaccuggcuaauuuuuuaauuuuauuuggagagacagggucucccuauauugcccagccuuaucucgaacuccugagcuuaagcgauccuccugccucagccuuccauugugcuggaguuacaggcugugcccagccacaaugugcaaaugcuaccauaaauuaccauuuuuuaaaaaacgaaagcagauacuuuagacaaauuauuuauuuaaugccagugucauuguugauguuauaguuuaugauuauuuaaaaguuaaagguauuuuaccaaaugagcuacacuugauuguccauuuaaucugucaguuuaauuuguauagguauucauaggccaggcgugguggcucaugccuguaaucccagcacuuugggaggcugagacgggcagaucacuuaggccaggaguucgagaccagccugaucaacauggugaaaucuuguuucgacuaaaaauacaaaaauuagcuggguguguuagcgcacgcuuauaaucccagcugcucaggucgcugaggcaggagaauugcuugaacccaggagacggagguugcagugagucaagaucgcaccauggcacccuagccugggcgacagagugagacucugucucaaaaaaaaaaaaaaaaguauagguauuguagauguguuacugguuguauaauacaguaagauugggggaagagaccuaggcaaguuauuuccauuuuaagggcuuggauacaaaugcauaaccaaacccuaggcauuuauuuuauuuauuuuuauuauuuauuuguuuauuuauuuuugagauggagucucacugcaaacuccgccucccgaguucaagcaauucuccuuucucagccucuugaguagcugggacuacaggcgcaugccacuauaccugguuaauuuuuguacuuuuaguagagacgggguuucaccauacuggucaggcugguuucgaacuccugaccucaagugauccaccugccucagccucccaaagugcugggauuacaggugugagccaccgugccuggccacccuagacauugaaauuaauguaacaaaauacaaugaaaaaacagucuacaguccucuguuggguucacaguccuucaccaggcaugcagguuugucuuccuuuagguaauauacaaacauauggaacugucaaauuuaaaaacucaagaguaauugcuugacauacagagggauuucuuaaagaacaguuuuacgcugggcgugguggcucaugccuguaaucccagcacuuugggaggccgaggugugcgaaucacuugagcccagaaguuugagaccaggcugggcaaaauggcgagacccugucucuacuaaaaauacaaaaauuagccaggugugguggcacacacccguaaucccagcuacuugggaggcugaagcaggagaaucacuugaaccugggagguggagauugcaguaagcugagacugugcuaccgcacuccagcaugggugacagaguguuuaaaaaaaaaauuuuaacauagcauuaaaauauuuucuugcagauauuuauagaaauauauuaccuauauugauuguuucaucuuaaaaaagguuuuauaugauacuuggggcaugcaaaagacaugguauaguucuaugaauucacccagauaucacuguauguuucucuucuaucucauccaucuucucuccuuggcaaccauguccugauuuuuguguuccauaugcccuugcuuuaaaaaaauggauuugucuuuuaugcauuuauccuuaaagaguagauuaaauuugauuucagauuugugaaaauggacuuacgcuuugguuaguuuaaggcuuucugagauucauccauauuuauuuucuuuuuuugagauggagucucucucuguugcccaggucagagugcaagugcaguggcacaaucuugucucacugcaaccucugccuccuggacuccagcaagucuucugucucagccucccgaguagcugggauuacaggcauaugccacuauacccagcgaauuuuuguauuuuuaguagagaugggguuucaccauguuggccaggcuggucuugaacuccucaccucaagugaucagccugccucggccucccaaagugcugggauuacagacgugagccauccugcuuggugauucauccauauuccugggaguagcuaugauuuguuaauuuucacugcuguguaguuccaucgggugaauauauugugauucauuuccuuauuuucuuguagauugauuuuugaguuuucaguuuuuaguucuuaugaaaaugcuguaaugaacauuauuguacaugucuauuguugaacuuacgcuagaauuucuugaggcccuagcaaaugguuuuuuuuugagauggaguuucguucuuauugcccaggcuggagcgcaguggcacaaucucggcucacugcaaccuccaccacgcagguucaagcaauucuucugccucagccuccggaguagcugggauuacagacauuggccaccacgccuggcuaauuuugcauuuuuaguagagacgggguuucuccauguuggucaggcuggucucgaacuccugaccucaggugauccgccugccucggccucccaaaguguugggauuacagcaugagccacugcgcccagcgacaaaugguuuuuaaacaguugcacugcugauguuuuggugcuugguaauuccuuguuguggggacuuuuuuauguuuaacagcaucuacccauuagaugcaacuugaacucuuccucuugugacaaaaaugucuccaggcauugccaaugucucaaggauacaaaaucaccccugguugagaaccauuguuacuuuugauacaugaacaauuaaaaauuauuuuugugcguuccguauaucccauagaaggauaacacaccuuucucuuuuuuauuuuuagagauggaggccucacugugucuccuggucuagaauguaguggugcgaucguagcucacugaagccuugaacuccugggcucuggguauucuccugccucagccuuuuggguagcuggaacuacaggcuuuacagguguaugccaccaugccccgcucaacacaucuuucuuuccuuuuuugagauggagucucgcgcuguugccaggcuggagugcaguggcacgaucucggcuuacugcaaccucugccucccggguucaagugauuccugccucagccucccgagaagcugggaauacgggccaaugccaucacgaccagcuaauuuuuuguauuuuuaguagagacagaguuuccaccauguuggccaggauggucuugaucucuugaccucccaaagugcugggauuacaggcgugagccacugugcccagccucaacacaucuuucuuuggcucaagucccauuuaucuucaaggccugucucaaacccacuuuuuuuuuuuuuuuuuuuuuuuaaguuggaguuuugcucuuuuugaccaggcuggagugcaauggcgcuaucucagcucacugcaaccuccaccuccuggguucaagcgauucuugucucagccuccgaguggcugggauuauaggcacauaccaccacgcccggguaauuuuuguguuauuuuuaguagagacaggguuucaccaucuuggccagugggucucaaacuccugaccucaugauccacccgccucggccucccaaagugcugggauuacaggcgugagcccgcgugcugggccucaaucccaccuuuuaaaggcuucuccuacugugcccauuuguagucuuaucuuuuccccaggaauuccuauagcacuuagguuuguauauugaguuugacccuuaaguuuuuauugucuuguauugucaacuuuuccaggauuccucacccuucuguauuuucauccccuacccccaaguaaggaaacaacagauuuucacuuacucuguagucaguugucuaaucuguauugcuguuguugauuuccuuuggauuuuggucaauuuaggcagcuaucugggaagaauucuuuuuauuaauauuauacuuuugguguuuucaucuacagcaggguggaagcagaccuuaagcacccaaagcucucuacuccuuucugccacuuacguucucagcaaaaccucaguaacugcuagguuuuaucuuuucaaagcugcuuuugagugaguuuguuaaccucuugauguucauguuaaguacuuaaauguuagcugccccagcuguuaagucaugcaaagagucuuccuucagcuucagcugggcacaucuccggggcugugggaggacuuuuagaaugacaaugugaucugccucauuuuaucuuuucuguagugaguguagcucuuucaguagugaaugccuguguuuuacauuuuugagauuguucccuuuaccugucuaagacaagaaaguuguuauaucuguucuccuuauugcccccagguccuugaaguuaaaauuuuuuuuuugagacuuagucuugcucugucgcccagucuggagugcaguggcgcgaucuugguucaccgcaaccuccaccugcuuccaccauguuuggcuaaucaaauguaacauucuuaacaagccauccucuagauuuaaaaugguuuguaauuggaaacugaaaugguuuccaacugcaagccauaaaaacuugaaauucuucaguuugauagucaggauaacuagucccaucauuccaucauuuuucuucaaaacauacagguuuucaggccuuuuuuuuuuuuuuucuccccauaaagacaggaucucacucuuucccagccuggagugcaguggcaaaaucauagcucacugcagccuugaacucuuggacucagggaaucguccugccucagccuccugaguggcugggacuacaggcaugccaccaugcuugccuaauuuuuucuuuuuuuuuuuuuuugagacagagucuugcucugucaccaaggcuggagugcaguggcaugaucucgucuuacugcaaccucugccuccuggguucaagcaauucuccugccucaaccuucugaguagcuaggauuacaggcaccugccaccaccccuggcuaauuuuuguauuuuuaguagagacaggguuucaccauguuggccaggcuggucuugaacuccugaccuuaggugauccucccgcuugggccucccaaaguccugggauuaugggcaugagccaccccaccauuccuggguuucaggccuuuguagcuaaauaacuuauucacucaagugacagcucucugcuuccacagcuaaauacaaaaguuuaucagauuuuuccaaggcccggugcgguagcucacgccuguaaucccagcacuuugggaggcuaagcugggaggaucaccuaaggucaggaguuugagaccagccugaccaacauggugaaaccccgccucuacuaaaaauacaaaaauuagcggggcgugguggcacaugccuguaaucccagcuacuugggaggcugaggcaggagaaucucuugaacccaggaagcggagguugcagugagcugggaucaugccacuacacuccagccuggguaacagagcaagacucugugucacaguguuacauuugugagauucgucuaucuagguggagauuuggugccuuuuuuuuuuuuuuuuaauuaugagaaggagucucauguucgcccagacuggagugcaaguggccuggcuaauuuuuuguauuuuuaguagagacaggauuucaccauguuggccaagcuggucuuuaacuccugaccucaggugauccacccaccuugaccuuccaaagugcugggauuacaggccugagcuaccucaccaggccugauuaaagucuuuuuuuuuuuuuugagauggagucucgcucugucgcccaggcuggagugcaguggcgugaucuuggcucacugcaagcuccaccuuccggguucaagccauucuccugccucagccucccgaguagcugggacuacaggugcccgccaccaugccuggcaaauucuuuguauuuuuaguagagaugggguuucaccguggucucgaucucuugaccucgugaucugcccaccucggccucccagagugcugggauuacaggcgugagccaccgugccuggcugauuaaagucuuuuaauaugaaaagacuuagauucagaacugagcaggguaaggagagaguggaaaccuguaaggcauucuugcuggaguagaucuagcagaaguagcuugggucugaagaaauaguucuggcacgauuccugaccccuagaucauaacuaauuugguguguucgugaaacaaacagguuccacagcaacuuccugcuccccagaucucagucaaggugcuaugaacuuggacccugaucuucuguuuguaguagcaguggcaguucccuugacagcuccugcugcagcaguguucugggagacaucccuggggauugagcugagagucugcucuugcaaccuucaacagugcucuaacaccagucaauaucaaaucccuuucugcuuaaguuaaccagagcagugucuauggguaauugaaucaugacugaugcuauuaucaaauauaaacugaugacaauggcaagugggaaaccugcuguuuuacaaauaccagaugugcaucacauggagguuuauucacuccuauuugcguuuugauaauaauccuuucuaauaauugguucauugguguaaucuuuaugaaauuaaccugaguggcucaaaauucauuuuguagcacugaaugcaauuacuaauugagcuauuuaagcaaacuagccagccaccuacagcuacuuaaucuuacuggccuacuauaguagcucugacucacccuuaucuuaaccagauaagggauaccauacauucucucuaaagaacaccacugaccucacacacagggcuaaguaggcuaugccuauuguuaauauauccaaauaccaguugaauacucagcaggucaacaguauuucccauccaguuuaugccagcuguguaaguaugagauauaauuaaaaauuauguaaauagauuagcugugaauacagcgguguuauuguuucuaccaaauuuaaguugaauccuuuggaaagcaccauuaaagaugagguaauuuauuuuuaaucucaaacgaggugugggaauuauaacaguaaaaaguuaagagaucgggaauuuguaaacaucugcaaggauucuggcucauauugcuucucaaguauccuaauucucauacuguuauuaaaaacaaacccacaaaaaaacgaaagagaaauuggccaggugcuguggcucacaccuguaaucccagcacuuugggaagccaaggcaggcagaucucuucgagcucaagaguccaggaccagccuggaaacauggcaaaaccuugucucuacaaaaaauacgaaaauuagccgggugugauacuguccaccuguaaucccagcuacuugggaaggccgaggcaggagaauugcuugaaccagggagguagagguugcagugagccgagauuccgccauuguacuccagccugggcaacaagagugaaacucccucucaaaaaaaaaaaaaaaaaaaaaaaaaagcgacuuuaaucauauuuggaaugucucauauaauguagauuucagcucuccagaaugcagucucuugaaggugcagauucuucaggcauugagcucaugauuucauuaugccuaugaugauucagucuuggcuuuuuggucccuucaucuuucuuggggccuugcauucucuugauucuacuuuucucugcugaucucuuuccuucucucauuuucuguuuaugcauauagcagacaguagcugcuguagccccucauggcauugucucugcucucuaguucugagucccggggaagugauugugccaggcuagucaauuguagucuguaggaguggcugccugaauuuaccccuguaggcugggaagcuucuuuggggcaggggauuuuucugaauggucuuauuacaagggccaagguauaguugauucucauuauuugcaguaguuauguucuauaaagucaucaugaacaaugaacuaguaaauacugaaauguugcuccuaguggaaguacaaguuuagguuccugucacccucuggucagaacauuuucaucaacugaucaauacauaaucuuguuuuuuguguuuuuuuuuuaaagacacuguauuuaaaauauaauuguugauuuauuaacauuaaauuuguugccaacagcacuguaacucaugacugaaccaaccuuauguaacaugaauuuuugucauaagccauauagcuauagccauaaaccaugguauucuuguacuuagaaacacaagacagcacuucagcauuaugcuugggagccauuuuaagcagcuaaaucaccaacagacaguguaaaagugcaaaaaucauggcacuaaauagaccauagaauggacacuuguuugcauuaugagagcugaaacaagaaagccuuuguuuggccucagcugggaaugugugcauugggcaauucaaauuuuucauugcgcuaugcgugucugugaaugaccauacaaauggugauacaaauacugauuuugggguuauaaauaauuuuuuuuuuuuuuuuugagacagaaccucacucuugugcccaggcuggcuggagugcaguggcauuaucucggcucaccugcagucucagccuccuggguucaggcuauucuccugccucagccuccucaguagcugggauuacgggugccugccaccaugcccggcuaauuuuugugcuuuuaguagagacaggguuucaccauguuggcccggcuggucucgaacuccugaccucaggugaucuguccaccucggucucccaagugcugggauuacaggugugagccaccaugccuggccugguuauaaauuuuagugaguagguaaauuuguagauacggaaucugugaauaaugaagauugaugacguguguggagugccgagagcauuuaaaaaggacguugucaguugguggggaguguugcccaaaaagcuucauaagggagucaacguguaagauaaaguugaaagaugaguuuugccagauaggcaccacugaggauaggagaagcaaauagcaaagcaguuaugaguagaaucucagauuaggcucauuucccaucuucugcuccuacuaacuugggaccuugagcaagcauuuuauucucugucauuagugaaauagggauauucauggucccucucucaauggaguucuuaugagauuuaauuaagagaaugaacauuaaugcacuuaacagaugucuugcucacagaagguauucguaacggcguacacgugacacauaugucuauauauagcacagcaaaggagggaaauggcuucacuccuuugggaacaucgagugguuuaaagugaagcaaagguuucaagugggcaaaaggggucuuugaggagggaggggaaaggcaggagcuagauucauggcuccauacuggaacgauauugagcuauugaaggguuuaaaagagggauagcaucaucaguuuugugucuagaaaguuugcuuuauguuuauauagauguauggaagagaauugacgguggugaacuaaaggugggaaaaucagcaaagacucuuggggugguugaagaaaagaacgacagaagucacucgggauaguaauaguugguauggagacuagagaauggaugugaaagaugcucaggauguugaauugacuacaaaggucaccacuuagaaguggagaguaagagaggguaggcuugggaaggcucuugggauucugauguuggccgugcaguagaggaugggcuugguguguaggagaugcuuucacuuuucacuucuuucuccaccuuuacccugguaaaagguagcucccacuguucuuguucuaaaggguuuugugguccucucugcuucccuuuauugcagcaccugaccugugguauaauaaccgccuguguacuuguucuuuccugcacuuguaagcucuuugaggauuagcuguggucagugcuggccacaaagaggcaagcuaaacuguggauggauugaaugaauaaggaccaagacugggauagagaagcagauuuuggaggacagauucguuuuuauccuuguuaaguuuuagauucauuauugucucuauacagcuuuauacucaucuucaaaugacugugccuagcagacuggacugagauucaugagagagaggcccauguagcauuuuuccgagguguauugggaaggacaguugaggccagcauggaugaaaucucccauagugucuguguuugguggaaagggaagauaacugcagaaagagacuugcagcauaccaauaguggagggguucgcugaggaauaggggcauggaaaggaguuccagagagugcagugaccaucagagagugaggaggggcuaguugcccaccacccacaaaagcugugccuggagaggcuuuucugguuucagaggcugcagaaggguugguaagaggacuaaaaacaacauauugauuguagcaauuaaaaaguuacuggcaacuuuuucuggagugauuucaauccauugguggaggcagacaucagauugcagaugaagauuugagucaggaggugaacugacaaagaaaccccguucucuguugggguuugucugugagaggcuggggagagaaggcuguagcuugggugagucuaggaggggacaugacauacaggaagccuuugaaaguuauaugggagaaauuugagcaucuguaggcagugaggaagaagcucauggaagauauuuaauuugaauguuuuuuuuuucuuucuuucaaagccagcaugcagauguuacuauagccuggcaauaugcuaaauucuuacauuuaguggcuuacuggauccccaucacaaugcaguugguuagguaauguuaccccauuuuacugauggggaagcagaggccucauuuaaguaacuuuccugaggucacacagcuacuaaguggaggaggcaugugggagggauuaaaauccaguuauuguuccugguccugaggagaaaauaaaaauccaguuaggucuguuauguccugccucagccucccaaguagcugggacuacggguacaugccaccaugccuggcuaauuuuuuuuguauuauuaguagagacaggguuucaccauguuggccaggcucguugugaacuccugaccuccagugguccacccaccuuggccucccaaaguggugagauuacaggugugagccaccacacucggcccacuguauucuuuauagcaaaagaaaagaggaaaaaaaaauccuuuuggucuaggauccaaggcacucuguuccagaacuaucuccuugagucugcucuuccauuccuaccccuggccucagcaggcagguggaacaagauggaguggugaucggaaugggaugaaacggaugaaauaaaagcugcuuggacuugugagagagaaaugaguccuggcuuaggcaaaaauggucaggaggcucagggaguuucuuugcuguguugcuuucuaagcuggggcccaggccuggggggcccuuucaagcccucuugugguucaauaacuggguagaugugcuaacgauuaauggagaguuguggagguggccugcgacuucccuuuuccuccccaguuuagaaccauuugagaaggaugaaguuagaugaaaagucagaguauuaggagcuuugcuguugauaaagcuaagauuggagaacgugguccucuucuccuuucccuccagucuggcccuucaugccuguauuaguuaccuagggcuaauguaacuaauuaucacaaacugggaugguuuaaaacaagagacgucuauccugucacaguucuggaggcuaaaggccaaaaucaagguguuggcaggaccguguuuucucugaaggauuuaggcaggaaucugcuuacagccuuuguuguaguuucuuguguuugccaggaguccuuggcauuccuuggcuugcagcugcaugacucuagucccugccuccaucuucacauggcacucuuuccugugucugucucuucuccucuuccucuuuuuuuuuuuuugagauggagucucacucugucacacaggcuggagugcaguggugcgaucuuggcucacugcaaacucugccucccggguucaagcgauucuucugccucagccuccccaguagcugggauuacaggcacccgccaccaugccuggcuaauuuuuuuguauuuuuaguagagacaggguuuugccguauuggccaggcuggucuugaacuccugaccuggugaucugcccaccuuggccucccaaagugcugggauuacaggcaugagccacugcgccuggcuucuucucuuccuaaaaggacaccagucauaguggaucagggccgacccuaaucaaauaugaccucauguuaacuugauuacauuugcaaaaacuuuauuuccaaauaaggccacauucacagguguuggggguuagguuucagcgugucuuuuggggggacacaagucaaucccuaacaaugcccagccaaagcagugugcagagcagaagcuugcuuggcuccugugaggccacacccagugugcugaguguugggauugaaaggccagacuccaucaccucagguagggcccagaauccuucuuuuucuagccagagacauagucugcuaacugugagugcuuagguuccuagagggcuguguuuuaaaguagauacugaacuguucucuucagaggcagcagugcacaucaguucuguggcaggcuuuguuggagaaacuaauacacaaugagagcugucaguuuuuacuccucccacagaaguuguuuaagagaauacaagucagaaacacagguguagacagggaaggaaggcaauguuggauagaguauuacauuuggccggaaagcaucagacuugguuucuuuuuuauuaccaaauaaagacacguucucauuagaacaaggagaguagauguuuguccuuuaucauaauguaaaaauuuucagaaacaaacauggguuguuauaugaguuagugcuggacuuuauucaauggaaaggucuuuagcuuauuaaaaaaauucuuaggguacuugcuauaaauaucguuuuugcuguagguggucucagaaacauugaagaccagcucuguggaagcaagauaacaguugccuucagagauaguauugucauucacuuuguggacucagucaaaagaaggguagcauuuaaaaaaaugauuaucaccuucagcuaaaaaucauaguggugcuuguuuuaagauauaccuauuuuccugugacuuggaaacauuacuggaagaacauuuuaaacuucuguuucuucuugguucagaaaaauaaagguaaaagagaaacaagagggacuggggauuuaauuguagcaugauuaaguuuaguaaugauaaauauagauuaggaagaacucaaggaacagaacauuuauuaauauaaauaccuuuuaaauguaaugaauguaaguaggcaccucccagaaaaagaaaugcaaauggcuauguguguucaaaaaugaucacugucacuaagaaucaaauaaaugaaacuuaaccauacuuuuuugcccaucauauuggcaaagaucugggugguguagugaaaguuaacuuuuuagauuauuuaacauauuuaaaauuuuaugauuauccuauauuaacuuccaagauugaaaaaggucuaaaaccuaagcuaucuaggucuuuaaucuauguaucugauuuguagguagaaauaguuuuguguaaucaagggaguagugaugcuagaaacuggcagaguauauuuccuagaccaguuagcaaacuaggucaaggucuagguuuaauucuaguagccacuaauuugcugcaugucuuaacaauuucugugccucaauuucuugucagagccauuuuucauuuguuuguuuuuugagacggagucuuuaucuguugcccaggcuagagugcaguggcaccgucuuggcucacugcaaccuccgcccccgggguucaagugagucuugugccucagccucccuaguagcucggaucacaggcacgcaccaccacaccuggcuaauuuuuguauuuuuaguagagacaggguuuugccauguuggccaggcuggucucaaauuccugaccucaggucaucugccugccuaggccucccaaggugcugggauuacaggcgugagccaccacgcccaggcccagagccauucuucuguugcuuagaccagaaaucuugauucguauuucucuuacuucugucaagaaauuuuguucagaauguauuugcaaucuacaaucugagcauuucccucugcccaucaugguccaagcugccgucuuaacuugccuggguuaguguaaauugccuccuugucgaccucccugcuuccagccuuguccuuuuugacacaagagccagaaugugauuuacaauaugugagccagcucauuucucugcuucagaugguccagaaaaguuucuuuagagacagccauuaucuccuuaaaggggaauggauguuugaguaccaagaacuggauaacuaagagggggaggaaccccaggaucaguucccaucucaugcagaguaaaugccaaacuccuuuucuccccaguuucauuucucaccauucuccuccuugcuuacugaguuccagccacacgcaucucuuugcuguuccuugaagaguccgauagucucuuuccuuguuguuccuucagccuaaaauguucuucuuccagauaucuguaugauuaauucccuccuucagcccuuuguuccuccgaaguaccuucccuugccuacccuguauaaaauagccaccccuccccuuugcagucuauccccuuacccuugguucuucuucauagcauguacuuuuuauugucuguuucauuccauuagugucaggacuuuguucccuggugaaugacugcccagcaguuaggcauacaauaacuauuuguugaaugacucagugauuuccuuuuuccuauuggcuuuuuccucugccuagggaaaugcucgggccacccuuguucuuuagccugucgaagaugaacacugccuucuguguaccaaauguuucuacaaaggugaucugugggcuucuacccuguucucacugcccagauuuuucuguugcauuauucuuuaccagucaugcaagugaaucuguuuucuaaguaacuuuucuguguuugggacuacugcuuuccuuuuccugaauuugguaucauuauguaaauauguuaacaauuuggcacuuacuccuucauucagcuggcaaauaauuauugcagcagauacugugagccaggcuggggugccagacuguaugcuagggcuuaaagagguggcgagccggcauuucccuggaggagcugauggcucagugggugguuggaagugccagcaguugggacaggcaacugcuauaaugaacgcagagggggaguugggaacacggugaugggucaggcaggccuguuccagaggauuaggaaucucaggggugugcaggaguuugucaggugaggaagcaggcagaggcugcugugaggggaaggaauaccgugcagaaacacagaaagcuuugcuuguuuacagaagcacaagucagugaguauuguuggaguguaaaguacagugcagacagugaugauggacgaggccauaguaguuaggugagggccagauccagauuuuuguuuuuuuuuuuuuuugaaacagggucccacucuuucacccaggcuggagugggagugcaguggcacagucuuggcucacugcacccucugccccccggggugguaaagcaguccucccgucucagccuccgaguagcugggacuauaggcgcucaccaucacgccuggcuaauuuuuuuuuuuuuuuuuuugagauggcguuuugcucuuguugcccaggcuggagugcaauggcgugaucucagcucacugcaaccuccgccuccuggguucaagcaauucucccgccucagccucccgaauagcuuggcuuauagacaugugccaccacgccuggcuaauuuuuguauuuuuaguagagacgggguuucuccauguuggucaggcugucucgaacuccugaccucaggugauccacccaccucagccucccaaaguguugggauuacaggcgugagccacugugcccggccacgcccagcaaauuuuuauauuuuuuuuuagagacaggguuucgccauguugcccaggcuggucuccaacuccuggacucgagugaucugccugccucgaccucucaaagugcugggauuacaggugugagccaccgugccuggaccagauccagaugcuucuaaaggacuguguguauacuauauagagugaggcugcuauccugaagcccaugaauuuggggguauguaccugucuacacgugaacagaggcagguaggaauguagccuggaagguuuuucccuguugcaggcccccucccugaggcagggagaauucagaauauuuucuaccauguguuaauauauuuuugugcagauuauuuucuccuuuggauuguaaguuccuaaaggguggugagguuuaaauuuuauguaucuccuacuuccucaugugugcauugugagauagaugcucauuuaaacuuucuaggcugggugcgguggcucacgccuguaaucccagcacuuugggaggccgaggcgggugggaucgccugaggucaggaguuugagaucagccuggccaacauggcgaaacccaucccuaaaaauacaaaaauuggccgggugugguggugugauccgcucgccuuggccuccugaagugcugggauuacaggcgugagccaccgcgccuggccaaacuuucuuuaaacaaauaaugacuacaucacuaucuguagcccugcucuguuuuuuuuguuuuuuuguuuuuguuuuugagauggagugcaguggcgugaucugggcucacucacugcaagcuccgccuccuggauucaugccauucuccugccucagccuccugaguaacuuggacuacaggugccugccaccacaccuggcuaauuuuuuuuuuuuuguauuuuuuaguagagaugggguuucaccguguuagccaggauggucuccaucuccugaccucaacugauccgcccgccucggccucccagagugcggggauuauaggcaugagcccuagcccuggccagcccugcucuguuuuaaccuguuacuaucucaugacguuucacccuuuuaucugccccaucccucauuucuaauuuuucugucaggcagauuaaauucagcaaaaaaaaaaaaaaaaaaaaaaaaaaaagaggaaaacuuuuuuccaggaggauuuguuguuugugcugucagaugccagguccuaauggauuuagaagaagguuggggugggacuccuuccugaggcagccacuuuagugcuucuuacuuaccuuugcauucugugugccugucucaugauaggugcucaauaaauguuugcugaaggaaucauccuguuuauugacagcgagauuaagccuguguuuucauaguaaaaccugccuacuuuccuacuuugaucuccuauagucuuuccuuucuaugcuccagacacauuauuaaacuccuguccguuccagcgguacuuccagauauuucugcugccuagagugcccuuucucuugucuggccaacucccauaccuucuuauaagacuuaacucucccccuuucugggaaaaugauugcucauuaacccagguggaguuaguuacuucuuccugugucacuccaucacccaggcuggagugcaguggcaugaucucggcuuacugcaacuucuaccucccagguucaagugauuuuccugccucagucucccuaguagcugggacuacaggcgugugccaccacgcccggcuaauuuuuuauauuuuuaguagagauggcguuuuaccguguugcccgggguggucuugaacuccuggccucaagugauaugcccgccuccaaaguguugggauuacaggugugaacuaucacucccagcccuuguguacauuuuuauauugaaguuuguucagccucuagacaguuuggaaggugaagacagaccucaucccuuucugucuccaucgucauucuuuuccguguuuugccuggugcuuggcgauuuugcugaauggauggcuuguuaauuacuguaggaaggcaugauaugacaaucuguaagcacaccugaguaaacuaacgauuuuuaacauucucuacucagccuagacuaggccuuuguacagguacguaugugagugagagucuguuucagaacugguauauagaagcaacaucuuuuguaaacuugcaagguuagaaaauucauuuuuacggccagacacaguggcucaugccuguaaucccagcacuuugggaggccaaggcggguggaucaccugaggucgggaguucgagaccggccugaccaacauggagaaaccccauuuuuacuaaaaauacaaaauuaccugggugugguagaccaugccuguaauccgagcuacccggaaggcugaggcaggagaaucacuggaacccgggaggucgaggcuguggugugccgagauugcgccauuucacuccagccugggcaacaggaguaaaacuccgucucaaaaagaaaaagagaaaaggaaaauuuauuuuuacgucugggcucgguagcucacaucuguaaaucccagcacuuugggaggcagaggcuggcggauuggcugaggucaggaguucuagaucagccuggcuaacauggugaaacuccaucucuacuaaaaauacaaaaaagguagcccggcaugguggcgggugccuguaaucccagcuacuggggaggcugaggcaggaaaaucgcuugaaccugggagguggagguugcagugagccgagauugcgccgcugcacuccugccuaggcaauauagcgagacugucucaaaaaaaaaauuuuuauuuauuuuuuauuuauuuauuuuuugagacggagucuuacucugucgcucagaccagagucucacccugucacccaggcuggagugcaguggcgagaucuuggcucacugcaacuucagccucccagguucaagcaauuuugcugccucagccuccugaguaacugggauuacaggcauguaccaccacacccggcuaaguuuuguauuuuuaguagaggugggguuucaccauguuggcuagucuggucucgaacuccugaccuugugaucugcccgucuuggccccccaaagugcugagauuacaggcgugagccaccgcacccggccuagaaaauuuauuuuuacuuggaaggguuuugaggaggcuaacaguauagucagaucagugguucucuaccuggcauagggaacuuggcaagaggaaugacuagaggcccuuguuuguucagggguucaggcagagaugagggagucucccugagacugguagaagggaaugggaagugacugaaagagaaggguuccugcugggggagcugacauacuauuuguuaaaaaugaccuaaagcauauaauaauucaguucuguugacccuacugucuucucuccagacacugcccuaaccaucauggagguggccgagguggaaaguccucugaaccccagcuguaagauaaugaccuucagacccuccauggaggaguuccgggaguucaacaaauaccuugcauacauggagucuaaaggagcccaucgugcgggucuugcaaaggugauuauccuucgaugcuuuaaaugaaaaacaaucacuuggccuuuaauuuauguucuuaguuuucacgauuugggacauuguuucugaaggaagaaauuugcaaaaucuuuguucucguuaauccaugugaaacauuugauuucuucaaauaguaauugucuuauuuuuccuucaaguauaacuauucauacuagguugucuucuaaggcuuaaaaaaaaaaaaucaaaaccaaccaaggguggcugauggaaaccaaggagauccauguauggguuucagaggugugagaguauucauaguuuuugucaguuuuuuuguagacaacaauuauuaaccugaagguuaaccacaauuucucucuccuauccuuuuucuuuccuucuauguuuuuucuuuucuuucuuucuuuuuuuuuuuuuugagacagaguuuugcucuugccgcccaggcuggagugcaauggcgugaucucggcucacugcaaucuccaccucccggguuccagugauucuccugccucagccucccgaaguagcugggauuacaggcacccaccaccaugccccgcuaauuuuuuuguauuuuuaguugagacgggguuucaccauguuggccaggcuggucuugaacuccugaccucaggugauccauccgccucggcuucccaaagugcggggauuaaaggcgugagccacugugcccggccucuuuuuuuuuauauaacacuuauugauauauuuuaucauauaauaauauuguauaaugcauccauuuaaagugugcaauucagugauuuugaguauauucacagaauugugcaaucauuaccgcuauagaauucuguaacauuuucaucaucccccaaagaaacuucauaugcauuaagcagucauucuccauucccugcuaucacccccagcccauaggcaaccacaaacugacuuauucucucucuacauuugccuauucucuuuucuuucugguuauuuguucaacaaauguggagauugccugcuaugugccagacacuaugccaggugcuagagguagggauaugggggagcagaacagacgauguuccugcccccauggagcuuacauucuaguuguagcaucuuagaaugaugaaauaaggacauuuaagcacagauccaaaggauaaaaauaaaccagucuuuucaagauauggggacagaaagaauagcaaguccagcggccuggaggcugaccuguacuuuguggcugggaggaauaggaagguggucaguggacuugucuggcuaugguaaggcauuugggauuuuaaguguagagggaagcacugacaggcuuaaagugggagaggaagauaugguggcuguuuguuucuuucuuuugcuauuuuugggacauuauuuugaaaagaucacacuggcuccuacaugaagaaugaauugguguugugggggcagagcacaaauaaagcaccuugucugggauaguuauauuuaucuagugaagagccaauggugacccagaccagugaagaugggagaaguugucuuuggucuggauauguuugaaaauaucaucuuaucuuauucuuacgggugccagauaauauucuuaaaaaaaaaugguagugacuuaagccuuguggguguaagugacaugccccgagucauagggguggucagugaggugcugagaacucauugcacauuuggaugcauagguccaaaguaagaucuuugaaagagagauccacuauaugauauaauucaucguccaacuugagaugguuugugugucccuucuauaauguaagucuauuuuaauuaaaaaauuucccauggaagaauauauuucauugcacuuguuucaauuuauuauuguucuaaauguuaaauuuauaaucuggguuucuguagacuugucaauaucacugcauaaaucccugaguccugacagagucugcugccaggccgaaccacucaguugcacuuauguaaaggguucuccuugaaauccccagcuauggaggucagauagcauggaaaacagaagauaguugaggagagagcuuccagaacuauugggauugguguucaacuccuccugcaaauggaccugaugcuacuuguaacccacuacuuuacuguuucugguaucuguacccugaggccuguaauuagguuguauauauauauauuuuuuguuguuguuucuuuuugagacgggagucucgcucuguugcccaggcaggagugcagaggcacgaucucagcucacugcaaccucugccuccugguuucaagcuauucuccugccucagccuccugaauagcugggauuacaggcauguaccaccaugccuggauaauuuuuguguuuuuaguagagacaggguuucaccauguuggcuaggcuggucucaaacuccugaccucaaaugaccugccuuccuuggccucccaaaaugcugggauuauaggcaugagccaccgugcccggacauguaucuuguuaaaguucaugcccuuccuagaaaauuuuuuuuuuuucuuuuuuuuugagacagugucucauuuugucacccaagcuggagugcaguggcaugauauuggcucacugcagucuggaccuuccagguucaagcgaucccccucccucagccccgcaauuagcugggauuacagguaugcagcaccaugccuggcuaaguuuuguauuuuuuguagagccaagguuucaccauguugccuaggcuggucucgaacaccaggacucaaguggucugcccgcuuuggccucccaaauugcuggaauuauaagcaucagccacugccccuggccccuuccuagaaaaguuuuaaaauuugggaauauuaaguugagugaaaauuaauuaggggugggugagagagagaggaaacaagauaaagagaaaacaaacagaaacuaaagcuucguaaugacuuucucagaugagcuauccuuaguuuaacuucuuuauuggguuagcucaucaaaaaaaaaucucauuugggcuggguguggggcucacgccugcaaucccagcacucugggaggccgagguggguggaucacuugaggucaggaguucgagaccagccuggccaacauggugaaaccccaucucuaccaaaaauacaaauuuuagccgggcuuggaggugggcgccuguagucccagcuaaucgggaggcugagccaggauaaucacuugaacccgggagguggagggcagagguuggggauaaccaucucuucucuucucugggcucugaaugcagcccuuuguccuguucucucccacuuuuguuuccggaaaacauguacuguguuccacugaaauuaguggagugucuugugagguaggguggcacguucaguaacuuuagaagaggaaacagcagcuacccucacaagggagcugcaugcacacagagcacaccugcgucgcugucugcauuauguaacugaauaaaguuaaugagaacuaugauuacaaaacacaccugaguccagaccgugccucauuuuuaaaauugagacucauugacaaaguuggagacauuaauuuacucaauccugugauaauuuccuauuacucauuauuaggaauacaacgaacuguuucaaaucauuuuugccaucuuugacgucaagucacauaagcucaguuuuacuuacuuucccucuuguucuggaaguugcaguaguagcauauguauaaaacuguaccgaaucaaaucauauuauaaaaaucaagacugcauuaaugaagcugguuugcuuugggggcuaguccuggggaaccgagccacccaugauguucuuuguuaaugcacuauuuuuuuuuuuuuuugagacagggucuugcccuguuaggcuggguggugugaucguggcucacugcagccuugaccucccaggcucaagcaaguagccucccaaguagcugggacucagccucccaaguagcugggacuacccacgccuggguaauuuuuuuuauuuuuuguuuuuuguagagauggggucugcuguguuacccagaguggucuugaacuccugagcucaagugcuucucccaccuuggccucccaaagugcugggauuacaggcaugagccacugugccuggcccguuaauccacuauugacaagauuuaaugaauuggucuuaauuuaugauuugaagaaauuggucgaguaggugcaacaguagugacuuuagcuucagaugacagucugucuugguuuuucucuuucccauuuuuuagauucaugcuuuaaauuuaacauuuauuuuuugaguggaagguuugacacuuugacugucuacaaaguugauggucagguugcgaaagugaaaagaguggcagucucuucacauguaaaacuuguacuguuuuuguggaaggagauuaugaugaacuuuuuuuauauaugaagugggugaaauugguccccaacagaaaucugaacauagauuguccuggacuguagcuuaugcacaucauguaguuuuaugaacagccuagagagugcaaauagcuaucuuugcucacaaggugaagaaagauuauaagaagcaccacucuuucucuuccuccuccuugcucacuagguagaugguagaaauugcaauuuauuucaaggcaaguagugcaaaugcacauuuuagcagaaaguuucccacagggaauaggggccaggcuggguuugugggguuguugauaaaagaagguauauucuguuuugauauaaucaggaaggugaacuucagaaggaauggcuuucccucauuuagauucacuaaacauaaagauuuaacuuuggaaucuuuuaaagaucucaguauguuguguuucccuaugcaagaaaaucugaugucuuaggauuucaaauuauaguuaaaauaagauuuuuguuauagagcugaacuucugaaaauauauuccauuugaacucuuuaauuuaaaugaacuuguacacaaaaagcacaagguaauauuuggauuuuuguaaguuuauugugugccuugcuucucugucuuuagaaaauugcugcaaaauauuuuauaggcaagcaacuuccuuuuuucuuucuuucuuuuuuuuuuuuuuauugaucauucuuggauguuucucgcagagggggauuuggcagggucauaggacaauaguggagggaaggagggaaggucagcagauaaacaagugaacaaaggucucugguuuuccuaggcagaguguuugugucccuggguacuugagauuauggaguggugaugacucuuaacgagcaugcugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguauagaacaaaaugaaaagucucccaugucuacuucuuuccacacagacacagcaaccauccgauuucucagucuuuuccccaccuuucccccuuuucuauuccacaaaaccgccauugucaucauggcccguucucaaugagcuguuggguacaccucccagacggggugguggccgggcagaggggcuccucacuuccccguaggggcggccgggcagaggcgccccucacuucucagacggggcggcugccgggcggagggucuccucacuucucagacggggcggccgggcagagacguuccucaccucccagacggggucgcggucgggucgaggcgcuccucacaucccagacgauggguggccgggcagagacgcuccucacuuccuagaugggauggcggccgggaagaggcgcuccucacuuccuaggugggauggcggccgggcagagacgcuccucacuuuccagacugggcauccaggcagaggggcuccucacgucccagacgaugggcggccaggcagagacacuccucacuucccagacgggguggcggccgggcagaggcugcaaucucggcacuuugggaggccaaggcaggcggcugggagguggagguuguagcgacgcgagaucacgccacugcacuccagccugggcaccauugagcacugaguuaaggagacucugucugcaaucccggcaucuugggaggccgaggcuggcggaucacucgcgguuaggagcuggagaccagcccggccaacacagcgaaaccccgucuccaccaaaaaaauacgaaaaccagucaggaguggcggcgcgcgucugcaaucgcaggcacucugcaggcugaggcaggagaaucaggcagggagguugcagugagccaagauggcagcagcacaguccaacuucggcuuggcaugagagggagaccguggaaaggggagacaggagagggaugagagggagaccguggaaaggggagacgggagacgggagacgggagagggcucuuuuuucuuuucuuuuuuuuuuuuuuuuuuacaaaacagaaaaacauuuaauucuacacauaauauuaauuuugauuguggauaucuuuauugcuaaugaagagccugaauaaaucuguguuccauuuuuuuauuauucuggcuuauuuccgaggaaaaaaguuaguuuuuauaacauucuuaaauauagugccccuccccuuucaauaugucaucaaaauaguaagguuauucauauucauaugaauguaguaagguuauucauauucauauagucugauuguucauauucuuuucaaauauugaguguggcugggcaugguggcucacgccuguagucccagcacuuugggaggccaaggugggaggauugcuugagcccaugaguucgagaccagcccuggcaacauagcgagaccacaucuuuuccaaaaaaaaaauaaauaaauaaaaaaggccaggcacagugacucacgccuguaaucccagcacuuuggaaggcugagguggguggaucacuugaggccaggaguuugagaccaaccuggacaaauggugaaaugcugucucuacuaaaaauacaaaaauuagucgggugugguggugcacaucuguaaucccagcuccuugggaggcugggacacgagaaucacuugaaccugagaggcugagguugcagugagccgagauugcuccacugcacucuagccugggcaacagugagacuccaucucaaaaagcaaacaaacaaacaaaaaauuaacugagcguaggagcaugugccuguaguccuagcugcuugggaggcugaggugggaggauuucuugagccugagagguccaggcugcugugagcugcgaucaugccacuauauucaagccugggcaacagagucccugucucaaaaaaaaaguuaaauaaaauaaugagggugugauuucaguaacauauacuaugaauguauaucuaucuauuuuauuuuauuuuuuaauuuauuuuuauuuaguucuuuugagacagggucuugcucugucacccaggcuggagcgcaguggugugaucuuggcucacugcagccuuguccucccgggcucaagcagucgccccaccucagccucccgaguagcuaggacuauaggcgugugccaccacaccuggcuaauuuuuguauuuuuuuguagagcugagcuuucgccauguugccuaggcuugucucgaauuccugagcucuaguuauccuccagccucggccuccugaaguguugggauuacaggcgugagccaccguuccuggacaguauucucauuuuaaacaaacauacguuggaggauauaaaauauguaguauccuuauauugcuaaugaaaauuaagguaaaauugacagcucacugugaggugguuuuauuuuuuuugagcuaacaacucucacuuauaagcuguauagcacuggccaaguuacucaucuccugaccccaaguuucuuuaucugaugacgcuugacuugaguuucagaguuauagguacauguagaccuaaaugugaaagacaagacuuuaacacucuuagaauauaaaguagaccauuuuuauguccuugaguagggaaauuuuuuuuuuuuuuuuuuuuuuuuuuuuuuuugagauggagucucgcucuguccccaggcuggagugcaguggcgugaucuuggcucacugcaagcucugccuccugccucagccuccagaguagcugggacuacaggugccugccaccaugcccggcuaauuuucuguauuuuuuuuuaguggagacgggguuucacuguguuagccaggauagucuggaucuccugacaucgugauccacccgccuuggccucccaaagugcugggauuacaggcgugagcuaccgugcccagccugaccuugucucuuaaaaaaaaaagauuggagggcaaguuacaggauaagagaauauauuuacaugcucuugugcagauaugcucucucucucucucucucucugucucucucucucucucucuguauaugccuccauauacacauacacaucgaagaguauucuccuuggauauauaaaagaauauauaaaagacuucuauacauuaauaaggaaaaacccaacaaugcaauaguaaaaugauaaagagacuugaauaaguacuuuauaaaagagaguaucagugagcugggcgcgguggcucaugccuguaaucccagcacuuugggaggcugaggcggguggaucaccugaggucaggaguucgagaccagccuggccaacauagugaaacccugucucuacaaaaauacaaaaaauuaucugggcaugguggcaggcaccuguaaucccagccacuagggaggcugagauaggagaauugcuugaacccaggagguggagguuccagugagcugacaucgcgccauugcacuccagccuggggaacaaaagagaaacuuugucucaaaaaaaaaaaaaaaguaucaguaaggucaguaaacauauggaugaaaagguuucuuucuucauuuauucggaaaauacaaauaaaauucacacuugaguaccauuguacacuuaacagaaagacuaagaguuaaaugauggacaguauuaggugaugaugaagguguggaggaaugggaacucucguauauugcaguugggagugcaaauugguacaaccacuuugcaacaguuggcaauaucuaugaaauuugaacuacacguauccuaugugucaguaauuugacucuuagaagugucuguguaugcauggauguuuuagagacccaugugcauauaugcacuagaauaucuguacaaaaauauuaauagcauuauuugcaauagccaauaauuagaaaaagccacaugcccaucaaugguuaucaguuuauaaauacauaaauauuuauaagacaaaauacugaguaggaaugaaaaucaaagaacuucagcuacauaggcuguuacauuugcuuauuuauuuauuuauuuauuuugagacagagucucacucugucacucaggcuguagugcaguggugugaucucagcucacugcaacaauucaccugccucagccuccggaggagcuuggacuacaggcauugaccaccacguuuggcuaauuuuuguauuuuuaguagagaugggguuucaccauguuggccaagcugaucuuaaacuucugaccucagguggucuguccaccuuggccucccaaagugcugggauuacaggagugagucaccgugucuggccuaggccguuauauuuaaaucucacaaaauaugagugaaguauaaaagauaaaccucaaguaguauauacuguaggguuacauuuuuauacauuugcaaaacugguguauagguaugcauauagaagcauaaaacuaaagcccagcaaugaagucauugccauaaacaccguaauugugguuaccucuugggcaauagggaagaugaggcuggaaaagggcgcuuggagggccuguaucgugccagcaauaucuugccucuuacaccugggcaguaggucauuugguguuugcuuuguaauaauucacagagcugugugcuugugauuaugcauuuucuacaugugugcuguuuuucaauaaaaaaccuuaaaaagauuguuuuaggccaggcacgguggcucaugcuuguaaucccaacacuuugggaggcagagguggucggaucacgcugucaagagaucgagaccauccuggccaacauggugaaaacucguccuauuaaaaaugcaaaaauuagccgggcaugguggugcgcaccuguagucccagcuacuugggaggcugaggcaggagaaucgcuugaccccgggagguggagguugcggugagccgagauugggccauuggaguccagccugggcaacaagagcaaaacucggucucaaaaaaaaaaaaaaaguuuguuuuaaaaaaauuaaaaaaacuucuaaaggugguaaaguggccaggugcagugacuauugccuguaauuccagcacuuugggaggccaaggcagaucaguugagcucaggaauuugagaccagccugggcaacauggcgaaaccccaucuguaacaaaaagaaaaaaaaaaaaaaaagaaaaguuccagcaauagaucaugaauugcuucaugacguuguacguucuauuuuaauuuaauuuaauuuauuuguuuaugagauggacugucacccagacuggagugcaguggugugaucuuggcucacugcagccuccaccuccuggguucaaagugauucuccugccucagccucucgaguaccugggauuacaggugccugucaccacgcccggauaauuuuuguauuuuuaguggagaucagguuuuaccauacuggcuaggcuggucuagaacuccuggccucaagugauuuacccaucuuggccucccaaagugcuaagguuacaggugugagccacuacggcuggcuguuaccuucuacuuuuaaauccuaucaauauguauuuuuggucuuaauguuuucuguaucuuuucacucuuaguaauuaaguacuuaaauacugcaggcaaacacuggugugcugaggcaccuuauacuggcauuugagaguugauagugcacaucucuucccagcugcuuauguagugaugucacguugguagguucagauuggccauggugggaguacuaugccauggacacagguaaaagcuacaaaucaagguuuccuccaccuuucuggaaagcugguuauuaaagaucuacuagcauaccgcugugcuaucgccauauugugugagaagucuauaaagaauauaauguuggccgggcgugguggcucacgccuguaaucccaacaauuugggaggccgagacggguggaucaugaggucaggaguucaagaccauccuggccaagauggugaaacccugucucuacuaaaaauacaaaaauuagcugggcgugguggcaggcgccuguaauccuggcuacuugggagccugaggugggagaaucgcuugaacccagggaagcggagguugcagugagcugagaucgugccacugcuccccagccgaguaacagagugagacuccgucucaaaaaaaaaaaaaagaauauaauguugacuauguauuuacuuauuuuucucauaauaauauaaacagcacauagguacuuagaucauauucaauaaagaugaacuucuuuggggaagaaauuauuuauguaaacauaauuucgucuuuuuuuguuuuuccugagacagagucucacucugucacccaggcuggagugcaguggcgcgaucucagcucacugcaaccccugccucuuggguucaagcgauucuccugccucagccucccggguagcugggacuacaggugcgugccaccacgcccggcuaauuuuuguauuuuuaguagaggcgggguuucaccauguuauccagguugguguugaacuccugacguggugauccgccugccucggccucccaaagugcuggaauuacaggugugugccacugcgcccugccaauuucaucuauugagaggcagguuaacauaaucgcucagugugaauucaaacuguuuuaauuagaauuucagcucaaguagucuuuagccauuuuaacuucaaauuauuuuacuucugugugucuuucaauuuuaucuuuaaaaucaagauguuaauaguaccuacucaaaaugaguuuaauacaaguacaguguuugggauagugaguacucaauaaauuuugcuauugaauaacaucauauugcuuuauugcaaauauucaucuuuuuuuuuuuuuuuuacacauuugucauagagauacugagaaauucuucaguuguaguuuaucagaauacuuaaaagcuaaauuacuuggaguauuuucaagaugauauuuuauuucauuauuuuauuuuuaggugauuccuccuaaggaguggaagccaagacagugcuaugaugacauugauaauuugcucauuccagcaccaauucagcagauggucacagggcagucaggacuguucacucaguacaacauccagaaaaaagcgaugacugugaaggaguucaggcagcuggccaacaguggcaagugaguagaaucaguuugcuauuucuguuuccuucaaagauuuauguaaauauguuaagaaacaaaguagacagaggagcuuauaaaugaaaagcaggagucucccaugcaauuuuucacccuucauugaacuguuucuguuuucuguucuuuaggugguugcugaacauuugacuuaaagaaauugcucuuuauuuuauuaucucguuccuagcaguuauaaguggaacuucuuauccuauaguugccaugaguuuucguuucuacacaugauucauguuuguugggcaguuuuuuugguguguguuugauaauguuuaagccuuaaaugauuuauauguauuagaagauuaguacuuuuaaaagcaaaccuugaaugacuugaaaggccaccauugcauuaguuauuuauugcuguguaacaaauuaucccaaauuggccaggcaugguggcucaugccuguaaucccaguacuuugggaggccaacgugggcggaucaccugaggucgggaguucaagaccagucugaucaacauggagaaaccuugucuccacuaaaacuacaaaauuaaccaugcgugguggcacgugccuguaaucccagcuacucaggaggcugaggcaggagaauugcuugaaccugggagacagagguugcagugagccgagaucacgccauugcacuccagccugggcaacaagagugaaacuccgucucgaaaaaauaaauaaauaaauaaauaaauaaauaaauaaauaaucccaaaucuuagcugcuuaaaccaacccauaauuucugaaggucaggaaucugaccuucagauucugccucagggucucaugagguugcaguuagcauguuggcugggcuacagucaucugagcauuuaauuguggcuggaagauucucuuacaagagugcuccccuuucauggcuuuugaugggguccucaguuccuugucauauggacugcucuucaugucauggcagcuggcuucucccagagcaagugauccgagagagaucgcaagaaggaagccacaugucuuuccuugcccuguuucagaagugacacacuguugcucucccucuccgucuccgucucccucucccucucccucucccucucccucucccucuccgucuccccacggucucccucucaugcggagcggaagcuggacuguacugcugccaucuccgcucacugcaaccucccugccugauucuccugccucagucugccgaaugccugcgauugcaggcacgcgccgccacgccugacugguuuugguggagacgggguuucgcuguguuggccgggccggucuccagccccuaaccgcgagugauccgccagccucggccucccgaggugccgggauugcagacggagucucguucacucagugcucaauggugcccaggcuggagugcaguggcgugaucucggcucacuauaaccucccagccgccugccuuggccucccaaagugccgagauugcagccucugcccagccgccaacccgucugggaagugaggagugucucugccuggccgcccaucgucugggaugugaggagccccucugccuggcugcccagucuggaaagugaggagcgucuccgcccggccgccaucccaucuaggaagugaggagcgccucuucccagccgccaucacaucuaggaagugaggagcgucucugcccggccgcccaucgucugagauguggggagcgccucugccccgccgccccaucugggaugugaggagcgccucugcccggccgagaccccgucugggaggugaggagcguuucugcccagccgccccgucugagaagugaggauacccucugccuggcaaccaccccgucugagaagugaggagcccauccgcccggcagcugccccgucugagaagugaggagccucuccgcccggcagccaccccaucugggaagugaggagcgucuccgcccggcagccaccccgucugggagggagguggggggggggucagccccccgcccggccagccgccccauccgggagggagguugggggucagccccccaaccuggccagccgccccguccgggagggaggugggggugucagcccccagcccggccagccacccccuccgggagggaggugggggggucagccccccgcccggccagccgccccguccgggagggagguggggggggucagccccccugcccggccagccgccccguccgggaggugaggggcgccucugcccggccgccccugcugggaagugaggagccccucugcccggccagccgccccguccgggaggugaggggcgccucugcccggccgccccuacugggaagugaggagcuccucugcccggccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucugcacuaagaaaaauuccucugccuugggauccuguugaucugugaccuuacccccaacccggugcucucugaaacaugugcuguguccacucaggguuaaauggauuaagggcggugcaagaugugcuuuguuaaacagaugcuugaaggcagcaugcucguuaagagucauuaccaaucccuaaucucaaguaaucagggacacaaacacugcggaaggccucaggguccucugccuaggaaaaccagagaccuuuguucacuuguuuaucugcugaccuucccuccacuauugucccaugacccugccaaaucccccucugugagaaacacccaagaauuaucaauaaaaaaaaaaaaaaaaaaaagaaguggcacacuguuacaucugccauauucuguuuguuacaagccaguuguuaaguguagcuagccuacacucaaggggaggagaaugaagcucuacuucuugaagggaggagugucaaugaauuugugggcauauuuaaauguugucacaauuauuauuauuaaacuucuuuuaaaaaauucugauaugauaauuaaggccccagaugaaagcauaaaucuuacaaaaacaaaauaaaaaaaccugaaagaccaacaaaaaaucauaguuuccaaauucccuggaugggugugaaugagauuaagacuuugaaugaauuuagguaucuuccuuuaaaaaaauuauauuugacauuguaagcacaugaugcuacuugaagacucuuauuucugcauguuaaauuccuacuguggaacauucuggcuauuccaaagaaauugaaaauuuuauauuugauauaauuugaaucauuucuuuugaauuuuuuggguugguauuaauagaguuuuauucuuucagaucuuauuaaucgagaacaugaaacuuucaacaaagauuggaagcauuuucuuucagacucuuccagaauucuuuuauaagugcaaugcuguugaaacaagauugcagaggcaauuaaaccuguuuacaaguauaaacuauugacuguuuucuguuacuguguuuuaguacccauuuccagugucucucuuaaaguguuaauugaauagguuaggucauugaguaguaacucugcuuggcuccuuugauauuucaagggauacuuacuaaaaacuauuguuaauacucuugauaauugucauaacugccauaggaaagguacaaagugcuaugagguuucaaaggaauacaaggcuucugugguuguucauaaggaauggguaauuucauuuuguaggcacuauugagauggauuuugaaggauggucagaaacauuucuaccaguuacaaaaguaauaugugcuuauuuaaaauuucaaaaauaggcugguugugguggcucacacuuguaaucccagcacuuugggaagccgagguagguggaaugcuugaacccaggaguucgagaccagcuggauaacauggcaaaauccagucucuacaauaaauacaaaaauuagccaggcaggugguaugugccuguagucucagguacucaggaggcugaggauugcuugugccugggagguugaugcuaccgugagucgugauugcaccguuguacuccagccugggugacagagcgagacccugucuugaaaaaaauaaauaaaauuucaaauauagccauauauaacuuuaacucuaagaggcaaucauuguuaguauuacuuggcaauucaaaauauuauuaagacuugagccuugaaguucuuucuucucuuguuauaaagaaacuuugaucauccucucuagcccauuugauuauuucagcaugguaucgguuuucuacuucaagauaauuuuacugaguacacauuuuauacauaucucuguuaaauuauuacucuacugacuugguuguagauuuacucuuucugaagauagccauucaggugacauuguuuuguguaucacuguguacacagugcuugguauaguaucugggauaugguaggugcuuuuucaaaugaauaaauaguguuauaaaaacuaaaauccacuuaaaaugguauaaauuuuuaggcaaauuguaaagauuuacuuauuaacagaauauacauuucuugacauucugggguuuagagaugguuuaaaaaauuuuugguuuuuuuuaaguuguaaaauguaaccauuaugggaaauuauuugaaaaauuauuucuagcuuuaauuuuauuucuuuugaaguuaauuuacgcuggguacagugguucacgcuuguagucccaacacuuugggaggcugagguuggagaauugcuugagccaggaguuucaagaccagccuggucaacaaagugagacccugucucuacaaaaaauaaaaaauuagccaugcaugguggcaugugucuguagucccagcuacucgggaggcugaggcaggaggauuacuugagccugggaggcugaggcuucagugaguugugauugcaccauugcccccgagccugggugacaagagcaagacccugucuccaaaaaaauaaauaaauaaauaaauaaaguuaauuggucuuuugauuuggacuaguuucauuauaauuguuguaauguuaaacaacuuuugaaauucauauuuuuuguauuucuucugccaguuucauguagaaauuuauuucaaaugccaaggaaauggauuucuaagccucaagaaccaaugcucuuacuugucaacacagagcugugccaggaucaccugguuguggaauggucauguuaggagauuaauuuuuguuggagacaagagguuuucugcugggcugucuuuuuuuuucugagacagagucucgcucuguugcccaggauggagugcaguggcgugaucucggcucacugcaaccuccgccugcuggguucaagugauucuccugccucagccucccgagcagcugggaccacaggugcgugccaccaugccuggcuaaguuuuuuguauuuuaauggagaugggguuucaacauguuggccaggcuggucucuaacuccugaccucugauccgcccaccucggcuucccaaagugcugggaucuuuccauucaucuguuuuucuuuagcaccugaccuggcauuggugcaccgucuguaauguacucagucuuagcaguagagacgaugacaugcucauuugguugauaaugcaauguaguccaaagaaaaccuagagauuuccgauauaacucuaauauaaaaauuuauaaugguagguaauaugaaucacauuacugauguguacuuuccucuaggcacagagccaagugcuuuccauaauuaucugauggagcccucacaacaagcuuccuguuuuuaucccuauuuuuuagaagaauaacugaguuccagagaaauucagccccgugucuaggguuuuguggcuuaugaauggaagccugaguuuaaacauguguagccuggcccuggagcucaccucuuaagaacuguacugcaaugagugagagguucuggguaagaagauaugguugaaucaguaucgggcaaauuuacacuggauuuguggaauagcugugauuguccauuaggaaggacaguccauuaggaaggacucugaucaguuacuagccaagucauuuauuuuguuuagaauuaauauuuguuuaauauauuuaaggauuuuagaauuuaacuucaauggacaauaccaaacuuuaucuuucucucuuagaguuaugaguuuuaaaaaauugauacugcacaugccuguaauuccagcuacucgggaggcugaggcaggagaaucccuugaacccaggaggcggagguugcauugagccgagaucaugccaccgcacuccagccugggugacagaacaagacucucaaaaaaaaaaaaaaaaguuguuacugauugaguacauagugauagauuggucuugguauagguguaaagcagauuagggcuucaguuuccaacaaucuuggagguuucuguagaaguccuaauaaacagcaucucugcuaucuucuccuuucugaucauucuguguuuuggggcagugguccccaaccuuuuuggcaagggacugguuuuguggaagauaauuuuucuauggaugggaguggugggaugguuucgggaugaaacgguccuaccucagaucaucagacauuagguucucauaaggagugugcaaccuagaccccucacaugcacaguucacaacaggguucauacuccuaugagaaucuaaugccacugaucugacaggagguggaacucaggcaguaaugcucaccugccacugaccuccuaugcaucccuguuccuaacaggccgcggaccccuacuggggauuggggacccauucuccgggaaauagggauguacaccugucucugucaccugacucugaucuuuaguuagcuugcuuagcuugugccuggaauucccgauacuacuggaaccuacuagcagaagugguggaaugaugacagauuaauagugcuuucaugcuaauccuuuuuauuaaaaacauuuuuaaggcugggugcgguggcucucgccuguaaaucccaggaguugggaggccgaugcaggcggaucaccugaggucgggaguucgagaccagccugaccaacauggagaaaccccgucucuacuaaaaauacaaaauuagccaggcaugguggugcaugcuuguaaucccagcuacuggggaggcugaggcaggagaaucccuugaaccugggaggcggagguuucagugagccgagaucgugccgcuguacuccagccugggcaacaagagugagaccgucucaaaacaaaacagaagaaaaacauuaaaaaaaaaauuuuuaauucuuuagaaaauagagggucucacuaccuaggcagaccuugaacuccugagcucaaaugaucuuccugcuuugggcucccaaaaugcugggauuauagccaccaugcccaucccaugcccauccuuuuuauuuuugacugugcuuuauauucuaguguucuggguaaauucaaauuguucuauguuuuaaauacaguuguuaaauuaaguuguuugguauuuugaauacaguuguuccauuauuugguauucuuguuacacagauaacuaguuugggguccccaguauagugaguguagaugucgguuauucuguagucaaucuaaaauguccaguaugcuuuauagggauucuacuacugcuaaauaccuuuuuaacuuugcuucauuauauucucauuuguuucuuucuuugcuuauuuucuuccugaagaaacauugguauuccuuuuauguggugagauuauuguucaaauuccuaauaauacagagaaguaagugcuuuucuguaauuucuaugugagagauaaccauuaauaauuugguguacauuucuuucuaaugacuuaauauacaauuacagguuuuuuaaacuguaaauaggauauaguauacacacuauuauguaaccugauuuauucacuguggauagaauuugaugucaguaucuugaaagagcuaucuuguuuuauauucuguauuuuuuuuagcuaauuacuaguugauggauauaaacuuguauuuucaauuaaugcugcagcaaacauccugggucaacuguuauuguacacaucucucuguuguuagggugaauuucuacuuuuagauuuugggucagauaugucaauuuuuaaaaagcuuuuuauauguuuagaaaaauuauaugcuggaaugguuuugccagcuuauauucccacucuaguugucuaagaggugucauuauuuucuugccauuaauauauucagcauuuaccaauauaauaacugcaaaauaucuuauuuuaacuuuacuuucuuggauuuuuagugagauuauuguuugucaguguuucucuaaguguuaugucauuuuuauauaaauauguaaaauuucuuagcauaguauaguugauuaaagauuuuaaaaauacuuuaaagcugaaauaaugacuuuuaaacugcuuuucugcuucuauuguuguuuucgugaaaguaguuuucuaauaaaauguaaaguaauauugaguauucagcaaucuuaagacuauucagauagcuauguaaaucaguuuguauguuuacuuguuagaauugacaacaugcaguauuuucguuuugguaggauuuuguuuuagaaagugauuuaaaucaauuuggugggaaaaacccuaaaacugacuuacugguuuguacauuuuugucaucuaccuuuuacagauauuguacuccaagauacuuggauuacgaagauuuggagcgcaaguacuggaagaacuuaacuuuuguggcaccuaucuauggugcagauauuaaugggagcauauaugaugagguacauucauauuuacagugaguuuuguaaagaucauuggaugugacaguuuuguuaccauuuaagcaguuuagaaguguucuuuuguugugcuuuugggugauccauaauuccucaaaggacaacaggaaauauucaucaguaggauuucugcugcugguauuuuucaaacugaagcuagauaaucguacaaauaccugaaauuguucaguaguaacaugguaugugguuaucuggcugaucuuuucauuacauuaaaacuuuuuaaagcaaaaauacauuauaaaaauguuuggaaaacaggaaauaugaugcaucauacugacaccuuaaagcagaagcaguauuuuagauauauuuuuccaguacuuucccucaaucauuaaaaaaauguuauauuugaacaggcuuauauuguccuuuuuuucacagacaaauuguaauauauauauauauuuuuaaaaaguacauguuauuacagucuagccauuuuaaugguggcguaauucauugguuauauucuaauucuuuuugccuuuuccugauauuuuaaaacccuaauucuaaaaguucuuugucuuuugaaaccuucuaugcccucucucauuauuuucuuuuuuaauuuauuauuucuugaaauauuuauuucaaaacauacagggucucaguauauugcccuggcuggucuugaacuccugagcucaagagaucuaacugccucggccuccuaaagugcugggauuagaggugugaaccaccaggccuggcccauuauuuucuuucgaaaaauuucuuaucuacugaaagguggaacuagugcaauacacaccuggauaccauucacuuagguucacuaguacagguuaagcauccuucauccagaaauccaaaaucuaaaugcuccagugagcauuuccuuugagcaugaccuuugagcaucguguugaaacucagaaaguuugggauuuuggagcauuuuggaagggaugcucaaccuguaaguauaaugcaaauacuccaaaauggggaaaaaucugacaucugaaauaccucugggcccaagcauuauggguaagggauacuugaucuauaguuaauauuuugccacauuugcuuaauguuucuuugugucucuuuaucucuguuucuaucugucugucuuucugucuuugauguaugaugcaggcaucacgauaguucacccugaauuauauaagcauguaucuuuuaaugacaagagaguuuaacauuuauauaauauuaucuaguguauagaccauauucaaauuuucccaguaauguuauaacuguccccccgcccuccuuuaaggauucagucaaggauuccccuuuguaacuaauaagugaucuaugggguauacucaaauauuagcugacuaucuguccccaacagccuuucauucaguggauuuggcaucuauggcauucauucauaauccuugccuuaauuccauuauuauauuauuuuaaaaccuuuuuuauuuugaaauauaaaacaagcuagaaagugcauagaacauaaaccuagagcuuuaugaauuauuguaaagugaacaccuguguaccauuucugacacugaggaaaacauuaccagcaccguagaauucccuuaccugcccuauuaccuacuauaggcuccccuuuuccuccaaagguaacuagaucuucugacuugaagguaaucauuuucuucuuuuguuuaacaguacagcucaguguggccuguuucugaauuuuauauaacuagaaucauucagugugcauucuuuuaugucuggcuucuuauacuucauaccuuauaccuucuuauauaccuuauauauacaugguuagcuuuagaagaaaacauuuuuuccagcuuacacuuccuauagcaauguuuucaaguuuccuuugccccacauccucccuaacacucgauauugucauuucuuuaauuuuagccacucuguugguguguguagucguaucuuuugguuuuaaguugcauuaugauuuuuuccccuuauguucacugaauguuuggauuuccccuuuagugaagucucuuauacacuucuuuuuugucaugcuuuucuuuuucuuuuuuuuuuggcuuaaguucccuuuucugugguuuuagugauucuuacugguuuauacuucuuuauauauccugcguaugagguaguagcacaauuucaaauaugaauuuuuaauugcugaacacuuauuucaaagacgauucuuauuuuugaagauauaugauauuguagaauugucauauuggauggaaugauggcuauguaauuuucuuaauuuaucaauuaaagaugcauauugaaggauauaugauugaaauaacacgaggguugggauuuguuuuucaguuacuuaagaaaauaaaguugaauggauauagaugaaagaagauuggccccucccccugcccccccccccacuuuuuuuuuuuuugagacagucuuguucugucacccagguuggcaugcaauggcaugaucacggcucacugcagccuugaccuccuggguucaagcagucuuccugccuccaccuccuauguagcugggacuaccugcaggcgccaccaugccuagcuaauuuuuaaaauguuuuuuguaaagacagggucuuccuauguugcccacgcuggucucaaacuccugggcucaagcgauccucccucuucagcuucccaaaguguugggauuacaggugugagccacugugcccagcccagcaaaauauuuauaauugaagcuaguugacagacugguguuuuaaauacguauauguuugaaauaguaaaaauaaaaguuaaaaaaauagccuuuccucauucugcaucugaauuuuuacuaguauaaguaaucucuauguugagaauguauuguuuauuaaaguaguauauguacauguaggaaaauggaaaaauacagaaaaacgugaagaagagaauaaaaaauugcucauaagguuaucaaacaggaauaaccuuuuuuuuuuuuuuuuuuuuugagacagagucucacucuguagcccaggcuggagugcaguggcgcuaucuuggcucacugcaaccugugacuccuugguuuaagcuauucuccugccacagccucccaaguagcugggauuacaggcacgugacaccaugcccagcgaauuuuuguauuuuuaguagagacgggguuucaccaucuuggccagguuggucucaaucuccugaccuugugaucugccuaccucagccuuccaaagugcugggauuacaggugugagccaccgcacccugcccaggaauauccuuuuuaugauuuccuuuuggucuuucuguuuuaugugaguguauguauauaugcaugccugugauugcaugcguguucauguuuaccaccaaagaguugagaagguuuuuacaguuuuuugacuuuugaaacauuuccaauauugcuuuccagaaggaucauuucaguuucuuuuagcacaagccacaucuagacuaccaauuucaaaucguaccuuguauuacaugguggauuuuuguucguuucaguuucaaguguauuguuugcugauuuauucuuuagcaauaauaaauuucuuaugagcuaaauguaaguuuagcuguugugggcaagucauuagauguugcccauaggcaggggcaaguuaugcacaugugugauaaaggugagggcucagagagaggccaagagcagguucuagugcuuagagcaauugucugggaaggguguggcagcaaguaggacauguaggaaauugauggugagggaugugggcagaugggagugggcauauugaaaacauuugugugggucccguaucuuuaugcucuuaccaguaggcuuccuuaaggaauguggcaucuugccuuguuaaaccagcuucugugcgauuuccauuggaaugggugaggcagcuuaaguacuguuggccuuuuacacuuaacaaaacauggggcccagagagggucaagugcuuuuccaaaguugggaggcuaguaaaagggccaugacacgcucuuaucccccacaccaguauuagagaagucauuaugcauagucagucucauaguuguggaaauauguaaaacuaggucuuugucaacuagauauugccccugagcugauggguauauuuuguacuuucuccauaguuucuuccugugcguuguaaccuggcaaauguucaggcuucugagaagaagguugagcugaugggucauccagauccuggccugaaaguugcaugucugagugcuugaaaauaaaauaaaacucaaucuuaaguuuuuuuucuuuuaagauaauuaaccuuuuuguucccuuauuuuuguauauaugauuaagaguuagaagcagcauguuugggaacauuuucagaaaaauugauacaaaaauguccugaauuagcuguauguauuugguagugaaauagcauaagcauugacuguaaagaugagguugauggacuuugguuugcagugcuuaucaauuuacugcuuguguuugaaagccauuuacucauuggcauuucuucaagggaacauugacuuuagacuucagauuuguguaacuuuuguuauuaaaauccaaugaacaaaauccacugguuuguaaacacgcaguuuuaaaacauccucaucguuuacagguuuuagagcugggaauguaucauuuugguaggaccuacaaggcaguauuuuauagaauuucugcaggcuguguggaagcauuuagcagcuccugaguuggacugacauuuucaugcuuuuguagcauaaggaaagacaugagaggaguguuguaaacugcuucugguaaacaaaaccaaucacacucaagacaccuaaauucaacaaaugagaaauaacuuguauuuacccgccuugagguagacaaagaauaacaaaagaaaagagugcauuaaagggcaugauguagagugaguguaauaauugcuuacugucaggaauguuugaauucauuguaaugaaugugcauuuaaaaagcccauggauuguuuugcuguugacugucuuaucuuuauauuguuuaauucuuuaguucaguauuuaaauuguaccaagaacugguuucucgugguucauggcauuauuuugaaacgaauuauagagucaucaaauugcaguuuccuuuuuccuugaauuucuagugguagcuauuuaccuuaaucuuaaaagaaugguaagaaaaucguagccguuuuuuggugggggugggaguucuuggagaggguauggggagauaagagaaguaauuugugcaaggugcaaagauggauacgaauccugcuucucaaguaguucauagacuuugugggguggagggacaguuggugcagugggcuugacucuuugcagccugcgggagaggcaguaugagcaggccugcauucaaguaagacuuucuggaguggggacgacaucugaacuuggcuuugaugacuaaguuccagugaaaggagagagagugaaaggugggaccagagcuagguaaauugaagggugagaccacaccuaacagugucaguauuuuugcugaaauugcagguuguuugcugagcaggagcauaggagggugaggaaaaacucgaauagcagcugugggauaugggagaggggccugagacagggcugugguccugggucguggaucugacccauggccccacagcagccccaccugcuuuguuccagagucugaauuuugucucuuagccccaggcaaaucuuuuaaggagcagagaaggugccaugguaguuuucauccagcugggauauagcauaggaauuaggggugaggguguuuuuaaaggacuagaucagaauagucauccucgacagaagagggagagggccuggaaauccccuggcuugugucuugaucucucucucucucucuuuuuuuuuuuuuuuuuuuugauaauacuucaaguucuaggauacaugugcaacgugcagguuugauacauagguauacaugugccauguugguuugcugcacccaucaacucaucauucacaguagauauuucuccuaaugcuaucccucccccagccccccaacccccgacaggccccagugugugauguucccugcccuguguccaagugaucucauuguucaauucccaccuaugaguaagaacaugcauuguuugguuuucuguccuugugauaguuugcugguaaugaugguuuauagcuccauccaugucccugcaaaggacaugaacucauccuuuuuuauggcuacauaguauuccaugguguauaugugccacauuuucuuaauccagucuaucauugauggacauuuggguugguuccaagucuuugcuguugugaauagugcagcaguaaacauaugugugcaugugucuuuauaguagcaugauuuauaauccuuuggguauauacccaguaaugagauggcugggucaaaugauaauucuaguucuagauccuugaggaaucaccacacugucuuccacagugguugaacuaauuuacgcucccaccaacaguguaaaagcguuccuauuuuuccacauccucuccagcaucuguuguuuccugacuuuuuaaugaucaccauucuaacuggugugagaugguaucucauugugguuuugauuugcauuuuucugaugaccagugaugaugagcauuuuuucuugugucuguuggcugcauagaugucuucuuuugagaagcgccuguucauauccuuugcccacuuuuugaugggguuguuuguuuuuuccuuguaaauuuguuugaguucuuuguagauucuggauauuagcccuuugucaggucuuagccucucuuucauucuuuuuuuuuuugagauggaguaugcucugucauacaggguggagugcaguggcgcggucucaaccuucacccccggguucaagcaguucuccugccuuagccucccgaguagcugggauuacaggugcaugccaccacaccugucuaauuuuuguauuuuuagcagagaccgugauucgccauguuggccagacugguuucuaacuccuggccucaagugaucugccugucuuggccucccaaagugcugggauuauaggcgugagcugcugugcccggcuggccccucuuuuauucugcugcugcuuucagagcuugauuuccuuagguuauacuaaaaaaucugaacaccauggacaguaaccuauggcaacaguaacacaacuuaagcaaguuauuauuuuuaaaaccaaaaaaccaagacucucaaaggcauggggcgaauccagccuuuggguauauauugaagagcaggguuuggcugucaaguucugccuuuugcugguuuuuguaauaaagcuuucuuggagcccagucuuuuucauuugcauauuauauauuugugcacuaccguggcagaggugcuuuaguugugacagauuauauggccuucaaagccuaauauauuuacuguuucuuugcagaaaauguuugucagccccuuauauggaggauaauuauuuguucuuggggaagacuguacaaauccuuuuugagauagaugggauauaaauaaaauuggaauguucucaggaggaugagauuaauauaauugacuacauugauucauugcaagaaagaaauuggaguguuugguaauuucaggaaccuucuguaguuaaaacaagaucuuagaaauagagccaucuuugguccugaguaaguccuagaugauucuuuggaaacaguacauacacauaaggaacuuaagaucuggauuuuuuuuuguuauguuucacuaagggcuggucugccgaugaaguuuuaauuagccuuuguuaacaagccuuuacauuaaaauacucagccuucuguuagacgcagcacaggaguuucuucgggaaacaaaacaaacacacaaagauaaagauaaaagagggacugagagaaaauaagauuuggcuaaaggaccugcaagucagcagaugucuguagaaaagacagaagguauaacauugcugagauggccaguagccauguacaccugcaucgaccuuugaaggcaaagcuacaucucuuuuuuucugugugugagagcuaagaauagacaucagcauuaccuauguuaguacagugacaaaggaucaucagguuuguguucuguccuauuuugggcugcauuucuagcaauaccuauuguguagcauaaugaugauucuucucgugguaaugcuucauuaaauagagguauaaaaugaaguucuacauguuuugcucaugcuauuaccuucauaaucuauaacccuagauggaccuuccaguguauuguguguauucaagucgucuuugcaagauuuucccuuugcugagcggugacacauagcuccuccucucauccucaucucuauucuccaucgugcuggcuuuccaguuuaaaugccucauagcauaacaugcaggucagucuucaguggccccuuggaaccaauguuuugcaccaaaaggggguagcuuauccucacugucagaguacccauggagcaauuuagccuuuggauucuguaauaaaccuaugggauagcauuucauaaagacugagaauuuccuguguguguaaccaucuuugaugauaguuuucugcaggucacuggaggaagguagccacacuucacugugaggggauggugcccuaccugucaccuucaacuucugcuaucucacacuguuguuggauguuucagaccauuuugcacuugcuuugaaacuuagcuccuucacugaaucacguugcuccuucguugcugcugccuccagaucuccaaagguguccccuacccucuccuguaccagccagauaaucauuggucuccuacccugagaauggcuaugaguccacugcaaaaggaauuucucuaguuuuucaaaaucuugagucacauggugaagcucuucaggagcaacucugcuauguugaagagauugggacaugucaaguuaauaucugaugggccuccuuccuucaguacgcaccaucacuuccaacucuucguaggcuucuguaggucucauaugcucacuuacuuucuccucggguuuuucuacuuuuucaggagacauuuucacucauacugaugggaagaugacagcaguaaugccaauacacuuaaugugggcgcuagaaauaauccuuuugggaaaacaucugagauacaacuuagcugcagacuauauucucugaccuagauuuguauacaacugaaacaguucuguugguggacaccaucauagagagucuuugauuuggacagugaauauuggguaaaaaaauuauuguagcaaauaguuggaaaaugauaacagaggaugaagguuacuuguauuuguuuuugugguauuucuuuucguggcuauuucuucugcaguagacucugaguucauuggugacaggugucauuucucauguauucucuagcuccagucucuagcauagggucugaugagugcauggcauuggaaaaauagcugugaaaaauauugugaucugauaacagacugcagcaagauggucuaguuacagcaagaggcuuggggagggcuucggaugagaagggugaagaggguucaggugagcuuccccagugugcauuuuucugaacucuuuuacuccaagacaguaguucucaaacuuucaucuuaaggcccuguuacaauuguaauaauuauugugaaccucaaauaacuuucauuuaaggagguuauaucuauuguuuuuuauuguauuagaaauuaaggccgggcgugguggcucacgcaagacuccgucucaaaaaaaaaaaaaaauuaagagaauauuuaaaaaauauuuaauucauuaaaacaguccauuauauaucaacauacauuauuuuauacaaggugaccauaggguagagaggagcagacagaaaaagaaaaggugacuguauuuccccaauuaaaaaauuaguaggaagagucacauuauuuuacauuuuucaaaucucuuaugucuagcucaauagaagauuguggccagguacgguggcucacacccauaaucccagcacuuggggaggccgaggcggguggaucaccugaggucaagaguucgagaccagccuggccaacauggugaaaccccaucucuacuaaaaauacaaaaaaauuagccggguguggugacaugcaccuguagucccagcuacccgagaggcagagucaagagaauugcucaaacccaagaggcagagguugcagugagcugagauagugccauugcacuccagccugggcaaccagagugaaacucggucucaaaaaaaaaaaaaaaaaaaaaagauagcuggauuuuuauaucagcuucuacauuuaaucuguuauaaagucauauguccuauagcuucuggaaaacucuauacucaugagagugaaaaaggcaaauacuaauuaauguucugguauaauuuugaaaauaguuuugaugucacagacccucugacaaggucugcgugucuuccugugguccucggaaaacaccuugacaacugcuucgguaagauacauagcaaaagaugacuuaucuauugcacauagaugaugcagagaucuuagggcaagguaacuguguucuaucuuuauuuauuggccuucagguaacugcauuccugauauguuucugaaagaacgaaucaccuucagagacagugauucucaaacuggaagccauggaguucuuugggguacaucauguccuguguuuugucuuauaaaccaggcaaaauuuuacaaguggacagcaugugaacucaugucucugcaucucaaaauauagaaaauauuuuaaauuguaccuccaagauuuuucuucaauauuaauuugcuggccuauugcuuuuguuaucuucagguauuuauuaauggaaaagugauagaaaauuuaaaacaguuugaaaaauauuguggcaaaucuuuuuuuuauuuauuucucugucucucuuaagacaaggucucacuccauugcacagccugcagugcagugucacaaucacagcucacagcagccuccaccucccaggcucaggugauccuuccaccucagccuacugaguagcugggacuacgugugugcgccaccaugcccagcuaauuuuuuguaguuuuuguagagacgggauuucacuauauugcccaggcugaucucaaacuccuggcuucaagugaucuuccugccuccgccucucaaaguuacgggauuacuggcaugagcuacugugccuggccuuguggagaaucuuaauacaaaaaaauauaaauguuuuauauauuucuucuugagcuggggaaaaguuuuuuuuuuuuugcuaugcucguacuagguggaugggugguugguguccuauucuuuccauuuuguuuuuaguuuucuugauaaucuauaaguauaaauuacaccacuuuaagguaaaaguuaccuuuuuguuaauauaaacauuacauaugaaaaauaugggaagguauuacauagagaaaaugaaaaucauucauaauccuggcauucagagaaaacagcugucaaaacuguuuuguauauuuccuuccauuuuuucucuaugaaugcuccauaauugcauauaaaaaaaauuuuugugguacaaugaacauaguuuuaucccccuucuguuugacccauugugaaugcuuucccaugaugauagauguucuucaacaagaugauugaaaauuuaucuuauuuggccgggcgcgguggcuuaugccugugaucccagcacuuugggaggccaagguggguggaucaccugaggucagcaguucaagaccagccuggucaacauugugaaacccugucucuacuaaaaauacaaaaaauuagccaggcaugguggcagggaccuguagugccagcuauuggggaagcugaggcaggagaaucgcuugaaccugggagguagagguugcaaugagcugagaucgcgccacugcacuccagccugggcgacagagugaaacuccaucucaaaaaaaaaaaaaagaaaauguaucuuauuuuuauuguuuuuauuggcaggaugguuuucacagguagaggaaagcagauaaaucuaauaugaaggauguggguggguggaggcgggagaguaugacagcuccugaucuuguguuggucaguguggggcagggcacaguccacaguggguggccagaucgcugcuaaccugagagaguggcaccuugcacagacacccacugccccauuuucugccauucuucugcagcuucuugagauugaagacuuuauuaaacaucacagaauauuugaccuguuuucguuuauaaucaaugucugccauuccuagcugugacuuucaggaaagcucuguguuuuucucagagucuucaucuacaaggggaagaaauugaauuaacugcucucucucguuccuuccagcucagaaauguuuacuuuaugauaagcaauauuuaagaugaacuaaauucaaugauagugaauuuuugucaguuccagauuucucuuguauuagaauuuugucaaaucaagagcuccuuuauaagaaaccuguuggugaggcaugggaaucuuuucacaccaagguguuagacauaguggcauuuaaccuauagacuuuuuuucccucucccucaaugggguagcuuaaauaccuucauccagcagauggugcucuuggacagcaaauuuauuugaggcuguggguuuccaaaugagguaaaacaguuuaaacgguuugagucaccaggagaguuccuuuccauuuuuuauuuuuaucaugucaggauaucauuuacuuugaaauaacaaaucguucaaagccagaacacuaacugccuaaauuucacauccaaggcaaagaugucauccuagacagguuuugacgcagagagagagcuauuggcuuguaggauugugacuuucagguuuuaguucugugaaauaaggcuucuagguaaucacagcucauuuaucugcuagcauguuauggcugcucuuuagugaagcaggucagcuugcaugaccccaaaaguuaucauccagacaggggaggugauggacagcuuuauuggucacauugcauccagaauguuuccguuaguucuagaagcuguguuuucagagggguguugccagagcagcacagcugggauggugcaggaauuguuggaagagcaguuaaagcccaugugguuguugccccugagaauggugcaaguaggaagguuaggugggaucacugugggaaaauucagucugucucuggaauaaguuucuuuuuuuuuuugagacggagccucgcacugucgcccaggcuggagugcaguggcgugaucucagcucacugcaagcuccgccucccagguucaggccauucuccugucucagccucccgaauagcugggacuacaggagcccaccacaacgcccggcuaauuuuuuguauuuuuaguagagacgggguuucaccaugucagacaggcuggucucaaucuccugaccuugugaucugccugccucggccucccaaagugcugggauuacaggugugagccaccgugcccggccaucucuggaauaaguuucuaaggaauacaucugccccagagcagguugggcugccacuugagguaaggaaauacugaccuuggaauguucacguagagaccgucugaucuucugucagacauaguuuaaaaauuugggguggggccaggugcgguggcucacgccuguaaucccaguacuuugggaggcugagguggguggaucaccugagguugggaguucgagaccaaccuggccaaaguggagaaaccucgucucuacuaaaaaauauaaaauuagccgggcguggugacacaugccuguaaucccagcuacucaggaggcugaggcaggagaauuguuugaaccugggagguagagguuggcaugagccgagauggcgccauugcacuccagccugggcaacaagaucgaaacuccgucucaagaaaaaaaaaauuggguuggauaggaugugaguagaauuggccguuucucuuuucacucuucucuuuaccucucaacuguuaaacuucacaguugaaacauacuuaaauguuuaauaaccugguaaauugauaaaucaacaaauauguguggagaaucacucugagugaucgaugauugugagacgugucagcaaugguggguguuggccagugcaaggagcuuacugguuagcuugagagucaugaaugguuucccugagggauaaacaacacacacuauacaggcagaagccugguggauggcaugaauacuacacacaguaggaguguaaagaggugaagauuacugggcacuggcaaaguccacaagacuguacugagaauccagggcauuauggacauuaggcauggugagcaaugugagggaugaggaagcugagccuguuuugugaguucuggaugauuggcaugccuagaggggcagauuucugugggaaaguauuagggacacagcagugagaauucagugagaauuacuaaaggagaaagaacaugaaacucagaggugaaaagugagaguuuuagugcugaauuuggcuggugaacauaaagucauugacaauuucagcuggaaaaaacuuuggagaucaucugguauaauagucaacacauugauagauaaggaagcucagacugaauguuaggguuuauccuagaugacuccuacuuaguggcagagcugggagaccccccuuuccuauucugucucuacucuuucagacagucaccaggaaggaugguuagagcuugaacacuguguauacucuggagcucuucuugucuuggauuggugucuguugaggccucugcuggucagaagggcauuuccccugcaacccagccuugccugcagguuuacagaagggcuuugauaagguauaucuauuggaagcccaguuccugcuuugggccugcuguuuuccauuucacaaaaaggaauauaaagauaaucuagauuucaucuuuauuauaauuuuguaagauauaaaagccuguguuuuuuuucuggggugaauuuauaaauagaguagaaagauucaaguaauucuugucagaaaggaaccauucaucuacaacuucuccuagaaucuguuuuacagaugaucaaaaauauggggcaguguuucuguaccaaaauuuuuuuuaguguuuuccuuauuacagcaaaaaauguaaaacaacuuacauguuacaaaggagaaauacggauacaaauuguuaaagccaugaaguaauauguacaauaaaauguuaagaaaauguuuguaacacagugguaugugaggaaaccaggauaaccguguauagauauaucuccaagauuuuggaaugcccacucuggauuuccaguauugcuuacaaucucccucauaauucauucacuugcccaaggguagagagcagcaggucuggcugagaugagggaggucguggagcugcuucccacaccccagcauccuaguaugguuucuucaaaauaagucaccagcugucagugggcuuuuggggggucacuggugcagaguuagagucaugaaugccaggagucugauucuaaauauaugcuaguuacaacaaguuuuuaagagaaagaugucacuaaaaugauaaaaugguuuucucuucuuugcagauuuauauauuugauauuuuaaaguuuacuuuccaaauguccuauaaugaugaaguauaguuuaauauuuaggagaauuauuguuaguuuuccuuuuccauugaaggaauaaugugccuauguguaugauccagaauuuuauucugugaagaaugaagaaugaaaaugaggccacuggaaguaccuuaggcuguuuuucuuuaugaagaauaaaagggaaacucaguagcaccagcccucugccauguguuaugagaguguguuaaaucugacauugcuuuaagaaauagcagcuguagagaaaaugaagcaagguggaaaaaaccaacaacugggagaaacugaaggaaaaaucacagagugguauagaggaauugggaagaacagguauauucuuuauuuaaacugggauuuuccagguauuagugguuaagaaaaggcucaaguacagcccauacuuugcuaccauucaagaauuaagugguacucacuuuuccuuuuguuagaucacguuagugucauagacucuguuauuuuuuuucuuauuuuaauccacuagucagugggggaagcggggaucuguggauuuuacuaucgaagaaauauaucagucagacaauauucugcugccaguaauaaagaccucagaaucaguggcugaaacaaauugggcauuuaguuuucuuucauguaaaaauuugagguaaguagccuggggccaguguguugguuccaugaugucauuauagacccauacuccucccaauucuucugcuuucuuuaugaugagaucuuuuuuauuuuuauuuauuuuuuuugagacagagccucacucugucggccaggcucacugcaaccuccgucucccuggaucaaguaauucuccugccauagccuucccaguaacugggauuacaggugugugccaccacgcccagcuaauuuuuguauuuuuaguagagaugggguuucaccauguuggccaggcuggucucgaacugcugaccucagguaauccagccaacucggccucuaaagugcugggauuacagguguaagccagcgcacccggccuaugaugagaucuuuacccucauguuuuccugguagaugccugagccuaauaaucaugucugaaugucucauggaaggaagagggaggaagagugaagggcacaaagggcuugugccugcugagguaguccuucaaagcucuauucuggaagcucuacucagugaugaccgcugaccuuucguuggccagaaagaacccuguacugugaccauccuuagcugcaagagaagcuggaaaugcaguuuucauucagcuauauugcucuuucaauuaaaugagguccauuaguaaggaaggugaaacuagauccugaguacuuaggcagucucugccauaaaagcuuauuauaagacaugaugacuuugagaugcuguguuauacuguauuauauacaguuuaaauaguugaauuugucggcugggugcgguggucaugccuguaaucccagcacucugggagucugaggcggguggaucacaaggucaggagaucgagagcauccuggcuaacacggugaaaccccgucucuccuaaaaaaauacaaaaaauuagccgggcgugguggugggagccuguagucccagcuacucgggaggcugaggcaggagaauggugugaacccgggaggcggagcuugcagugagcugagauugcgccacugcacuccagccugggcgacagagugagacuccgucucaaaaaaaaaaaaaguugaauuugucaaggggcuuaauagucuagaaaauaugaauaaaguaguauagauuauucuuuuucuuuuuuuucuuuuuuuuuuuuuuugagguggagucucgcucugucacccaggcuggagugcaguggugcaaucucagcucacugcaagcuccgccuccuggguucacgccauucuccugccucagccucccgaguagcugggacuacaggcgcccgccaccaugcccagcuaauuuuuuguauuuuuaguagagaugggguuucaccauguuagccaggauggucucgaucuccugaccacguaauccacccgccucggccucccaaagugcugggauuauaggcgugagccacugugcccggccuuuuuuuuuuuuuuuuuacggagauggaguuuugcucuuguugcccaagcuagagugcaauggugcaaucucagcucacugcaaccucugccuccugaguucaagggauucuccugccucagacucuguaguagcugggauuauaggcacccaccaccuugccuggcuaauuuuuguauuuuuuuuuuuuuaguagagaugggguuucaccauguuggccaggcuggucuugaacuccugaccuuaggugaucugcuugccucggccucccaaagugcuagcauuauaggugugagccacugugccuggucguaaaguaguauagauuauuguguuuuaaauuuuucauauguaaagguaccuugaugguucugagcaugggauauggcuguuuuaguauauguugagauaauugaucuccuuuaaaggggggcuucauaugguuugggccccuuuaggauuuucuacaagagccaucuguagauauguaaaauaaaauuaauauuucuauuuagccuauuuuuuuuaaaaaacagaaugcauaucugugaguauauccugcacuuccucuaugccaguauuuuuaaaaacaucuucuugacagggagucuuuuaaaaaaaauagaaaauguaguuaccaaaguacugacuuuccuagauauugggagauagagggaaguuucucccucccugaugauauaaaaaguguguagucagaguugacuuacugguuuaucguuuggccacguggcuucagaaacaauagagccagcauggguuagaauuuucauucucacccuugaaccccggcccugugauuaugaacugugaggucuuggcaaguuaucugucuuugcugcaguccccucauuuauaaaacaguguugauaauaguugaugguaguguuuagcuggcaggacaaaaugaggugacauaaauaaaacaccucguacagggccugcucccugguauguacugaaucaguguuagcugcugcagguggcaguacuaaagcaaagcaagacagaagucuccaggccuuaacgagauaguuauucacuagcugauucugaccaagagaauugugaagaguucuguucugcgguugccauuuuaaguuuguccaauccgcagcccagugauuuauacuuuuugacaucugucagagccgugaagaauguuuguuuaggagucacugcuuaagaaaaugccucugucguuuuugagaaauauaccacuaucuucuugucaguaagauccugccguguguggugccaggacagaaguggccucaugggauaugacucaagagauagucuuuuuuuuuuuuuuuaagauagucuugcucugucaccuaggcuggggugcagugaugcaaucuuggcucacugcaaccuccgucuucuggguucaagcgguucuggugccccagucucccaaaaagcugggacuacaggcgugcgccaccaugcccaguuaauuguauuuuuaguagaggcaggguuuugccauguugcccaggcugauuucggaacuccugagcucaagcaaucugcucgccuuggccucccaaagugcugagauuacagcaugagccaccccaucuggccgauagucucuuugucaugauuuuaaaaaucaucuuguuggccaagaccacguccgccccgugagcacagacccuggcccucacugcucugcugccuguccacacccgcuaccagcucaccauagaugaugauauugcuacgcccgucgucgacaacggcuccggcauguggaaggcuggcuucgcaggugacgaugacccccggccgucuuccccuucaucguguggcaccccaagcaccagggcaugauggugggcaugggucggaaggacucccaugugggcgacgaggccuagagcaagagaggcauccugacccugaagugccucaucgagcauggcaucauuaccaacugggacaacauggagaagaucuggcaccacaccuucuaaagggagcugcaugugguucccgaggagcaucccaugcugcugaccgaggccccccugaaccccaaggccagccgcgagaagaugacccagaucauguuugagaccuucaucaccccagccauguacauggccauccagcccgugcugucccuguacuucuuuggcuguaccacugguaccgugauggacuccggugacggggucacccacagugugcccaucugcgagggauaugcccucccccacaccauccugcaucuggaccuggcuggccgggaccugacuaccucaugaagauccuuaccgagcguggcuacagcuucaccaccacggcugagugggauaucgugcgugacaucaaggagaagcugugcuauguugcucuggccuucgagcaggagauggccauggcggcuuccagcuccucccuggagaagagcuaugagcugacugacggccaggucaucaccaucggcaacgagcaguucugcugcccugaggcacucuuccagcuuuccuuccugggcauggaauccuguggcauccaugaaacuaccuugaacuccauuaugaagugugauguggacauccacaaagaccuuuacgccaacacauugcugucuggcggcaccaccauguacccuagcguugccaacaggaugcagaaggagaucaccgcccuggcgcccagcacgaugaagaucaagaucauugcuccuccugagcucaagcacucuguguggauuggcggcuccauccuggccucgcuguccaccuuccagcagauguggaucagcaagcaggaguaugaugaguccggcuccaucauccauccuucaaaugcuucuaggcggacugugacuuaguuguguuacacccuuucuugacaaaaccugacuugugcagaaaacaagaugagauuggcauggcuuuauuuuuuguuuuguuuuguuuuuguuuuuguuuuuguuuuggcuugacucaggauuuaaaaacuggaacggugaaggugacagcagucgguuggagugaacaucccccaaauuucugcaguguggcugaggacucuauuucuuguuuguacauuguucuuuuuuuuaauagucauuccaaauaucgugagaugcauuguuacaggaaguuguuugcccuccuaaaagccacccgacuugugucuaaggagaauggccuaguccuccuccgaguccacauaggggagguuucuuguaaauuagguaaugcaaauuuuuuuaaauuuuugccuuaauacuuuuuaaguuuguuuuauuuugaaugaucagccuucguggccccccucuuuugucccccagcuugagauguaugaaggcuuuuggucucccugggaguggguacaggcagccagggcuuaccuguacacugacuugagaccaguugaauaaaagugcacaacuuaaaaaaaucacugggugugguggcucacgccuguaaucccaacacuuugggaggcugaggcgggcggaucaccugaggucaggaguucaagaccagccuggccaacacggugaaagcucaucucuacaaaaaaaugggaggcggagguugcggugcgccaagaucaugccauugcacuccagccugggggacagagcaagacucugucucaaaaaaauaaauaaauaaaucagcuuguugaaaucuuaauauuugauuuauauauguacaauauauuuaaguuuuaaagcauaaugauuuugaauaucccaaacucaccaugcagucaacaacuacaacauuaacagcacugcucagggaccaaccacucuuuuuuaguccuuuccugcuaugccacccccaucacucugggguggccugaauuuuguguuugauuucuugccuuguaaaaaauaguuuucucaugcaugcacguauuuuaacacaauauguuuaguuuggcuuauuuuugaccuuauuaaaaauaguaucacuuuguguaguuuucugggucuuugauauuuuucaccuaacaguauuucccaguugauccauauuauuuuguaagcuauuguaauguucauucauuuucuuugcuguauaauauucuacuuugugaauuuacaacuuuuuuuuuauucugcugccagugaacauuuucuuucuuuuuuuuuaaaaauaaauauuguugcugugaacacaucccauacaugguaccugauguacauguguaaaaguuucucaaagguauuuacguaggaauggaaaugcuggcucauagaguauuuaacuuuaccagauacuguugaauugcuuuucuaagaguuuguaucacuuuauauuccuuuagcacuguauaucauuuuuguuuuuuuaagacagggucuugcccugucaaccaggcuggagugcagugguacgaucuuggcugacuguaaccucagauucuugggcucaagugaucgucccaccucagccuccugaguagcagggaccacaagcuugcaccaucauacccaacuaauuuuuguauuuuuugucgagaugggguuucgccauggugcccaggcuuaucccaaacuccuggacucaagugaucgccugccucagccuuccaaaguauuacgauuacaggcgugugcuacucugcccagcuuauaaucauuauuaagacagcuuuauugagcuauaauuuauacaauacaaaauucacccauuuuaaguguauacuucagugauuuucgugcagccaucaccagucuagucgcagaacauuuccaucagcuuuaaaagcuucuucaugcugauccagucuucacgcuuaauaucuuacuacuugaugucauucuugugccuguaaaauauguuaugugaauuugcaccucucugauuaaaaauggcuuagaauaucuuuucaugucuuuaucggccauucauauuccugucuuuaugaacuguccucuauuuuucuauuagaucuuuuggcuuuuucuuuauuuggaauucuuuauucuggauaccaaaacuaucccaguuauauuuguugaauuauuugcucuaguuguggcuauucuuuucacuauuuuguuugucuuauuuacaaugucuuuuaaugaacaaaugucuuaauuuuaauuuuaauagauuuuuacuauuuuauuuaguuuuuuuguauuucucauuguuccuggacugauuagauucugucuuauaauguugcauauucuauccucaguauugcuuaacuuaccuuucagacuuucaaucucauuguauuucuguacuguacuauguuaauguccuaaauauuauauucugguuaacuacuuuuuuugcuuguuaauacugguuaacuguuucucuuauuuaacucuuucacugaguuuuuaguuuaauaaugauauauuucuuuucuaggaguucaccucuccuucagguuggacuggacauuccaaauauuuuauuuuucuuugcuugucuuagcaauuccgucuuuuauuucuuuaaacauuucuuauuccuugacgacagaauaagacaacucaauauuagugguccugcuugaggggcuggucugaacaauuuguucauuauuugcgcuaucucucugcaguguuggcuuucuucccgguaugcacagugaucuuugcuuguaugcguagacuugauguuaauuuguggaauaauucuggaucuaaauguaugauucuuuucucccaagaggauuggaguuauuucugccuggaaccaggaaacuccauuaacuucacacuaucaguagucuagacucaaggugggagucucaagcucacugcagucuuuuauuugacuggacguuuuccccauuuuuucucuguccuuuuuguacucauauuugccuuuaucuuuuuauguggcacuuucacugcagaauuauuuuucuuucaaaacuugcuauaugaugguuguuguugagaauucuaaaacagaaagcagugcuguaaaaucguagguauuugguguauaaaaaugcaaaagggaaaauaguuuuguuuuaaaauaaagauuuaaggaguacauuuuuagaaagaagcagcaaaaaagcuaucaugucaaacauuaugauuaacuauaagcaaaauguacugcauacggaucuauucucauuguguaaagauccagggaaauccucagucuauauuaaaguguagaccagaacuuucaauuuaguuauuagaaggcacuguuuucuuuuauggagaaaagacuauacacuauggugugaaauggauugaauuuugaaaucuuuaaagaacuaaccaaauuuuauguuauuuuuucuccaugcguguuaccuuugaaacuucaagggcuuguuccagcuguaugaauuuguggcaguauuuuacauuagccuagcuuuaaguugccagcacaguaguggaguuugguggauggucuuuucuuuaaagacaaagucuucuaaugugggcuuggauaagaguccuaaaacgggaugauacaagucaaaugaggaaaggcauaaauuugucuguuguuuucccuuugacacagggucucacucgguuacccaggcuagagugcaguagcgccaucauugcucccugcagccgugaccuccugggcucaaaccauucccccacgucaacuuuccuaguagcugggacuacaggcgcuugccaccacaccuggccaguuuuuuuuuuuuuuuuuuuuucugguagagauagggucccacuguguuacccaggcugguuuuaaagucucagacucaagcaauccucccgccucggccucccaaaaugcugggauuacaggugugagccaccacgccuggccaaauuugucuuuuuaaaauucuuaaaaaugaguguuuuuuacuuaaaauuuuaaaguguuuuuacacuuaaaaauuaagacauguggcugggcaugguggcucgugccuauaaucucagcacuuuuggaggccgaggcaggaggaucacuugaggucaggagaccagccuggccaacauggugaaacccugucucuacuaaaacaaauaaaaauuagcugggugugguggcaugugccuguaaucccagcuacucaggagacugaggucaggagaaucgcuugaaccugggagguggagguugcagugagcagagaucgcgucacugcacugcagccugggugacagagugagacuccaucucaaaaaaauaaaaagcuucacauuaauggguuaaugagaaacaccaugucacaaugcugaaauauaaaaaugagaccaauuccaguauuuaugaggggauuguuuacaaagagcuaugauauacuggacagaugauacauuugcuguugaggagacuaacuguucuguuauaauuuccucuuuuuuuuuggagacaggucucacucugucacccaggcuggagugcagugccacaaucauggcucacugcagccuugaccucccaggcuaaggugcucuuucuaccucagccuccugaguagcuagggcuacaggcgggugccaccaugcccagcuaauuauuguguauuuuauagaaaugggguuuugcuauguuguccuggcuagucuugaacuccugggcucaagcuaucugccugccuuggccuccugaaaugcuaggauuacaggcacgagccacugaaccuggccuuuguucuaauuuucucuuuuucuuuuuuuugucuuuuuuuugagacagagucucacucugucgcccaggcuggagugcaguggugggaucuuggcucacuguaaccucugccucccagguuccagugauucuccugccucagccucccgaguagcugggacuacaggcgucugccaccacgccuggcuaauuuuuguauuuuuaguagaggcgggguuucaccauauuggccaggcuggucucaaacuucugaccuugugauccgcccccacuucggccucccaaagcauugggauuacaggcaugagccaccgcauccagcccucuguucuaauuuucaaauaaggaguccuguaaguuacugacugggcaccuuccuuucaucuguaaaaugaaaugauguuuugcuuuuguuuuccuagcauggggguuaucccaccucuuguuucuuuccaauucuaugugagaugguggugcaugccauguuguuagguagaagacauguccccagcucuacaguuagcaagcuuugagagaggcaauuuaaaugggugcuagcuaugucagcccuuggaaagaccaagagcacaucuaaauguaacuuggugauggcauuuuugugguggaagaaagacuguaguccugcccaucuguauauucuuuuugaugacuucguuaaguuacgggguagaccuggaaacuugagaaucuuuaacagguucuuucaguauuuucucagauucuuacagaaucuagguggcagaucuuuuuuuaauaauuggauuuucuaaugaagugguaguucccccugugaauucuugaauuucaaaaauuuuuauuggucauuauuggcccaguuuggaguuggcucuguggcacugaaacucaggagaaagaugggggcucauagcuuuguuuggaaaucagccacaugaggauaauauugaaggugcugagggugacagcaggaaaugggaaggauguuguugaggauggaauauagagugauaacugugaagauauggaaagacuuagcgagagagugacagguuagugguuuugaccuaauuuuggggaacaagguucauauagacuuuuccucuucuauuauauggaaaguaccauaaaaauaugauuaguaauaaucguguguaucaguuuaucaauuuuucuguagccaacucugcuuuuauguacaacaaaugagaaagcagccccuaaaauaugccagagugaagaacaucuucacguuuuguguguucaguuggaaguguuucaguaaucauccagggcugcuuccacagucuccguguugauauuguagcaguuucucagguuugugggcaagugacuauagcuauuccacuugguggacaaagcagaaugcaugaucaggccgucuuuggugcaguucacagaaucaucaccugugccuggcaaauggcuaaguucuagcagaccuucccugccauucugcugccucacagagacuucucuuaagaaguuacacaguuuuguucagggcugugcuagauccuacuuauccuggagcugguuaucaguuuucuuaauugcucaggcuuuguguuuugccauuuuacuuuguuuuucuuuggccauuugcauauugaucauggaacagagagauaaaacaugcucauagaguggauuccuguuagguuccuaccacuuguauagucucacuccaguuacuggacacauuuauggaguaacugauagagcuauuuaguguuggacaaauauaugauucauuuuaaagcaguaagcucacaaccacuaacuucauauuuauagccugucuccaaaacuccuccuuccuuuauucuuuuaaaauuacuguaauaaguauggacucuuuaaugccugcuacauuuuuugcagauuuggccacagauuuauuuucuuuuauccacauuucuuuuuuuuuuuuuuuuuuuuuugagacggagucuugcucugucaccuaggcuggaaugcaguggcaugcgaucauggcucacugcaaccucggcucacugcaaccuccgccuccuggguucacgugauucucuugucucagucucuugaguagcugggauuacaggcccacaccaccacgccuggcuaauuuuuuuuuguauuuuuaguagagauggaguuucaccauguugaccaggguagucuagaacugaccccaggugauccgucugccuugggcucccaaagugcugggauuacggacgugagcuacugcaccaggacugauccacauguuuuuaaaaguugguuaaugucacauaaaauugggauuuguggcuuaaaaaaaaucagaaaaucuggcagcauucccagugacugaguaauggcugucuccuuuagacaggauaguagguugucuccaaauacacaucacccccaauacccacguuuuuugacauauaccuggcugccuucacuaauugcuguuaccugccuggcucuuugggcaccugaguuuguaaguccugcuuuauuacucagcucuccacuuccugcuguguucuuguacucuuuguuuuuuguuuucuuuuuucugagacagagucucgcucuguugcccgggcuggaguauaguggugcagucuuggcuuacuguaacuuccaccgccaggguucaagugauucucgugccucagccucccgaguagcugggauuauaggcaugugccaccaugccuggcuaauuuuuauauuuuuauagagaugggguuucaccauauuggccaggcuggccuugaacuccugaccucaggugauccucccaucucugccucccaaagugcugggauuacaggcaugagccacugugcccggccugcugccaugcuguuuggaacaggaugcugacagcccucuuugaaguggaaugggcugugaauccgucgaggugccccucuaaaaagcuguggucugaacccucuccccaucuuugaaaaugaaaaauuuaagcaauuuuucaaaauauuuucacuuguguuuuguaauccuuucuuuacaacuguccuauaagguaggcauguguggauuuauguacuauugggaagccuuagggcuuucuccacuucugcuaggaauaauguauuuucuugaaaacaguuucagugaaagacuggacuuuuccugugguccuuucaagguagccacagucuucuuguggcccaauuugcagcacugaacccugggcguagcucugccaugaaaggcgauugagaaaccaucagauccuauaauuggugagugguggagccagcauuugguuggagaacuuuugauuccagugcagcauggugcuauucugauacucgguuacucuuucagauugaaauucuucauuccauuuuacuguuugcugggugagugcagcagugacacaguuuucaaaaguuuacuaauaaucuauuuuuugucuaaaaaaaucuuuuuuguaauauuugauggacaugccaucuuuuucuuuuugagacaucucacucuguugccuaggcuggagugcaguggcacaaucaugacucacugcaaccucaacucccuccucagccgccuccugaguagcugggaccuguggcaugugucaccauacccggcuauuuuuuaaaauuuuugguagagaugaggucucucucuuuauugcccaggaucgucucaaacuccugggcucaaguguucauccugccucagccuccuaaagugcugguauuacaggcauaaaccaucauuuuuacguacuuuuaaaaaagcuuuuucucuguuuuucaguacauuuuauaguuuuauaacguuggauugagucuucucuuuuccuaguuuuaauccuuuggacuaucuucauuuacaaauaucuuuuguuuuaaguuuuucuaauuuacacuauuuuauuuuuagugacauaaucaaauuaaauauguguauuuugacaauaaaugugaccauucucuagccaccccuucacacaccccggguucugaagugcaucucugauguggucacaguaauuuuuuguuuuacugacuuaaacauuugcacuacaguguuuagggaaccgccuaucauaaggcuuccuuuaauauguugucccacacagcacuguuuuacaugauguaaauguguuauacaaacaagcuuccguggucaaaugauuuuugggaaaugcagaguuaaacgaaguuacacagguuuccuuaugagugcuuuugggggugccugucagcacugugacugucuuaagagcuagaguuaaagaggacaaaguuuuucgaccuuggcaucugauaggacugauauuucuuuuuuuuugagauggagucucgcuuuguugcccaggcugaagugcaguggcaugaucucugcucaccacaaccucugccucccggguucaagugauucuccuaccucagccuccugaauagcugggauuacaggugugugccaccacacccggcuaauuuuuguauuuuuaguagagaugggguuucaccauguuggucagccuggucuugaacuccugaccucaggugauccgccugccucggccucccaaagugcugggauuacaggcgugugccacugcgcccagccuaggacccauauuucuaauguugcauuggaaauauuuugggaaaaauugagcuacuaugauuuucacauuauuucuuucuguagguggaaauggcucauuauuucucaagguuucuaacauggcauguugcuguguuguucccuucaguuuugcagagacugagugcaguuacuguggagagaguccaggauggccuaguugagacauugaagauuuaggaaugcauugauugauugacugauugagacagggucuugcucugucaugcaggcaggagugcaguggcgcaaucacuggcucacucuagccuugaccuucugggcucaauugauccucccaucucagccuuccauguagcagggauuacaggcgugaggcaccacaccuggcuaauuuuaaaauuuuuuguagagacggggucucacuguguugcccagggugaucuugaacuccuggccucaagugauucuccuuccuuggccucugaaaguauugggauuacaggcaugagccacugugccuggccuacgagugcuuuuaaacugcugucugauuccugauaggaggaagauacuaucacugauugaaagggaauaucccuaauaaaguucucaguuacaccugugugcaaaaaucgugguccaauugugaguuguuucagaaaacagaugcaggauacguaaaggaauggggcaggacaggcuccaacuggguaauuggcaugaaaggagaaaggggccggggcacguagacucccaggcuuaggacuccaguuaguccauuggaagucaggugaguuaugaauauugcucaugugccugcugaacaugugugggagaguuuuguucgagggagacagaauccaggaggagacuuuugucugugaacuugggcuggugugcagccuuucugcugaaaccugauggaauuaaguuuuaaacaguucggcagauucuaacuugucauuguggggcuuguguguagcugggguuuggagacugcuuuuacacuaaaucauuccugucaccugcucucaagugaagcagucugcaguguaagccuugcugguauuuguguagaguggcacugccucuggugggaagaaugcagcagcuucacguguuugcugcuccugaaccucagaucuuuguugacaaugaugcugagagaagaggaugauauguuguguuuugaaaggaucaggacuagaagcauaaaccuuuaaaagggaagguccaggagucagauagauuuagguuaaucauuaccaucuacuucuagcuaggaguguuaauuuuuucauuuguucauuugggaauaacauuaccuauuuuauaggauuguuuagaauaaauguaagauacaaguguguauaguguaaugagguaguauauuguauaacacuucacuuuaaugauaacuaggugcauuuuuggucuaaguauaugagacagaccugguacuguucagaagagccuuuguggagccuguuuuuggagucagauagcuaguuuaauaguagagaacaaaaauuggagaaagaauuuugaaacaauaagauuuaucucuguugguuauucuuaauauuugcacaacugcuuaauugaaauuauaugacuuuuuauuuuagcaaaauaaauuacuuuuuagcaaccuugccuugcugagaagaaacugcugcaaauauguuauuugcccauuaacggggagaaauucaguagugaauuuaaacacauuuuauuaaauaaucacuucucacaugcuugacuuguuuuuugggaggcuuuccaguaagauuugcuagagaauaguggugauauuuauuauaucaguucuaauaauuaaauuuuauuuuauuaaaguuuauuuucauuagcuuauuuagugcuccgagcaacucuaggaggguacaagaacccuuguguuuccaugaagaaagacuugacgcucagaaaagcuccgugauuuuccccucagugaccugcagagcugggguuauaaucuaggucuuuuuguccagcacuauuugaucucuacccucuuccccucauaccaugggucuaggaugucaagggauucaacccugguuauuuuuaaaagauagugucagucagaaauaaaacuuagaugucuccauauguaggaauuuuagagaaauaguuugugucuaaauuugcaagcucauucaguuuaaaaaugguuccuauaauauggugcucauuuauuacuucagauucauugcuucacuaaugacuuuuaaauaggacucuauuauuagagugauuggacugaagucugauuggacuagaguuaagagauugcaucgcuauaaauagaaugagauaaaauauuuuacauaaugugauugaacuucuaugaggucugaaaaguuggaaccuaggaucuucucuuuuuuuguuuuuuuuuugagacggagucuugcucugucgcccaggcuggagugcaguggcacgaucucggcucacugcaaacaccucccggggccguucuccugccucagccucccgaguggcugggacuacagacgcccgccaccaggccuggcuaauuuuuuguauuuuuaguagagacaggguuucaccguguuagccaggauggucucgaucuccugaccucaugauccacccgccucggccucccaaagugcugggauuacaggcgugagucuccgcgcccggccggaucuucucuaaacggauacuuugaccaguuuccaaauaacaagcuucucagcguguggccuaaguuguagauagaguggcuacuuaagagaauuugggaauuaaauuauguccuuuggcauguucaguuauguuaccugagucagaguuucauuagcugcuucaucaauaguuuuuuaaccccaaagcuuuagacaguaagauuaacacacugauuagaaaaucauuuaaagaccaaaaugaaaacagaacaacucuaaaagcuuuuaguguguucaggaaauguuagaagugguuguaugugaagccauugguauaguuauuggagaggacaauuuugguagacauagaugaauuuaauacccucaauuuuuuauuuuuaaaauagacauggggucuugccauguuucccaggcuggucuugagcuccugggcucaagugaucugcuuuccucagccucccaaagugcugggauuacaggcgugagccacugcaccuggccaaugcgcuucucuaauagugcauuagcacgaaaagguuggaauggcuuuaaaggcauuucaguuuccccaugauuacacaggaacaugccuagucucugauauuuagaauuugauaaaaauauaugguaaaaaugcauaguuuguaaaaauuucuaagcaguugugaacuguagucaauucaugagugauuggccgggugugguggcucacgcuuguaaucucagcacuuugggaggccgaggugggcaggucacuugaggccaggaguucgagaccagccuaggcaacauggcgaaacuccugucucuacucaaaauacgaaacauuaggugggugcgguggccuacgccuguagguccagcuguguggaaggcugaggcauaagaauugcucgaaccugggagguagagguugcggugagcugagauugcaccacugcacuccagccugggcgacagagugagacugucucaggggaaaaaaaaaaaaugauuguuaaguucuaaucaaaccagaaucuuuuccuaucaccuuaacucuuauaguagugacucuaaccuucccucgcucugccaucaccauccauauuguuauacuguuauaaaacuacauuauuccagcaguuuuaccaaaguugggauaaguauuuuuaauaggcauuauguguuuaaauuuuuccauuaacauaagagguaaauauuuauuugaagcaucaguagaagcacagugaucaguggauacugccaagaguuuuuccaauaauuagaguggaacuuuaaggaaacaauguauuacaugcuaagauugaauggauagggaugggagagagauagcagaagauauauuuugcuguugguuucuugaugugauaugugauggugaauauuaccucuaaacuaaugugcaaaaaaaucccaagaaaacccaaaucucaaaaccccaaaaacaaaaaggugugccaaggagggagagcacaugccggaucaucuacuuugaaucaguaauuuuuugcugacagccaaguugggagugggucuguaacuuucauuuccauuuggcaucaggaagcuauuugguauaaauuucuaccagauaguuguauggaaccacauuaugcugguaguaaucuuugaccaauaauaauggacauauguauguggcucuugaauaagaguuguuuuauuuuucaguuuucaguuaguuagaauauacaauguaauaauuuugguggauagugguuugauuaguaaaugcuaucuuucaugguuuaguaagauuugauuucucucucuuuuuuucucucucauuccaggguguggaugaauggaacauagcucgccucaauacagucuuggaugugguugaagaagaguguggcauuucuauugaggguguaaauaccccauaucucuauuuuggcauguggaagaccacguuugcauggcacaccgaagacauggaccucuauagcauuaauuaucuccacuuuggagagcccaagucuuggcaaguuacuuguuuaauauucauuuacuuuggaguuuugaaauuugggcaucaggcacauauugaagaggauuuuguucuuugauuugguggauucagauuuaugugagcuguaaggaaguuuuugacuguaauaguuaauugucuucuauucugucugggauugugcuuggaaaccauaaaccccaugguaacucguacagucaugcacuguauaacaauguuuagaucaaugauggaccacagauacaacggucauccugaguuuauaaugcaauugaaaaauucuuuuuccauguuuagauauguuuagcuaaaugaauacuuuguagcuaaauacuuuguguuaaaauugccuacaauauuuaguucaguacagguuuguagccuagaagcaauaagcuaugccauauagccuaggucuguaguagauccacuaucuagauuuguguaaguccacuccaugauguucacacaauggcgaaauugccuaacaacauauuucucagaaacuaucacuguuauuaagugaugcaugacuguauauguaaaguugccuguaguccauuuugugaaccaugaauugauaaauauuuuaggcuucaagaauuuauugggcaucuuuacuuugagcauuuguuggaugguauguaggagguaguuaggagugaagagcugacuuccuggguguaguuucaaaccaucuucaugaucuucugguucauccuccucuaauuauuuuuauuuuauuuuauuuuuuuuugagaugaagucuugcucugucgcccaagcuggagugcaguggcgcgaucuuggcucacugcaaccuccgcuuccuggguucaagcaauucugcugccuuagccacccaaguaucugggauuagaggcccagcuaauuuuuuguauuuuaguagagacaggguuucaccauguugcccaggcuggucuugaacuccugagcucaggcagucugcccaccuuggccucucaaagugguaggauuacaggcaugagccaccacacccagccaauguauuuuuuauuuuuuauuucuauuuauuuauuuuuucgagacagggucucacucuguugcccaggcuggagugcaguggugcgaucucggcucacugcaaccuccaccuccuagguucaagcgauucuccugccucagccucccgaguagcugggaugacaggcgugugccaccacgccuggcuaauuuuuguauuuuuaguagagaugggguuucaccauguuggccaggcuggucucgaacucuugaccucaggugagccacccuccuuggccucccaaagugcugaaauuacaggcgugagccaccacgccuggccaaaugaaacuuuuuaauagguggucuaggacucauacaggcuccagugacaagagaaugugaucggauuauucauuacucagauguuuauuuguuauuacuuuuuguagagauggagucuuaguguguuguccaggccggugcugaccuccugggcucaagugauccugcugccucaaccucccaaagugcugggauuacaggugugagccacugcacccagcacucagguguuauuugugggccugguuugagcacaugcuuaaggacagggaucucuguuguguuuguacagcauuacuguaaaguuuguuggaaugucaucuuuuaguuuuuucagaacuuagcuuggagagacuaggagaaauauuuucaacaaugguuaggcuccuggacaguuucucagcugcuuuguuaucuugaugcucuuucugacauucacuuaaaguguggauaaaauugaaugaaaugggugaauucaacauguuaauaaaaucuaguauguaggcaacuacauacuaugucuugcuuaagaaaucugaaaaguuaguagcaaaacuuuucuggggauuuguuaaggaauuaauaaaugaggaugccugggacguuaauuugaguuuucaguauuaggaaaguuuaaaugaagugucugcuuucuaauuaagaaagauggcugucuugucuucuccugggaacagguugauguugucuccuaaugaucacuucaggaagaauauucuggucagggcuaagauggauucuggugucuugugucuuugggaaagagcaucacuaaucaugagugagaauaauuaugcccauuuucaaaguauuucuuucuugcagcuuguauaugugcaguaguuaauuacucuauuaguuauuaaguauacagccuccaucagacgcauuaagaguagauuuauacugucacuauuauccuuaaccuuggccauuguuuauaaugauaaaauaauaaaauguaguagugaguuguaacacugauucuacauacuauuuccuaagauaacuacuguaggaagagaguguuauaaaugccccuacagauauuuucuaguagauguaugaaauauuacauuuccucagcauaaauaauuuugagguaaacuuugucauuauuaaaauucauuuuagcaauccuuauaauauauuugaggugagcuuugaaagauguuagaagcaacacaaauucauggaaguauuuggaggcaggcgguuuggcagagcuuaggacacgagggcccaguaaucagggcuguagucuuuauuaugcacuagugcauguggcuuugggcaaauaacucugcuugucuggacuccaguuccuucacucccccaagucacaagguuagccagaaugaccuccagucauucugauucugugacucaugaucagagucacaggaauauuuuuauugaguugacaaaacgagaggaugaagggcugcaagguucuguaugcacaugugggugcgugugcaccagcguccucuucugccuguccucuccuuguugagcuguaucuccccuucaguaugggaugguugccuuuacuuuucucuaguggguggccucuccugugcuugacauaucugucacuauauuguuuucucuucugucucugaccuuauagguuggcauuucaagucuacuccuuccucuugaauucuaccuccagguaccaggcucuggaugggauuauugcaaagacugccuacgauucccuccuuacuuacgggcccaugcugcucucaucuguccauguuucacuuaggguuugcuuaaagacucucuggacuaugugcugccccuacuuuagacauuguuuuggcaucuuacaacugguuguggccaccccuccugccaucucccucauuuucccaccuccuuucuccccgaccauccuccagcuugccugugugugccuugaaguuaagguccaugguuuuguuuuuuuuguguguguuuuuuuuucaccuuugaaucaucagcacuuaacacacagggccuggcuauaggagcgaugcccuguaaagaauuguuguauugaauuagaagaguguuaaauuauuuuagauccaucucuuuaagggcaggcauggaaacuuuuaauaaaaaagauucuuuucuagcccaggugcgguugcucaugccuauaaucccagcacuuugggaggccaagguaggcggaucacuugagcccaggaguucaagaccagccugggcaacauggcaaaacuguuucuacaaaaaaaaaaaauaagaaaauuagccggucauaguggcucacgccuguagccccagcugaucggaaggcugaggugagaggaugaccugagcccggggaggucaaggcugcagugauccgagguggugccacugcauuccagccuggacaacggagggagacacugucucaaagaauaaaaaaauaaauaaaaauaaaagccuaaaagguaacuauuaagaauacuaaguuuccugaguugcuauacauaggagacauacauuucuagcuaccguguguggcagguuugcggaguaaguguucaugaacacagguuuguacugaagagacuucaaagcagcugaugauuuauuugaacauuucugguugaagguuuagggggaaaaguauccuuagaguaagcagauagaaaacugcuuugacagucagugguaaaguauuauuuucuuggaaugaauauugacuuuggagccagaaguccuguuuuaaaaccccaaucugucacuuacugggaaugacuuagggcaaaucacuacacuccuuucaucaugaguuucuuucacugccaaauggaggcaugauuuauucucugucuacuuaagggauaucuaggaggguccagguauauacuguguauaaaugcuuuguaaacuguaaaguauuauacaaauacucauaauuacuauuauuuuaauaaccaugaaaauaauuuuuuuuuagucauaguaguuacuuaaagucugaacuuggccauaauguauguauuuauaauagaauaggaguuucagugauuaaaaaaaaaugugauucucccuuccaagccucuugugugagugcuuaacugcuagaggauauagaauucagaugguaucuugagucuuucuuucccagacuggguacaaacaaaaugaauaagaaacuuucgacugggugcgguggcucacgccuguaaucccagcacuuugggaggccgaggcgggcggaucaccugaggucaggagcucgagaccagccucaacaugaagaaaccccgucucuacuaaaaauacaaaauuagccggguguggugguacaugccuguaaucccagcuacucgggagacugaggaaggagaauugcuugaaucugggaggcggagguugaggugagcugagaucgcgccauugcacuccagccugggcaacaagagcgaaacuccgucucaaaaaaaaaaaaaaaaaaaacaaaaaaaaaacuaacuuucaaauuuacucuguagagaacaagggagauaagguguaagaggauguguuuuaagcugugaaaaggucuaaaaucaggaaagguuuuccugaagguuuuuagaaaauuaagaauggguuguagcauuuuggacauuguuaaauuucauucaguaaacugagauuuuguuaaaauacuguguagcaguuaagaaguauccaauuauucaggauagauacacauuaguucaaugcuuucucauuagaacuuuugaucaguguuguguaguacuuaccagcacagguuuuugugucagucuugaguuuugcaaaacucuuuacucuuuacugagcaugugaccuugggcaauuauuaaauaaccuccaugccucaauuuucucuccuaaaauacucagaugguuuuggcacccaccuuguaaggcaauuguguggauuaaauaacaugcuauguacaaaguacauaucacagcuggagauguaacacagugcucaauagauguuaacguuucauacauucauuuagcaaauauauguuguauguauacauggcaugaaguguuuuaaacaugaacuucauaaauuuguauuaauaaguguucuugguuauaaaugacagccaggcgcugaggcucaugccuguaaucccagcacuuugggaggcugaggcgggcagaucacgaggucaggaguucgagacuagccuggccaacauagugaaaccgcaucuguacuaaaaauacaaaaauuagcugggcaugguggugcaugacuguagucccagcuacucgggaggcugaggcaggagaaucacuugaacccaggaggcagagguuguggugagccgagauugcgucacugcacuccagccuggggaacacagugagacuccgucucaaaaaaaaaaaaaaaaaaaaaaaaaaaggaacccaauuuaaguauaacggauuuuucccaguguuuguaguugggauaaaccagaggcauggcucagucuaggaaaucagaugcucccauuggaugucugucucagccuuucccuuuauuucucccucccuccacucucuucuauucaccuuaccccuaucucuuccuguccuuucuccucuccauuccuucuuucucccuuuggucuagaagagagaagcugcuuacuuacaacuaauuacuugauuauuguugaauuauauaauucaagucuuacuuuuuaaaagaaugagcaaguuauauggugccaaauugaucuaagcuuguuuaauguacaucuccauuaaaaugugagcucugggaguuggggagccccacuauucauucauucauucguucauucauuuauuaugugguuuaaauuuucuuuuuuauagagauggggucucgcuggguugcccaggcuggccaugaacuccuggguucaagugguccuauugugucugccucccaaagugcugggauuauaggcgugagucaccauuccuggccccaccagucuuuuaacuagcaugccucuagugccuggcacagcauuuggcaugagccuggcacuugguagguacucaguaaacauuugcucagugaacagucuuacugaaggaacucuuuauuugaagaucaaaaaaaaaaaaaucuaagaacauuagggauuaggcagcuugauaguauuuagugauccauugaauuagcagcccaugguaauaacucauacuuguuaauuuuucuauuuaguaacuuuagacccaguaauauguucuaauuucaaauguuaagacuuacuggaugguguaaagcugcauuauuuugcuauuuugucuagaaaaaaugcacuuagaauuaaccaugguucauuuugguuuuaauugcuuuuucuagagaaauuugcccuuuacauaagaaaauacuuuuagaaauacucuuaaguugaaguaauaaaauuaaccgcauagguuauugauuaguuuuaggcauaucucucucugugugcguguguguguguguguguguguguguguguguguguguguguauuuuuuuuugagacagagucucacucuguuucccgggcugaaugcgguguugcgaugauggcuaacugcagccacaaccuccugggcucaagugauccucccacuucagccucccagguagcugggacuacaggugugugccacuaugccaggcuaauuuuuguauuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccguguuagccaggauggucucgaucuccugaccucaugauccauccgccucggccucccauaauuuuuguauuuuuguagagaugggaucuuccuauguugagccuuccuaggcugguuuuacacuccagggcucaaucaauccuccugccuuggccccccgaaguccugggauuauaggcaugagccaccaugccuggccauuguauguuucaaagauaguauuguuacuuugggaggccaaggcagaaggauugcucaagcccagggguucgaaaccaaccugguuaacauagggacacccuguaucuaccaaaaacaaaacaaacaaaaacaaaccccaaaacagaaaagauaauauugcuaauaaaauuuaaaaaguguuggaaauauaccaaaaaguaugguauuagcuuuguacauagcugcuagcuauauuuguaagaagaagagaauacagugcuaacugguaguaaaauauuuauugaucaaguggaucacauaccacucuagcacacacccacuugcuugcagccccaaaacauugaucucuguggaccacugcucagcacagaauucccuaaaggaaccauccaggauaucuaguguuugugaguuggaaagucucacucuuuuuuccugaaguguugagauuuuacuaauuaauugauugguaacuggauuguuaccgaucaaguuuaacguugguacuuugaugaugaaauuaugaacuggaacuaauccuaauaaugucagucaacgugcaaagcaaauaguuuuccagaguagccagcuguacuuuuuuuuuuuuuuuuuaagacagggucucgcucuguugcucagauuggagugcaguggugcaaucuuggcucacugcaaccucugccucccgggcucaagcgauccucccaccucagccuccugaguagcuaggacuacaggugcauguuaacacaucuggcuaaguuuuuuuuuuuuuuuuuuuuuuuuagagaugggguuuugcuauguugcccaggcuggccuggaacuccugagcuaaggcagucuacccacgcagucagucauagcucauuguagccucaaacuccuaagcucaagcacucuuccugccuuggcuucccaaaguccuggauuacagguuugagccacuaugccuggcaguaaccugcuauauugaugguagauuuaaaggaaugaauugaagaaacagaagacucagggcaaaaucuuacccauugugagaaucccuuuucuaccugcuuuugcuuauuuuguuauuagcaauguuccaaauuugcauauuaaugaauuacugcucaguaagggcguguaaauuccccuuaggaugcuugcugaaucuuuuuugcuacucuuuuaguuacaccaccaccaccaccacgaccaccaccaccuacaacauugacaucccuucaaaugaaaagaaauuguuaaauccauaacucuagggaaaaaccagaauguuuacccaacuuucuuuauuguguacuucauggaaagcaagcauuaaugcuguucaccucgcaaauuacuguguuagggcugggcaugguugggaggccuaggugggcggaucauuugagaccaggaguucaagaccaucuuggccaacauagcaaaacccucugucuacuaaauaugaaaaguuagccggguguggugacgugcgccuguaaucccagcuacucaagaggcuguagcaugagaaucgcuucaccugggagguggagguuucagugagccaacaucgugucacugcacuccagccugggugacagagugauuuugucuccccccccggcaaaaaaaaaaaauuacuauguuaguaguuaacaaguuauuuuacccagcuuuaucauuuuuuugguaucucuuuuuuuuuuuguuuucacacacuacuuaaugucauuguuuagauuggaguugguagaaaaugcaugcaauuuaauauuuguuaugcaaaaauuguuauuugcccauaguauauaggaaaguggcuuuuuucaugauugcauuucuaaagcuaggauuacaaauagauuuauaaauguuccguuguuacugcacauguguucauuuuuuauaagcuugcuuuuuaguuaguaggguuugaacaagguuguaaaguguguugucuuuggugacuccauuucauuuagugaaguccuuugauguuugccaggaaccauacuaaucacuguuagaaaucaucucugguggccggguacggugguucaugccuauaaucccagcacuuugggaggccgaggcaggcagaucacgaggucaagagaucaagaccauccuggccaacguggugaaacccugucucugcuaaaacacaaaaauuaguucgacguaguggcccacgccuguagucccagcuacucgggaggcugaggcaggagaaucacuugaaccaggaagguggagguuacagugagcugauaucacgccacugcacuccagccuggcgacagagcgggacucugucucaaaaaaaaaaaaaaaaaaaaaaaagaaaucgucucugguaacacagacgacagaugucucaaguagguggauuuuuuuuuuuuuugccccauuuuaaaacugaggacuggcugggcgcgguggcucacgccuguaauccagcacuuugggaggcccaggcgggcagaucgcgagauccggagaucgaaaccauccuggguaacauggugaaaccccgucucuacuaagaauaauaaaaaaaauuuagccgggcgugguugcaggcgccuguaguccuagcuacucgggagguggggcaagagaauggcgugaaccugagaugcggagcuuguagcaagccgagaucgugccacugcacuccagccugggcgacacagcgagacuccgucucaaaaaaaaaaaaaaaaagacucagaauuauuuagagucuuaaagguuuaucuaguuauuaauaagucuugcaguugggauucagacuauuaacugauuuuuccuauagcuuuaaggagaaaagaaaagaguaaagaugaaggaguaggcaagaagaaagccucccuguguuucuuuuuacaccaucaacuuucuuuuaauuagauuuuaugcagaacuaaaagagaaacgugcuccucauuuuggggggccagacuguggcauaagaaagauuuucagagggcuguaauguggcuagauucuaaucuugugauaauugacaggugauggggaugggggggcguuuggagguguagguaggagaaaugucugaaccaacaccguuuguuugccaccuaagguucuuucuuuagauguguuacuuggaaacauucuugaagucagaaagaaaaccccacauuugaaggauugaguuaugucuugacggaggguuuuguuucucucuagggaauaguuggugauuuuuaauuagacuauacuuagauucugaccccuuuggcaaaguacauugacagaagcuagucaguccuugucaggaguuaaguguacuuuaucugucuaaccuaucagauaaauaacuacuggguacuaggcuuaauaccugggugaugaaauuaucccuacaaccaacccccaugacaugaguuuaccuguauaacaaaccuucacauaugccugcaauccuaaaauaaaaguaaacaaacaaaaaaagauuugcuaggacugugagaagagacauagagucugagcccagcuucugaaggcuguaacacaguccucuuuagucuugcaguaguacagagcaaauaguuuuuacauuaaaguuaguguguuuuuccauguguuacuuggaauguauuuuaauucauguuaaaaugaucucaacauuguguuucucuagauugagaauacuuuuuugagauugucugggcuccuugcuuaaaaucuuaugaagguugauuaacuuaccccaacuaacuccuuuuuuguaaaagugucaaaaaugaaaaacugaggauauuuaagauggaauauaucuauauauaauauuacaguuauuaaaaauguauguuugcuuaaguuauuguaaaagcauuuccagcaagugauugauaacuuuuacccaaggcacaggcaguagguggaaauaaaucccugcacuggacuugaaacuaacacaucuauaauuuguaaguuuuuuuggucacuacuugaaccaacauuggucuuuuuucuugugauuuauauagcucuaauggucaguuuuacuacuuuauuauguucuguucucauagaacucuucauuaauuuguguauuuuggucuugucucucccaugagauauucaacuuccugagagcagugguacauguauccuauuuuuguguguugaccagguaucacaacuuguaugucauagauaugugcaguuucaugcuucuuucagcuguuguuaaucuaacauacuuuuagcuucuuagggauaaauauuacaaagucagccuauagaauaguacagucaugcauccugugugaugccuugauuagaacuagucugauauauaggaaauuuuagaauuauagaaaacugcuuauuagaaauguucagccacucuaccauauuuugauugucagugauaaucacagauuuauauuuguugcauaagagaaaucuacagacaacauaccucaaacuuaauauagccaauugucaugaaucuauccccuccucucuuccucccagugacuuauuauuugugugggcuucauagaggauuuacuuauuugaggaaucaugcauaaaguuucuugaacucaugcauaaaguuacuuuacaauauauauuucuuucuuucuuuuuuuuuuuucucgagauggagucuugcucuguugcccaggcugcagugcaauggugugaucucggcuguaacugcugccucccagguccaagcgauucuccugccucagccuuccgaguagcugggacuacaggcaugugccaccaugccuggcuaauuuuuguauuuuuaguagagaugggguuuugccgcguuggccaggcuggucuugaacuccugaccucaggugauucaccugcuuuggccucccaaagugcugggauuacaggugugagccaacgcgccugaccuacaauauguauuucugagaggacauagcagucaauuguaugaucucuaauauaauuuucuaaucagagacagaaaacuuauuuaacaauuuuccuuuaagugugguuaaaaaacugagugguuuuugggaagauauuauacuugagaaaggacuugaauuaguuggguugccuuuguugucuucaugucugauaaguuaucuuacugugccuaccuaaugaagauuaacauuacuuaugaaauguuugauuuuaacagaaacauuugaccauuuacuguuuauuuuuauuuuaauauuucaggcuuuguguauuuuuuucaguuugcauguuacuuguaguuugguugcuuugaauaaagugcacuuuugaaagccucuuaauucucaaggagauuuccaacuguaaagaagcuguacagguaguuuucccuuaaaggcuaaacuucaggcugggugugguggcucacagcuguaaucccagcacuuuaggagguugagguugguggaucaccggaggucaggaguucgagaccagccuggccaacauggugaaaccccaucucuacuaaaaauacaaaaacacauuagccagguguggaggcacgugccuguaaucccagcuacucaggaggcugaggugggagaauugcuugaucccgggaggaggaggaugcagugagccgagaucacgccacuguacuccagcaugggugacagagcgagacuuugucucaaaacaaacaaacaaacaaacaaacaaacaaacaaaaaacaaaaaaaaauucaaucauaggaaaucuugaaaaugcuucaguacuuuguuggaguucauugugguggaacuuuauaagccaauuuuuauggaccccuuuaagccacuuuaucuuauucauggaugguguaauuaucauuuauuuauuuguuuucauugauacauaauaguuauaccuauuuugggguacacauuuauauaauauauaaagaucaaaucaggguaacugggauaucuguuaccuuaaauauuuaaagaggugacaacguauacagaaaagaauagaaacaaaauaaaaacaaaaaaacccugugcuuuaacucccccccaccccauguuuugauuuuuuguuuucuuaauuuacauguuuuaauauugccugcuuuuuaguagguugcuguaguuauuguuuuugagauguuuuucuuuggggcuucauacuggaguuauguguggauuccaucugacuuuccuuguguagcuaugaaggaauaccugaggcaggguaauuuauaaagaaaaaagauuuauuuggcucacaauucugauguuuagaaaaguucuggauuaggcuucugcaucuggugagggucacauguugcuuccauucaugguggaaguugaagggaagccagcauguacagagaucacaugguaagagagagaaggggcugggcaccauggcucacggcuguaaucccagcacuuugggaggcggaggugggcggaucacgaggucaggagaucgagaccauccuggcuaacacggugaaaccuugucucuacuaaaaauacaaaaaauuagccaggcgugguggcgggcgccuguaguuccagcuacucagaggcugaggcaggagaauggcgugaaccugggaggcagagcuugcagugagccgagaucuugccacugccuccagccugggcgacacagcgagacuccaucucaaaaaaaaaaaaaaaaaaagagagagagaaggaagggagggccaggcucuuuuuaacagccagcucaugggaacuaauggagugagaacucacccauuaccgugaagauggcaccaagcuauucaugagugauccacccccaugauggaaacaccucccauuaggccccaccuccaacauugaggaucagcuuucaacgugagguuuagaggggucaaauaucaaaccauaucaauaccacuauuacaguaauagaguauucugaauuuguucauguacuuaauuuuaguggguuuugcaucuuuaaauguuuucuucuugcauguuaguggguuuuuuccccucccugcuucguauugaagaauucccuuuaagauuucuuguaagaugggucuggugauggcaaauucucucagcuuucauuuaucugggaaggacuuuaucacuccuuuauguuugaaggacagcuuugcugguuucaguauucuuggaugacaauccccauuuuucagcacuuugaaaaugccaucucacuacuucuuggccuauaugauuucauugagagaucuguugccaggccaguuagauagaguuccuuuauaugucauugcuucuuuucucuuccuguuuuuaagauccuuucuuuaucuuugaccuuugagaaauuuauuauaugccuugggguaaucuuauuugggucauaucuguuuggugaucucuaacuuuucuauaccuggugugaucucggcucacaguaaccucugccucccaguuucaagcaauucugcugccucagcccuccauagcugggauuacaggcaugugccaacaugcccagcuaauuuuuuuuuuuaaauuuauuuuauuuauuuaucuuuuucuaguuuuggaaaguuuucuguuguuauuucuuugaguaagcuuucuacuccuugcucuugcucaguucccccuugaacagaaguaauucuuagauuuggucuuuagugguaauuuucuauaucuuguuggcaaucuuuuuuuuuaauuuauuuuuuuucuccugugucuauguaugugccugucuucaagcuuacuguuucuuuccucugcuugaucaauucugcuguugagagccucugauuaauuuuuuaguucagcaaauguauuucuuagucccaagauuucuguuugauuuuuuaaaaauuauuucaaucucuuuguuaaauuucuuucuuuuuuuuuuuuuuuugugagauagagucuugcucuauugcccaagcuggagugcagugacgcgaucucggcucacugcaagcucugccucccggguucaagcaauucuccugcuucagccucccgaguagcugggacugcaggugcccgccaccacaccuggcuaauuuuuuguauuuuuaguagagacgggguuucaccguguuugccaggauggucucgaucuccugaccucgugauccgaccgccuuggccucccaaaguuuugggauuacaagcgugagccaaagugccccgucuuuguuaaauuucuuugauaaauucuugaacuccuuuucuguguuaucuuggagauuacugguuuccuugaaagugcuaucuugaauuccugaucagagagcuuacauauagcuauguuauuagggccagucagucacagguuucuugcuuuguccauuugagaaggucaugguucccuguuugcuauuguuucuuguggauguaugucuaugacuuugcguuauuguaggcuuaguuauuuaucucagucuucucucuucuuuuuucuuucuuuuugagacagagucuuggucuaucaccugggcuggaguucaguggcgugaucucagcucacuguaaccuccgccucccaguuucaagcaauucugcugccucagcccuccguagcugggauuacaggcaugugccaccaugccuagcuaauuuuuuuuuaauuuauuuuauuuauuuuuuuuuuugugcgacggagucucgcucugucgcccaggcuggagugcaguggcgcaaucucugcucacugcaagcucugcuucccggguucacgccauucuccugccucagccucccgaguagcugggacuacaggcgcccgccaccaccaugccuggcuaauuuuuuguauuuuuaguagagacaggguuuccccguguuagccaggauggucucgaucuccugaccuugugauccgcccgccucggccucccagagugcugggauucaccgugccuggccacccagcuaauuuuuguauuuuuaguuagagacaggguuucaccauguugaacaggcuggucucggacuccugaccucaggugauccaccugccuuggccucccaacgugcugggacuacaggcaugagccacugcacccauccuuuuuuuuuuuugguuacuauuaaauaugucuacuuagagauucuuauaauuuaccuuggauuuauuuaccaaggauauucuugacccuucuuucuuucuuuucuuuucuuuuucugcuagguuacuguuuccuuuuugguuccagauggugccuucagcccagguuuuccuuagcucuaguaaaggaucagagugcccccuguccugaaugggguauuuuccaaagggugugagagggcuagcuagggguucauucccaggagaccugugggacagaccuccuacaguguagcacugcugagcugccacucugauuuggcaucuccguuggcugaauugcugaguuuccagggcugggaaugguauuccugccaucgcucuuugugucuggcugucuugagggauauuucuuucuucagguacucccagugcuuccuacagauugaagaagggacaguguccuccuaggaaacccacaauggugggaaagcugguuguccacccugaucucuauucuaguguagaaaccgugagugggggguuuauuuucugcacacuugacuucaggcagaucaaaggaaggggugcugaggauauagaagucucuuauucucuuacuauuugcuuggaaguuuuuuacuucucugggaucugacuccuccucauauuugaguucuaggaaauugcuggugaugacuuggugcuguauauauauauacauauauauauauauauauagaaaaauguauguaaaaauguauauauguguauauaaaaauauauguuuguguguguguguguguguguguguguguauauauauauauauauauuuuuuuuuuuuuuuggaagauggaaucuugcucugucaccaggcuggagugcaguggugugaucucagcucacugcaaccuccgccugccggguucaagcaauuccccugccucaaccucccaaguagcugggauuacaggcacacaccuacacacccagcuaauuuuuuguauuuuaguagagacgggguuucaccauguuggcuaagauggucuugaucuccugaccucgugauccgcccaccucggccucugaaagugcugggauuacaggcgugagccgcugcgcccggccagugcugcauauuuguuuuugguuuucugugaagguugugggaggagugaauccagcuugcuucuauagcaccauuuugguaucagaaaccacaauugauauuugaauaaaugaucauuuggaaagaguaauguucucagaagauuccuauauaagguaagauuauuuuuuguugggaaaaguuugcuucagaaaauuuuugauaugggcagacagcuuuauaugggcauguuuuucauuuaucgucaacuucuuguguucuuacauuuuagaaucuucucgaaauggcaucuuucccuguuuuauuaaugcuugaugcuguuacaaaacauugcaucuauguuugguaauuuaugauuuuauauguuuuuccaauuucuucauuacuuacugagcacacaccugugucagguauugagcuaggugucaauaauaccaugaacaugugaacuugacagaauggcuucuacuuaugaaacuuacuaacaguugacacacaaagcuuuuagccccuccccugcacuuccccacugucuuuuauugcaguagcagaacgcuugugggcaaaauuucaguggaauuaaaaucuuacauggaauccaaaucuuacacagaacccuuauguaucaaccagaaagaauguuuucugugauaggucccuacuuuggaaaagcuuuaacacagagauuuucaaaacuuucuauacaugaaaguuucugcagaaucucaauauuuaaagcagaaaacauaaggcagagcugauauggaugaaauguguggugagaagcuuucucgcaccaaacccucccuggaggcaccuuguagagcugaggcccuaugaagacaccagauaaaaagccccccgagagaaagaacucagcucgagcuuugccucucccuuacgccacugguggcccauuuccugacagaacguuuaggugaacuagagacacucuagcaaccauacgugcaggcaguccuacgugaggaaacuugaggaaaauauccucacgugaagagaguuuccguagguaacauagcauucaucccaggaaacccugggaacuuugaggugugccauaaaaagcaguuugaaaaucgguuaacuggaucaccgauuugagccaccccucaguauccaugaacuguugguuccagguuccauucacaauaccaaaaccuguggcugcucacgucccugauauaaagugcgugguaguuacccaugcacauccuccccuauacuuuacaucauuucuagauuacuuguaagcccuaauacaauguuaaugcuauguaaauaguuguuaucccgaauuguuuagggaauacugaccagagaaacaguuuguacauguucaguacagacacgaccguuuccccuccacguauuuuugaucugugauugguugacuccauggaugugggacucucgguguggagggcugacuguacuagaaaagucgcuuuacuacugcauguauuauauguugaguauuuuggagaggucaggaaagcuuuuuaaaaguuguucagaguugauaucaacuaauuuagaauaccuuuuuucucacgaaaaauaguguguaaaacacuaaauuauuuucuacuuagaaaauauucaguagacuagguaauauaaaauauauuauuucuugaaagucaaguuuugugccauugucuuacuagauuuuauaacaaugauguuagguaaugguaacuuacuaauuuuucugaucgcucggggaauuaauuuacauguauaugguuaucgaauuguauuugaaauuccagauuaaaaagaacugcccaacuuuccaaagcuuaguuauucccuucuuguaaggauuuuuucucacuguggcuuccacaguuaugacugccugcacauaugguugcuaggguuucugguuuucaucugaauguuaugucaggaaaugggccaugaauggcauuaagggugcggcugagcucuagcugaguuccuuuucucaggggcuuuuaaucucagguucuguagggccucauuucaggcaccucauucuccaggccguacucuuagaugccuagcuuacaaggcaagaggacuggcauuuaagugacaccucuuuacaaacauguuuauuguuacuguuuuagcuuagauuacuuggggaguucacucugagauugugugccagggcuuucuuguauagugcuccaggaauaauacugcucacagugggggaggcagaacugggcagaaggggaaggugaacuccagcagaguccuggcagauccuaagggcagugcuggagcugacauugcccuucagaauugccccaaauucaggcaagauggccaagccuuuauacucaagccuggaccaucccuugcaugugggccgccauucccucccucuucaagggguauguucuugggggagggaaccugaacucaugaaggcagcaagggccuugccaggagugggacuuggcagccugccugcagcauccccuauagccaugcuuucuguuccucacguucaucuguuuuuaagaacugaaaauuaaguaugcaauguucuacuuuccacaguuaacuaacaagacuucauaauuuaaaacuuaaugcuuaaucuuuaauaaaugcacaaguauuaaaacuuguuagcaccauaaguaaugugaaaauguaacauagucgcaucuauaaaauccauagugguucaaucuuuuugacaauugguuaugaguaugcuuugauuaaaaaguguauuauaaauuaacuacuucaggaauuuugaguuuugugaaauauacuuuacuuuuugauucauaaaguguuuuuguaacaagaacucccuugcauccccccugaaaaaaacaaccacuucagguagugguuugcuggucuuguucuuuguaucugcgguuuauuuaaaaugccauugucuuuugcuuguucauuguaagggggguuuuucccuuggaggacagaugggcccugucacuucuuuccuuuugacaucuucauagugauuguuggggaaacaguguuggaaaauggguuuggagaguagaucuuguacuuuggaguuaagauaggucugggguuaggugccagcucugucaucacuuugcuugagugaagagaugccuguaaggaagcuuuggcuuccucauuaguuaaauggagguaguaguagaacuuguauuauaacaucuuagcauaagcucugguguguuaucagugcucaauaaaugauggcugugaugagcuguaaucauauuauuggucaguucuucuuuuucacuguguuuuugaacacuuuagugaagguagagggcaagucaggcauacaagcuuaugcgaggaauggggccgggggaucauuuugggguuguuaucuguuaaaaaauuguccuugagguacugggcuuucuucuucacaggggaugauugugagcaaaacagcaacaacaagcagaaacauaaauaagggaggaaaugacuacuucacacggccuuaguuaggcgcagggaguauagggcaggcuuguuuuaggacugaccugccugagcaugacgugggccuggaaggaauucuccccucugugguccuggaugucacaaggugaguggaagcugggacaucuguaggugcugcagccccuguuggugacagugacagagggaccuauggcagcugccugugacagcccugugacagacgucugggcagugggacaacagaaaccauuuguuccuaaacacacagccccagggcucccaaaaaacaauagggaauuuugagggagugaucugagaaguaggaguuagucuuugagaaguacugguaaacaaguaaguggacugagcauauuuugaaagaaguacgaagagggcaguuccuagagaaaacuugaacuagagaaaguagauuuucauaaguauagauuuacuuacuauuauugugaaauguuggccuaaucucauucaguucaagguaguguuuguuucacaacugcagggcuauaucuguuuauguuuaauuuuugaguaaaucaccugaagauauguuuaaaggaauuuuguuuuccuuggccuucaaaauaaaucuuaaaaaaaauuuauaaaagacuucaguuuuaaaugcaacauaauccuguaaauaucuaauuaguguguucauaguucauuagugacucaguuuuuuaguguuagcaguacuugagcaauaugcagaauagcucaagaaaaacccuacugucccaaagcuuaaaugaauaauuauuaauuuuaacaaaccaguauguacuugaggauauacaaugguaggcauuuuauuugaugguuuucaaaguauacaaaaaaggugcaaaguacauucuuauccucaaagaauuuggaauuagcuacauaacugagcaauugugucccauaauuuagggccuggcuguggagcaggcacucuacaagguagaugaaaauggauaguuuauguuaaaaugucuggguggugguaggcuuuuucuaccucauagaacucaagaccuaucaagacaaaaaugaugugugcacauugagcagcaucuugcuuugggaaguaguauauaauacuacauaauauacaauugaagggcucugggaggaagaaaagggaugagauggcugaaauuuauaauggucaaagaaggcuucaaagugguggaaucugggugggguuugagaggugaauugaaacacggagagggguauuuugaggggaggagugagguugacaccuaugugagugauagaauaauucuuaguccagccuauagggaguggaauguucauauuuaagaagguuggaguuaaauuguggaggucuugaaagccaggcagugagguaugaagguuuuuaaacuguaauagugacaauagucuagcugaaggcugauaaagguugaaauuggagugauacugcugggagauagacacaagguuuugaggugguagagugguuaggacuuguuauuggcggagaagaugagaaauaaagagguauugauuugggguggagaguucuguaaaugucuauuagguccacuugguccagagcugaguuuaaguccugaauauccuuguuaauuuucugucucguuuaucugucuaauauuaauagugggguguuaaagucucccacuauuauuguguggaagucuaagucucuuuguaggucucuaagaacuugccuuaugaauccaggugcuccuguauugggugcauauauauuuaggaguucgcucuucuuguugcauugaucccuuuaccauuauguaaugccuucuuugucuuuuuuggucuuuguugguuuaaagucuguuuuaccagagacuaggauggcaaucccuggcuuuucuuuugcuuuccauuugcuugguaaaauauuccuccaucccuuuauuuugagccugugugggucuuugcacgugagaugagucuccugaauacagcacaggcaaaguagguuuaguauaauucuuaaggguccuaugauuuuuagaaugguaaaugaacauuggauguaauuuaaagucaccagccauauucgccuuuaacaauagaguucuaccuguccuuugaagcuuuuuauuuuuucuuuaagacagaguuucgcucuuguggcccaggcuggagugcaauggugcaaucucgucucauugcaaccuccgccuccuggguucaagcaauuguccugccucagccuucugaguaguugggauuacaggcgcgcaccacuccaccucuuggguucaagugauuccccugcccagacucccgauuagcugagauuauaggcaugcaccaccaugccuggcuaauuuuuguauuuuuaguagagacgggguuucaccauguuggccaggcuggucuugaacuccugaccucaggugauccacccgccucggccugggauuacaggugugcugggauuacaggagugagcuaccaugcccgucccuuugaagcuuugaagccaggcauugacuccucuaucugugaaaguccuagauggcaucaucuucuaguagguauaaggagguuuccuccacauugaaaaucuguuguuuaauguagccaccuucauuaaugaucuuagcuagauuuucauaauuugcugcaaugucuauuaauacaucagcagcacuugcuguuucaccuuguacuucucucuuauggauacaauggcuuuccugaaacgucauggugcuagaguccagcuuuuauucugcagcuucuucaccucucucagucuucauagaauugaagagaauugaagccuugcucuggauuaggauuugguuuaaggaaauguugcugguuugaucuuauguccagacaugccaacauucuccauaucagcaauguuuuuuguuuucuuaucaucauuguguucauuguuguagcacuuuuaauuuccuucaguaacuuuuucuuugcauuccuaaguuucagcuuaucuuagcuuucaaaaugcccuccuuacuaagcuaaaucauuucuagcuuuugauuuaaaaugagaggcauggagcucuucuuuuucuugaacacuuagaggcgagagagagagcgagagagagagagagugagagagagcgagagagagagagagagagagagagagagaggaucagcuagccgacggagcagucagaacacacacauuuauuauguucacgcucuuaugugggcaugguuuguggugcccccaaacaauagcaguggcaacaucaaaggucacugaugacacaucaccauaacagauauaauaaugaaaaagauugaaaugugagaauuaccaaaaugugacacacacauucaaagcgagcacaugcuguuggaaaaaugccacagauaggcuugguuagcacugcauugccauagaccuucaguuuguaaaaaugcagcaucuuuaaagcacaacaaagugcaauaaaaugagguauguccauaguacuauguuaaacaacaauuaguaaacacuuggauguuaucagagcagcaggauuuaaaacuucuuaaaagccccggguuuuuuuaaagggcuuuuuaccuccuaucauuugcucucauucagggcauucuguuucagcuauugucugacagugacuuuuacugauuuucaaaacuuguuuagauaaagacuauuagcauauuuuaauaaaguacaaacauguugcuguuuaacuuuauuacucauuuuucauuuuauaacggaauuagaugacuuuuuuuguggcagcugcuacaauucauggagcuaaauuuuuagggcaguucuucugggaaagugguuuauguggaauuucggagccccaagucugcccaaucuaucuugagcacauguugucugucacagccuguggacuucguaggcaacauagcucuggguaagacccaggaggaaugaagagaaggcaaggaugaagcauggggagaccaugcuauaaugaaaauguggacuggcacaguggccugugguggccuguaaucccagcacuuugggaggcagaggugggaggaucacuugagcccaggaguuugagaccagcuugggcaacauagugaaacccucaucucuacaguuaaaaaaaaaaaaaaaaaaguugcuagggaguccugggagacauuuaggucuugggaguuugacugaaguagacguuugauugaggaugcaguugcugguccugagcacaccagacugacccuaaagucaggaaaugagguuugcugacauagccuuccuucccauuuucugcuuucgugauuuuuucaucuucccguuuccuuccucuucuccaggacuuccaucuuggaggagcaggaauaugguuuaucauuugagagugauauaagucagcaaauacagaauaucuguucuucuggugcuguauuccgggagaaagccauagacccuuccucuuagggagcugagauaggauaguagggaggcaggaagguagaaauacacauguauucugagugccaggguggacaccugcaugugagauuguugauacaacaagagagggagugggaguucuccugggcgggucuugagcugagauuugaaagaggaguggguguuuuguuguaucuuauuccuguuuaggacaggaagacuaauuuuguccuggugccugguagguagaacuaugaaguaaucuuagaaauguaaguggguaaugauacuuauuucagauguaagauaaguaucccagaguugaggcauuagaguucaucucuaguggcgauaacuuuggguguuuugagaagucagaggucuucccuucucuuuuauccucuucuuauucacacuaacugccauaugauaguagaugugccugagcacuugauguugcugagauccaugugucagaaucuaggcuucauucugauaggucuuagcaauaucuguauguauuucuacccccgcuacuuacauggaaaaugccuugaguucuuccugcagugcuuuauauguggcaggugcucagcaccuaucuccugaauugaauuagauuguuuuaaagugauucuuacuagcagcacaucuauuauaaaggaaaauuuugggacaguaacccaaaugacucaaccaccuggugauuugaguauccugcguuugcucgggccugugauggugcaguagagaaagagaacauagggccugaucaucaggcugcuggagaguugaguuuuggauauuccgauggguugcaaaaagguacugugcuuuccuggguucuuucaaauuguaaucagccuuuuaugugccugucugacccuugauguuaggauuguuugaacugauacuuuuugaacauuuucucaaguuuacuggauguggggggcagcaagucaggcucaccucauugccuuguagccaucauuuacccuugaucuuagccaaaaggccgagaagugauuuagccaucuuuuaauaaugagcuccuaaauaugacucaguugcugcauuccguguuguucugugagguagaugaggucugacaguguauaaugagcuccuaaauaugacucagucgaucuguuccguguuguucugugagguagacuaggucugaccguggugaaguggcuugugcaaugucucuuagauggugcuuuccaguucuuguuuaacgugcguuccccucuaccgaggaagcugguugcuggaaaacacaugaaaauauaugcaccuugcuguuuuguugucuuuucuuucuuucucucucuucucauggcaugcuuugaaacagauuagaguuguguuuggcuucaaauugcugcaguugcccaucaaaguagugccgugguguaggguuagcaggggugcuguugcagagaagucagugagucuaguguucaaaugcaaugugacugagugccccugaagccaggugcucaccuucuuacaggcaagggcugucugucagccuacacacauagacugcagguuugaaagugcuaugugaagcuuuuguuuagcauucugacuugggccauugugguauuaccggaaaaaaaaaucugaaggaaaaacauaaaaaagcuucgcauacacaaaucuaucauccgacaucagggagguuguggggagucaggaccaagcagagguucuuagauaugguaauuagaaaucaccccauucuuucguucauucauuauaauguacuacccugucagaaucagcuagggagcuuuuuucaggguaugcuggguacuucaucccugagggauguauguuucugcuguccuucauucucccaggugccaguuauugcugguaauuagagguguuagugauucugccucuguaaugguauggaaacaggaaaaaggcuuagaaagugcuaagcaagauuuuuuuugagauggagucuugcucugucacccaggcuggagugcaguggcgccaucucagcucacugcaagcuccaccuccuggcuucacgccauucuucugcgucagccucccaaguagcugagacuacaggcgcccgccaccacacccggauaauuuuuuguauuuuuaguagaaaugggguuucaccuuguuagccaggguggucucggucuccugaccucaugaucugcccgccucgaccucccaaagugcugggauuacaggcgugagccaccacaccuggccuaacaagauuauuuuuaagggcccuuccagcccugcaacuuguauuuagagaacagaauuguucuuugauccccuagggcuuuauugacagagugagauaauugauuaaaagaauaguaguaucuuuugagcaagauuuugggguugucaagaugguacauggaggcauauugcuucuugacugcugagugggguagugcucugauuuuauuguucauggcaagaacaaugauuuggcucuugguugaauuucuaaaacauuaaaauuagucuuuccuaguuccuuuguuauguggaaacauuaaaaacagaaaaaucugauggugacauuccaguuuuauuagcauuauuacuuaucuucagacuguccuuugucagacccucgggcaggguuuugggcucauucagggaacuuucaaaguuauuuguauaggaaacauuacauagcuuugucauuauuuaaauacuguguaacaaagcauagcauugauaacagaagagagaagcauguaaaauauuucacagggauaagcauggagaugaguggguucacuuugagcaagauaaugacuaaggcagggaaggagagugaccucugcuugaaggcauuuuugcccaguugugcuucacuggauauuaccacaguauggcuuucaguuugaggauuuaguucuacuugggaaauauuacaugucuuccguguacggggcugugauuggaaggaaguuuucauccuuugauuauuucugaagcuauuaaacuauagcaauaguugguuaaccauaagaauuuuauuaauaauuaguuaugauuuuaaaaugaacuugauauuuauagaauuugaaaagaaauugagacacugucuuccaucuaaaagaagaaaaguagaacuaauuaaaucauuuggcuaagauaggaauagcugcaccugggaaauacuuguagaaaauaauaggccaguaagccuaccuaggaggagaggaaugaggagauugaauugguaugauucagauccuaggaguaaacugaggaucagaguaggaguagagccaucuugccuuacuuuuuccuccuuucugcagauaaggauagcuaaauuuucugugagcauaugguugaacuuuagauugaggagcuuuaacuuuaccaauuuuucagaaaaaugaaucugcauauauaaauaucuccauauccuaccuuuuuguuggcaggcauauucauauuacauguauguguguguguguauguaugugugugaugaggaaggcugacccucuuguuuggaagggacauacccccacacccacacccacacccacacccacacccacaccccuuuucuggguauauuugugauguaagccaggaauuaagaacugguaagaaguggccauaaauauacauugggugauagucauuuaguuaugcuaaaauuuugucuucccauuucgguuggaacaauuucauuagcagugccuuaagcaacaggauauaugauugaauuuucuuuuagugaauugcauaguuauauuggauccaauuaaguuuugcauauguuaucaguagcauuaaaugaaaccaagugugguguuaaguaaaauuaguuaaguuacuuuaguaagaaguaacuuguacuaaguauauauugagcuaguaaguacagcaaauagaggucuucaaaaguauaguuuauauguaaaacauggaaugauuauucaaauuuauuguuaauauccucauuaaauuuccucauuaaaaugccuuuacaauuuaguauuuguauaggauauuaugagauuguuguuuuaaaauuucuuagcaaguccauaguaaaaauaacuauggaacuagaaaugaguauuucuguucuuuaagggugaaaauuuuuugcuguaaucaagauuuugaaagucacauaauuaugaaauaaauaaaacuuuuuuuaaggcugauaaucuuuugcuuauuaaagucuguuugaaaauuacgguguucuuaguaagauuugguggaaauauaaauguugguguaauaauuuuguguucuguucugcuugucaauaaaaauauuuuaaaauuuagaaagagagcaacccagauuuucuuaaaaacaaaagccaaaaucaaccaaccacaaaacgaaaaacauacaaccaaaacaacccuagagugcuggggugcuaugagagcuggcacagagggucucuaggcugugacuagcugucuuguugcugagcaguuuaccugccuugggccuuuguucccuaauuuguaaaaugugguuggcaugaugaguugugacauugaaauugguaauuuauaggcauauuuuuuuucuguucauugucuaaggaauaugacucugugauuggcuuucuaaucucuacucaguucaucuaaguggaguuugguguugaauuucuuuuaugugacauuauuuaggaauagauguccuuaggcuacuagcugaaaaauuauaaaccuaaaauuuuuacuuauguuuaaaauuuuagguaugcuauaccuccggagcauggaaaacgacuugaaagacuagcucaagguaaaacuugcuuuuuaaauuuguuuucuguguuuuauauguuucuguguuuuguagguucuuuguuuuugagguacuuuuuacaauauagaccguuacucuguugguuuuauucuauucaaguuauugacuuuuacauguuuuuuuaauugaacaauuuuaaauuuuuucaccuuaguuugugaauauuauuuuuucccuauugcauaaucgucaugguuauuuuaguugacuguuuaguauuucaucaagugauugcccuuaaucuguuuugguaguuucuaaaaaaauuguuuuuaauguaaugcauucaacgucauugugccaauaauuuuuuuuuaaauuaaguuacauucuuccagacgguauuguugcugcaucuugggguaugguuuuuucaugacuacuuuuucuguugaucugcuguuucccccaaggguuaugucacugccgacgcccaguucuucuguggcccacugggacuggaggugugcccuuagggaagugugaaggugaauggcucugaguaacaauacacaugagauuuugggccuucuuggacuggcaaaauuaaacuuacuuuacugcagguugcauuuuuauuuuucauggccugcugcuucuucuuuagggccagaauaaagaacuuuucuggaccucuauugaugauccugugccugcuuuuguguguguagacaaugccaaugcaagcagccaccuuccuccuuccuccuuuuuuuuaaagauaagccaggcggccuugcccucaucuacuuacguaugggaagcagagucacauucacccccugccauccuuaucuucuguuuugcuagccacccuuccagaaagaagauguaggcugguagugacuuauuuccagggaaaaguggaguuccauuugagugacaacugaggagcaaggccuucugccuuuauccaggauugaguccucagugagcagugcucuuuuaguccagugcagaucuaaguuucauugguguguuagguuugccuucuauuaggaaaagaauuuuguuccugccuuauaugugcuuucaauuaauaaugaaauggggacacugagaaaccucauugcuugacuugacaguuuuuaacagaaacuguuaauggcaccuaaagguuacuuuucccuaaauuacagaagaguauuagaaggaacaguuauaguauuacauuuuaagaagcauuauuauaauuuugucaggcuaauaacuauaaagugucuuuuuaaaaauguaauacauaauaguaauaauagcgauugauguaauuguaaucuugaacuuuguuagggacuguuuucaugaauaaguuuuggauaauagauuagaguagagcuuauaagaugauuacuguaacacuuaacuacguaggaagugaacuuuguguuaagacuauauucucaacugucuucuucucuguaauaaaauuuuuccaccauuuucuauuaaucuugcuaccagagaacuuuuaaaaugaagccgauguaaaccuuacaauauugagucacagacuaaaauuucugauauaaacuucuaaugcuuugacguaaacugucugaaaaugacauuccagaaaaugguuaccguuuguuuaaucaguaagagguuaaugaacuugaaggaugaacaagaacuugaaaucaguugccuguuuauucaaaacucuuuugcagcaauauuuugaggaauaaagcagggaaaagacccugcaagauagugaaggauuuguaucugaugaccagaugccagccaaaauaauugaauucugcuaaauaauuaaaaugauaaaauaaugcagugcgaaugauggagcauuuuagaaugucuagcugauagcaacacuugauucauaaaaugaaaaguaggcucagauauuuuccauuaucuugucugcgcaucauaauuaucacacuugccuuuuaugcaugaaugcuuucaucuuugguuucuauugaaaucuugauugacuguggcaccuacaaauauuuuauccaaaagacauuaggccugcaucuaauaaagccaggaguuugauuucgcccuucagcugcuuucuuauuuauacagguuuuccccauauuauauagacauaaauguaauaaaaaucucaagugaauuguuacaauuuuuauacuuguuauauucgucuguaaugccauugcauucuuucuaauuuuugguuugauacaauuggauugcaaauauggaggagaagagaguuauaauguuaaaucaugaaugacaguuuggaagauuuucaguuuuuaaaaugucuaaaucucaccuauuuuagaaaaaagauaauauugcuguuauauuaaguuagguaaauugagaaaguguacagauuuuugugaaaaguaguauuucauauuucauuuguccuuuauugggaauaaaaugcuauuauuuuaaaaaacugaaaaggauuuacuuugaaaauuuugguuacucguccaaaauaugugauuuaggacuuugugcagccaguuuugaaagugugaacaauuaggaggaaacuuauuucaaaggacaguguaguggaagugagucaauucuuuuagauccuuauauuuacuugaaacaaauguugguuuuguuaccuuauuaaaaaagcaguauuuagcaaaagggaauagaagaaacauugcuaccaaggguuaguuuaguucaugcuuuuaagcauuugugugugugugugugugugugugugugugugugcgcgugugcacgugcacgcacauuguggaauuuuuuuaauggcuaguaaucuugauuuuaauccuguggaguaagaggucauagcccgauuugcagagaucccugugccaggggguagauaaaggucaaugggugggaugcagacaggcauucaguggacucuuugaaauuauauucaaaguugggcauauacguagauuucugggaacgccaucaucaaauccccugagaucguuugguccgaaaaggauuaugagccacugcugucaagagaauagaagagcagcaauaaauaaaucauuuuaauuuuaugaacagauucuaaauuaaccugcucucauaccucucucuuggaaauuagggaaauguacuuuuauuagcucucaaaaugguaaauauuauucccuuaagcauucacuuagcugauagucugaaauauuauauugaaaugucuaguuuugaaaggcuuauaaauaaaauaccucugauuauaaauaaucaauuuuaaaguacccuguaagccauaaaaaaugcaaaagaccagugauauauccucugccuucaugccuaacucaugccuuaggcauggagaucaauguguggugcgucaggguauguuuauuuucgucuaucagcuggauuucacuaagagugaagaaacgguugguaaacuuaauuucuuaacaauuugaugucagugauaucacugucuguauuuaaauguaauuggauauuuuauauccagccauguuccuagugggauuuuagacaucgggcaauaauacaugaaauacacccaaauaacauaauucauuugugagugaaagacuuuuaguucccuucucuuaaccgagaauggagaggaagaauucaggaaaugaaugucaacuaguagggaggaauuauggggaagugaagauuucuuugauuugagggugccaauggggcugggcagaggcagagccagaagaauccugguuaguuuaacucugaccaguuugaucccaauguucuuggcuuggggaguccuuggugacuugugcguagauuauccauggauauuucaagggggugggaagugagagcugaaauuaaguggucucaggaaugcaguaaaaaaaaccccaugcguguaaugacacacacaccaguuaaacuggguggaaauuuuaaaucucgguuuucugcuaauuaucuugaaauggaaaaaacuugcccauuacacaacgcgcaccaugucuaggagauuaaaacaagccacuuguuuaggagaagcgccauucuccauuccaggaucaguaugaaguucuccuggcacuccuccuggagcgcucugcugguagagauguugauggauuaugggacguuagggucaagugaggccugcgaaaggauaauuuucuauccauuccugaguaaccacuccgugaacguuagcaagcaccaagaggccaaauguaauaugugccucucaugucaaccucucaaguagagcuguggguaaauguuacuagguuucucugcauacaauguaggucauugguucuuuucauaaauaagcuugccaagaaauuucauguguaaaucaaauacaguacaucuguuucugaaagcauuuuucacugaaccaauuuucuauaccuuuuucuuguauucuuuuccuuagcuuuuguuuauaugguugcuauauuuuucaagccucauaccagucauauaaaaccacgauaaaacuucaucaaagcauacuugggcaaauuucaauuaucaaguaaaauuguaaagaaaaauuuuuuacuaguuuggaaauagaucuacauguuugauuuucuuuccuuccucccuccuuuguuucuugucuuucucuccccuuuccuaaaaaguuaauggcuaucauuaucuucaccaaauuaguguuuguauacccauaaaaaugucacuaagcuuugaucuuaaacucuuuucucaaggcugaaauuuuuggugauuuaauacuauagcguguguuuguauuugaaucauaaaagauugggauuuaaaaauaauuucuuagcaauagcuaauauauuauaaacuauaaaccaguugacaguauagagaacuucucauuugaaggaaggaacacaccuguuccauauuuuuagacacauccacucuauuucaaaaauaguuucaaaagauuuaaugauuuuuuugagucaguuuuauucagguaaaaucuacaguaaaauucacuuauuuuaagaauagagcucauugaguuuugacaaauguuuacagugguguaauuaauaaaccacaugauaagccacuguuaucaacauguaacacauuuccaauaccccaaaaaaguucccucacaccucuuuguacuuaaccacucuccccuucccugucacccacuaaucugguuucugucccuaucguuuuaccuuuucuaaagugucauauaaguggaaucauacuauguguagacuuguuuuuugcuuuuuucacuuagaauaaugcuuuucacacaugcucacuuuuacauuguaugugaaacauccuuuggauggguauagcacgugauccuugagagagcuuaugagauccuacacacuucucuguguugcaaaacucucagcagcacuuugguguucuuaggaaagguuauuguggauugcuuuuaggguuuuagggcucuguuggggucucuggaauacaagcuuuuuauuauccuagccuuccaucccucuaacuuauuauuuggauuggaagaaugauuccaaagaccaucuuugcuugcuugauccuguauaauaucuuaaaaaagacaaaaaaaaaaaaaaggcaguugacuuuaguauggcaaggaauugacuguguuuuauagacuauggagugagagugaguaugaaccauguagcccugcagguauuuugagguaaaauucauuuuaaggcacauacuuuguacauaagaugcguuguuuaugaaguguuuuucaggacuauguaaaauauaauucugauagcauauuguaaauauaaauucugaaccaaugugaaauucuuaauauacugcaaauuaccuuccuucagugguuuuccaauuuagguuaacuuaugaccagucaccacauuguucagguccugauuacaaaucuauauugaaagaaaauggaauagacucuucuuucuucacugauuuuaauuuaaaacuuaauucaucaguguugcagaaaguuacagauuugagaaguuugauggauccauuugaauuguuuauaaaaacguucccauggauugugcauuuggggacugccccuuggugcccuucucuguguguaggacuuaggacaucuuguuguguggacauggccauuauauuagugucuuacuuucccuccacucaccaguguuuuauuuuguguuuauguauuaugaauauuaaccauaagcagagggcugcauuauuaagagacauuguaaagaauuaacauuucucauguuuuauugaacuuccuuccuuccuaucuuuuuuuuuuuuuuggagucucucucguugcccaggcuggaguacaguggugcaaucucaguucacugcaacccuugccuccuggguucaagugaaucucaugccuuagccuccugagcagcuaggacuacaggcacgcaccaccaugcccgccuaauuuuuuuuuuucuuuuuuccuuuuuuuuuuuuugaggagucuuacucugucauccaggcuggaguacaguggcacgaucuuggcucacugcaaccucuaccucccggguucaagcaauucuccugccucaguguccugaguagcugggaccacaggugugcgucaccaugccucgcuaauuuuuuuguauuuguaguagagacgggguuuuaccauguuggccaggcuggucucgaacuccugaccuuguggaccacccgccucagccucccaaaguguugggauuacaggcgugaaccaccgcacuuggccuguauuuuuuaguagaacccggguuuugcuguguuaggcuugucccaaacuccuggccucaagugauccaccugccuuggcuucccaaaguggugggauuacaggcgugagucaccguaccuggccaaauuggucacguucuugaguuaucugcauagagagauccacagaguuagaugucacauuuccagcaguuuccccccucauucuggugguggaggagucagacagcaucuacgccucauccugucacacauaugcauugcaugugccuuccuggugccuucucucuuccuuuuguguucucccuccaugauucucugucuuuuccuuguuucuuguuuuuccaaucccuucagcauggcugccuucccucugagugaggaagguguggagcaguacaucagacauguucauuuucuuccagcuugcaucacugaguuaaugagagucugccucagacagaacugcagguuugaagucagcgauggagaaaacugacucugucuuggcguauaauauacuguugaaugaaaggguuguuguauguuuaacuuccucauuuaaaagccuccucaaaacacuucucccauucaggcuguucaggcagguucucagacaguugaugggugauggcugggaaguucauucaggagauuaguagcaauuaguuucagauuaaucagaaaagaaacagaaaggugggggaacuacucugucugcuguaugccgaggauugggaugagugcuucaggaaugcauacuuaucuuuccuuuuuuuccccuguauuuuuagcuauagauccagcaucccacguauuuaucuuuccuaacuucccuaaauauuuucuccauuuaucagauaauagauugaauccacauuuguuucaaauugaaauuuauuccuaaaguugaguaauuuuacagguuacaaaaacaacuuaugguaaaucuguuuguaaagaagaucaaccuuuggugauguauccuuuaauuuuuaagaauucuaacucugacucugaguuuuaguacaagggcuuuuuggcagaagagguccauacuugcauaagucaaacaguaagaacacuagaacuuacacauuaaaaaaccuauuugauauuuucucuuaaucgacacagugccacuuacauuuauuguuucuuuuuagguuuuuucccaagcagcucccaagggugugaugcauuucuucgccacaagaugacauugauuucuccaucaguauugaagaaauaugguauucccuuugacaagguauguuaguauucaucuuacacaaauuaauuuuguuuguguaggauuuguauuuaagaaguaauguaucuuuaacuuccaguagaauuuuuaggauguggguagagaaauucaaauuuauguuuuauagcauaucaauuauuuaucuaaauccuaauuagaaauuaauuuuauuucaaauauauuuacuagagauuucauguugcuauaguucacuuauaauuguacugaaaauaaaauguagcacauucuauaaaauaagaggaagcacuucuauauuaaaaucuuuuuuaugaguaacauaauuuauguauaugugaucuauuuucuaaaaauuucagagcaauuauuagcaauggguugcuuagaaucaaugauuaugguagcacuauguugcuuguaaacacauuuagacauaauacaaucgagauuucauuauggauaaaauugccugaugauuuaauaaucugauauugcuucugcgaguuuucugaagauuagguucuauaaaacucaguagaugcuggaucccacauucuuugugucugugggugguuauugggucagaauuauugcagagcucaaacauuuuuaugugaagcagcugauaugaaaaaagguuuugaccagauaaauaaaaucucccucucagucucaggaggauuaaguacuuagcugcuugcagaaacauuaaaaaauagcucuuccuucuucuguguuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggccucgaucucccgaccucgugauccgcccgccucggccucccaaagugcugggauuacaggcgugagccaccgcgcccggcccuucuguguuuuuuauuugacuuuucuucucauaauccuugcugcuuuccaucuuggaagcuuuuugcuugugacuaaaucuuuacauuuucuucacuuuagguucuuacuguggccuucuuuuugugugugugugugugugugugugugugugugugugugugggagggugggggggauuuguucaaaguagaaguuuuucaagugccaggguucauucuucagcuugaggugauucccugcucccucauaaacugucuaugcagcagucacgcacaagauaugcuugcuuuugugaaugugcccucaucacugguuuacucgcacguuuuuaccaugaaaaaaucgugccuccgagaugugcaccgugggggcugccugcggguguagggaggcacuauggaugggcugcagaacugcuggguacagagggcacaggcugugccacucagaggggcugcuguggcuguggggcuuugucccaucugcagacaccucugggcaccaggcuuuugugagucucagacacaucaucauccagugcuucuuuuaaguaguuggcaucagcuucauuagguacuuuuacuuaaguuggacuguuacaagguagacgugaaggaaugcaacaguauccccaagacacaaaauccuucucuguuccuuuggggcugguguuagguguuggugguagcuuaaggcugauacgugaagagaaguuaugugaggcagcagggcugugggauuggcucccuuuccccaggagggaggccucuggagcuuggagcucuuuucuagaggugccuggcacccucuuucuaggcugcagcucucuaccaguacuacaugguagaucgcuggaggcauugggcucucaucugguguuuuguggauggcuucuguggaaaguggcgagaugaauuuaaguccugaaauggugaaacaccagugacuuugaggguugauuggcaguggcacuuccucauauuuaauacugucacuuccccuuuccaccucaacacagggccugucaugacacuguauuccucaagaaccacauuuaccuggugaugauagcguaacauaugauagggcagcacaaugguagcacaggcugcaggauuaaaccuccugaguucauuccugauucagucgcauaaucuuuccgagcuuuaguuucuucgacuguaaaaugggauaaaaauagugacuacuuaauaggguuacugugacgagaaagauaaucuauagacagaguuuugaauaguauauguugcauaguaacguacucuuccucuucaacucagcccucuuccuguagguaauaaugucucaguuggaauacauuuuuuccuucuuucauuguauuugccauauucauacauauguaugaaaacauaaguguaauaaacagcugaugucugcauuuagauuauauccacucucuucucuagcuucuuuuaugguaugagauugggacugaccuguuuuuggaaaugacaggggccuaaaauucagaguugcauucuguguaacaggugcucuuuuuuuuuuuuaaaucauggcaugagcuggauuuucuagguaggguagagaagguuuguagguaggauuccauggagcgggaaaaguaguuuucuuguuccaguggcagcaguccucccucuccucucaccuuuaugugggagcagggugaguuuuguuucauuacguaggauaagaaagaagcaccuagauaauuaauuagauucagugagaccaggaaaggagagaguugggcuauguucucacguggcucagauaauggagcuugaaccgugcugggcacugguaagccugucucugcugccaggugacaacugagcucauugcagcagaacaucuucugggguuucuuuggcacgggacagugguguuaugaguuacauuucagaauuguugggaaaaauaauacuuuccccaucuccaauaccauuuuagcauccauaacauggcaaagcuaaucaguggugaaagguaucagaagagugauuauuacugaggugggaguaggggaugggcaggggauggucuagguuagggaugagggagcgcucuugggugaugaaauaauaggggcauggacaauuauccauagcaccauuauuccuagugcccaaauuggaaaugaccaaaugucuguuggcugaugaauaaauaagcaagugugauauauuuuauguaauggaagauuauucagccauaaaaggaagugaaguacuggcacaugcuacaaccugggugaacuuugaaaaguuuaugcuaaguggaagaauucaguaacaaaagaucauacuuuauaugauucuauuaauauuaaauauccauuauaacaaaucuguagagacagaagauaaaucagggguuuucuuagggcugggaugaaugaggggcuuggggaugacagcuaaagggugaggggguuucuuuuugaggugauaaaauguucuaaaauuaauugugauaguugcauaacuuugugauauacuaaaaaccaacaaauuguacacuuuaaaugagugaauuuuaugguaugugaauuacauuucaauaaaguuguuacugaaaauaaaauacuuuaaaaaacacuauauguauauacagauauuuguccaaagaaacaaaauacuacaaauguagcuauuacuguuucagucucuucucccucccagagauaaguaauuuucugagguugauauauuuaauaaauauauuucuuccuuagauuuuuaucauaaaaaaagaaaauaggggcaugggauauacagguauaugcauuugucaaaacagaucaaacuguacauuuauuaucugagcauuuuauuauauguacauuauaucucaaagaaaauauaaguuguauuagggucaguaggauaauuaaaaaugugguuuuacaacuuuuauuaucagagcuagcagagaauacaggcucugaaugugaacauacagcauuugcuaaauacuuuggcaauaugugucaaggagaaacauugcuucaguggccaaauccuaugaguauuuuuauauuacuuugcagcaacugaaagaauuuaaagauauaaggggucuauccuauugggugcugcuggguuagaaacauuuuaagaucagauaauccaaaacaaauauauuauauuauuccauuugaaggagugagcaauaaguuuuauaauuuuuguaucggauagauacuuuuuuaaaaaagaaacaacacuacauuuuucuucacuuuuucuguagaccaugggauauuuuguguugcuuuggugauuguaaaaaaaaagucuuuaaucuaaaaaauagaaacaggguaaauacauuuaaaauucuuuuuuaaaggcucaggcuuauuuaugcgaguuauuuuaauuauacuuaaaaaugcacucacucuaacauacauauauuugaauaauucuuuuaacagaaguuuuacugugaaauggacugugcuuaauugaauguuuucuaggugcuaggaaaaaauaauuugaugaauaucaccaacucuuuaccaacaagaauucaugauauagccugccaagcauguauuaucaaaguuucuguagcuguagcuuuaacaaugucaguuauuauaugauuuuuauauguaacuccaguaaugcaaguuauuaaaauauaagaauauauagcuugauagcuaauaugaacaaauuuacuugaauaaccugaagauaccuucaauuaaaauguaauagcuuugaguauggauuguuugauuuaauucaagugccagcaagccacauccuauuuaggaaagucuuuuaaacguuuccugaaaaagcacuauuaaaggauuaaguaaugaaucugguggaacucuuuuugguagugcucugauaucaagacuuuuuuucuuuguuuuuuaaugggaaauauauuuuaauuguauucauaauuuaggaagucuuauuuuuacaaaauauuauauguuuccuaccuugcagauaacccaggaggcuggagaauucaugaucacuuucccauauggcuaccaugcugguuuuaaucaugguuucaacugugcagaaucuacaaauuuugcuacugucagauggauugacuauggaaaaguugccaaauugguaagcuaugccucaaaaauaaagcaaaaauuaaauguguauucugguuauuuuaguaggaacccuacgauccugugcagcauuuauuuauucuuccucacuggcgccaugugccucucaccacagcaauucacuucaggcucgauacauuuauuuuacauagccaauauuaccaauuuuagcugaauuugucuguuuugagauuaauguggagcaauuuacccugauagguaauuugaugcgacguguguuugcuuuuuaucuugaggccuccaguugguguuuugcaagauuuuccaguggcaucauguggcuccauguuagguagacucagaucucucccuguuugcgaucaguuuguggcuuagaaaacagcacuuuacagaagggagugucugauaaaauuguagcaagagauggagggagguugguaggaggaaaugauuaaaacugcccuuagugcagaaaugaaauucuugaaaguaaucauguagaacacauuuuaacaggaaauacauauucauguuaaauuugguauaaaauuuugcaucuccugcccaguguauuuaauuuagcucacauaguggguauuuucuuucacaggcaauaacuucuauuaaauuuaauuacuuucccccugugguguuaaauagaagacaucuucaaagugauggugguuucuauuagguuugcuuccuuuccuguggcuuuuaagggaaaggugcaggcuggcagagggcagcuucuaaauaaaacuguguguuuuacagaggauguaaaguugacguagauuuagcagaaaaugauaaauaaagcguauguggucuuauuuuggccauugcauggcucaacugaauaucauucauucuacacugauaaaacuuacauguggagccaucaggugaacguagacagaaguauauuuaggggagacaacucuuaguuuaauuuaccuguguauuuagaaaauugcauaauauauuaaaagauaaauaaaauauagcccuuuggcagcccaggagucauucgaauacauucuugacauaaaggaaagccccugguauuagaagacuuuuucuguucuaaguaauuucuguuuaugcugaguaauucagaaaggaacagaacuguacuacuacuucacauuguacauccuguguauucuaagaacucaguguguguacuuuggccaaccacugcauugcuuuuguggaaauguaaugcuugcaucugccuugaagcagugucuuggccacgagguuauaacaaggucuguuauuuuauaguuugcaccuuuacuuacagauauaagucagcuauuacagcuguucagagucaccacaaauauugauucuuguuuaauacaggucucagaaguagccuaugauauuggccagaauaggacauuccagccuuggggagaagcuaaacuaccauguacauuggaguugcauuuccacauuuccauguggaaguagaguggguguggaguggaaggaagagaggcugguagugcuccucucugaaaucccagcugacagagcccaucacaguugugggaaugugaaguguugcacugugguggaggaggcuggaucugacaaccaaguuuucuucucuggcuagccauguaacauuaggaaagucauuuauucuucauauauaaauuagaaauaccucucuacccuauggguuagagaaaagaacuuagguaugugacuaucuguuuauucaguuuaguaagggcuaugacuguuuuguuugguucuggguacaaaauauucagugcuacaaugcaguuuuggccagcuaauuaaaaauugcucuaacugaauguauuugagauuuuuucaguguuauggccaccccuuacuuccuuuggccaggugaugucaucugagaauauauuaguugucucuugcugcuguagcaaauuaccacaaacuuuguguuuagaacaauagccauuuauuaucucaugguucuguagguaauaggccuagcauuggucucaccaguuaaaugucaagauguuugcaggauugcauuucuuacugagacucuggggaagaauucauuuccuugcuccuuuggguuguuggcugaauucacuuccucacaguuguaagacuaaacguucauauuuguugcugacugugaaccagaggcuggacuuuucuccuagaagccucucucuaguccuccuguguaguuccugcauuucagagcaggcaauccgcaaaaucccacgugucaugcaagauagcgcauucaaagaucucugggauuaggaugaggacaucuuuguugggggugcaggaggggaagcaucugccuacuacuacaggggguaccaauuuaucauugacauauuuagaaucugcuuugggcuggggcaguagcucaugccuauaacuagcacuuugggaggcugaggcaggaggauugcuagaggccaggaauucaagacuagucuuagcaacagagugagaucuugucucuacaaaaaauaaaaacaaaaauuaagaaaaaagaauauuuugaguuauguaaccaauuuuaguuauuuugcauaaaaacaggaaaauaacuuuauaaagagauaguuucgaauguuucacuaaaauaucaugugcuuucuuaauuuauaccaucaauacuaauauuuucaugucuauucuuggauaauaaauuaccuuacauuauaguaagcugaguuagcauuuuuuuuacccagauuuugguaucuuuaaucaguuauuugacacauauuuuugaucuccaagucugauucuuuagguaaccuuaugaauuuacuguguugcauguauauguaguuucuaaucccuggcaaauuugugcacugggcauacauuuauguguuuuccuggaaacugauguguagugaauugcacuaaaaagacuuuuagcauugaggaugcccauauuugucuuaauucuuugucuucaucaguuuguucuaaaugguaacuauaaaaaagucauuguucauaagugauuaugaacaauacuuuuauaauuacuaugaaaauaugagcacuuuuucauaaugaggcauugguggugaugccaccugcuuuaccugucacaugggguuuauugaauguguauaaguaucugauaaauuauuuguuguacagcauuaaauaagcaaaauagugcagaguguggggucugcauacauuauaugugcauauauguaaucacaaacacuaugaaauauauauauauauauaaaaauauaauuuuguguaauacaaaccaguauuuuuaauuaggugacucagaaaagagcuguuagagaaggcaauuuguuuuuuaauuaaaaaaaaaaaguagguuuugaaaagauaaccucauguuccccaguagggaccuuuugaucauaagucaacaggcuuugucauuagggaccuuuucagaugucucagauggcugguagaagggggagaaguucuacuuauggagacuaggcuuaucugcugugugccaggcaucauguauguuucuaugaauucaucacucgugagucauuguucuaugagaacaggggugagaguagaguugacacugggagggguucaaggucugcuuccuuugcuguuggcuacuugacuucuucuggugucccuggagcaggacuggagagggggcuccuguggcuuucaucggaaucuguuacugaccuauugauaugugauaguuguucaauaaaucuuccuggcucuuaagauuuggguacauuugauuagaaauuucauuauuuguguaaagcucagauacacuuccaaauuuuagcaaauuccuggauguuugauauucucagcugaauuauuguauuuaggagaggugucugucccugugcguaaauucucuguuuuuucaguccuucaguccagauggucuuuuuucacaguauccauccaaacugccucaucucucaaacagacuuuuuuuguguguguauggauuguguagaagaucuggggaaaauaggcagaggagagagugaagggacauuuaccuuuuaguuuugguagcugcuuaguuugaccaucccuguuucuaauauucucugauaauggcccaggccuuaccauucuccucucauuucugucuuugcuuguguuuucccucaaugaggaucauucugcucucuugucuuaacuugcaaaauauagcauagccaaauccuguaagaugcuccagaacaaaagggccuugcauuuagcaggaacaacugaccuaagaaggcaguuguguaauuuucccccauuucucuaaucaaagacaagaucauuacugaaaaaaauugagagugauguuucagguagucacauguucauuugcugcugaugggcagaggucagauuuggugagugcccagugaguuccuccugugcuacauguguguacaaagaagaaaaacauauauauugucuucaaggagcuuucagaaagaacagaggggcuuuuaauaaaacuccacuugcaaaguuguaguauuaauggaacguaacaucuaguucuuuguuuuaggaaucuuuguagcuuugaauguuggcauaacagagugaaaugcaauuauuuuuucuugauagagauuuaaaaauacuucaacagcucguuuagcaguugaaauaagacauuugugcauauuugagcugacuguuuucuguuucuggagcauucuuuccuucugugguggaaugaaguccgugauuacucugugcagcugcugccgugacacucacaggucugcuuccuggccagguuggaucaaagcgccggccggcagguuguauuucauuuuuccguuugcugggaugaagugcaguuguuugauguuagguuugauggauuuguuugccacugcauucauuagcuucacaucaaaaaacugacaggcuguuaaaugaaacuuuggcuuagauuuucagcuugacuguuuggagacauuugugaagauauuuuguguuuguguuucagcagccucaagcacuaugauugucucgaagggaagaaaaguuauuuacuguacugauuuucuugaguaaaaaagaaucauugucuuggggacagucauaucucguuuauaccgucugaagcaguguauuuauuacagugugugcagugaaagagacuuacugugucagaauaaauauuaucuuauuggaaggaaagguaauaguuggugacacaaaaaugauaucuuuuauuuuaauuuuaagugaucauauuaacaugauaugucagaaaguugaaaaacuguacugcagagcugggaauguucucuuauaaacuccaggaguacuaccuuacuaucuaauuuuaagacauuuugauacuugaauccucaaauguuugaacaaguuuaaaaagagaugauagaauuuuaaaacugauuucccuuuaaucuggcagggguuucaacuauuaaauugucuagcauguaagugccaugauguggguucauucuauuuuauauuucaauucucuaaaauuaaguuagauauuucuuaaaucugguagcauccuuccagaaaaucuuuaaucuugggcagucuuuauuaaaacaaucagggaucauuuuuguggugagucucuagguuauauuuuaauaugcuuuugaucacaaaauacuaguauagugauauuucucuguuccugugacaugugaaggaaagaaaauguagacugcuuugaguauuguucauuuuaacaguucuuggcauuucaauuuuaagugucugacaugacauauauaauaugaacuuagugaguauggggauuuuauguucugcauuuuuuuuuuuuuuaccucuacuuuuugcuguuucugauuccuagguucugaugguacaguguaacagagcugaugaguaguuuugcugcgcucuuuuauuuuuuugcuuuacuuuuaagagcaucuauagguucacagcaaaauucagaggaaaguauagagauuccccauauuccccuucuccccacaugugcauagccccccacauuaucaauauccuuaaccagagaggugcauuuguuacaaauaaagaaccuacaaugaugcaucauuaucccccaauguccauaguuuuuuuuaaacuuuuauuuuuuaaggaaacccaggcaaccagaccaaaguccguaguuuacauuagggcucacucuggguguuguacauucaguggguuugaacaaauauacaaugacaggcaucugacauuguaguaucauacagagugguuucacugcccuaugaguccucugugccuuuuccauggggguguguguguguguguguguguguguguuuaacuugcuagcucaugagaaaccucuaccucuggagagaguguucacacaucuggaagaaguauuaagagauaugaagaacauagucacauuauguccucuuuuuauacugaaaaaauauugaguugugggauucaggauaucugaaacuucaagaagucugagacuucagguaugaugguaucaaaccaguugguuaguauauauugcugaagucuggagcuagggagccugauuucauuuguuguuaacuugcauuugcugcauuaugggauuugaaaggaagugauaagccucaugaugcugauguuuaguucuuaaccugaaaucaaggcauuaucugcuuuugagucuauaguuugucaguaccuuaaaagaaaguaaauuugccuuuugaauaacuucuauacucuauugagaauuaguuuguuuuuaauucagucuaguuucuuguaguuaaauacaauaguaauaauauuugacauugucuccaauaugucagaucgagcucugggcacuagacacaucuuauuuuucuugaucagugaugaugcacauucagagauaauugcuuucuguccuauacuggcccccuuuuuacaaugugucauuuucagggugguccuauaucuuacguugaauuggagggaguuugggaugaagaagaaaauagggcagugaggcccggcuuagauguagguuugcccccaauguccuguacccuucuggacucauuuuucuagguguaauggcuuaaauaagcgccagccacgugugugauuugugggaucacucucaagauucuugaagauucagaauggucuugucccaugaaagcuguagcugaugucaccaccaaguggcuuuggacucuaucucacaauugguugaguuuggauuccuaaagucaguggagccaggggcaugguggcauacgccugucaucccagcacuuugggagggugaggugggaggacugcuugagcccaggaguucaagguuacagugagccgugaucacaccacugcacuccagccugggcaacaaugcaagaccugucucaaaacacaaagagaagccaauggacauguuauuuuggauucgucuucucugucgauaaaccuacaugugaauuccuuuuuagucuguagugcaaccgucguuaacucugaggcuuugacuuugcucuuugauuaaggcgguaggggugagagcaaagguuuucuaccuucucuuucauuuuaucaaguguguguggggaaguucugaggcaucugucuggauaaaaggacuuguguauagagaaugaggucaaaguuaagggccaccuaucucaauguauguuuguaugauuaucaggggccaaauuuuaguguagcacuuuugaagcuuuaggauucuuuuuuuuuuuaaugccuuaguuuggacuuuuccauauuuuuucaguguuuauaauaguaaacacauaggaaaaauuuuuacuaaaggcucuauucuagacauggugacugcagaagaaggcaaaaguugguaguguguuuucuggcucaugauuacccagaagagaaagcagugggcagaacaugaggugacguuugagagaagcaggcuggccaaccccuggagggaaggagggacuggugggagagucagcagggcccugggcaccccccagaguuugccauagucagaugcccuggcuucccacagcuucucauccaugcaggcuuuccugcacuuccaccccugcagguucugcugaggugacacacagugguuuaucucaaaagggcucuuaccucacauaagggauugucagauaugugcuccuaggguugguguagcagcucagcaaccucaugaggucucaugcaguuccuguccuucagauucacugucucugggcaggcuugucuugauagcugugcuuacuucagacaucuugcugccaagggcaggaagcgagacagugugagaacuaggcucaucuacccccauuugcgaggaaaaucuuuccuugaaacacacuugaaaacauccuuuuauguccuguggccaacuguuagaaaggcuggaaagguaacuggcgaguaacugguguuuuuagggaaaggggcucugccuguggagaagaaagaaaaagauggaagaaagaaggaaaaagauucauugacagaaucugccacaauaugugcuucugauaccucauuucgugacacauauuuacuuuuagcaccuauuauuuggugggcccugugcuguggcuaaaaaacuaaguaagacauguaguuucuguauaguggcgcuuacagacuucagucuauguucucagcucuguggaacauuauaaguauggaccccuggccccaccaaaaucaguaggauuagaauaucugaggauaagggacaaacauuugcauuucugaaaucuuccugugacucugguggaugcuguggguugagagccauggguuuuuagggaguuaaauuaggccuuuguuguuuggguugggguucuucugcaucuucuauuuuuuuccaccaguaugaauuuugaguuccaaaacauuaacuuaauaucuauuuauaaauuggagauguguaauguuuuguacauauaucauuuacagucucuuuucuccaagaauuaauagguguugugaacacauauagaauugugcccacauauuucaugaucaaguaaacaugcccaguaguacuuuuaaggggaggaagggagaguguuggaaaagaaauagaguagauguuaaagauaggaaugcacuguauauaccucuuucugaagagcuuaguaaauguccugauggcugucaggagugcacguaaaaaacccaacauaaucaccugggacuguguuggaauugucguucuguguggaauaguugugugaccuggggcaaaugacauguuucugugaggcuuaguuuuccuaccuguaaagagggcguucacuugugccucacagguugugaggaugcggguggugaugggagaacucgccuggcaccaugucccucuccccaaguacauauuuaggaagugacucauugugggucauuuuuaugucagggaacucccugaauauuaauuugggggaagacugguggaguucaggccugaggugcugagaaacagugucuguggggacaguguuugcaggguaagugucaacagcaggcugggcagauggauauuagauaguuuuacugacuucucacucgcauucagguguacuuuuuugcuaaaaugaaggcaguaugaaaagaagugccaauaacuaacaguggguuuuuguggaccagauugcugagagaaggaauuugaaggagcuguugcuuauaucuucagaaacacaguguagcucuugugccccuuguugaauuugaaaggccguguuuuguaaucccuuggaaaaaacaccauccuggaugguagagauuacugcuaagcuuugacuguauuucccacaucaguuucauauacuucagguuuuuugauucgauuaaaaaaacccaauuaguuucuauuaacuguuuaaaauuuucguaaaagguauuuuuguaaggccugauaaucauuuucauugauuuuuggcagcauauucccaguucuuaggaaugcauauucaggguuguccuuugauuuugaguguuaauuuuuuaaaaagaugacuguuuuguugauuauugaaauagcaugaaaacuuguuucuuugaagguaaauaaaauugaaacaguuuucaaacuuauauaaugauuucuuuucuuuuuuuaaaucauauuaguaaagauaauaagaaaaugcccaguccccaggagaauguaguugguagagugggcacuguguucucuuggcaggaauaugauuggaguaagcauccugaagagaaggugggcagugugcaucagucuugguaaacaucuucuugcgcuuuuaccauuuucucacacucuuaggaaaugagcagaaauguaggcaaaaggugauuguuguagugccaguuuuaucagugaaaauagaauuguaacuaaaauguccaaugauauaggaaucauugaauaaccaauuguguccauacacuguaauuuuuaaaaauuuuacagaaaagcauuggaaaggaaaucacuauggcuaauaauauuacuacccaaauauccauuguugaaauuuguaaaaauaaaaauauuuaauggcacccuuucuaguuuauuaaagguaaaaaacuguuaacaguucauuguauaucucuuaaaauaucagcauauaucuguaucuuuucgaaaaucuacacaauguuauucaagauccuauagauuauuuugccaugucuuuaauauaucauucuguucaauauaucuuucauuagccgggcgcgguggcucacgucuguaaucccagcacuuugagaggcugaggugggcagaucacuugagaucaggaguucaggaccagccuggcugacauggagaaaccucaugucugcgaaaaauacaaaaauuagcuggcauggugguggguacauguaaucccagcuacuugggaggcugaggcaggagaauugcuugaauuugggaggcagagguuguggugagcugacauugugccacugcacuccagccugggcaacagagugagacuccaucucaaaaaaaagaaaaaaaaaucuguaucuaugucuaucuauauauuuauaccuauaucuauauaugucuuucauuuacagcaaguaaaacauuucuggguuauagauacuuacuacaagaaaauuguuguagcguaucccaaaagaaugugacaggugguuugcaguggauuuuuuuuuuuuuuuugaggggcaucacagaaccacaguaguacauaagaguucauugcacagaucuuguuaacaaaucagaauguugaaaaugaacaccuuagcucauggcucuguuugcauucccugggugcagagcagaugguaggugggcuugugcuuggugcacggguccagucuugucuuuguugaugggcuguguccacaccugucaccucggcuuauuccacuacaguuaauacuggaagagauuuauaaugccuuugcaguuucuguuuuacugaaugacagcauuuauaacugggucuguauauuugaaggaauguauuuuuaagaaaaacuuuaauaaauuccuuuaguaaugccuuucucuggcaucauaaaggaguauuccagugaauuuggaagauacgagaggaaaaaguaacuaaacggcguuagucaacaguuuuguggcaaugggaaauuaaacugggaauaacacaaaagaaaaaaaaaccuagcuugguuucuaaguacgagccuaggcaaggagggcuacauuaaacaaaaaacaaacaaacaaaaaaauccucagcacaacaaaaugcuaacugcaauaaccauaaaggauacuauagauuuaaaacauuauuguccauuguugcagagagcagauggugcuuaaaauauccuuuaauuugaugugcuucuuaaaagagcaaacagccaaagaguauauaucaucuauauuaaaaaauuaaaugcaagcuuuucuauuuuugaggaugccauaguauauauaguuaacgaggaacaaauguaacaucaguaugccaacagggauacacauuggaggccgucuuggcaggagauugagggauagaugagggaaaagacuaugaagaaacacuucuaaacccugauuagcccuuguaugaaacucuucucgguuguauaauuuccccucaaacugacucuaccaaguguugauuguccugaaaugucuagauugccuuacaacuacagccauuaguuugggggaacauacuuagguauauggucauaauuuucagaaaacaugguuuccuccuuuagucuuugacauuuguuuagaauaucagagagguucuucugaauuugggugcuguauacacuuaugaccuucagaauuaaugcugaauccuaagcccuaaaaugauucuuuugagaaagcaugaccaagacuucguaacagauaacugccguucucagauuuguagguggguuuaacuauagcaggguaucuuaaauggcauuucuauaguguaggguccuugugaucaauuuauguugcuuuuugauccaguuacuauacagacauguuugcugguguuauugagauggaaggugucuggggcaaagcuaaaucagccugugacuucauucagccccucagacugaaaaaugugcugagcacagauucuccuucaauuccuauuacccuuuauuuuauguucacauugaggauccugccaguuagaguggccucuguguaaacgaagaaaaugauuuggaguucagauccauauuucugaaaguauccaggcuuugaguuguggagaaucuggagcccagauucaaaugacugaguaagugacgcauagcuacuuaccgagaaaauugggaagaugcaacacacucuguuuucaaagaaacauuuugagguuggaaaguauacagacauagaauuucaaagggcacaugucaaguuuaguuguagauuaacaugaugcuguguguguugauuucaugaugagagagcacuuuucccuuguuuuuuuucuccguuugcuuucuggaacugauggacaugauugcagauggugucagauuuguuuucuuagaaguaauuauuauuaagcauugaaguaaaugguacuucucguuuguggaaacuccacaggguaaaccucuccaggcaacacuauggaaggaauucucagcaucgugguauaccguuccuaaguaccuguuguugucucaauagagucuaugggcgaauugggagauuagugacuccaagucuucugccucaaugguuuugucucugaggcaaagggcugguacacugaccagagccucccaccucagccucccuaguagcugggacuacaggugcucccaccucagccuccugaguugcuaggacaacuacaggcacaugccgccaugacuggcuaauuuuuacauuuuuuguagagaugaagucuugcuuuuuugcccgggcuggucucgaacuccugggcucaagugauccucucguuucagccuccccaagugcuggaauuauaggugucagccacugugccaggcagguuugguuuuuaaaaauuucucuuuggguuacuaaaaguguuuggcauuacaugauuuuuguaguuauuugugcacaguuguagacucaagugaauuuuaaaaugaaauugccuuuaaauauuaguauggcaaaaaugaaaacagcauugcauaguauuguuuauuuauaugggugacguagauagguauuuuauuucaugggaacaaucuaagauuuaugauauggaucaaggauucuagaaacuauucucguaaccaguuuuaaacaaggucauuuauaacaccucugcccaauuuuacuauugugaaaauaugcuuacaagcauuaaaggauugacucaauagauuuuuagaaaaaucucugcuauacagcuguuaaaaacagcaggguguauguauugaugugauaaugaucuucaaaauauauuguuaugugacaaagaguaguuaaggaauacuucuuuagcaugaagcuguauuuuuaaaaagcaaucuuaaaaauauguaaauugaaugaaaaauaaaugaaagauaaacaugguuaaugcuauggccagaggaaugaacuugagauacagacaggcaaacccucaucuuuuaugcggucuacuucugugagguugacauucauuuauuuauuuuuuuugcaagucuauuuucauguauuauuuaaaauucaguaaaauuauuguuaaaguuuucaguaguaucuguacauguagagcucuggaccaaugucuaaaugcaucuuauagacacauagcagagauguuuuaaaauuuguuuccuccagaauauuuaacuuguagccaaaacuuuaggggaagaggguaguauaaauaugugucuuuacucauaggacuuuuucagcauuuaaagcauuacucuauaauuaauaauugauaucuaauuaagggacauuucacguugauucuaaaauggaaguaaacagcacuaauacaauuacuaacucaaaaugcuguugaaagaaguaaaguggaauucuguguugaaacuauauucagauaaaauggcguucuuuauuccuuguuguaaaaacagccugaaauuuuguauuggcuuuggcuauguauuuguuuaacauuuucauacaauuaaaagucacuauuagacuguaaauuguaucauggacuaugguacuuaaauauuaacauauuaaauuuucuacucaaagauucauagacaguguggaaaauucaccagcagaggacagugucgcuucauacauuuuuuuuccugcaaaguccuuuguaaggaauggauuuuccuuauaaccuugaccuagagucuuagaagauauuuauugguuacacauuuguaaucgguauguuuuauauugaagagaagaugauaaaaauggauguaacuuaauguaguaagggcuauuuauacuauuguuuauauucccuuuacauuaguuguuucuuaaaugaagugcccauuuuauguguaggaaguuugugcauuuaaccuaaaauaccaucaaguugaagugcugucuuuugugaaaugagguuauaauuuucuuccaaaucuauugcaaacuguuaauguguuuaaucucuacauguuacuuaguguagcugcugugcgaaguggguacagacaggcacacacaguacaaaaaugaaauagaauguauugggagggccuuacaagcugacaaguagcagugugugcaggucccccaccacucauucuuucacugagagaaugaggcuugaguggggcacaggugggaacgggcguccacggaaggaccccaccuggcccaacaugcuccauuuagccacggagaaucagggcagaacacaucccugugggaccaggugugacaagaucuucuuggggggaggauguagucuuuguagcacugacuuagcaaagaggccucuuuuugcuaaguuucugaggugggggguggggagguaccuagcuuaauuggggacauuaaguagauuuuagugguaaagagaggacauuuagucugccuggguuugaauccuagcauugucauuuacagguaauaucaucuugggcaauucaucuauaaauugggauaauaauaccaaauuggaacaauaaugauagguuaguuguaaugauuaaaucaaauaaugagaguaaacuccuggaguagugacugacacauggcauguaauaaacauuuuucuuucuacgagguauugauauuuauuaaccucuuaaaagcaauuuggacucccuuugucucuuauuguccugugacaguuaccaugagugcauucucccauuuuuguuuaccagaucugccccaggaacuuuuuaaaaaauugauuucuuucuuuugaaaauaaaacaaauaugugaaacauacugaaaaugcuaaaaccuacaugagaguauuagaaaguaaagaauguaauucuauaaucagcuacauauggauaggcagagagaggggucugcuucuuguccagcuguagcucugugcuaguggaagcauguccuggaguucacgauguggccaagagaacagauguaguuaggcaauggaggugggacagagagcugcaaagugcugcacuugccccucuuacuggacccaaaaggcucucaaguguaacaccuuucuguagugcuguagaucauuaaucugggugugugaugaccaucugaucuagcacauccaguggcauugugcauauugggauaggaauuugauuuugugaacucaagcuauucagcagggcccaugaaaaaucaccagaaggguaggugggucuuugccacugucugauguuucaaagauuucuuguauuaaaugcuguguccaaaauuauagaauacucuccaguuuguauuuauguaaaaaaaaaauaaaaauaagcuuucacucguauuuuuaacauggcagacuuuguaaaaacauuuaaugaaacaaguaaauauauacacuuauuuugaagucuuuaguauuuuagaguauauuugacagcaaaagagggugaggaaaaacaaauuuggauuucugucccgcuaaaaaauucuuaaaaaaauauuuaauguuaaauauauuagaagaaaauauaggggaguauuuauuugauccuugaguggagcaagacuuuugaagcggcacaucauugguggacaccaugaaagaagauuucacguauaucuuugaaaauugcaagcugaauagaaaaguauaugauagguaguggguuaauauccuuaauaaggugcauguccaaguaaucccuggaugucacuuaauagcaaguucgugagaaggaaaauaugguaaaauugaaauauuuugaagcugaauauaaaauguacuugaauauuuuaaaauaaaaccauguuuuaaggaaauuugauacaucugguaugcugcaugguuuuuaccuucagaugccaugagguuaugaguuacucuuuuuugccauuaggggucguuuuugggcaaguuugagaagcagcacuacauuaauauauaaagaaauucccauuuguaauucauuaaucuuuaaauggcuaaacuucauugaguccuuacuuugugucaggcauaaggcugaacuuacauuaacuuguuuaauuuuuacaacuguccuauagaauagauaauguuauuacccccaucuuauuagagaaaauuaaagcacugagaggcacaauugugggucccuccacaccaaaauuagaaaaacugggcaaaagacaggcaguucacuaaagcagaaauauagucagcaaauaacuacaaaacguaaauauaaucucauuaguagucauagaaaugcaaagagguuagugccauuucucaccucucagauuggugcagaagacaaauggaaauacucagugcaguuuuaaacuaugcaaauuaguacaccccagagcaugccaaggcaccagccuuagaaaugugugcccugugacccugcauccacaccugggaauuuguccuauggaaauaaucaguaguugcccaagaauguauuuauuuggauagucuucacaguguugauugugaaacugaaaaaauugauagcaaguaaauguugaacgcugcgggauaguugaauagaugaugguacauccagucaugauaugcuaauuagcauuaaaaaugauguggagguacguuuauugauauguguagauagauguuuguaauacacggucauggauuaaagaaagguuauagaauaggaucuuuucuuaguuugaaugcuuacuuguauuacaaauuauagaaagauguuuauuaaauuuuagcgucaucuuugcaggguuuuaauuugcuuaucuuuauuuuaaaauauuucuauagcaaccaguuaucacaugugcagugaaaaaaauaacagauuauuuuuuuaaaagggcuggcuuaaauuacuuaauuuacuuaaaauuauguauagcucuauuaauaaaaaacuuuuaugccaucacuuagaggaugagggaaaaaaaccuccaacuuuuaauauggaaguaaaaagacaagaagguagaaaaugaucagcgaugaggaaucugaaagauuagaguuuccauaauuugcuagauuugaggcuuuggauaaauuaccuguuucuagcuucaaacaggaguauaaauaucaauaauucuucagugugcguaauugcaucugauauuuguaaugaugacugugggcugucaagcuaguuaaugauuuugaugaauuacauaucccgauuaagaaaauaagcuaguacauuagugaauuuuagaaugaauaguguuaaauaguugaaauucaugccuguccuucaugauacauuucacuuccuaccucugcuagauaagucagaccuguuuaacaauguuagcacuuguauaaaauguucauauuuaguucaaaagggagaaauuugacuaaucuccuugaucucuaaaauaaguuauuauaucuaaaaacuuaauuaaauuauuguggucaugaagcuuuuguugacguauugcaaaggacauguuugugaacgugugugacccagcugaauguuucuggcucugcauaagaacaugggaggaggcuggugcuggggcucggggagguggcagggacugggcacuguugccugaggggguaaacaccccauguccuuuggauccugguucuggcuucuuaggucaugaggcccuucugcaggguugcuccccuacuuuugcccaggacuuggggcaguuugugagguuugugaggaagguggaaacccagugccaaaacuagaugguagccagaccaucugugaagguuucucccaggagguuggcacagaacgggaagauggcaggugaccuuaggaaagagguuuucucaaggugcaggcagagccagggaggggccuucauggugccuugcuguuucuggccagccuuauuuccugcccaccugccccuuccuccuuuccugccauucuaugcuucucugcauucuccuuuagcagcaaguugagcugcuccuccccagacuaacgaauacuugauaccaugcagcucagcuuugcugucacuucuugcagucaggacccuuaaccucuccccugugugauaaaguacugucuccuaggguuauucugaagacugcuggagaagauguacacaccaugcuggcauuccuugacaugcuucacauaggcgcuguucucugaggcaggguuccaggaagcucauaguccuggcauucauuguagaaugaaugaauacaaaugccucugccaaacacaguggauaaaaacagaaaugaucauuaauguaugugaauggaguagauugaaaguaaagaaaacccauguacaaauuguucauuguucuaucugaaggguaauaaauauacugggagagagagaauuuauauauuugcagcuuuaacuaauuuugguuuugcuauaguccaaaggcauuucugcuuagaaauguuuguaagguuguuucuuuccccaguaacuggauucuaaugaggauagcagguauuagugucugcugaacugaugguugcucccggagauguguugguauucccuauguguuaccauguguguuuuuuaauccuuuuuuuaacuacuuuugauaaagaaauaaggaaaagaauauuuuuuuucacuauuucuauuguugauauuucaagaauugugauauucuuggaguuuuucguaugguaccuuuucuauauuguuccaaaucagugggcauuuucaguauguugaggaauuuaacaaaaaauaaaaaauaaaaagcaaagaaaauacuggucguaucaguccucccuggaaucaguggaagugaaaacuaugacauacuugagacauaaccuugguuaaguaacgaugguuuuaguucuguguuugcagcuaaacaaauaaagcacuaguacuuauucugggauaaggaauuguccauuuucuuucuagauaauauaacuugauuauauuuuucaaaaaauuagcuacccagggauaugaaaugaaaaauaaaaaacccuuucauuaaaauguuuccuaguauuaaaauuuaaaugcaagcaaguugauuuaaaacaaguaauuagguaaucuugaaggauauggugaaacaaacccauuuguugugauguagugcaacauuuaaagaaucuaaugcacugucuuaggcucuaguuugcaaaaugggcuuuuaucauguguuuccuucuuuagcucauaccuugcgccagcuggugaagaauacguuucauguacagugcgcuucuccauugggauuugugagaggcaggcaaagggcuguuaccuauaccucuucucugaagggugggucaguggacuucacuuguccuccugcccuguugguggguguggcagagcccaaggggagucauuucagugacagccaaccuggcugccuuuccuuccuucuuaucaggaaagcuagcacaugggaaaaauuggacaguuucuacucuauuaugauaauccauauaagcagaaucacaaaauucccagaugacaauucaaacaguuacuauaaaaaguaauaagguguauuugacauccuuugaggccacacuaaugucagaguuucugauaguuuaugcgguuuuaauggacacauauuacuguuaauguagauggaagggauaguaugagaguugagagcagggaaugagcuaacagucaggguuuaagcacuccuuuaggagcaacugcacuuucugcguuucuuuuucaauucuguuccaucauccuuguuugcaguugaaagccugagacuguuauuuguuuacaacauaguacauuuuguauuuucccuuuuuuuugagacggaguuuugcgcuuauuguccaggcuggagugcaauggcguaaucucggcucaccgcaaccucugcuucccagguucaagcgauucuccugccucagccucccgaguagcugggauuacagccaugcgccaccauguucaguuaauauuguauuuuuuguagagacaggguuucuccguguuggucaggcuggucuugaacucccgaccucaggugaucugccugccucugacucccaaagugcugggauuacaggcugggcuuacaggcaugagccacugugccuggcccauauuuucccauuuuaauaaagcauugucuaagacaguaacagaugaguacaucauuuccuggcuacuuguaauaccguuaugauaugccacaugcuuuugguaagaucagugcuuauaaugaggggugcagagguauuggaccaauucaugagugccuuuugacauuaaaaaacauuagcauuguuuguauuuauuauuaugucugcuaugguuugaguauuggugucccuccacaauuagugaugaaacuuaaaccccaauacacuaguauuaagcaguggggccuguaguaaaugauuaggcauugagggcuccacgcccaugaaugggauuuguguucuaacaaaagggcuugaggaagcaaauucgccuuccccauuccuucuaucucuucugccaugugaggauacagaaacaaggcaccaucuuugaagcagagcaugggcccucgccagacaccaaaucugcuggcaccuuggucuuggacuuacuugccagccucuaaaacugugaacaguaaauuucuauuauuugugaauuaucuguaauuugcuuuguuaaagcugcccaaauguacuaagacagagucuuuuugauuuugcugucuaccuaucuuucucuauuuuaagaauuaaguguuggacuuauaaaaaggggcacaauuugaaauucucgaguuagucuuacugaaauuaacaugauaaaacguucuaaaucauagaauuuucuguggggugcuuuuuuaguuuggaaaaauuuuaaacuuccuuuacuacuucaaagauacuuuauuaauuugcuagaaugcagcucacccuauauugucuuauugguaaaaauaugcaagaagcacgugaucucuuucuacuguuuagguuuuacaaaacagguguucaugcaucuaccuaagagaguuuguuuuaggugcuucagauuuccugugagggguuuaggggguugcauaguaaagcauuagguaacaaaagaaaaugaccuuccucugaagcaaucauuuuugcuguauugucuucucacuacuacugugaugaacacuuggagaugccugccacuuugagguucgggguuacauuccauuuuaauucaaaagagauaaaaugauuguuacugucuagucauuaagaagucauuuuccuaauuguauuugacacauauuaugcuauucuacuggcaaaauuugauuauuuuuaacccuuaagagagauaacaaaaauacgggaaauaauccacuugacugucucaagaauaaagagacugcuuuuguuuuucuuuccucgaaugcuacaacaauuuguauauuccuuggaccuuauuggagccuuagucuugguggcuaugcccuguauccaagguauagccuucgaagaacaaggaaagggcuaguuuuacacuuccagcuuccuuuggaagcugccuguuaauagugaugacguuaucaagugucagguugcaguuugccaucauggaaggaccuaugcuggggcaugagaagcucgcaaagacuccuuuccagcacuugaauuaaugacaggcugggcuuuuaucacugacagaugcuguaaaauaguacaagguaaucaggguuauaggauggggggaauuuaauuccaacauggcaugaauuuggacagcuuugugagagacaucauauuugaccuggugaagauuggaugguguuuuggaaguauauauuuggaaggagagagucagcaaccugaguaaagaugggggcuagaugugguaagguguuuuugacagucacuucugagugauuugagguguaguguguuuagaaggguggguggagcugggcuaugaagugucuugaaaguuuuacagaguuauccggaccuuuuuuauucugagugauggggagccuaugagcauuuuaaagaagagguucaauauaaacuucugaaggacagugguaaaaauauaauguguuugcaauuuuaaugagaguuuuuuuuuuuuugaaacagggucuugcuuuaucacaagggcucaaaugauccuccugccacagccuuccgagcagcugggacuucuuaauuuguuuuuuuauagagacaggccucacuguguugcccuggcuggucucaagugauccuccugcauuggccucccaaagugcugggauuauaggagugagccacugugccuggcugauauuuuucuuuauuggcuaauucguuugaccagaugaaauucuuuuucuuuauccagcaaauauauauuaagcuuuaguuacaggcaagauaauuuauaugugugaauaaaauaugaauaaagccaguucuaacuuacaaagagauuuuagcaggauguuuuauuuuauuucuguuuuaagcauugaauguugcauacuuacuaagaggauuaugucuucuaaaauggaccuucuuguuuuuagaaauuuugaucaccuuugaauagguucuauuuuggcuaagcaacuuucaaagcaacagcacuguauuuuucugugcuugguggauggacaaauguuuguagauuagaguagaaacaucccaguuucauuaauuuuucucucugguuuuggggaaaugauacaaaguugaaugagggaaucugccuauucauauuccacccacgaagauuguugaggucauucuguuuuuuuuguuguuguuguucaagaguuaaaauaucguuuauauagguaugaauuauuuucauuggcaggagugaauuggagaaugugggaaguuaggcaugaauugcagggcugugggagagaugcucaggaaggaaaauggcuguugggcagccccugccucccuuacucagucuucuggucuuaauaugagcaccauauagguauccauauucucaguuucaggcaugccuuccucugaucuacaccaccugucucucaagcucuuuuucuccacuacccaaacuguagcaugcacuuggaccccaguaggguuuaaaauccauugauccuacuuuucaugguugcucacucaccucaacuucuuacuucccccuuucacugguuucuauugcaugauccaucauuguaaagauaccuuugguuucacaccuugccuuucuuucacuuuguuauacucaucuggcaaaaauccccaucuuguucaacuuagcuauuucucuugcuugucccuguguaucugaccauggcuggagauaagcaugcagccaucccauuuccuaucccuaaauucuaggacuccaaugaguuguucacgaugcccagcaguccagccauguugccgaguucguuggcucucccucucuccuccugucuccauccucauucuuugcugauugucuugcuucucaucucauugagaaaauagagaacuucugcagacugcacacagcacauuuuccuaccuaucagucccggugcccauacacuugaacucccauucuuuuaccugauugaauuguuuaugggucuaagugaggccacuugugcacuugaccccagccccucuugcaacuugaagaccauuguccaggcaucucaauucuucauucacugcaucaucacguuuuccuucuccacuagaucagucucaucagcauacaagcuguuauuucucccauuugaaaaauaucuucucuuuuuaaaaaauauaaacuuuuauuuuagguucagaggguagaugugcagguuuguuacauugguauauugugugaugcugagguuugggguacaauugaucucaucacccaggcagugaacauaguacccaaaagguagcuuuuuuuagccuuugccguacucccucucucauucugguaguccccagugucuacaguucccaucuuugugucaauguguauccaauguuuagcuucuacuuacaagugagaacaugugguauuugguuuuuuguucuuagguuaauuuucuuaggauaacggccuccaccugcaucuguguugcugcaaaggacaugauuuuauucuuuuuauggcugcauaguauuccaugacguguauguaccauauuuucuucauccagucuacuguggaugggcacuuagguuuaguccauguuuuugcuauugugaauagcacugugaugaauauagagugcaugugucuuuuugguagaaucauuucuuuucuuuuggguauauacccaucaauaggauugcugggucaguugguaggucuguuuuaaguucuuagagaaaucuccaaacagcuuuccauagugguugaauuaauuuacaucccuaccagcaguguauguguucccccuucucuacagccucacuagcauguauuauuuuuugacuuuuuaguaauaauaggaauucugacugguuugagaugguagcucauugugguuuugauuugcauuucucuaaugauuagugauguuuagcauuuuuucauaucuuuguuggccgcuuguauguaugucuucuuuugagaaggcucuguucauguccuuugcucacuuuuuuuuuuugagacagagucucacucuguugcccagacuggagcgcaguggcacagucuuagcucacugcaaccucugcugccuggguucaagcgauucuccugccucagccuuccgaguagcugggauuacaggcaacggccaccaugccuggcuaauuuuuguaguuuuuaguagagaugggguuucaccaucuuggccagacuggucuugaacucuugaccuugugauccaccugccuuggccucccaaagugcugggauuacaggugugagccaccacgcccagccuacucacuuuucauugggguuguuuuuugcuuguuguuuuaaguuucuuacagauucugaauuuucuuuuuccuucuuucuuucuuucuuucuuucuuuucuuucuuucuuucuuucuuucugucucucucucucucuuucuuucuuucuuucauugagauuuuggauauuagaccuuugucagauguauagugugcaaauauuaucucccauuauguaaggugucuguuuacuuuguugauaguuccuuuugcugugcagaagcuugaaaaaaaaaucuuaaucccucuuuccaucuuaccugcuaucccuuuucuuuguuuuucuauuuaacaauacuuugaaagaagaauugccuauauuucaucuuucaauuucaucugucugucugucugucuaucuaucuaucuaucuaucuaucuaucuaucuaucuaucuaucuaggauggaguuucacucuuguugcccaggcuggagugcaauggcgcgaucuuggcucccugcaaucuccgccucccggguucaagugauucucuugcuucagccuccggaguagcugggacuacaggcgugcaccaccaugccuggcuaauuuuguauuuuuaguagagaugggguuuaaccauguuggccagacuggucuugaacuccuggccucaggugauccaccugccuuggccccccaaagugcuaggauuauaggugugagccacugcaccuggccauauuuauuuuucuauucucucuuuaaauaccauagccuuuuaccuacuccaugcuaucagaacugcuuuugucaaagucaguggucauucauuguggaauugccugacaaguucuuccugccugcuacaaaggcaaaaucuguucacuaagucuguggcauugcaguaaagaaagaguuuaauugaugugaggccagcccaugcagaagaacuggaguugucacuccaaagccuuggagguuaggguuuuuauggacaauuuggugggcagggggcuagggaaugggugcuggugauuguuuggggaugaaaucauagggguguggaaagcaguccucaugugcugaguccacucaggaucaguugugccaugacucaugagucccauggggucagucugaaaaacaguucaaaaaagaaaauaaaaaaacagucuuagguuuuauaauagugauguuaucuguagaagcaauugggaagguucaagaccagccuggccaacaugguaagaccccaucucuacuaaacuacaaaaaaauuagcugggcuugguggugggcaccuguaaucccagcuacucaggagacugaggcaggagaaucacuugaaccggggaggugcagguugcagugagccgagaucguuccacugcacuccagccucagcaacagaacaagaaaaaaaaaauuaauuaaucaauauaaagaaauagaaacuuguauaucauccugacaaaauagguuauuggagguggaggggugaaagcggaauucuuuugaggaaauuaccagggagagugaaugaaaucagggaacagauuaauuuguacauuaucuugugaaagggucugaaggugugcuuacauucuuggucuugcacagagggaaagaaaaacauuuguucugcuuggugggucuggaucuuaggcagguaaaggaacuacuucaccuucuuugaaagggacuggggccaggaggaagucagagaggccuugagguuucuuccccugcaguaugucaaaauggcauguuuugagguaucaguuuucugagccccaacaccaaauuauauuauuuaaaaauucucaucuuacaugaccuccuggcagcacuugauaaaguuguuccuuuauuauuuuuuuaaaucggcuuuucuccuugcuuucugagaugguacacauuucuuguuuccgucugccuuacauggucuucccuucucggucaguuuuguugguuccuuuuucuuugauaccuucgagagcuuuagggcuuaguccucagguuucauuuucuugucuacacgaauuaccuuaugaucaaauucagucuugcaacuuuaaauauuaucuguaugcugauuacuaaugacuacuaaaauuuguaucuuuagccuggacuuuuccuuggaacccacaaacuccugccaugaaaucaaggcugauuacuucacacguccgcuuggauguugaugggcuucacaaacguuaacaagcccagaaagugcugucaaaagacuucuccaccucauuuaguggcaacucuguuucuccaguugcucaggccaaacacucugggagucaucacugcucacucgcuuucuguuuaaucacacacccaaucaauucuguuggcucuagaaucucugggaugcccacugcucaccacacucaccacuauuacucugguccaaccacuauaagucauuggccuggcuaugccaguggguuucacagucuuacuauuucucucuauucuuuauucggcagccagcaugacagcuuuaaaaccauuugucagauuguguauacuucugcucagaaucuccccuuccuagcuucccaucucgcuuccauuaaaauuuaauaugcuuaccauggugagcaaaugcuacgugaucacucccugccccaaccccuaccccccaucuuugacuucgaguuuuaccuccaugacccuugcccacucuguaccaacacaguaaggcacauuaaugcccuaggucccccagguuccaugauccuuuucccagaauaccccuccccaaucugcauggcucggucccucccuucucugaaguauuguucaaaugucaucuucucacugauaucauuucucaauuugaauuggaacccucuucacaaucccaagcucugugaaggggauuuugccuuauucacaccuguaugcccagugccuagcaccauaacuuguacauaguacacguucagcaaauauuugcugcaugaaugaaugaauguaugaugacagaaugaagcaugcagacuuuuaacuuacacaguuuagcccaaucuuagcugcugcugcuauguuuuugugaauuucuaucuaauuccuaucuuaauuuuuuguuuuaugcaauguuauaacacugaacauuucuaauuucuuuuaccuuugcccuuaugcagggcaugugcauaguacuaucaugguuauagucauaaggaaagccacccuguugcaagauuuccuaucacagguuucugauuacauuuacuguuuuuuucccccccauuaaaagaaguagaauuccuggaaauaguuggguaacaucuucagcaaucuuccaggcugugcauguuggcucacgccuguaaucccagcccuuugggaggcugagguuggaggauugcuugaguccagaaguuugagaucagucugggcaacacagggagagcccaucucuaccaaaaauacaaaaauuaguugaaugugguggcccgugccuguagucucaucuaccugggagacugaggugggagaaucaccugagccugggagauugagguugcagugaaccaugauugcaccacuguacuccagccuggguggcggagccagacccugucucaaaacagagaaauaaacagccuuccaacauauccucaagcaguuaacugacaaaugucacuaaguuucuuucacugucacuaauaauugaacuucagccagaaauucaggaagagaugcuuaucucucccucucugacucaagccacuuaaacugugcguuagcuacagaaauggaugcacauuagauuuguuuccaaagugauguuuccaaauuaacuuaaaaggcagugucacagggugaugucucaauaaauccucucauuucuuguuuugucauaugcuuuagauucuccucagguaugaauuuucuccccucuaaaucuauuuuauggguauuuauuugguaaagccuguuugauuuaauguuuuuacucuuuacggguuuguaaagcacugccuccuccccacuucaccugggggccgagauuaugguuauacaauagcucguuuguuacauaugcaaagcauuggaaucagacagauuuuuuuuuuuuuaaucuuaaaaaaauucugcaaagaauguugcacuguugcugcaugugacccucuuuucuggcuauugugacuaauaauugcacaaguaugguuuguaguugcaguuuccguuuaaauguuuuuuuuuccuuugagauacuucauuuauacugacuuuuuuucugaguggcuaucuuaugagcgcagcuugaauuuuaagauuaauaugaaugugcaucacuagugaauuguauucuuggauuuauuugaaugagugaaugacugaaugauuacaaugacagaaugaaggugcaaacuuuuacuuuccaugaauuccaagaauuguauucuuauuugccgagggaucaucaagagacagaacauagaauacccauacauuacaggcaaguucuucagagucuugugggguuugacaucugaacuaauggcuuguaauuaaugaccaaaaaauaagucauuaauauaauuccaucaaauggcucuuuaucuuguuuuguauguauguguguugucauuauuguuuguuugauuguuucaaaugcuuccugugucaaugacugcagaauccagucuucucuuuuugggggcagagaaccaagggggaccacugugucuucagcacauuggauuucaucuuuaucuguaagagaaaaaagcaggaaucugagaagagaccgaugcuuauggcugcugcagccuuucagguggggcaugggauucuucuuucccuccucagauauuuagaaauuucuugguaaguuuuuugaacaguucucagcaugucuuccucaggugccuuaggcgagacaauguuuacuucuuauaaagcucagauaugguaauccagaauccuuuuucuaauagcugcuggcuuuuucuuuuuuuaaaaaaaguuagcugugguuuuauauuuuaauacagaauaagaacauacuggagagagaaagugguuacugguugcaugugcuuuuuuguuuguuuaauccaucgugacagaugguguggacuaguuuaauauacugaacaguguuugugcuuguuaguugcaguuugugccuccaaguccacuuugcccuagucucuuaccugucugcccaggguugcagaucuguaugggccgccaccacaggcccccuuucccucuggcuucugguagagcccaggcaggaaauuacaagaggaggagagugagggcccagggcugcagcgcucuguuggacuugccucacaccauccucuguugcucuguccuuaguuuggggaauuacacucuucucuaguccuuuuaggacuagauuauugacaccucaguuguuagcuggccuggggcaccacucugucuauccucugguuuuucuguaccuugcccacgccaauucagucccuuaauuagaucuucucugauuauuccaacguugaauguuacacuuguguucugcugggguaccgaugcauaaugugucauccugggaaacuccuguggauuuugucugaggaguuuuuauuaaacacaaaaacuuaaaauguuuaaaguuauuuucccuguauauucuuuuuuuugguuucugcauuccacuuugcuauuaacaugaaaauaagacaggcuguccacuauauauuuuuuucaaugaauauuuggggugguggagcauuuuguuggucagaguacagccuuuaguucuaauaauaauguguucugacagugguuauuuuaaaacacguuuugguagaaguguugauguuuuguauuagugaaucuuaggcuuccuacuucugaaguucugaaaugaaccagguguauaagaaugaacauucaacgaaacaugcauccuuuuuaaaauuuagcuuucuaguacagaccaugcauuuuuccucuuugaacucuuucauggaugccaagcagugccucacuggaaguccuuaucaucgugcguaaacauccagggcugucacuguuggcgauacagcucaugugagagcuguggcagagcuucagacggaauaauuaugaacagcauuguaggagguaguuacuaugggaaaauauaauaauggaggucaaauaaaggagacacaagcuuucaucaguugggcgucuucauuuucuuuuggcgaagagaagcucaguucucuuuguaaauuaaaagcuuuuuuucuuuccuucccuuucccuuuccccuuccuccuuuccccuuuuccucuucccccuucccccucuccuccccucuuuucaaauaaggacauauucucaccaucuugcucaugcugcuuucaaucuccuggcaucaagcaguccucccaccuuggccucccgaaguucugguacaagugggagccaccaugccugggcagacccucaguucuaaaaccgucuuggcuuguuuaccaucagcccuucaccguuucagaaagaugcuguucggagaacuguaagggaauuuuccaauuaguucuguuuuucuuucuuuuuuucauuagcccucucagcugacaugugaguuacauaaacuuuuuaauugagauucauguguucaaaaucauguuuuaauuuuguuuuugguuuugugguagcuugauaugaugugguacuaccucuugugaaguuuaaaguuuguauuuuaugaaagggcauugggacgugaaaaaauucuguuuuuuaucuugagccgcagcuuagcuugggauauuaggauuagcagucacuggaguggaacguuuccaguggcuuccguaaaguacccuggauuccucuucccuggauuacuagagagcggcuuccgagcauagccgcugcgaacuguaaaagcuuguggucagugaacucaguuaagaaagugcuggcgauggugaaagucaagccccuuuagauggugguucuuucguggaccgggugccuucucuuugugagcagauuacccaguuuggcgucaaggggcuguuaggcauuccuucuuccaggaaaacauuuccugaggcuguaggacucaacugugagaggcaguugugaaggaggaaaaauaauguaagaauuaacugagguaauauaaggcguuugugaauagaaacaaguggagaagcaguuguagagagauaauuuguaaaaaaaaaaaaaaggaccaaaauaaaaaugaaugaaagggacacaugaggugaaaaguggaaucuuuguucugugagagcugguuuucauuuuuuugcucugaaaauauuuuguggccauauucaguuucuuuuugcauaauuaaaauuauaugauuggcuuauagcagcaagcaguuacagaauaaaaaugauuauuuccuccucagugagaauccgcucuuucuagucuuaaccucagacucuuauuucugccucauucuucacucuagcacgaguaaggaaggccgggugcuaagaacacauggugggaaaacaaacaaaugccuccaggcacugcuuaucacagcuaugguuuagagaaacggacauucagaaauccagcaacauugggguguguuuaguaguuuacagauuguuaaaagaaacucuugauguuuucauugaucugugaggcuccauauuauggggacuuauggcuuguaguucagcaguggaaaucuggcaauucuugacugcauuacuguccuuuaauuguugcuuauuuucuuauucauaaacaugucgaagcuauugguagaugcaauuaaauguauacauguucauuuaucuuaauuauuauuuauuagauggagggaaaauauauugauugggugacuauagcuuuuugguaaagccagcacagauuuuaaucauuguuaacagaagaaaauuaaccccuuagauucuauccuuucaaaaaaaauuuucuaucuaucuaucuaucuaucuaucuaucuaucuaucuaucuaucuaucuguuuuuugagacagagucucucuuuguugcccuggcuguagugcaguggcauggucuuggcucacugcaaccuccucuucccaggcucaagugauucuuaugccucagccuccugaguaguugggauuacaggcgcaugccaccaagccuagcuaauuuuuguguuuuuaguagagaugguguuuugccguguuggccaggcuagucucgaacuucgggccucaagucauccgccugccuuggcuucccaaagugcugggauuauaggugugagcuacugcgcccagccucuuuuuucuaacauuuauuccauauaguaacuguagcuucuauauuuuauaaugcuucugaucauguugaccuguggugauaauggaauugauaauaagugauguuaauuagaauaugagauguguaggacuugcuccccaaaagaagacccuuuccuuugaggagaucaucccucaucuacguagaggcuuccagggaccacacgaaacugcuggucucaguucugcucuugggagaaaucacaauaugccacuuuguuuuuucaucuacguaucaacccuccacacaagugaacaugucucucaguucccacccuguuagccuuguaagaagauuaaguucuuagacuuuuagcauugugucucaccaauuuccuugccccuucccacuucccauucuucucaaggcauucuaaucacuauuuugaucuggcuguuccacugaaacugcuguaaucauugaccuauacauuucccaaaacaaccaaccagucuguucucauuucauuugaacuuuugguaucauccuaccacuuuguccuucuugagaacauucuuaucuuggcucccacaccuuuacacuguuggaaagaguugcuguacucaccaucucuauuuucucaccacuuauuccuuuuuuagcccacuccaguugggcuaucaaacagcuuuuaucaaggucgucucuaggccaaaaccaggagucaguucuucauccucauguuacucaaccccucacccucuccauccuugcaacacauucuucucauaacacuauacucaccuuguuuucuuccagcuuuccagccguuauuucacagccuccuuuaccaggccuuccaguguuagagagccaaagagcucuguccugaacucgccccucuuucuuuaccuucuuuauguggucguuugucuuccuuauaccagaauguaagucucuugccagcaggcuuuaagucugucuuguuugugcauguaucucuuguccagaacagggcugagauauaguaggugcugcuugccugguuagacccuuugucauuccccuuauuacucggaucuguguauccuacuuccucgugguuucaccaagauuguagaggguaguucuauuaucacuucaaauguuacgucgguauccuggacuauaguauaucaccuauguccucuuuuuuuuuuuuaauaauaauggcaucaccuguuuguggcggaugaaagcuguggucuuugcuuuguuauugucgugcccguuauuuuuuaucgccuaugauuagucacuuugcuugcugcauucuuacccacucguuuuuguucaagccuucacuuuuuaacuaccuuggagguugauggcuaccccuuggcucugucuuccucuuuagugucagauuauucugcuaaugcagaacucugagguuucccuauggaaguagugugagcagggaaucccagcugccggcugcauguuugggacccucuacagcuuaucuguagccuguuuucuuguuuauggccccagcacuacccacacccuugugcuuuaguaaaaccaaguuaccuugcaccucguaccugugcugcuucaucuuccugcuuuccuuaugcuguugccaggaauaucuucuuuauccaaacacuacacuucaaggcuaucccaacugcuuccucuuuugugaagauuuaucuccucacccucagcuagaaguaaucucucucuacagugaaauucuuaguuaucuuuaccuuaauuuuagggcuuagaccuuucuuucuuguauuugcuuaugucuaauaucuguuauaggucauugaagacacauguuuagcuauagccuuuuguucaauaaaucuugaaggaaugaaagagacuugaagucauuuaaagaaacugagugcccuuuuacuauuuacucaacuauccugggugucauuccucuuuuaauuguguuuauucuuccauuuccaaauuaauaucagcuaacauuugagaguaaugcuuuacuuuucacaaagcaguguacacuuuauccuguuugacuuuuucuuuuuuuuuuuuuuuuuuuggcaacaauucaguaaggaaggacaguguauguaaaugauaaaauaagguagaaauuguggugcagaggcugguugguuagguaagugcuacucuuccccagucacuggucuguccuaauggguagacucuuuuuagcagcccaguuuuauugaggaggaaacugaaacucaugaauugucugguugaggucacucugcuggagucccagucaggauugcaauccggguguauuugaccccaacuucuugguaugugcaagcagaaaggauacuuuugugggugccaaaauagaauauuaaaaaguucaucuucccuguuuugaaaaaaguuugaaggcuucuuucaaauguuuucucuaguuuuugaggaucaaaauagacgauuucuacaacccucugccaauucuuucuuuuauggcucauaagaagucucauuacuaaaaugucauuaauuuuauugaucccuuaaggauguuacucacuguugaugaguccugagggucuuugggauauuagucucauuuuaacucuuacugguguaauuggaugaaugugaugcauuugauuuaauugguuuuaguuuggcagaggagaaagacacacuccuuggugcuaugcuaagugucucuaucgccuaagauucccugcagaaauuaaauuauuagcagucagcaguucucaagaucuacuagaggucagauucagccacugaugggaacuacuccaggguggccacagguagguuuuuuggauauguauguugaauuuucacauucucagaauaacgcugccccauucugacacuauuucacugacuugucaacaugaguuguuucuguaaguuucucuagaaucuuuuuauagaacuccacuuauuuuguaaugagcaccuaauacagugaauauguggaaaauaaagcacgcguugaauuuaguggcaguuauuuaaaaaugucuuuugaaaaaaucugcauaccuuauacauaauauacaaaauauauaacauauguaucauaaauauguacauauauaauaugaauauauguguuauauauaacaacaguauguuauauauguuaucuauaacauguuauauauucauauguauauaauaaaacauguuauaauauauaacauauucauauguaauaugaauacauacuacauauaauaguacaauuaauauauaauauauuaauuauuaacauaucauaugauuauacuauuauuauaauauaauaauuauauuauuauguaucauauauaugauauucauguaucauucuuucauaccuuuucagcaaugaauguucuuuuguuguaaaagaguaacacccccuaaucuauuaguuccuuucaauuuagugcacaugagaaauaccuggggaauuugcaaaaaugcaggggcuuggucccacuccuuugcaucugcaguuugcaguaagcaccucagagaauucugauguaugggauccucugaguacaugcugaaauaugcaacugcauucuuaugcuucuuugccugugacugaugucuucuuuuaccaggauucaucaggagaacccuggcauuuacacagaguugccuaacuuguugccuccauaggcacuuggaacccucucucuucucaccccccccacacaaacacacuuuaugucuugaauucccucaguaacaagggcagcaugcauugcuggauacuccccuuguuuuucuaucuggagccccccagugugaaacuaccaucgccugacuuaucagcuaaaggaguguauacugaacaauauaauuuuaguaauaaauaaauugguuaacagugauacacaauaaauaaacuugcuagaguuaauuuuuuuuaggucacaguaauuugcuuauuaccucuucauuuagauaacaaggacauuuuauguacuuaaagaauggccaucaacuaaacacgcaugcaugaaaauuagucauuaguuuuguugggucuguggaugucaguaagcaauagucauauauauauauauuuuuuuuucauaagaaagggucuuguucuuucacccaggcuggagaacaguggugcaaucuuggcucacuguagccuccaucacccaagcucaaucaguccuuccaccucagccuccugaguagcugggacuacaggcaugugccaccacacccagcuaauuuuuguaguuuuuguagaguugggguuucaccauguugccuaggcuggucuugaacugcuggacucaagugauccacccgccuuagucucccaaaguguugggauuacaggcaugagccaccauccucagccagcaauagucauauacauuuggcagucuuauaugagaaaaauauuuacuguggagcuauauauaaaaacuauaucaaccuauuagagaauuguaauuaauugucuaaagguagcuguccaguugaaaagauauccuaagcaauaauauggucagugcccuggcugugcccugcaggguaaagagaggagugaggacagaaaaagugucagugauucaucagagaagugagcucauuugggccgugacuauugugagucacuuguuaucugcagaguacaaaugcuaugagaggccuugguguuugggguggggccagagggagaugauuagaaugucaucaggcauguacuucaugaaagagaaaguggcauuuggugcuggauuccaacagguguguagcuccacaugagcuguggucauguuccccuucagaacagaguggaagccggagugcagagggaggacuguguguagcauuccagugaccaagccgacucuccuguuucugcggcacagggauuauuaguuucaauuaggguuuggaucauauucuuagggccuugaaauggacuuugaggaagaaucuguaauccauaagcuuaguaaugcccccucccaccuuguugugggcccuugagaaaacuuuuguugaaaaaccauacauuugggucauagggagacugaaguuuagagagaugcuacaguguauacaauugaagcaaucauagcaguagcaguagcagcagccacuauucaaaccuuuucuaauuuaguccuuacagcuguuauuuggggaaggaggaaacugaggcaaagagguuaagugucucccccuggugcacagccaaagcagcagagccaaacugcaacccguguguggccauuucuacuccuucauugguucugaccccugggaugauuuugucucauaaaggacauuugaccacguuuaggggcauuuuuuugauugcaugaugggggaggugccaauggcaucagcggccucugccaaggguacugcaaaacaucguacaauacacagggcagccuccacuacaaaggauuauauggccccaaaauaucaaucauguagagauugaggaacucugcacuacugcacuuuguaaccaucuuucaugcauuaaguuuuccucuuugguguagagcuaauuuaagaaaaagcuguuuaucuuauugcugcuuuuuagguuguacaagcaaguguagggaguucauuuguacuucaucaguggugaaauaccaucucaaagaauuuuaauuccguaagaaguauguauugcauguaucagauaauacuauauuuaaaugacacaaaauagacuauagcauaaauugaaucagcuuuucuauuggacauucuggaauuuuucuaugggaacaauagguauaggauguuaacuuucaaaagccuuuaguagaaucugacagguaauuacaucuucagguucuaagccccuugguuuuuuaaauucugaaggugacauauuaugccuaagggaaagauaaauaccagcauuacuugccuaucugagauagauuuuagcuaucuacuacaugcacugcuuggugagggggcauaaccaucagugguugaaauaaaacagcauuaggaaagcaguggcuuggaccacauucagggucaacuuuccuuuuggaaaauagugauucugaugaugaacaguauucuuccccugggaaucuggcucugcaaaauuacuuucaggcugaauuugacauacaauuuaaaaaagaaugcuguguaauaauuaacuuuaaaaggacaaauaaaagccauuccaguaaaguuuaacuuguugguaauuugauaaguauuuacuuauguauaguucuaauacacauguaagacaguguguaaaucacaaauggaguaaguauuuuaguuaagaacauggagguuuggcaaugaaagauacugugagggcaaagauuuugguauggcuguuuuuagaguaaaugguuuuuuuugaauugcauuuuuuuccaggucuuccugauuuuuuauuuuuauuuauuuauuuuuuuuugagauggagucucacuuugucacccaggcugaagugcagcggugugaucuuggcucaugacaaucuccaccugcuggguucaagugauucuccugccauagccuccuguguagcuggaauuauaggugugccccaccaagccuggcuaauuuuuguacuuuuuguagagaugggguuucaccauguuggccaggcuggucuucuugaacuccugaucucaagugauccgccugccucagccucccaaagugcugggauuacaggugugagccauugcgccuggcccaggucuuccugauuguaaaaaaaaucacuguaaaaauuaaaguuggggcugggcgcggggucucacgccgguaauccuaucacuuugggaggcggaggcaggcugaucaugaagucaggagauugagacuauccuggcuaacauggugaaaaccugucuccacuaaaaaauaaaaaaauuagccguuugugcuggcggucccuguagucccagcuacuugggaggcugaggcaggagaauggcgugaacccgggaggcggagcuugcggugagcugagaucaugccaccgcacucgagacugggugacagagcaagaccccgccaaaaaaaaaaaaaauuggauaauuuuaucuaaaauuaaauaccaacuuauauccucucucuuuuuuuuugagauggagucucgcucugucaccaggcugccucagccuccugaguagcuaggacuacaggcacgcgccaccaugccuagcuaauuuuuguauuuuuaguagagaugggguuucaccauguuggccaggauggucucaaucucuugaccucgugauccgcccaccucggccucccaaagugcugagauugcaggcgugagccacugcgcccggcccacucuaauuuucauugagaacuuuaauuggauaugaacugauccuucuuuuuccaaaaaaauaagauuuuauuaccaagaugaggcaaaguuguuaauauucaggauuaaaaaauaauauuucuuuuuuuuuuuaaauuagguauaccagauuucuuuauucucaaccaugugugcacauacacucagauuuuuuucuuucaguagugauuuggcuuuuuguuaauaacaaugacacaaguuuuauguauaauuuaaauauuacaacggcuaaacugguuuuggggaaaauuuuccagaaauuuauuaaauacgaaguuccuuaacuacugacuuagaagaaugaguauuguuuaaccagggaaaaaguugucaaccaccaccagcuuuucuuccuacuguuuuuuagaauauaaaagauaauaucucaauuauuuuuuccucucucaucauuacuuacaaaaaucucaauaauuuaggcauauccuuggcauguucguaaaauuguuccauuaggcauucuauaauuauaaucauauuauuuuuaaucccuacucaucucaccuguaauuuucaaauguuugauuuuuauucaauuuuuauauccuguucacauauuuuuuagcuacaguaaaacaugauuuuucauguguauuuuuuuuucuuuuuuuuugagauggagucuugcucuguugcccaggcuggagugcaguggcaugaucucaguucacugcaaucucccaucucccaaguucaagagauucuccugccuuggccucccaaguagcugggauuacaggugcgcgccaccacgcccggcuaauuuuuuuuuuuuuugagauggauauugugccuauauuucuccuuucuaauuucucauuguaauauuucauaaccaaugucuuuucuuaacagaaucauccaaaacuucguuuuuauuaggaaguaugauacuucaaaauagagauuacaaaaagagccaugaguauguugcuuuaauguaugucuuuguaguuuguguuauguguuguuauugaacagcauuaaguuuuugcggggaauuuuucuugauagaaaauaaaaguccugauuuuugucaacaagaaacuuauauuccagauuuagggcuugaauuuuuugaagacaugaaaaguagaugaaagaauaauaaacaguaagaguuuuaaaaugucaucuucuuguuuaguaaaagcuauugaauuacauugucagaaaaguguacuuauguuuaauauuucacauauuuugcuuugaauuuuuacaaacaauuuuuuguaacuuauuuggcuuucaaauggaaacuagaauuauguagugccagaagguagcuugaauauauggaguuuauucaaauccuagagagaagggaaaaaauuccauaaacaaacaauauaaaaaaagauaucuugugauuucaggauauccagcuguuuguauguuucguuuuuaaacuucacugcuuacuaaaugagugauuuuacauauguuagaaagauacuaccccaugcagaacugcaugucuauuuuuaaaaauuauauaugcuaaaaucauggagauuugugggcauggguauacauguauacaaacaguauuacuuuacauauauuugauuugcuaaaaaaagaaugcauauauacauuuauagguaacaaaaacauuauugccauugaauauuucauuuuuucacuuuuuaauauagugaagucuuagucacuuuugaugguccaguaaauuagguaauacuauuuuaagauaaagugaaaauuucccaugagaaaucacucagcccauuuucaguuuugcuuuuccugguuuagguugaacgccauaucauucugaugaaugagaaugagccuucccauggcuauucuguucucuggaagccaguuuguagaaagguuccugugaaaacaauauuuugggagguacauaguguaguagguuaagagcacaggcuuuugaguaauagggaccuguugguaacucccauuuuugcuuccuaauaacuaugugcccuuagcuaaguaacuuaucuccucugugcuuuaguuuccuuagcuaagguaauaagaccuccccuacagagcuagaggaaggggaaugaaaagauuuuagcacagugccuagaacuuagcauugagaaaauauucauuaaauguguucuuuuauugacuugguuuuaguuacagauucuagacccauaucccuguaguuacauauaauauuuuggccauuuuauuguguagauuuuauguacauucuugccacuuuuaucagagaaaugacaagaaaggaaacaaguaaguuauuguagucaaucagaaagacuaaaacaauuuauagaugauaauuaaaauuuuaauauuuauuuuuaacauaagaaccucccgaagugcuaggauuacaggugugagccgccucacccagcgaguaauuaaaaauuuacucuccuuguucguuuuucuugcagaauugucauucacauuuaaaguuugaaauucugaagacagaaaaagcaaauuaaaauuuaaaaauagccaguggugaaagguaaauaguucauuggugcauggcagagccuucugcuuguuauauauaguaggguacuucuaaggaagguguuucucuugcagaguuacuuguugcaguuagguuuuguuuugggcauaaugccaaguauuuauucuuccuauguguaauauaguaggguauuuuuguguuuaaacaacaguuuuuauuguaaucuuacaucuuauuggauauuaaccucuuugauagcaaacaagccauucuuaccuguugugcacaugcugcucuagcaggcugggagucuucaccacaacacuagcuacauaauagaacauugcuuccugaggucugggaacacuguuuuuuucuucucuccuguggaauaaaugcuuuauauuuaauuuaauuuaauuuuuucagacagagucuugcucugucgccgaggcuggagugcaguggcaugaucuuggcucauugcaaccucugccucccggguucaagcaauuuuccugccccagccuccugaguagcugggacuacaugagugcgccacuguggccagcuaauuuuugaauuuuugguagcgauggggauucaccauguuggccaggcuggucucgaacuccugaccucaggugaucugcccuccuuggccucccaaagugcugggauuacagacaugagccaccguggccggccagaauaaauguuuaaaauuaaucauuuugucaguuacuuucaauauuuuacaaauugcuaacauauaucacauaaaugggacagaauaauuuaguacuaauuagauuugcaagguaugcuccagaucaccugcacugcccuccuccagccaauguuugcauguuugugugaaugaauguguauauaauauuuaauauauagauauauauuauaggaugaacauaaaacauauuuauauguuaugugcaauauguauuuguuaaauauauuuguguacacuuauucccaugguauaagccccauuuccaggggauggcucaugaugacccagagagugcagcucaguucuaaacuuuuuuaggaggaugaaaagaaauagucuuuuguucuccucuacaggaagcuaauauuuugcuccuacuguccaaacucuggaauaguaguauaacaguggcaaagaaugggaaaaugaaaaccgaccguaugaagcuguuuuuggaagauacucuaaaugggaacaaucuucuaagcucagcuggcuuuuuagucggugaagccaucuguuugguuuuucagccagcacucuuuucauucucccugauuuuuauagcuucccuugggaaaccacaagauuccaaaucacuccagcaaugcagagccuuuugaagaguuguguguggcuuagugguuugucagucuucuguuguguaacuucaaaugguuuuuacuucugcuaugcaaaucaugguuuuaggaauauuuggaaagagaagagucugaggagaguagaaagaugguaauuuuuuucuuauauaaauauuuauuuuucagauacacuaauaauaaaauauuauuguucuuucauagagguuaacuuacucauguuucauuuaugaggaaugcauagaccuguuacucaaagcaacauuguauuauauuuguuguucugucuguaguuucuaacauuauuagacaaaguucagugauguuaaagauuguaaacauuccuuaaagcagggguccccaaccccugagccacagaucuccugcuguguggcccaguuccuaacaggccacagacugcuugugguuagguuccaguggccuguuaggaacugggcugcaccauaggaggugagcuagcaagggcagcagguacagcugcuccccaucgcuggcauuacugccugagcuccaccuccugucagaucagcggugguauuagauucucauagagugugaacccuguugugaacugcacaugggagggaucuagguugcaugcuccucaugagaaucuaaugccugaugaucugucacugucucccauccccccgugagggcauggccuaguugcaggaaaacaagcucagggccgccacugauucuacauuauggugaguugugugauuauuucauuauauauuacaguguaauaauaauagaaauaaaguccacaauaaauguaacaugcuuaaaucauccccaaaccaccccacaccagauuugucagucccuggugccagaaagaauggggaccacugccuuaaagcaugcugggauuaugauuggauguagaguuggguguugauguuaaagguacuuauacuuuguuacagugguuaugguuacuuagagcuaucacauaguuacuuuagaauggauauuuuaaaauugaagaauaggcagcagucuguuucuaauuaaugauaggguuccuuguuuuaaaaguuaaacacuuugguaaggauacauuugaagauuaucacguggguggucagcaagugauuccgucccucucuuggcauuuauauauguuauuuauauugaauuacucuuggcagaggaaauaacugaaagucuaaguaaaaaacguuggcuuuauccuguggguagaaaccacuuuuuauuuuuacuuuuaccccaugugcuuuaaauccaauaaccaaccuaccuaccuaccuaccuuccuuccuuccuuccuuccuuccuuccuuccuuccuuccuuccuuccuuccuucuuuccuuccuucccuccuucccuccuucccuccuucucucucucucuuucuuuccuucuuuucuuucuuucuucuuucaacagggucccacucugucacccaggcuggagugcaguggugcaguauuggcuauugcaaccucuacuucccaggcucaagugauccuccugccucagccucccugguggcugggacuacaggcaugugccaucaugaccagcuaauuuuuguauuuuuuguagagagggaguuuugccauguugcccaggcuggucuugauuacaggugugagccacugugccuagcugagacaaucauuccugacuuucauguuauuagagcuucaaaaugugaacaauuauugcccgcuguugucacuaccuuggagaacaagaugaguauagcuuuuaaaaucuuugcgggaauugugucaacuuucauuuaauccaccucuauaaaaauaagaucuauaugcuaaaggauuaauaacagugcaaauugcuacuugaauauuaaaaauuuaaaaucauccacaaggcagagauauucuugaaagucauuacagcucuaagaugucauaauuuuauugaaagugggaaaaaaaacguagccaccauuuaaauauguaaguugucauuuuuguuacauuucacuagcauuguauuugaaccgaauauucauuuuuuacagcacguaaguauccauauaucauaagacauguaacuaccauauuccuuucccagaacuuuauuucauuaucauuuucauuuaauuuaggauaauguacccuugauucuaaaauauaugcucucugauaaagucuaauauacagcaucuauaagaaacuuaaauuuacaagaaaaaaacguaucauucuuuuuggcugcucuacauugggugagcuuuguguaauauuuguucuuuacuuaauaaugcaaccucaaaauauucacccuguuuagacugauucccucaugcuugagagaggaaggcaucucuuccuuuuuuuuuuuuuuggagaaagucuugccgugucauccagguuggagugcaguggcacaaucucagcucacugcaaccucugccucuuggguucaagcgauucuugugccucagccucccaagccaccaugcccagcuaauuuuuguauuuguggcagagauaggguuucaccacauuggcugggcuggucucaaacuccugaccucaagugaucugccggccucagccucccagaguucugggauuacggguguugggcuuuuuuucauauguuuauucacugcauguaugucuuuuggaaaaugucuguuuacauuugcccacuuuuaaugggguuguucuuuucuuguaaauuuguuucuuauagaugcuguauauuagacuuuaucagagagcauauauuuuagaaucaagugugcauuauccuaaauuaaaugaaaacaaauuaucagaacauaugauagaauaaugaagcauaacaacuaaaaaaaaccauauuacauuucagggccaaugaucuaauuuugcuuuuccucugacuguuaccaggagggcagggcaugcaugcagccaugugaacugagagugagagggaaauggaugagaugcuuaaugucagaucuaugccacugcccucaugcuugacguuguggcagccaagccagagauggccaugcgcuccuuaccacggucauucucagcugaaucuacaucacauucacccggaagccugggaguaaucuguaccuaggagucuguagggcaugaccagccugcagaugugagcaaguguguguguauguuucugugucugugucucucucucucuuguguguguguauaugugucuguguuuguauccuguggugccucacagugucuuagaaauauuugaauuacauuaauugccaguguuugaguaucacaagauuucacauaaccauauggauuuacauguugucuugaaaacuucagaugauuugaaacucuuuuaaaaagggcucuuuuaaaaaggguuccaauauaaauugguagagcaguuauugguagagcguauacuuucaucuuuguuauaauggguuugaccgcauuguguuugggugaaguagcagagcaauaacuuuaagauaaaacugguuucuuguaauuuauuaaacuuacccauguauuuggcucccuuuucccuuuuauuuuauuaugucuguuuuagccuuaucuauuucuuucucauguucuagcccucaaaguguguguguguguguguguguguguguguguguguguguuuaauccuccaagcuagaagucacucaagcuuccuggaaucuagguuguaagguacugaggccaauggcugccucuuugucuuuuuucuauuuuuucuauuuuuuuuuuuuuaauuuuguguuuuguuucuuuccaguacuguguugacgaggaagauggcagccucuuugauaugagauagggcucaucugcauguuacguguaguggcaugucacugcugccacugcucuucugcuaccaggauggcuugaaugcaauauaggcuguuccaugugugcuuucccuccguuaugaaacuucuuccugugggguuugugagcuaacugcaagucuuucuuuguuuuagggcuguggauucuguaauuauuacaauuguguacuuccuuaaauuaaggcuuucacguaguagugaucugccuuuccuuugacaguuuuaccuugauguuuuauauaaugaagcaaaacucaaggaauauagaaggaagcauagggggaguaaaggauagucuuaaaugcugagcagugguuaccucugugaucaaauuuauuauuauuauuuuuugagacggcuuuacucugucaccucggcugagugcaguggcaugaucacggccccuuguagccccaaccuccugguuucaaaugacccucccaccuuagccuccugaguagcuacgacuacagccaugugccaccuugcccgcauaauuuuuuuuaaguuuuuuguagagacgaggucuugccaugguucccuggcugucuggaacuccuggagucaagcaauccuccugccucagccucccaaaguuuugggauuguaaaggauuugugagguacugagccuggccucugauugaauuuuaacugauuuuuauucuuuuuuuucuuaccucuguuauucaaguuggaaacaauugaaugugauuuccuguuaacuacaaaaauauuuauagucauuuuuagagcauagauguuaaguaguuaauuuauuuucuguaaagauuuguaagucuuuugaagucauuaucauuugaggaaaauuauuuuacaaacuucgcauuucucuuuggauaaaacaccacuuuaaaauugcacaaauaagggccagguguaguggcucuugccuguaauccuggcacuucaggacgccuaguggggaggaucgccugagcccaggaguucuagaucagccuggguaacguuagcugagcaugguggcgugugccucugguccuggcuacuugggaggcugaggugggaagauugcuugagcccaggaggucaaaacugcagugagccauaauugccccacugcacuccagucugggcgacauagggaaaucuugucucaaaaaaaaaaaaaaagguugcacaaauaauuaucugccccaguggaaacacuuuagucugcugcuauagaauacuuuacugcauuguguagaagugggaauggaaggccuucugugucagaacaacugaaauguuugucaagaaugcagauuucugggccucacuugaauaaucauuaagccagaaucuuuuuuuacaggguccccagauguuucucaugcuugcuaaauucugagauucacuuugcuaugccuugcugccaggagaucagugucaaacuccagacagacuuuuaccuggauccuugcuaauuuucagucaugucgggccuauuuaaauguaaaaaugucauaauguauuccuucugguuagcuuaaauuuauauaucuuaaauggguuacauuagcuucauaauuuaaaagauagauuuugucgaauuauguguuggguuaggaaauccucuuaaaugaaauuaaauuaucugcaagcagagggugcuguugaauuggcaucugaauuuauuaucuuuauugauugaacauccuugcauuugaacuuaugccagauucagaaggccuaggcagugcaggaagugcuuaauauuacagugguaguuuauccuuuaauugucuggaagcugggguguuaaacucuguucuccaaauugcuuuucauuugcaggauuucaugcacaucaguucuggaauggcacuuccuuuuaauaguuugaguacauuguucaaaagagcugcagcaugucuuuuggugacucauuagauuuuggcucacaucuuuuugcuuucaucaccuaaauuaggguaugaucaaauacaugaaaacugcuguguauuuuggcacucauuuucauugugaaaguuaaauauauagguuacuuagggauaaaaauuuaacuugaauauucuuucuguaaauguccucuaaaauccaccagcaacacacuuuuugucaagguagagguuuuuuuuuuuuuuuuuuuuuugccucugugcaacaggggaaacagcacagcauagggaaccauugaucuuaggaagagcuuguuaguagauuucggcuugcuuagguauuguuaggggaaggguucaaagaagagugguuuugguuuggauuggaugcuggcagaaugugggggcaauuguaugaucugguaucuucauuuuagcuauacaacaaggggacuggagcaagcuaaaaguguaauuagcaaaaacaugggaguuacucaaauuagcuggaacuagagguguuggguuauuccugugguuuguauaguguucuuauuuuugcauguguuucaaugauuaugcagugaucuuguuuuugucuugcucuacauugugaucauccagggaccuuaugugaucuccuucucacucucuuucuugcucuacacagccacagacauaccuuccaccucuuacucacugcacgaacccguggacccgcacacauacucacgaaaaugcucacaugcucauaaaaaugcuuacacacaaggaagcuuguuuucucucucauuuuuuccuuguuagucaauugaucuuagguaaacaauaauauaacaugaauauaauuuaucuuuuuucuguuaccaccaguuucauccuuccuuugaaacaauuaacuaaaccaauuuuaccugucacccugguugugaaaauguauauauaaauauuauuuuggguagcauaaauucagagcaauuuguggauuauaaagcauuuaguaguagcauugauguauuuuuuguugauauuuauuugccuaaauguuuguaucuugaacucaugauuagggagaaaguguuguaagcuuaaauuaauuaauuuugacaaaaucaucuuuuaaguaggaucuacuugagaaaauuaaagauggggcuacuaaauuuauaaucugagaauuuaucaaaauagauggaauuuacuacuuagagauaauauuugugugaauuuaacuauauuuuagauuuuaaauaucauuuaaaaccaggauuuuacuacauauagacaauaguaacugauugagcuuggcuuuuaaucuaagguacuuauuaauauuuuucaagauaguggaaauaaucuuaacauguuaaggucuugaaucuuaugcaaaauguguuuuuaauguuugcuuaaacuuuuccuggucauggaagggacugggcugucuguacuuaauuccauagaaaucagaagcagcacaguuggaacucacagauuuuaugauauuuuauuugguccagaugucuuuucuauugguauuuuauggcaaaauuuauaccauucaaaugagaauucaguugugguaaaugaauguaaauuugcaugaauuccuugguaugaaaaauugaaugaguuauguccagucacuucauuugucauuagaugagaaugauccuaugguauugcuuguguaaucaaggggguuaguggaucauauggauuggagaugaaguaguugcaauugauacuauacauggagagauuuugacaaucuauauuuaaagaaauuaugcuuacugcauuuucugacuucgaaaguaagauauguaaagugggguucugcuaauauaucaauaccauauuuuaauuuuauuuuuuauuaauuauauagagauguaccugacacaccuccgugacauuuuucuuuacuuuuuguuccuaccuauuauugaucuccucuucacaucgcaguaauuuuguaauauuucugaagagaauauggcaaggugauucaguuuuugauuuauuuaacauauuuuuggagagcauuacuuauaguuuuaaaacauuucuuuuauugucacaacuugguauuuguaugccaugcagauuuuuaggauuguuauccacauuuaggguaaaucucuaccaaguuucugugauaugugaguuguaauauuuugagacuuuucaagguguuuguuuaugugcguguguuuauguugucugugugcauacacagugaauaauauuugaauauauugaauauacucugaguuuauaaucaguaugucacucauguucuuucuauaguucauuaugaauuuucuuuuacauuuuuuaaugccauuuuauguucaaucagcagaaaacuugucuuuuucacucuuuaauugaauuauuaaauaauucuaaaacauuauuuuuuguuuccuuuuuucuuuuguuuuugccuuuuuauuauuuauaaauuaaaauuuaucucuaaacucaaaauaaaugcaucucacuucauuugcuucuuggccagaucccaaauauuccagcagcuccucugaucccaacuggucuaagucauagugaagggaaggauuauuauggaagaggucaggggguguuuaacagaaucaaaugaaaaugucguacuuuuguaaauuaacaaaaacaaauauagccaugugaauacauuucuagguccuucccaguguaaucucugggagguguuuacauucacuugcgccaaauuucucugaagaaugucaccuuagaguuucuacaaccguacuucuguucugauuuuuuguacucuaaauagcucuagaugugaaagcuauuuuuuucuaauuuuauugguaaagaauggaaauuuuucaauacauuuauuuacaugagaaacugaacauuucucaucuuuaguagucauuuuauguuuuuaaaauucuuuccuuuuuguccuuuauauuucauuuuccuguuagcauuaaugcuuucuuaaugccuauaagaagagcuguuuguuuagauaagguuaaucauaacuaccagucuucuuucuuauugucuuuauucagcauuuuguuuuaugcucagaaaggcuuuguauauuacaauguuauagucauggucauuuagauuuuuaaaaauuuuauaauuuuuuuguaaacccaucuaguauuguuuucauuguaugguaugaggccgagaccaacuuaguuuuccucuagguccuugaauuucaaauuguuuacuugaaauuguuucaaauaaccugaauccaguuuaucccuaaucuauuugucauuuucuaauauggcugugcuuuagaaucaucuagggaguuuuuaaucaguauuggggcccauccugguguaagucagaaucuuggguguguggcuuguuccuugauauuuuuuuuuuaccagcuuguuaggagauuauaauguguaugaaaacugagaaccauugcuguacacuuuuauaaccauuugcauuuuugucuggguuuucauuucuuuuuuauugguuugucagucucguauaugucccuuauucaaaacagauauacuucuccuuauucuucuaaguguaauuugauuuccuguuuuuuucuaggugagaugcugcagugugugucacuuuauucacuugaaucagaauucagcuuuguauauugaaucccaauuuuuaugguuacaucugaagagauaaucaccuauuugauauuaacuguagaaucagucuuugaaauuuauaaucugaagcauuacuaacugcauuaaagaacauuaacuguuuugugacuuacacaguuauuucuuauuaauaugaauaaauuugcaaaacuacuugaaucauccugccauuccuuugguggcauuuguuaguuucaaauaacucuuaagcagaaaugcaguaccuuuucuuauaguagauauuuaucugaacaguaggauuucguucuaaauauacguacuuauaaaagugaccuuguagaaaggcaaauaguauugacauggugaugauaugacacuuuccucauuuuuuuuuuuuuuuuagugugcuguuugcauuuuuuuuuuuuuaauugaucauucuuggguguuucucgcagagggggauuuggcagggucauaggacaauaguggagggaaggucaguagauaaacaagugaacaaaggucucugguuuuccuaugcagaggacccugcggccuuccgcaguguuugugucccuggguacuugagauuagggaguggugaugacucuuaacgagcaugcugccuucaagcaucuuuuuaacaaagcacaucuugcaccgcccuuaauccauuuaacccugaguggacacagcacauguuucagagagcaccggguuggggguaaggucauagaucaacaggaucccaaggcagaagaauuuuucuuaguacagaacaaaauggagucuccuaugucuacuucuuucuacacagaugcagcaacaaucugauuucucuaucuuuuccccacauuucccccuucucuauucgacgaaaccgccaucgucaucauggcccguucucauugagcuguuggguacaccucccagacgggguggcggccgggcagaggggcuccucacuucccagaaggggcggcugggcagaggcgccccccaucucccggacggggcggcuggccggguggagacgcuccucacuucccagacggggcggcugcugggcggaggggcuccucacuucuuagacgggguggcugccgggcggaggggcuccucacuucucagacggggcggccgggcagagacgcuccucaccucccagacgggguugcggccgggcagaggcgcuccucacaucccagaugauggguggccgggcagagacgcuccucauuuccuagacgggauggcggccgggaagaggcgcuccucacuucccagacugggcagaggggcuccucacaucccagacgaugaguggccaggcagagacguuccucacuucccagacgggguggcggcugggcagaggcuguaaucucggcacuuugggaggccaaggcaggcggcugggagguggagguuguagcgagccaagaucacgccacugcccuccagccugggcaccauugagcacugagugaacgagacuccaucugcaaucccggcaccucgggaggccgaggcuggcagaucacucgcgguuaggagcuggagaccagcccggccaacacagcgaaaccccgucuccaccaaaaaaaauacgaaaaccagucaggcguggcggcgcgcgccugcaaucgcaggcacucagcaggcugaggcaggagaaucaggcagggagguugcagugagcggagauggcagcaguacaguccagcuucggcucggcaucagagggagaccguggagggagagggagaccguggggagagggagagggaccauuuuuuuuguuaaugaagccaaagaaucagagauaaauugauguucuuucuggauuuuugagaucccugcauuaauugauuuaaggcucaaguauaacuagcuuauuuagcccaaggagucacauuucuucauaguuaacuuuugaaacuucucuggccacccauguggcugguuuuuuuuuuuuuuuugguggaguaucuuuucuuguuuuuuuuuuuccucaagcuuuauugagauauaguggacaaauaaaaaugguauguauuuacagcauacaaugugauguuuugagaugcauaaauauuuugaaaugauuagcaaauuuuauuauagaagguugucuugaaccuuaaauucuccuuuccagagguuuuauugaugugaacuauucuuucuauaguucauuaugauuuuucccuuguguuuguuaauguuggcauuuuaaauaaucaugguaaguagaaaucuauguuuagaaugaagaaaauuacacugaucuaggcuuuuuuguuuuugguuuuauuuuucccugucuuugagagugcagccucuagguaugggguaaauucauccauacagauuuuagaguguugauagauuugaggggaaguauuuaugugaaaaccuguacuggacaguuguuaauauggaucccuacuaaauucaaagcaaauuuaagcugccucauugucccuuagcaauuagaugaucaucaaaugcugguuuaagugagauuaucucuguauucuguuuauuaauacugauuaaacucaaaacuagcucuucuagcuagccaauguucccuccugauaacguuuauuguagcugcuuauuaucauuuacauaaaaguugaaguuuucagggagagaaagcauacuuuuuuaugguuaacuaacuaauaaauaccuuuaaggaggugcauaugccuuuucaugguucauccgguucaguaucuuuucuuugacugcucuaccaaaaagcuguggcugaguuaaaaucucagauccuuaguagucaugccaugaaccuuuccuuaaauguuucagauaacagaaaauacuugaauuuuggggggaggaggaauagcuuuacaguacuuauucuuugccaucucugaagggaggcauucauuuauucauucuuuaacauuuuuaaauuuuauuuuauuaauuuuuuuuuaacuugacaauaauuguacauauucauuggguacauagugauguuuuaauacauacaauuuauagugaucagucaggguaauucacauacccaucaucucaaacacuuaucauuucuugguguugggaacauucaaugucuucuuucuuagcuauuugaaauuauauauuucuauuaacuauagucauccuacagugguauggaacacuagaacuuauugcuucuaucuagcuguaacuuuguauccuuuaacacaucucucccuguccuuauaugcuuuugaguuauaaauuaaaaccugauaauaaacucugucuucuggacucugaagcccaguaucaguuucuucuagucaugaucugauuacauucuggugcccuuauggagacugauacaucccaugagauuaugggcaccacuaguugcauuuuguuuuuuguugggagucggcuuucuaugaaaaagaggaaugucuugggaacaggaguuaagaguguguauuuauggugggggcuauugaguaucucuuguaaccagaacugaccauuuaagccgaguguuaaacucugugcaaucuacagauaauuauaacaggacaauuacccaugguauacaguuuagacauaacuuugggaaaacacuuaacuguauugagaauuugacugucauuguccuauuucaugcauuuaaucauguagcauagagaugcccaaauucauuuauaauuaaaagagaaaaauuuguaugauuuacuucacuuaguacuuuguaugugaauuggguaugaagucaugaaaacaauagcaauauuauuuaaaugacacguuauaaauauaugauuaugauaauugaucuuuugucauuuuaaguuuuaaauuuuuuuuucucuuuaugccuuuaauauugggguauggcagugugauuuuugaaaauugacccugcuguuacuuagcucauauuuaaaaaauauaauaaccagaguuuauaaggcugaacuuaaaugggcuuaaaaaauacauuguugaugauacuguaaacugauuuaaucuuuaugaaaggaaauuugaggaaaaugugugaaaaauuacaaaaugcacccccuacaaccugacauuuuauuucugaaaaguugaucuaaggauuuagaaauaguuauugguauauguaaagauguuuaacauagaguuauuuaaaacagcaaagcaaagcaaccugaugguacgccuauguccaagaguaaaggguuagauaaauaaaucaaucgugguacaguuuuauaggaaaagaguaugaaaccauucaguaauguuguuaggccaauacuuacugauaugggaaauuguucacaguguguauguguguauauauauauauauauauaauaauaauuauuauuauauguuuuuuugagauggagucucacuuuguugcccaggcuggagugcaguggcacgaucucggcucacugcaaccucugccuccuggguucaaguuauucuccugccucaggcucccaaguagcugggauuacaggcacccacaaccacgccuggcugauuuuuguguuuuuaguagagacgggguuucacuauguuggccaggcugaucucaaacuccugaccucaguugauucaccugccuuggccucccaaacugaugggauuacaggugugagccacugugcccggccccagaguauguuuuaaaagaaagaucaugugcaguauuuguuccagugacauaagugcucuuagaaagaugaacguaagauaaauagguuaaaugugguucucuauaagugguuguuauuuucuuuaugauaguccuuguuacucaacauuuguacagugagcacgguuugcagucgggggagggagaucuaauauuuuuaaagauuuuacuucuuuaaaugacugguacuugcauuuuuaugugaugucauuuuaaaaaugguuuaaggcagcagaaugaauaugauaaaauguaaugcauuaucugagccauuuucaugauuaauugauacuuuacuauuuuagauguuagaaaauuccuugccaacguuucucuguaaaauagcuggaguaggcaguagaucuuuuuuguucauuuuagcuuauuuuaugaauggauauuuauuaugaaaagcaucagacaucucccuuucacucaaacaagacagccugaguguucucacuugaaauauagaguggucuguguauuuaaucaccagcuuauucagcaguuuugauucucauggaguaaaggcuuucccgccuuuauuuuuugaagaugaaauugagagauuuaaacauaauuuauucugcuuugaccuaugguuugaauuaacuuggcuguuugcauuuauuuucaaaagaaacauuuaauacuugcaaugcaauaaucugaucaaucucuuugucuuucaaauugcucuggaggcuguucuaagcugccuagacuauaaagcuuucuuuuauuagaauaugaaauauaaaauugauuuugauagcucauuuugaaaauaauguguauuuaagggaguaauauuuuguuucaaauaaaagucucaguguaccauguuauacaaauauuuuaccaauucauguggaccuuuucuugcugauccucagauaugauuugugaccuuugagagaacggaggauuuuuaaaaacgucaacuauagaauuaguuaugaguaauagugaauacacugauuuuccuaauaugccaccauaucaucccuauuuucuucucccaaacuugaaugguauucucugcuuccugcugccucaucaucauuacauauucacuucuugacccuuggaaaucugguuccucuuccaaccauuuagcugaauuugcucuccaaagucaccacauaccuaguuuuuauauuaaagucuucaucuugaauuuaccuuuucagccucucugagguuucagaaguagcugucgggggucagcaaaccuugcgcauaggacuucuuugcuuucucuuccuucacugcauucauggauacuucaccucauucuaugcucacaucaaaccagucaggcaguauacauucucaggugaauugucuccuccaugucuucugucccuucguacacagauacauaggauucugauccuauauaucuuucagugucuaguucaaacagcagggcugccuuucccaugcaauaugacuuucuccucuuuucuccugagacucuuggaaugucugcuuaguacucggucacgucaaugucuucauaguauguuuguuuuuauguuccuggaagaguggggcuaugguauaauuaauuaugucuguauuuucguagaacucugcacaauuccugcacccaucagcucauaauuguuuguuauauugaauaaaaugaaggauuuuauugacaaugaacuauucugguagcuacucuugacaagucucagacaugaucuuuuuauuugucuguucacgauguguuagccuggggaccaaggagaggccuuauugaucuaucuauaaaauuauaugaaaaauucuuauauauguuaauaaugugcagguuucuggaguuuggauucauagcuuugaggaaauugugaaaggcagcuuuuacaaggcuaagauauucuaauuuaaaugauuuagcauucuauguaacuucuuaaaaguaccuagcccaacaauggagagugaaagccaguaacuauugucaggucaguugagaaucucugaaugggcagacuucauguacccacucccuauuucauggguuuuaguauuuggcaaauucagaaaauucuuguuuaguuccauuuaggguuaaguaauuugaccaggaacagaauauugcaaauugggaauuaaaggccagaauccgauacuaauuauuuugcuucagucucuaguacugcaggaggcaucagggacuuucuguuggaagagugggaacucuuuauuaguuugcuaacgugaacaaugauguacuaaaggaauuuuguggcuagaccccucuuccuccccuucaggaacaggugcaucuccugggagcauaaaagguccauugcugguuacuggauggugaaagccuuugggcuuccagacuagagccaagaucugaaugccucucuauauuuuagcagaaauucuucuacuguggggugguaggaguggacagaguuuuaauaguaucaguuuuuggucagugauaggagaaagagguaaucaguuccuuaggugggguaaggcacagagagaugaaaugcccaaugcacaguugugucaguagguuuugguuuuaccuuugaauagagacaaagcuguuugcuguuuuguuucuuguccuugguucacccuuuguuuuucaugcagugcaguggaccaugacucaggcccugcagagcugaguauagaggccccuuuuccaagagcagagaaggaugccuuugaucuggauucacauaaucauucagcccucuuauuguguugccugcauauuugcauggaaucugugccgcagcuuuaucgaaguaugacucuagaaaaggaaaacgugaccagccucugauuaauggcaugauggcuuuuaacguuuggcgcuugaaauuuuuucagcuuuucccuuucuucuuauguaaaauaguuauaaucuuuuggcuccuugccacauuugccuuaugagcaguaccaagucaguuaacucaguuguggagaaaaauacacacucuguaucaaagugucucagaauuugauguauuaacuuuaauuuccagagcaagucacuaaccgcagauggaacacagugacgcuuugucuaguacaaaauuguucucaaucuuuauaaugcuaguaaaagagcacaauacaaccaguugucuuuagcuaggguuggaaauacaacagaacugugccaccucugccucugccucauuuccagaguguguuuuaguuccuucagaaacugcagugugcacauguucucacuuauuuaugagaucuaaaaaucaaaagaauugaacucauggacaugguagaaggaugguuaccagaggcugaggaggguaguuggggguggugauggggagguggggaugguuaauggguacaaaaaaauagauuuaauaagaucuacuaguugauaccacaauguggugacuauagucgauaauaacuuaauuguacauuuaaaaaucuacuucaagaguguaauuggauuguuuguaacucaaaggauaaaugcuugaggggauggauacuccauuccccaugaugugcuuauuucacauugcaugcuuguaucaaaacaccuuauguacuccacaaauauacacaccuacuaaguacccauaaaaauuuaaaaaauuaaaaaaaauuguaaugugggugcggacgaaggcuaucuuguaauugguguuuguugcccacuaaaagggucaaaugucaccucaccuguuuuucugaaacuccauuucuaaguuggguuggcacacuauaccccccugccuguauuuguaaauaacauuauuuugggacacagccaugcucauuuguuuauguauuaucuaagguugcguuuguacuacaauggcugacuugagugguugugacaaaagaucauauaauacacagagccuaaaauauuuuuacagaaagauaucaccaaucccuucuuuaugaggucugaccaggcccagggaccucauguauuuagauguugucugugcagcuuaggugauuaaccagcuggcaugcuuuauguuuuuugguagcagaaucuuucuuuuaucaaggcauaguaggguauccauuucuuuggcuucagagcucagcuggagcgcuauaguuucugguagugucucugguacugaagccuucucugccauccucuggcuugguucuguuucugaaauagugucuuacuggucaggcaguguuaaguugcagucuuucucacaguugcagcucuuacauuugguuacgauggacaagggaccagcuggcuuugcugacccacuucauaguggggcugauuaauaugagccauuaucuucuguuugugauauuuuucaagcugcauuaucuagagguagaaaauaaugacucuggcauaagcuguuuuauuuguaaugccuugcaaacacaugugcaaauucucccuggcacacagcugcuuaggaagauuauguucugcauaaugcugccuguugucacuuuugauacuuauuuuuaucacaaguccuuuucuauguuucauuauaaauauugugcacuaacccuaccaucuauuuucuuuacaagaugacuaguugcaagaaggaaagcuguguccugccuuuuaugaggguuuuuggcauucgcuuuccauugaaacucucuuaugggacccuguucuuuccagggaaaagaaaccugccuuuuggccacuuuuagagcuuguuaauaccaccaugauauuagguaauuuuuuuuuuucugcaguaauagcagccacagugguaguggcagcgacauugucggagaauacugguaggucaccaccaccaccauaagagaucaaacguggaggcugcuguuucucuguguugugacugauauuuucuauugguugcacaauuguguuguuugugaaauggaaccaggagugggucuggguguucauguuauagcaggagccaugucaagccagggugguggggagggggugaaaacauggcaugcacucagcuccagaaucagagagcugggucugcauacuggcccucuugcuucuuggcuagaaacccuugugcaaacugccuaacccuccugaaccucauguucauggacaauaaaacacaauucgaguacauauauuuuuaauugaugaugguaauaauaaacaguguuaucgaaagccuguagaauccguguuugagggccauggagaaguuggguggugagacggugugaccuccaaguauauugcuucuccgagggagagaacaauuguagacauauaaacauuaguuauaacaacugaggguuugcuucagcaaaguagcuuuuuuuuuuuuuuaauaauugcuuguagauacucuuuuuauugcagggacagaaaguuuuucuccaaccagguguuuccaaaagugacucacaaugccgucuuucaccuguuaacucugcagucuugucaaacaauuaauaauaauacaauaguauuuuuacuagaaauuauuuaacuacugugacagcagcuaaggauaagaauuauaucacauugaggccggugcgguggcucacgcuuguaauaccagcacuuugggaggccaagaugaguggauuaucugagaccagaaguucgagaccagccugaccaacauggugaaacccugucucuacuaaaaauacaaaaaaauuagcugggcaugguggcaugcaccuguaaucucagcuacuugggaggcugaggcaggauaauugcuccaaccagggaggcagagguuguggugagccgagaucgcgccauugcauuccagccugggcaacagagcaagacucugucugaaaaaaaaaaaaucguaucacacugaguaaggaauauuuacuuuuucccccuaguaguuuggcuauaauguuaaaaauacauuaugccuuucuuuauaugauuuuuuuuuuuuuuugggacagggucucacucuguuacccaggcuagagugcaguggcauguucauggcucacugcaaccuccaucuccuuccaccuccgccucccaugugguugggaccacaggugcgcaccaccacacuggcuaauuuuuguguuuuucauagaugcaagcuggucucgaacuccugggcucaagcgauccaccugccuuggccucccgaaguguugggauuacaggcgugagccaccaugcccagccuauguguaauguuaugauaauauuauuagagcacagaugauagguucaauagaaggaaaucauaaaguuccuuuuaugccuccuuuuuaaagccuggagccuagaauaaaacauuuauaguccugcccaaguuuucucuuccuuuuucagagauauccaggaacccagugaacaaaugacuuagcuugauguagauuuacccccaaacacuacuuuuaaaagaaguaggugagaagaggagcacuagagagcccaguuuucuucaugguuuuaucgucuguuugaaauccccaugcuggucccaccauguagucccagauguuacuuuuuauuugaccauaguuagaggaguggaugucagaguccccucacucuugaaaguguuggucuguuucuuugccucccuguccuuuucuucagauacuagacugugguaccugucagaggcucuuggagaauaugccuugaagaaugauuucugaacuuuggucugccuauuguauuuuaaguguacucacucugucuugcuugucguuaucuuagcauagugccaccugauacacagaagcuacauauuuacucugagcaacugcaagagccagcugguagguuuuuacacugguaaaauuuacugaggaaguuuguaucuacugucauucuauagauuuguuucaauuuaagaguuuauauuauaguuaauaagacaacuucaagaagaguaugugaauuguaguauauagucauggcauguuaauucugugaaauuguagucuaguuaggcuacacgaauuaugacuacucauaaguuguuuacaccaaauaacaugacggauauauaugucuuccuuucaguuguaauaaaaggaaaugccugucaacuuaauuuaucaccaggcauguucuuauuuaaagccucuuaaaaugaaauaaaagccugaccuaagauuaugguuacuacgaaagugacaacagcugugguauaaaauacuguaggggccucugcugccauacuaacaacuguguagcccguaugaaaagcuguuacauccagugaaugcuuguagauacagaaacgauuaaaguaauccucccaagcagaagucugagaggccaucugauccaagucccugagagauuccuuaggggucaagaccuucccaaagucacaauggagaaaaagcuuggccaauauuccuuuccccauucccucucuacuccagggcagaacugcugcaguccugauauuuauuacagaugcauauacuguuucauuccacaaagacugugaagcaguugaaagaaggauaaauggaagcucuuuuaaaauguuuuuaauuuuuuuuuuuuuuuuuuaaauacagggucucugucacccaggcugaaguacaguggcauaaucauagcucacugcagccuggaccuccugggcucaagggauccucucuccucagucuccugaguagcuggaacuauaagcuugcaucaccacacucaucuaggggucacucucuuuguuucccaggauggucuaaaacuccugggcucaagcaguccuccuaccucggccuuccaaaaugcuggaauuacaggcaugagucacugugcguggccuauaaaaaggaagcucuuuaaagauugucauagaaaguaggaaaaaaggaaguucuuuaaagagugucguagggagaaagaugguuuaaagaugauuucacacugacacaaauuuucauguacauguguauccauuugucccauaucugaaugcccacccuuuguaggcaguaaacagucucuuucuccaaguugcuuagacccagugcagacauucucagcuucagcaauauugucauuuuuagcagcauccuggccuuuagaaaugccuucaggcauucucaaauauccccuaggaagcaaaaaucaccucaguugagaaccacuaggcuagugagcacuacagucuagugugggaaacggacaaccacacagaaaaaugacauccauacacgcauugugaaacaguagacuacuuaugagcgacaugggguucagugauggagaacagcaagagguggcuucuaggacacucucaaauucacuuucuuuuucuuaggcugacacuuaaacaccauguagugccucuugaauagccacacaaguuuguuuauauuaugucagcauugugaguuugcaaacauuugacaaaauuuauuuacuaaagguaauaucuaaaauuaguuguccuuuauuuuaaaaguuaaauauugcuauagccuaauagucaugaaauagaaaaggauggcuugauaauuauccagugguaauuauggaggacagucuugucaucauguuacuagaugugugcagcacuaaacgugggguggugaauagaagaaccauauuacauccagauggcuugcaugcauauauaguguuuuguguuuauguuacugccuuacuagaugcagguacugaaagguauccaccuacuuucugaacagagauagucgugguuguauaaacugucagaaaaugagugcauaaacuuucuguuuguaaagaagguaacauuguaacuauuucucaucagacagaauauaguauuuauacauagcauaauucauuaguaagguauaaauugucuuuuuaaauaucuaaugucuuaaauuaugacuuaacuaaauucaaaauuauuuaucauaguaauccuuguuaucaaaauucaaauaggugaguguaauauacaagguaagggucuguggcccugucaaacaaaaacaaaaauaaaaacauggugaccucuuugaugguauuuagcuuuauuacuuuucugucauccguucauugucaugauuauuuuuccauauuauugcaucuucucaauagaaauugccaucauuuuaaagcuuuuuucccuucuagcuuaugguguuuuaaggauguugugaaugcaguuucuguguacuacugaaugagugcauguauaaaucaaagacuguagggaaugccugcuggccuucacaaguucauuuauaaaucagcuacugggucgguuaugcuugguaacauuaacuucguuauguacuuaugucagagucgugaggaacccuagagucacagugggauacaagaggagcaccagggggcucuauuggcugugauuuugaagaaaaugaauuaaauugauugauugaaaaaagcaauaggagugaauuugauuaggcauguauguacacauuuaaauauaucuuguacuuuguaugcucaacagccuggaugaacacacagcauacauuauagcuuaagcucccuuccuguagcaguguuuaaucuagcuagcaguaauucaagaaaaaauuauauccaaaugcauuugaagaugaaauguagauaaguuauccagucuucuaguguucagaaacgcaaacugaccuuuggacagugaauccauuaauguucagaugaguuaaggauaauugcaauuuucagcuucugagauaaucacauaaucagaccguaugaagucaacacuuuaugguuucauuuuuaaacaaaguaugagcaaugaucuuuuuaaucaguaugauuuuauuaaaggaacaagaaauccuauaaauguuuucagcauuuacauuuucacauaguaaauuuuuuauagucaacaugauagauucuguaaaauaagauacauuucuuuguuccauuaguagagaaaaaaaaagacaucagcuguaaugacugucacaacccugacucagauuuauuucuucuuaauucagcaguucuucugggcauuuagauuauaauacuuaaaugcauuuagguaacaugaaaacuuuaaauuguguauuuauuuuuaaaaucucauguaauuacucaauuacuaaaaaaagaaaucaacaucaagaaucaaguacuaauguuuucuguaauucauuaugcaugugagaauuaucuagcuaaaauguuaaaucucagaccuauaaauauuuuacaagauacauauaagcuguuuauggacaugauauaguugguuuaaaauuaaaauuugagccaguaaugucuuguggaaucaggcuucuuggguuugaaucuuguguccaccaugaacuuuaugcaaauuacuuaaucuuucugugcauugguuuucucaucuguuauguggggauaauaauuaugccaaccucugaggauugaguuguuaaaugcaguguacuuagaauggugcucaguacuuaguaaacuguaaagugauuaaaaaagugauucuuagcaaguaguuuuuaguaagcaaauaaaaaaauacuagacaaaugcuuuuaguaguauuaauaauuguuggaaauauauucauggacacauuuuuuauucaguuauuaauucaugcaguaaauauuuauugaccacucugguugggaguugcagugaugcaggauaagcacaaucuuuguccucuuacaggaagcccagaggcugacauuaugaaauaaugauacaacuaauuaugaccaguaguaucgugccgcauauucauggcauugaguuguuugugguaggggagcugaccuagucuaugggcauuuaaggugaaauaugaagcauguuagcuagauaaauacaguuggugcaacaagguaacaauacagagaaagauucaggauguagcagagggguaacaguggagagacaggacaucugaguugauacugaugguuucauugcuguuuaaauuuaugagauccauuccuucucuugcaauguguccuguccugugucuuccgcacauucuuccagagaagcaucauuuuccugccucucagucuucuuagacuaccucaaggccccuaacagcuaccuauauguuuuucuacuugaugguguuuccgccacccugacaguucccucucacauuucauuuuuaauccuucuguuucuugcuaucacuuuuuuagcuauuccuagauuaacuauucagugcagaggaguauuugaauguuugaaaaaugguuagaaagcagcuucauuugcaagcuguuggagcuaauaauuuugacuguuagaaagcuaagaacauaacucugauguuaauauuuuacuauuauuauuauuuuucuguaaucuuugcuuucuuuauugucauuuuauuuuauuuauuucaguuauacuuuaaguucuaggcuacaugugcacaacgugcagguuuguuacacauguauacauaugccacguuggugugcugcacccauuaacucaucauuuacauuagguauaucuucuauugcuaucccuccccccuccccugaccccccaacaggcccaggugugugauauuccccauccuguguccaagcguucucauuguucaauucccaccuaugagugagaacaugcgggguuugguuuucuguccuugggauaguuugcugagaaugaugguuuccagcuucauccgugucgcuacaaaggacaugaacucauccuuuuuuuauggcugcauaguauuccauaguguauaugugccacauuuucuuaauccagucuaucauugauggacauuuggauugguuccaagucuuugcuauugugaauagugccacaguaaacauacaugugcaugugucuuuauagaguucaagaccagccugggcaacacggugaaaccccaucucuacuaaaaaauacaaaaaauuagccgggugugguggugggcgccuguagucccagcuacucgugaggcugaggcaggagaauggcgugaacccgggagguggagcuugcagugagccgagaucacgccacugcacuccagccugggggacagagugagacuccgucucaaaaaaaaaaaaaaaaaaaaccacagacugggcgcaguagcacaugccuguaaucccagcuacucgggaggcugaggcaggagaaucacuugagcccaggaggcggagguugcagugagccgagaucgcgccauugcacuccagccugggcuacagagugagacuucgucgggaaaaaaaaaaagcaaagugaacguaugccuagauuuuucuccuacauaaccuuuuuacacccauuuacauuuuuuauucuuaaacuucucuuucuugaaugcgaaaguuuagaaaaauggaaauuuccaggagggugcuuuauaauggcuuuguuucccauuacucuuucuugcauguuauuuauuuuuaaugagagaaaaauuauauguaggaaauaaaagagaaacguggcucuggcuguguaagcauaggaagccuugagcuuaacacaaggcaaauugcaaagaaaaaaaaagucuaaaaccacauaucaauuuuauguucucuaauacaugauauauauauauauauuuggauauauuagguauauuuaugacuaaauuauaaauuuauauauagagagauauauaugacuaaauuauauaaagugaggacaguagugcuaauugauauuaugugacauuuaucuccagaacacaaguuuguuaggguucuccagacuaacaauaccagcaggauauguguguguguauauaugugugucuguuuauggauaugucagcauacuuaauuauggaagcugagaaaccucaagacucugcagucaauaaguugaauacucagaacugaugauguacuuuucugucugagagcuggcauucuugagacccaagcaaaaccuguguuucagguguggucugaaggcagaagcaaacugauguuccaguucaugcagucagacaaacagguccuacuccagggagaggcagggucucauuccaaggcccuuucagcuuguuagauggagccuacccacuugagggagagacaucugcuuuacucacucuacugauucacaguaaucggauuauccaaguaucuagaaacacccuuacagaaacacucagaauaauaucuuacuacauuucuggguaccucauguuccagucaaauugacacauaaaauuaaccaucacaauaaguuugguuuaacauuuaaaagucuaucaguuucauacaccauguuaacagaauaaaggauaaaaagcauaugaccauuuuauuaaaugcagagaaagcagcaugcuuuuuuuauuaaaaacuuucagaguuaacuuugcauuuagauggaaguaagucugaaaaaccuaaagcaaauaccauacuaaauggugaaaauuuagacaccuuaagauuaagauuuggaacaaaguaagaauuuccacuccuaauacuuuuuuuuuuuagacggagucucgcucugucucccaggcuggagugcaguggcgggaucucggcucacugcaagcuccgccuuccagguucacgccauucuccugccucagccuccugaauagcugggaauacaggcgcccgccacugcgcccagcuaauuuuuuguauuuuuaguagagacgggguuucacuguggucuugaucuccugaccucgugauccgcccgccucugccucccaaagugcugggauuacaggcgugagccaccgcgccgggccucacucuuaauacuuuuauguaacauuuuacugaaggccacagccacugcaguaagccaaggcaugaagaucagaaacaaauaaguaaaaauaucucuguuuguagauaugauuguuuaugaagaauaaaucuguauguagaucuaguucuugguuuacgucuagaucuuccuuaauagaagaguuaauccacaucagauccauauuuauauaugguauuuaguuuuuugucaaaggcauccaaccauccaguagggaaaaaaagucuucauuauuuaggacaaaauaaaccuugaaccucaccauacacaacuacuaauucaagauuuaucuuagaccugacagagaaaauuaauauaggaagcuauuagaugaaaauauaggggacagagcuaucuuuauaacuugaggauaggcaaagacugcuuaaaucacagaaugcaauaaucauaaaaaaauugaugauuuagggucucguuaaaguuaaaaacugcugcucaccaaauauaucacuaaaaaauugaauuagcaagacccagaggaggauaaaacauuugcaaaacgugucugauaaggacugguaguugggacauacaaagaaccugaaaaacucaaucaugaagugacuaaagcaucucccugaaaaaugggccaaaaauuauacagacuccuggccgggcaugguggcucacaccuguaaucccagcacuuggggaggccaaggcaggcggaucacuugaggucaggaguucaagaccaaccuugccaacauggugaaaccucgucucuauuaaaaauacaaauauuagccgggcuugguggcaggcgccuguaaucccagcuacucggggggcugaagcaggaagaucacuugagcccaggaggcggagguugcagugagccaagauugugccgcugcacuccugccugggugacagagcaagcuuccacuaaaaaaaaaaaaaaaaaaaauuguacagacucuugagaaaggaagauaugcaagauuaaaacguucacagaaagacuugcacaugaauguacaguuguuccuaguaagucugggugcaaaaggaacuaggcugugaaauuguuggaaggacuggaggagugaaacgggcuuguagggaagaugcuguuaucuggagaucaugacaggcagggggcucaccugcaccuguaugccuucuguugcaaucucuuuuuacuuucucugccuuauaaucucuguaaguuuucucaauaugagaaccauaccagagcccuauuauccucgaguucagaguucagaagauccgggaugauacacauuauuaguacuccauauccuggauucucauuauauugugaguuuuuagcaguacagauacugaugccaaaaagauaugaggcugugucuuuaccacuugcauauucuauggcuuuucauaaguaaaugguucuuugauuccaacauuaguaaaguagggauauuaauaguuucucaugggauacgaagauuaauugagacaauaucuauaaugacugaaugagaaaaugcuuuacauuuaucauuguaccugguacuuaguaugcacacaguaagugguagauguuugcuaucacuaucagcgugaauuuuuaaaaauuaugaucuauuaauuauguuuuaaaauuuuucaaaaguaagaacuaagauaggccuccuucaccuuaugaacuuagaaaacuaaacaugaaugaacaaugcccugggugcacucaugccuauaauccuagcauuuugggaggcugaagugggagauucacuugagaucaggauuuugagaccagccuggguaacauaguucagucccugucucuacaaaaguuauuuuuaauaaaugaagaaaugccaucaauuacuugccauugaggaaaggagaccaagauuaccauuuauguguaugcuggguaguucuuggugaagcaguuuuuuaugcagccucuguuguaggaacuuuguguucugcuuagucaggucuucucagagagaggacgucugcucucucugauguugcugugguuaaacaauaauuaaguuaaacuguuuccacauauuuuaugguuucauaaagaauguaaaagaaaaaguaguugaauucugcccuucugcguuauaaguuuacuuuguuggaacugcuagaauaauuccaaagugaggguucguugaaaauaggcuuccaaaaaccuuuguaguucaaugccaguuacuuaacauuaucuuuggaccuauguuauucauuuucagguacuucauaauuuuauaucucugugguuauuggaugucauauuuuugacauuuuauuaaaauuacuguuuggaucuauguauuaaagugagaugguauuuuauauugggcuuuuacaauaaucuguuuuaguuugaguguuuaaaauuuuuauauugguucugggauauuggaauauguaacuucuguuggguuaauuguguguguguguguuuugagacagagucuugcucugucacccaagcuggagugcaguggcaugauauuggcucacugcaaccuccaacuccugguucaaaugauucuugugccucggcuuucugaguaccugggaccacaggcacggaucaccacaccuggcuaauuuuuguauuuguagcagagaugggguuucaccauauuggccaggcuggucucgaacuccugaccucaagugaucugccugcgucugccucccaaagugcugggauuauaggcuugagccaccgugcucggccuggguuguuaauuacuauuuugauauuuauuucuuaaugcuauagagccagaauugcauuuuuauauguauaaacuuuucauauuaaggccuuuuuguauguucugauugacauuuaaaaucuuggcugguuuaaacagcaaucuaaaaaucaagccuccacauuaagaacauaggguuuuuuuuaucugcugauaggcuugauauuccaagcauauuaacugacuugaauuguuuugaacacauguaaaaauggaaauguaaacagucucuuuuggcagauccuuauauauacuguuccauuacugauugucuuauucguuuaacuuuuacauccgugccuggaucacaucacaugacugucuuaccugauaacgcauuccaucccaugcugacuaucaaaucauuuuuucauaugucaaauacaaauuguuacgcucugguuucaaccguagaugcauuuccagucuggaggaccguuuuuauuuaaaauuuuuuuucuauguucagaggugauuuuaacauuucuuuugaguguuauauacuuagagauuaauauuaagugcaucgauucugccuaagcugguccuauggguaaacauucucuggaugcaggacuaccuacuugacauuucuugucauacuuucugcucuguugauuucuuucucaggcaguuguuucccauguuguggcagagaugacuguuagcuucuguaggauaacaagcuaccgacacauucccacuguaccucauugguguugcuugggccaugugcccaucucugaaccaaucacuguugccauugggguggaauguuuggccagucuagcuucccuaaauuacaugccugaguuugggggacaaucaaggugcucuuuuuagucagaaagcauccuaacgaagagaaaucuuaggaacaaaucaugcggugcaauuuugucauuuaauucagccacaucaguuccaguaaaauuuuuuaaaaagauuaaauaaugaguaaugguuucuuaugaauaaaauagcccuguuaaguuucccaaaacuuaaccagugaugaacauugaaaacuuuuuauacuucugcccucccucuuguaguuuacuuacuuaugaaccuuggucacuguaauuguaccuguugggacacauuaggcaccaaaauauuuguagagugaaugcuucauagcugguuacuguggacauauugcuguagcacaaguauuaaauuugaaccaaagauggauguaauuuaauauuugauuaaagugcuggacuuccuguuaguuuucuuuccaauauacauuucauagagaggggaaauuagagcuugugguggcauaggcuucaugauuuugcacugugaaggaaaggcuuguaauuuagucuugggccagagauuauauggaucaggugugauaacuuuguggcuaaaaugacuuagaauaguugagaagccauuuucaacuuauguccuguucuuggacaaagggaaggagaaaguaugagcagaauugguaugugauaauuguuuauugcuauuuaaaaaacaguauucccaccccccgccccuaacccccaccccggucucacccccaggguaccuccucuuaggaacaacucauggaauguaggaugaaccaaaaccgaaaugaugcacucauacacuaaccccaucauucccucggcucuaccgucuucucccuuuuaauuuggucuuucagaccccaugaggaaaggguuuugcauuuugauuuaauggauagcugcugcagcuuauauuuaugcacuggugaugacagcgcauuccuuuuuuuuaaaaagaaaagauuuaaaaaaauuuuugugccaguggauggauuguaauaggcagccacaucugaagaaauaagugaaacuauagccauguagugauuucuuauuacacauauagaugaguaaucuuugcugugauuauuauauaaguuauacaaauguggagcuuuuuuuuggcucuagaaauauggauggauaguuggaauuguuuuaaaguggucuuuacugcuuggcagaacauggggcugauuucagcugcauuuaugauuccuuuuuggauuuauuccaguuuggauuuaaauauauuaaaagugccugugaauaugaggaaauguagaucauuaaaacugcauuuauuauguagccuguuuuaaaauuuggacugaucaaugaaucucuguagaguaaaaauacaccugaucguaccaaaucacuuucuagauuuuaucagcggucugugccccucggguagucaaggaauucuuuuguccagagcuuguuaaugauucauuacaucaaugaugauucuacauuuuauuugaauuaaccaauuucuuaacaaguguaugcauaguuagaaaucuguauuguaguuuguagaugaaugucauuuccugggcaaagaaagcuccuuaauauuuaugacauguuucauauuaauuaaggcagacuucccccauguaguaaugcaauacuuuaagguuaucuaaucaaggguucuacacaaugaucagguaauuuaauuuuaaaauaacuuacauaaauagaaaugagggaaguuauugaauaauucaaauauggugagucaacauucgauuuuaauuuucauuuuugacuuguuucuaacauugcuggcauuacucuagugggcuagccaucauucaacuaauauuuauggagcauauacuauguaaugaugacagauauucagugguaaaacagaccugaugccugucuucaccgaguguagguuuuaguguugaaaacaacugagaacuaaaaaaauacacaaaauaugauuacacguggcaagugauuugaagggaaaauaacaauggguacgaaauaaaacaccuuugguuuaagauaaauauagaaagaucaagagagugagagaucaagagagagaccuugaucucuuacucacuccaucuauuuaggggggagccauuuccuauuuugugaaaauagggguguguguguguguguauauauauauacacacauauguauauaaauaucuguguaugugaaaauagaaaaagaaaacacacacacaccuauuuucucuaccuaaugguaaugcauuuccauaugauuauauuuucucccauaaaaucaguuuacaugguuauaccauaauuuuuuaaaggaguauuagaaaauuuuuuucuaauuuuaagauauuugguaaacacagaugagcugugcguuguuaaaauuaaguugguguauuaauucaaaauuaucugcuuaggaaaaugccaccaguuguggucauagguuauucauauuuuaaaagacuguuaaauauuuuaaacauucugguauguguugccaaauuguugccaugcuuuauucuuaccaugucacagacugguuuaaugcagcuuuguuuugcuauucaugaguuucauguuaggcagcuaaugguaacagucaugggaguuaguucugcguguuggauaccuguuggguuuaaacugauuuaaauccaguucuucucauuuugauuuauuagaauaauaaugaaucuucuuucaagaaauguuuccccauauucuuccugauugauuauguuuaaauuuggcuagagagaaauuguaagaacacugaaauccauuguguguuuuucuaucuucuguuugcuuuuuuucugauucgaguuuaauacaucugucuuuuguccacuuuaaaucauuucaugaaacuaauaacagagaaaauauaauaguggggccagacauagucucauacuugagagggaaggcagggauugcuagguaaagugaaucugagauggugaauuauuuacuuauaguacuacuguuuuuauggagaaguuuggcugaaaaaguauguuuugucauugaauugucaaacuuuuauuucaaaaacaugaguuguuuucauuuucuuauuuaguguuaaauuucugcugcugcuuuuuuucuccccagauauggggucuugcuguguugcccaggcugcucuugaacuucuggccucaagcaaucuuccugugucagccuuccaaagugcuaggauuacaggcgugagccccacugcacccagccccugaccauauuguuaacauuagaaaaucaaauagacuaaaagcauuacucucuuggucuaguuagcuuucuuuagguauuuucccacuuuagaaacaaugucaaagaguuuucacguggcaggagacauguaaucagaguacauggagugcagguuauuguuuucgacauggcugcuaaauaaaucaagguuucauuuuuuccagagacucacacucaaaauuaguaugacauauagcauuuaaaaauaugguaaccuagaauuuauuugaaaauuguuauuuuuguuucucucaagugagagcacccuugauauacuauuuagagcuucuauucugggaauuuuauuaugcaugcauagcuaguuuuaaaauuuuucuccuuauugauuuguuaaucaauccucaucccuucccuucuuuuaaaacauuauuuccucauuaauauuuaccuacauucauacugcuguuugacuugugcagaaaagauggaggaggacaggagaugcuguguuuaucucauauucagcagaaguagaaaaagguaaaugucuucaacaucgcucagaugguacuuacuguggccagcauugugaaaccugugagacagcuaguucuguauucagacccuucaauuacucauuauguuccuguguacucagugguuacgaaauugaaaaacccaaagaggcuggugggcaggauacugaaucucacaucacuuaaacccccuuuucccccaguuacuauccuugugacauccaacaagucaguuagcauuuuugugccucaguuucuuauccauaaauuaggauaugaugauucaaguggaugacuuacuuccuaagguucaggaugcguucuaauuguguuaacuucgucauugaaaaagaaauaccugaaagacucucuaacaaggaaaucaguauaccugaacauuuuaauaaaaacauuuuaggagaaggauuauauauaacguuauauucaacaauaugcauccaugcuauuucugucugcuuuuuugucuuucuuuugagacggagucuuacucugucguccaggcuggagugcaguugugcgaccgcggcucacugcaaccuacgccucuuggguucaagcaguucuccugccuguuucccgaguagcugagauuacaggcaugugccaccaugccugaguaauuuuuguauuuuuaguagagacggaguuucaccaugauggccaggcuggucucaaacuccugaccucaggugcucugcccgcuucggccucugaaagugcugggauuccaggcgugacccaccgcacccugccugucuguuuucauaugugaucauauagacucauacaaauauuuauguuuacaaggaauuuagaucucuaagagugugcagagcccuauuuuuaucugaucuuccucagauuuaucauccauauaaacugugacauggagugcaugaauucagaacaaaacaacuuuaucuacccccgaauacuaaagaguucaauuucaugcuguuuuacauggcacagcaggaguggauuguuuaauaucucuaacucugaacuuccacaaccuuucuaucagauauucagguaagugcugagaagcagaaauucuaaaaauaauuucuacugaaucuuuuggagaccccggagcaaacuauuugaauccauuccccuucuuuuugcauaguuuuucuuugucuauuugaacagugcucucaugggucagaaagauugaguuucuagucccauaccuuaaauugcuuuauaauugccuuacuuuauaagggagacauauccuggcacagugaagccugcaaauauuccagagaaauuaaucugaaccuauuagaagugggaggagggaaagaaacuuauuuuggaaaauuguuagcuaggcugguuaaacucuaucaacacagcaugauaucaugcauagaaagcaaauauaaugagucccggacauuuauuugcagcuacaauuucaguuugguuaugggucauagauaaagaagauugagauggaaaaauguggccauuuaaaugauaaagcauguuguauguauuaaaugugguuuuguuuuggaauuuccacaguagauuggguaagaguguagaagugcuagauuugaaucuagcaaagucucuguuacuuauuagguaugugaccuuggacuaauuaaugugaguccucugcgccugucucuguuucuucauauauuuuuuuaagguuauuuaacaaacauuuuuaagggacucuuauucucuaggcaccuagaauauacuucucuauaagacagacacuguguguagcucaugguuaaguauagagugguguaggaaggucagauggggcaaaguaucugagauaauucacuaaugguucauuaaaauuagaauaagaaauucagggccugugugguggcucacaccuguaaucccaccgcuuugggcgagguggguggaucacccgaggucaggaguuugagaccagcuuggcuaacauagcaaaaccccgucucuacuaaaaauacaaaaauuagccgagcgugguggcacaugccugugaucccagcuacucgggaggcugaggcaggagaaucgcuucaaccagggagggagagguugcagugagccgagauugcgccacuguacuccagccugggugacaaagugagaccuugucucaaaaauaaaauaaaaaaucaguuaggggauuauaccuuuuuuguuuuuuguuuuugagacuaacguaucugaacuugcacagaucuaugugauuaugagaguguagucugaggaguuagaauaaaauuaugugucaggccuaauuaaugauuuuggcccuguuaguuaccaccaccagacauauucuugguuaaauaagagguuacuuugaugcuaacacuuagcagugcuuuguuacuucuuacuauagaaauaaugagcaauuaugaauuaugaagucauaauacaaguuagaaauaacuguuaauaauagauucuuaauucuuacugucuucacuaacauuaggguuauuagaaaacaaugagauauagaaugucuuccauuuguccauaauauuauauauauaguacuauucagagggcaauuuguauuaauaacauauaaacuguuggguucuuaaagccauugaacauuuugcauuuuaaaguuuuauacacagucccauguuuuuauaccuuauauauugggggauguuaggcacuuucgcuuuguguuggauagaauauagaacagaugccuuuuucaugcuguaguucugaucuaaugugauuugauugugccucaaagauaauuagcugauagccuucaagagcaauaacauuuuugggaaaggagaggcuagaguuugauuuaaaaauuuaggguguuuaaaacuaacuuuugcuuuuuaaauuauccauucccauuucuuaaggaaauagcaauaaauauguuguuugauuuuuuuuuuggcauaagucauuuuuaucgguaaauacauuuuugguggcuacuguaaagggcaguauuuuagaucuaaaggauaagauaggacagcauaggucuagagauaugauaucuacucaggcaucaccagaagacaacaauuuguguuucauuugggcuuauuuguuuugagacuggauuaugagauuaauuuuuguauuuuugguagaaacgggguuuugacauguuucccaggcuggucuagaacuccugggaucaagccauccaccugccucggccucccaaaguucugggacuacagguuauagccaugugccucgugucauuuggacauauuuaaaucuucaaaauaagaguuugccaucggcuccucccuucuuuaugauuguccuguucaaaaaucuaauugaucuucuacauuggguucuuuucauaauuguuggaaaauuaguaauuuucuaugaaagacaguaauucuuuuuaaauuuuaaauauuauccucuuuagguuauaauaugauauguucgaaauucacuagaguuuuauuuuauguaagcaagaaaucaacuuuuucccaguauguucugaaaguuauucuucaauccugagauucaaguggauauuauuucaugucucccaaaaccacauacauguugccauguaauaccaagcucuuauguuaaaaggaggccuauuuuguuuuuuaaauacaguggagaaugaagaagucacauaagucgaaccccugccuccaucuuauuuuacuuuacagcauccuaccuuggacaccugggcaguauuaauucauguuauggacauuuccuuucauuaaugccugucaucugcugggccuccaguuucaguuguuugcucuagaugugaagccauggaguugagucugguugcaacauaugauccaaacaggagcuugauguacacugcugucaccucuccugugacaauggcccaguccucuaggguuuuuucaaucccccacaagucugggauugcuccuccuguuugauucuucagaaccacuaugcacuuacuuccccuugacccuuaagaccauuuguuagaugcaguauucugauucuuauuucuuuuguugcuuccacuuuuucaguaaggcaaaauaagauaacacuagaaaccucaauguucuuguggucagguuaccaaaaagcaauuuguauaagccauauucggccuuuuaaaaauaggcacuuaucuagcauuuucagcaacauucuacaagaacaaaaaguuuaauucuauugucagccccaugaggauaguuaccacuguuacucucaguuuuucagauggagaaacugaggcacagagagguuaaacaagcuguucaagauuucauagcuugucaguguugaagcugggguuugaauuuagucuuuuaaacacuauuugcauugugggucuuacaguuucucagcaaauugauaugauguaaucuuuuucacaucuuccauugcauaauaauuccaaauaaacuuuaaagguguaaucuuuuuauauuaucuuuuauaccauuacugagauuguaauuguugguggguuuagguuauuuagaaaaauuuaguauagguggguuuucugguugauuuaauccucaaguaacaaaucuuacgacacaugguggcauguuucuguaccuccugaaggguaguuuguuagggcuguuguaauagcccagugagguucuguccacucagucguucugcaucuguggcuuguccuuggagucauuccuuucuuuuuuucugucucuguuccuuucaguucaggcuggcagcauuucugcugguauaaaagucucaaaauccuugucagucuucuguguaguucauggacauccaagcaucaagcaagacaguccugcacagcucucuccuggauaaccacauucucucuuccuggcuucugcugacaugguugauuggauccacgagucacauacuucaucuguuuagcaaguuuguccagcaguaccauccuccagucucggagcacacuccucuuugaccauggcuuaucugcuguuucuguuuaggcuucauagcaucaucugagcaaacaagaugaauauuaauaaggucaaagguuuuuuuuucugagacacuuuccucagaaauaguguucuguaccucaccagcuuaucugcccuagggauguugcaauuguaaucaugaucaggccuaaaucagcucauuaaaguggggagcaucacuuuuguucacuguuuauuuuucuuugugaagcaauauuaguaacacuuuaagaaaguuucugguuguaaguccaagcuuuuuucccccuuuugucaaaagauuacaucuuaauccaaaauaucuuucaauuucucaggaucuucauuuucuuuauuccaauggcaagauaauuaugcaagguaacuuagaaaccucauuauauguaaccaauaauagaaagcaguggugcagauaaauaguauuagguucagaggaacaguugggacaauuuauauucagagccgaggaugaaguuuugcuggauagccggcuaguaugcaggaagguggugugguaggaggaaaauacugaaguaaaugaagcauaaggggcauuugggcucccaugacuuggguugaagaggaauauacauguugacuugcugugggagagaaaccugaaaaucucauugguggaguaaagucuuggagcccuuaaugccaggcucauaaauuuagaccuuauucuaggucuaagaaaagcagggugauuacaccuuauugaacucaggaaugaaagauuguaagagauuugggggagacgaaaguaacagcuauaacgauggauuauuguuaggagagacuacaggcagggaaauuagccuuguuaugcuaggauucaaggccuggcagugcagcugcaaggaugcuggcagaaggaauugagacaggagaugccguaaauggagacaaggcugaauuuuuaggggugaagacauagggagugucuaggaauguggacuauguauguaggagaauagaagaacugugguaucauuugguagcgacagagugugguuugaaguugaagacauuaauuuuagguauuuugaauguaauggccauuaggaugagaacucuguggugggaguuuggguuuggauauauuaagacuuuggaguuaauuugcauggaggugauaauuguaucaccaagauaucuaaagucuuauugugucaaaacuguucagucagucuguuaccggguauguuagggauugucaaggucuaucaguuaaaucuuggagauuauuuaugcaccaccauuugaaugauaacuucccuguugcguagugcuggccuagaccugauaaaacuuugugugaagucuuuauagaaaacuugcuuaauaagaugugacugauaacuauguauucaugagaauuaaaggcauaguagauucaaaauaauuuuuucuuugaacuucucaccuuuaccccaugucuucauuuuaguggauauguuuguuguuguuguugaugguauuggauguuguaugugaugugauguagaaaaggcuguucauuugcuccuaauuuuggguuaccuuaugagaguucguuaauaaccauaaauauaauaaaauauaucuuagaguaaauuuaucucaacucacugguuaaaguauucuaaucacacauucauuggguuauuuuauuuguugacaacccagguuuucagcuuuacagaccuuuuagcgcucaguucauugacacaucauugugaugggcaaauaaucuuuccauugcaggcgugcuuccaaaugagcacucuuuccuuuuaguuuuucuuaguacauaguucccugugagguccacaaaccauuauaaccacauuauaaaugugaauauauagauucucaucucuauucagaagaaauuggguuuaucacccauugaauguuugauaauguaaugcauuauccuccauuauguagugacuaaguauucauggaugauguguucaaggaccaacucuguguuacuguauaguuagcgaaacguuuaacacucuccaacccgguuguguuucagugcacuugcaggaaagacauggugaagauuucaauggauaucuuugugaggaaauuucagccagacagauaucagcuuuggaaacaaggaaaggauauauacaccauugaucacacgaagccuacuccagcauccaccccugaaguaaaagcauggcugcagaggaggaggaaaguaagaaaagcaucccgaagguaaugaccccucaccccacugaccugccuugccugucguguuuucucaguuaaaaugggucauuggauguggcaauuuacuugcuuuuucuauuuauucaucauaacuuaauaccuuucugaaaaugugagacauuauuuuuaauucuuagguguguaauaaauacaauauaggaagagauguauauuuauuuuguuugagaauauuccugaaguugcucgacauggcaaauagaacaauauagaacuuguuagaccacuuacaugaauguguuuuaugguuguauuauuccuuucugugcauuuccauauuuuaaucaauaacuugauuuuccacuuuuucauuuugccaccauuuugcuuuuuggcuuuagugguuaucuucuucauuuguccaacaucugagcuacugcucucuucuggaugcuuauauuuuacuacauuuuaugcacaugguuuuauucuuuuguaagauguaaaacacagcauauagcauuucuguaacaugcuuauccuugugaacuuuauucuccauuccaucuuuguggccaggaucauuucaaaagcuuuuagaugugcugugggcaucuuguuguuuuaaaaccuauugaauagggugugugugguguugcucagguccuuaggcuaccuuuuaagggucuuauguuuuccaauuuuauguuaaauuuuccucuucaauauuacucauuguuuuucuuucagauuauaaaaguaauauuugugcauuggaggaaauuuguaaaauaaggaaaagaauaaugaaggaaucccauaucacucauaaccucacuauccagagauaaccaguauuaacauuuuguauauauccuuuaccuauauauuuauuauauauuuuauaauauuauauaucuuuccaaaauuggggccaugcucuguuaauaaucugacaaucaguuuugaguguuuuuuucauguaacugauugauuugcugcaacaugauuuuuaaugccugcauguauuuaauccccuguagcuuguguccacuuuuuugauauuaacuaaguaacaccauaauuuuacaucuuugcccagacuuaugaugcuuauuuucugucuuuuuuuuuucccugauauuuauuuucugcuuauuuagagugguagugaguggaagaaccuuaggaacauggagucaaacuucggcaucuuauaagagguagaccugaggugcagaacuaacucagguguugauauuucccccuguaguuuaccgcaaugaucgucaaaguguuuguuaguaggucaggaccaacauuuuaaaaugaggugguaaaauagaauaaaaaguauuauagugcuuccucugugguaagggcaaauauucacucaugacaugugugaguauguguguauguguguauauagugucacuaucugaaauauauaacucacuguggguuacauucaagaaaaguuugagaaauacuaauuuggacagucagugucuuugauaacuguguuaauucacagcacuaaagaagccagcgcuggaaggaggcaguauccaauccugaguucagaauacacaccaggagaacaucuugagcauuguucugucauggauggaaaacacaauauuuucauuagguguaugacuugguuuccagguauuaaccacagugggccuuuuggguugauagagaacauggauuuaugacacuugaacagaucaaaaugcuugucaguagguucaaauaaucaauggaacuugcucaccuacuuagaaagccugacuaugggcuuguuuaauaugcucagccuuguggcuugauauuuagagauuauugaucucccuuuggaaauagcccauuuagggaagucugaugaagggaaugauucauugaugucucaagcacaugucagccuucuuuuuuucacauauacuacacuguuuauaauguugagauuuucccacaucagccaaugcauggauuugcaacaaaagcaaugauggugaugaucauacuacugcaguuacugccaucaguagcagugaaagcuaauuuauauagguuaucgcaggccacccuauucucugcccucccugacuuccuacagugcuuaguccuguggugguuucuuguguguguauaauacauauggguguguuuuggacacuguugcuuugaguugauuuguaauuguuccuaauuguuaggaauguuuguuucauauguaaaaagcauauaugccaaagcuaucaagugaccugcuggaaaauacucaggaagaagauaaaaauuguguucacucugaaaauaguauguugauguacgauguuaaauacauaaaauuaggcugaaugugguggcucaugccuguuaucccagcacuuugggaggcagugggggaggaucacuugaggccaggaguucuagaccacccgggacaauauagugagacagugucuuuaugacacacacacacacacacacacacacacacacacacacaccaguuagccugugucuguuuuaaauccuuucgcuauugaugaauuggcauuuaauuugaacuauuuucauacauaccugacaauuauacaaaacucaaugaaaaguagucaguaguuuaccuugaaauauaaaaaauuuacuuuuagcacuagccuaacaggauauucugauuuuuauuuauuuucuucauuuucuaaauauuuuauuuauugauuuuauuucugucucauuucaacauuuuuuacuuuauuuuuauuuucagacuuuuaaaauguugucacaaaauuuuaggaauggcccuuuuucaaaauaauguuuaauaauuauuuacaguugugugaauuuuaaaguuuuauugauugauaagaaaauuguguuuaagauuuugauuucaaauuuaaucauucaguugugaacauugacuuggcauagugauuaacaaugucaguuguuuccuucuuuaagcaagugaaaaugacauuuauauugggauguguuuuucauauccauugcagacaucccgcucugaccacugcuucucuuguugacagcuuccagugugcuaggucuaccucuaaaaggccuaaggcugaugaggaagaggaagugucagaugaagucgauggggcagaggucccuaaccccgacucagucacagaugaccucaaggucagugaaaagucagaagcagcagugaagcugaggaacacagaagcaucuucagaagaagagucaucugcuagcaggaugcagguggagcagaauuuaucagaucauaucaaacucucaggugagaagaugguugauuagguuucacauauaaguaguaggugguugaugaucagaugucuuaaauggauguucacuaugacaaguaucugacuaguccacauagcuuaaucaguaaucuaccaaagucauggguaacucaaccaauagucccagggaauauuguaaaagucaggagccucacugcuauguguagcagaauugugagacaagcagucagcagugccuauuugguuuaauaaaaaagaagauucuaaaaugaguuuuuuuuuuuucgugcaacucaauuuacaauauacguuuuuggaaggcuucuuuugaauucacaugaguagagaaaaccaauuauagauaauucuuuguagauucuuagcuuucgacuuaagaagaaaauaaagaucaagguuuuaagaacaacaauaaugaaaagucaaccuagugaaaugacauguauaguccccuugcuucucuuuuguacuaaagccauugucugaaaaucucagcuacuuugccuuuucucccuuugguagcauauuuuucugaaacugcuuuagugauuugccucuuucauauuuguuggaguuuuuguauuguaauaagcuaauuccuguguuccucucauacuucucauccuguaaauccuuccucaugggauuccccccuccgccagaauccgacucccucugcugcuuccuccucacucauggcaccauagcuguugccuggaugacugcagcaauugcuuccuucuuauucaggaaugucagcuguagucacccccgcuagucaguucuccagguggccauuagagugauccuuuaaaagaaaaaaagcuuaggucuugugacuaccuucuucuuaguauuauuccaccuauaauaaaagaaaaagucuucacauaguccuaaacugguccucagcugcuacuccagccucauugccuuugcucuugaaauagcuguguggauagaguuuaaaccacagaacuuuuaaaaaaugaguucauguuuuaguggagagcuaggcaaauaaccacauaauuacaauccaaugugguaaguagcauuauagagauugcauaggauguugcugguuuaccaaggaaggacuucaaacacacaagagcuggauagccaagguuucuuggcaaaggugauaucugaauugaguuuugaugaauggauauaagauagcaaggcagagaagguagggaagggaauuacaacaaaugcagaauagagaguuaggcaauacauauggauauuucacuauagucccuuuuuuuaaaauuuuuaaauuuuuuuugagacagagucucucucugucgcccaggcuggagugccguggcacaaucauagcucccugcaaccucugccucucagguucaagcgauuuuuuugccucagccuccugaguaucugggacuaaaggugugcaccacuaugccuaacuaauuuuuauauuuuuaguagagcugggguuucgccguguuggccaggcugaucuugaacuucuggccucaagugauccaccugccuuggccucccaaagugcugggauuacacacgugagccaccgugcccggcuccucaucaugcuuucucuuacacuguguuuaauuagccaguuuaugaauugcuggaugguuuugccuaagggcccugaauuucauuaguucugucacuacaugguucuuugcacauugaucuccagauuuugagcccuggcauaauacuugaguagaagaacuggguuguucaguaucagagcuaguaugugauggguacaaaugagguuuguuuugugugugugcauguaugugcaugcgcaugcguguguauguguguguaagauacagaaucauuugggaauaguuuaccaauucuacuuaguaguaauacagugcaugauuuauuaacagucuucuguuuuauccucaggaaacagcugcuuaaguacaucuguaacagaagacauaaaaacugaggaugacaaagcuuaugcauauagaaguguaccuucuauauccagugaggcugaugauuccauuccauugucuaguggcuaugagaagcccgagaaaucagacccauccgagcuuucauggccaaagucaccugagucaugcucaucaguggcagagaguaaugguguguuaacagagggagaagagagugauguggagagccaugggaauggccuugaaccuggggaaaucccagcgguccccaguggagagagaaauagcuucaaaguccccaguguauguggcaauauccauuuuuuaccauauucauuauauggugagagcacauuuugaaaacaacaugcugugcacugaaauccuccuuuagggcacagauaaauaacauuuuacauuuaugggucuuaaucauauucauucaauaacugggagguaagccuccugugagcuguggcucacauagugauaauuuagcacauggagcuuauggccacgugucgaugcuugauuuucuuuuuuuuguuaaaaaauuaaacucuuuacuuugagguaauuguagacucguaugcaguugugggaaauagugcacagugauucuuuguacccuuuacucaguuucucccaaugcuaccaucuuagaaaacuauaguacaaagucacaaucauaucgacauugauacaguaaagauuacagaauuguucugucaccugcagaagaauucaucugcugggcacugaucacuuucugccaauaguuaauaccuccuggucccagccuucccacagcuucuauuucagugucaggacucacguggucaugcuuucuucuuacucuuuccucauggacccugaaucucaggaccagggugaccuuucuuguccugcccccuccucgaaagaggcccuuugccucugagaaaagacuccucuauauuauuuagcuucccauugugacuuuuuggaaaauuguacaauauuguccuuguacaguauuaauauuccauauucaguagaaacuguccauguagccauaagaguggaucaggggagcuaggacugucuguagcgauugucagaauucaguacuuuuuuuugauguauccagccugauuagggaauucagguggaucaggaaggaguaauuguuugagcugauagguugcgcuggcugcagaacagacacugcuccugcugguuucaacucaaaauagauccuugugucccugaguaggagcaagggagguuguauaaggacagcagcuuugaauaccuugcgucuuaucagucuuaaaauguuaauuaaaauauacuuuucugauuugacccaauaguguuuaucuuuuuauguagaauuguauaucucauugaauuauaaacacaucaaaaauaugaaagauaaaaaaaauauggucugguuucuuugaaaaggugccuaagaguaguuugaaaauagcauucacauacuaauaagcaaaauuuacaacuuuggccaaaugugguggcuuauuucuguaaucccugcacuuugagagacuguggugggaggauccccucgagcccagagguucgagaugagccuggacaacauggucacacccugugucuacaaaaaaaaaauaaaaaaaaauuuaguggugugugccugugguccuagcuacuagggaggcuaagguaggaggaucacucgagcucaggaauucaaggcugcagugagcugugaucccaccacugcacucuagccugggugacagagugagagacccugucucuuaaaaaaaaaaaaaaaaaaaaaaaaaaggaaaaaaaauuugcaacuuaauuucaugaauggcuuaaauguagccaagcagauauucauucuuuggacaggugacugagucaaaugccugcuuuaguuauuuuuagcgaccuucuuuaaaguagaauggagcugaaaguaauucucagauuucuuugcucucaaggaaggugauuauagaucuagugcuguuuaucuucaucuuuaucauuuccccaagcaaagacugacaguagagaaaccaacauugcuauugaaggcugagaggcuuggcuugccuguaagaacaacugcaugacauccuuuucuuacaccaugguguuggauaacuccuagauguaauacagccccacuuaauuuuuguguaguuuuggucaguuuuuuuuaguauucaguguaaugcuauguguaugcugauagcugcuggcauuagcugaucuacucaauaaguauuauguuauuuuuuaaagccauccauccauccauccauccauccauccauccauccauccauccauccauucaucuugggcucaaagcuguaccuggaacacaccgaguauguucucacuuuacgugcuauucuugcucccccagaugcuccucccccagauaaucauauguaugcacucaaaguuccccucaaguaucacuguaucagaaaggccuucucugauuacccuauaaaacugcccccuccccaucacuuucuauuccuuuguccuucuuuauuuuccuucguuacauauuuaccgaguaguauuugauaaauacgacuuauucauuuauuauguauucccuuaccccucuauaaucuacacuucuugagagcagaaaccugauguaauuuuuccugcuauagcuccagcuaugacaacgguauggugcauaguaguguguugauaugucuucuuggcuguguuauaauuucccauauuguuuuuuagcuauuauaaacauagauagcugucaucguauauugcauuugucauucuuuucuuauuccuagcuuugauuacaauggucuuacacauuuucuuagaaucauguguuggagucagaggccagaguaguuucccuauaucuggccacugcuucuucagcuuaccgggaagaagacuaagauuguuuucuuucauagucaacucuugauguaagcuugcuggguucaaacucucucugauauccucuuucccuucccccugccuuuaaaaauuuugcguugugcgagcaagagagcuuaaaagguggguccuagcuggaagguguaaggauacacaugacuuucuacccgggaaaggaauauauagucuguaaaucccaggacaaaaaaaucauugguaaaauuuaagugguuucaacauggcauuaauguaucauuaaaaaaagagaauacuuuugguuucuuguuuaauuguuauuuaugugaucuagaaguggugauucauuucugaauggaaagaaguguugcaguauugucuucucugugaggauagaaaauaaaauuccuugcuaaauguuaacaugggaacaucuuagaggugaccaagagccacaguccuguauuuuuaugagaaugcaaucuuagauuuacuuauuuauuuuuggcgacagggucuugcccugucacccaggcuguugugcaguggcuugaucuuggcucauugcagccuccaccuccugggcucaagggauccucccaccuuagccuccugaggaccugggaccacaggcauaugccucuauaccuggcuauuuuuuuuuuuuuaaauuauugacacagagucucccuauguugcccaggcuagucucaagcuccugggcucaagggaucccuucaccuuggccucccaaaaugcugagauuacaggcaugagccacugugccuggccuauaauccuaaauuuacauuaguuguaagaacuuuagaaaacuuguuaacugcugagcuuauugcagguuuaauaagccuacccugcccuacagcuuguauuuuaauacaaaguggaagaagaauuaauugaccucuggcuaaaauuacuaauagaauugauuccuauuucuuuugaccuuaaguuuaaauuucuuaaaggacuaguuccccaagagguaaacaaccacaagauuucuucaacauuaagugauaaauaauugugaacuguaggguuuuuuuuuuuuguaguuuguuuuugauaaugguauuucuccaccauuuuuguucuauaacuagauagcagagggagagaacaaaaccucuaagaguuggcgccauccacuuagcaggccuccagcaagaucuccgaugacucuugugaagcagcaggcgccaagugaugaaggugagauggugacccuuuuugggauuuuuuuuuuuuuuuuugguguguaaaacaaacuauuguaaaaaaaauugcugaauagaaaaaaaauucaacaaguagcaaauacguacuauuaggagaucauacauaauaaauaauuuacagguaaaaggaauuuggaacuuagagguaaagacguacuucauauaagcuagccuuauuacugguaaaagucuuccaguuuuaugucaugggguaaaaucagucagccuugacauguuuuaggguucuacagaagaagcugagacucauuucucuaaagguguuagauuuuagaguuaacgugcuguagguuucuuuacauugucuuuacuuuuaacuucaacucuuuacauuaauuuaaccaccuucaguaaaagucuaugugccauauccuuuuccauauccuuuuguaacugguguggggugaaacauccuuuuuccuucacuagaucgcugugaugcagcuggauguaacgcaguuucauuuacaaucauuuaccauuccuagauguaaauuuaucuuuuucccccuuuuguucuuuuuucaagacagggucucgcucuguuauucaugcuggagugcaguggagggugaucacggcucacugcagccucaaccucccaggccuaagugauccuccuaccucagccucccaagcagcugggaccacaagcaugcaccaucaugcuugguuaauuuaaaaaaaaaauuuuuuuuuguagagauggguuuugcuauugcccaggcuagucuugaacuccugagcucaagcauuucuccugccucagccccgcaaagugcugagauuauaagcauuagccacugcaugccugguuacccuucucaccuuucuuuuauaaaaaagaaauuuuuguugccucaaauuaaaaaucagaucccugauucguaagugucuuguauaugucuccuagcaucaugaaggccuuauuuuuucuguguuuagaggauuaauucaggcagguuuucuguuaagaguccuucucugaaguauucuccaguuuuacuuauggaaauuauuaccuaaggucaugugucugugagaauacuguuaagugaguaacaagaagcucaaguuucuuguuuaaauaaauuuaucagaguagguagauaucuuucacagauuuuuucccccuuucacucacuuuucacuuaugucccauguuuaguuagaaaacaagaucauggcagggcauaguggcugacuccugcagucccagcugccugggaagcagaggugggagcauugcuugagcucaggaguuuaagaccagccugggcaacuuggggagacccuguaucauaaaaaaguaaaaauaucaugaauguagggauuagggaucauaguaguuuguaugaaaccaauccaggguugaauucugauucaaguaauagaaguaaugaaacauauuugcauugauuuccauauaucauaauguugaguucuuuuucuuuuuuuuuugcuacuuuauuauacccaguacaaaccauuuucccuuuaguguuaagacauaugacaauucuguguaaaguaauuaauacuuaauguauaaugcucaugauuguaauuucccuuucccaugguagacucucuucaguauaacuuuugugaagggaauaggcuaugcuaaggcuguaccaacacauagagaaagcugcuuucuccuguguccuuauuugccuaggaaguuuauuuugaugugggccaucauaaauuggcccagaguuucuuuuuggaaagcaguucugauuucaguuuguauagcuugcaagauuuauaaauggauugguuugaugaagucgucucaaggguuugagguuacauauuuuguagaaacgaugauuguagcuuuugcaacagucuuucuuuccuuucuaauauguuaaggaccccuggugaccucuggggauuuuucagaauugauuagaaaaaucagagaaguuuugugauggcuuaaaguuuuuacaagcuuucaaacuggcaacagagaauauucuguugcccgaaguaaauuauuuacaucauugggaacuugaauguuaccuuagccauuugccucugugucuauguugcuugcaaaguugaaagugaauaaacauuaucauuguuagauugugaugugcagugaguguuuuacucacugggagcauacaauuccaaauccaacuccuuugggggauuuucuguccuaacuauucugcuccuuuugcacuccucauacguaggagcauaacuauauuagagcauaggagaauugcaucuuuaaacaacaaucagugucuucuguuggugaacgagcauuucucuauugaagcuggaaaguuucucccuaacagaaaggcugcacaggggaaagugacuugguccaggaccucugggagcugcuaugccacuggcagcugagagaugagccacuuguacguugcuauucucuuuaggacagugcaguggcucuuugauacccaaauaaccugaaacaccauagaucauucugacugguggcacauccuguaauuacaggaucaggaaggacuucgugacuccuagccuguuauuuuccgggaaaagauuuuccauguugaacagcaaaacaugaaaguugguggugguggagaagagggggcuauguaauaaaagaauaaugauuagaauguaucuuuacauaaaaauuagcaucuaacuuauucuuuuuuggugaaaaauaauguuaaauauauacuacauguuuauauuuuauaacuuaaaugaaaauacuaaacugccucuuuuuuucuuuuaacugaaauguuuuucaguugcauguuuuucuaagguuaggcagcuggauaaggugacugaaacuucaauuaaaauucuuuuuauugcccaguuguuuaaaaauuacgcaaauguuguguugaaaccuagacugauaagcaaagcuguuuggauuguuuuauucucgaagcauccaggauauguacguauucuucuguugccauuuguugauauuauuggcauauuccugcucuuuccugaguucacuguccauagagaaggaggauguguaugaagugcaugggugaacuaugcaugcucuggugcacccgugcacuuaggggagagggcaaugcucugucucuggccauggaacguacuagaugugaugaacccacugaagggcggccagcuuagaaaucugcggcaguauuucuuucuuucuuuguuuuugguuggugaggaugccugcucagaagcucucagguuuccuggaauuguaaaaugcuucaguacagguuaaaugcucaauuucuuuguguggcuuugaaaccaguugucauucaaugcugccugcucucucuagcuucauuucccuuaacuuugcgacgugagucuuccuuucuguucagaccaucauuccccugccuuuuuagcaccaggcacugguuuuguagaagacaguuuuuccauggauggggcagggguauagggguggggaugguuuugggauaaagcuguuccaccucggaucaucaggcauuagauuaucauagggagugugcaaccuagaucccuuacaugcaugguucacaauaggauuuguguuccuaugagaguauaaugccacugcugaucugacaggagguggagcuuaggcuucugcucaccccuugcuguguggccuguuuacuaacaggccacggacugguacuauucuauauccugggaguuggggaccccugauuuagacaacuucuccuuacccucccccugcugcuuuucuuccauguauuugcccaggcuguuacauuauguguggcacucuuuuccuucuuggaauguuucaaucccuugucaccacucaccucuccucuuccaccucuaccgcccauagacuccauaugugcuugguucucuugcaccacugaucaccuuacacugugguuuguuauuugucuguccguguaucugucuccccacucucauuccucucuuuugcuuccccuaucaugcuuuugguagugaacauuucccugcaaucaugguagcuuaaaucacuuauggauucaagagugggaaugcccuggauaaggcaaucaguaauacuugaaaucagccauuaaaaaguuaaguaccucaacguguuacauacugucauauuaaaagaaaaauguaaauccuuguccaggaaauagucucccuauauauguguauagaaaaacauguuguuuuaauuaccaauauaaaugugauaaauuauauauuuaauaugucagcucuuucaguuuuguaucuugacagaauugaaaaucucucuaccacugugccaacuucuagaauuaccucaaaguuaaaaugcagcugacccauuguagaugcggcuggugccuuggaguuugagggcuuuuggagcugugacauuacguugggucaguaagugacuccuuuuuaaggacuagcuuauuuaggcuauggugguuguacaggcuacggugguccugagagugguuuuuuuuuuccccacccacaacaaaggaaugaugcauacuguugucuucagcacauuaauuagagaauggguuuuuuccuaggauuuuuuuuuuuuuuggauugcugagaaaggaguguugugugaggaagaaaagaagaaagaucaagacuaagucaguucaggagaagucacuagugaacuuaaauuuccugaucuuugcaguuuguauuucuguugcuuuauaaaaccauucuuugaaacauaaauguguguacauacaccuguauggacacacacagacacacaggcacagacacacacacacacacaaugugguauuuccacacagagaauaguugccauggagaugaaagccuaccuugaauaagguaaaugucucauaaaagggaauuguucaagggaagcauggucaugguguagcaauucacugaaacauuaugcagcuauauagaauguuuucaaaguaucaucuuuagcacucuugggauaaugccuccaauauaagguuaagugguaaaauacaguucagcuagguuuguuuacauuggaaauauuuugaggcaaguaauuaucuuuugaugguuucagaaaguacuuacaccuuugcagguuuuaaauuuuuuuuuuuugagauggcgucucgcacugucgcccaggcuggagugcaguggcgcagucucagcucacugcaagcucugccugcuggguucacaccauucuccuaccucagccucccaaguagcugggacuacaggcgccugccaccacgcccggcuaauuuuuuguauuuuugguagagaugggguuucacuguguuagccaggauggucucgaucugaccucgugaucugcccaccucggccucccaaagugcugggauuacaggcgugagccaccgcgcccggcccugcagguuuuaaguuuuaaaaauauauuuaggggguacaaguucagauuuauuacauggauauacugcauaguggugaagucuggacuuuagucuaaccaucaccugaauaguguacauuguacccaugagguaauuaauuucucaucccucacccacuuugguaucucuguuuguugccuugcugcccauuuugaugugauucacacucacaaauguuuuaagccauggcaagcuucuucucacuagcauucuuaucagcagcacuuuaaucgugcugacgccaacuccagaacuucccuugaagugacguugggcuaauaaucauccugcauugacaucaguaucugaacaugugcuuuaucacacccccuucccccuucuucuggccucauggugcauuguuuguucuuugaagcuuucauccugcacaugugugcauuuguuucccaacauuucuuauuuuacuauauuguuuucaauuaaaaauggaaaaauuguuuucaauaaaaaauuuccagcuuuuccuacuguuacuucuagucugcucacugcuuuugugcuuauugugcuuccaauccccuugguuaagagaugagguuaaugauguuucuaaugcaauuguaaacuaaggacaagccgugcuaguguacagaggacgucgugagcauggcauuugcugacacagugauacuccucugcucagcgauucccaccaugugcuaguggugaguauagcuaacauacuugugcugacagugaaguuuuguuggagucugugaaaguuaacuggaaauuuauaagaaaauugcaagacuguuauuaggugauuuuaguuuucuuuuuuaugcugauaauuuuucauauuuucugugacaaacauuucuuuuauauuuggccaaacaaguguuuuuuacagagugucaauaugauggaguggguuaucugauaauacccuagguauaaaacaacuagaaauaauggcuaauauaaaauaaacaacuuuuauacuugcauagagaggcaaaaauagcacaaaggauaauaucucuccaugccuacaaaugagggucagucggcuccagcacucuacugugugaugccucggugccugcguuuacaaaguagugaugguagcagcaccugccgcauggaggaauuguuuugaggguuaaaaaaguguuuggcacauaaugacuguuuguuguugcuguuguaaggagagggggaaagugacagcugauugguaagggggagccaaguuguggccguugaggagaaauuuuccaggaccagaaugggcgcagagcgaucagaacuaggaaacuaaagggccccucagacaugcggagcuggagccuuaaaagccuacaccuuuacuuaagugcacacuugagaaaaagaaaaaguggaaaacaaaauccagaaacaaacaaaaacaagagagcuugcuugccugaaacuuaggcuuggauggugaagggcaauaugauagaagagaaaguuauucuaagaauuccuacccauguggucaaguuuauaccucuucuucuaagugagaaauuuaaaaugcaacuuaggcuggcgauucaugccucuggggcaucuggcacaagcaguugcaaaaucuuugaacacccacugaauaaaagucugguugacuaacagucaauagauuuuggagucuugacuuugugcuuuauauguuuuuugacuuuggguaagcccucucucuggccucuuuccuccuguguaaaaugugaggcuuggucaugaaugauaaguguuccuaaccuguaaguucauauauggauuuugggcauuuugaauccccugaaauagcauguggugacagguugaaggcugcuuuuccaaagagcugauugccauuaaucuaaacuuuuacuuauaacucuucaacuauaauuuuauguuuucuagaauaaucaacacagaaaguuggaaagaugcagauaaccaaguguacuguguuuagucaagugcagaggcagccucaucuguuaauacaaguuuggauauuggcaauauucagauuaaagcccugguuuugggucugauuuucucuaaucugaauuuuccaaauaacuuuucaucagucaucaguucagcaagugcacuacuguaaugagcuguuaagcaucuuuuugaaauuaaagacagcuuacacccugaucccuaucucuguaaugucugcaugccuugaggauuagauuaagaguguauuucaggcaauguuacaguaauuuauuucuugggacgucuguauauauauaauauuuuauucaguaauggauugaguguuuaaauauacagacagaagagguggaauuggagaucuuucuugguguuuaaccaucauuuaacccaucuaacccagguuuucuguuguuuugaagaauaaaauguauacauuuauucacuuuuaaguaagugaaaucucaggaagucccguuugacuaaauuugauuacuuccuuaaaugguuuucucuaguucacauuucuuuuauuagaacaauuguuuauaggcuggguuugguggcucacgccuguaaucccagcacuuugggaggccgaggcaggcggaucaccugaggucaggaguucgagaccagccugguuaacaucgcaaaacccugccucuacuaaaaauacaaaaauuagcugagugugguggcacacaccuguaaucccagcuacuugggaggcugaggcaagagaaucgcuggaaccugggagguggaggcugcagugcgcugagaucaugcuauugcacuccagccugggcaacacagcaggacucugguuccaaaaaaacaaaccaaccaacaaacaaacaacaacaacaacaacaaaaaauuguuuauaacaauugaauacuaaagugguccuauguguguuuucccaggacuagagcugcccacugauugcacuucauucuagguuguuuuuuuuucuggcaucgccugggauuucccgugguauuuucugaguacuucaccccgugucuuguagucauuguccugcugguacuuuuacuacacaagcuggcucucagacacuuugcaauugucccucaaacaaaaggacauuaguuagaaguggaauuuagaaauagaacuagaaaucaaagaguuagaauuuagaauuggcuguugcccuuuaccuuuuguagauagguguuuggggaaaauuaugcccuccugcuccuggcaagcuguuacucucuguuuuaacuguauugauguagauuugccagucuuaauuuugugucucuuauuuuaaggauuuauuaagugaauauguugaccaaauauaaugaugaugucuuuuugauucagaaauuacaaauuuuuuuaaaguauuaaauauaaauguuauuuuaaauauuaaaaacaggccgggcgcgguggcucacgccuguaaucccagcacuuugggaggcagaggcgggcggaucaugaggucaggagaucgagaccauccuggcuaacgcggugaaaccccgccucuacuaaaaauacaaaaaauuagccgggcgugguggcgggcgccuguggucccggcuacucgggaggcugaggcaggagaauggcgugaacccgggaggcggagcuugcagugagccgaggucgcgccacugcacuccagccugggcgacagagcgagacuccgucucaaaaaaaaaaaaaaaaaaaaaaaacaaucuuuuguuuuccagaugcuacuggguacaugacugucugcuuuaggguaggcaggcugcgacuuggcuuacgaauagguacaucucccauugaaagucuuuccccugcguaaaaaguucuuuucccugccaguuuugaaaaauaaaugcugugugauggcugcugcaugucaugcuccaaauguuauuaauuuuuacauaaugaucucuuuguuccaucaauucuuuuuagcuugagguauuacuauacuuucauaauaagcacauuuauaguucugucuguuuaagcaauaaaacagcaaauucagcagauuacuaaguagauuggcuuggaauguuuguugauaggucacagccaguguuuuccugcguuauguggacacaaaacauuagauguuguuggcauucagauaaaauggauauuuuaucuagugcuuaagguuuguaauaauaauuugguguucucaguuuagccuuauuucugucaguaaauuccacuggaagucccaguggcguugauuuuuacuguaguauggugaauaaaaaaaucaaaaccaccucacuuuuauuaugcuaguggcuuggucagguuuugauuaaauuagagacaaaaaugcuggcuuuauaauuuaugugaugcuguugcuuucuguauuucuuacuuucaauuuugaaacuuuucuaaacaaugauuagcaugaaaucuuaugaucagguuucugaaugugcuaaaagcauggagauuguaagaugauaagaaagaguuugagucuuuggguucauguaugccuuguuauuuuuuuaaaauuaacuuauaaauaaauucaaccauaaccuuguuacucuuaaaguccuguagaaaacuacccaggaacagauuuugauagcacaguuucauggugcauucaauucuuuagaaaaauaaugauuguauuagguuauaauauauaugaaauugucaauauuugaaauuuuuuuuacucuaugaaaacugcaauuucauacaacucaaguguguuacuuuacauuuuuuucaaccugaacgccaguuucuuuuucuuggagauagaaugucucagccuuauagaccaccgaauuagcacauauuuugguacacuuuguuuucauuguuacuuucaccuuuucuuugguuguaaaauuagcucugaagauguagaaucagcauggaaaguuuauguauauuucaaauuuuaauauuguggugacuuuaugucuucauauucuuuguuuugccgcuggccaaugaaaacuuaguccuggcuggcaacauucuacagguuggcauuugugcacguuggucauggaaguuaaguaacauguccaagacuuccagcuagugaaugguuagaagguggcucucuuuaucagcauuuuaauuuucauagaguuguuuuaguccuuuucccuuuuggagguguuagguucccaggcuucagagaaauggugagaugaguauaucuuuauaccugucaagugaaccuauaaauucuggauugauauuccauuguuuuaguguuuauguucuuuguuuuguuuuacagagauuuuuguugugcuuuaaaaacuagaaacuuaaggaggaaugauuggcuaugauauguauauguguuugaguguuacauaaauauuuccauaguuguugaugaagucuuuucuugaggaguaaacuugauaaugccuucaagugagugaaccauggaucuggguuaagaaucuucuuggggacccccaggagaagauugaaucuuucaugagguagagcugacaggaccauguaauguauuuugaagggaaaugagaggaagaagauguauagccuuguucucuccuuauuucuguaugcuccccugaauaguccaugucuuuaucuuccuuaguuggugugauggccacccuacuugaaguucucucccuagcagcuguuuugugugaucugccacgugauaacuccuauuaguuguugggucaaaauaucugugauuccugcugucauuuacauagaugaccaaagcugacaucuuuuuuuuuuugguauggggagcuucuuuuucauguagauugcaucaugcuaguguuaauaguuucuugcuuggagaucuuguuuugccaucuuuugacuuuguauuguauaugcuguuaaugaaauagcuuaugaaucuggagguuuuucccaugagugguuuuuguuuguuuguuugagacagagucuuacucuguugccuacacuggugugcaguggcacaaucuuggcucacugcagcauccgccuccuggguucaagugauucuccugccuuagccucccgaguaucuaggacuacaggcacguaccaccacaccuggcuaguuuuucuauuuuuaguagagacaggguuucuccauguuggccaggcuggucucgaacuccuggccucaagugauccuccugccuuggccucccaaaaugcugggauuacaggcaugagccaccgcacuugccucccauggguaguuuugaacuccauaaagggaaagggcuguugcuuuuaauuucuuauuuccagaaucuuuuauauuaccuagcauauggugaauuucauaugcuuaguaccuaucuuuguuuuuuaauuguaaauugacaauuuauaauuguauaaauuuaugggguacaaaaugguguuacguuuuauuaguacaauguggaauaaguuaguugacuuaugugucaccuuaaauacauaauauuuuguggugagaacaugagacuuuuacuguguuagcaauuuuaaaauguauuaauacuauuauuucucuucagaucauguggcucuuucuccuuuuucaccuaucuuugauuugaugcucagaauauguuccuucuggugccauguugacagcuaaguuucccaaggauaugccagcuuucuuuaggaguuuucuucuucucauuccuaccaugaugugagaauugacugagcugguuuccuccuauuuguuguacacauuacuaguaaccauuacuuauaauuauuuuagaugaugcuagcaucauuuuuacugguaaggcaaucgaagcucauagacaugaauucacuuguccuagaucacaaagcuaguaagugguagauaacaggcuuuaaauacugucuguucaauuccaaaguuuacacucuacacucuuguguuuuagauagacuauugcuaugucugccaggcuggagugcgguggcacgaucucggcucacugcagccuccaucucccagguucaagugauucuccugucucagccucccgaguaacugggacugcaggcgccugccaccauucucggcuaauguuuguauuguauuuuugguagagacuggauuucaccauguuugucaggcuggucucgaacuccugaccucaagugauccaucugccucgcccucccaaagugccaggauuacagacgugagccacuguguccagccuacucuuucaacacuaacaaccucccaaaauagcuagaauacugguaaaagaaguugaaguggacacauauaaaugucugauuauagccagauaccuuuguuaauaguguagauaaacuucccagcauuccuuguuuuuguucaugcguguuauaaaauauauauaaaauaugagcuaauguucuguaagaaacuucagccacgcugguaaugccauaguuccuggugaaacccaucuccucagagguagcauaauuaucauggguguuuuuuuuuuuuuugguaauaggaauuuugaaguuguguccuuuggaauguuucuuauuuaaaguguauauagagucauuuggaauguauccuucugaaauacuuuuguaucaguguuauugagaggugauacauaaagaacaaaacuauauacauccauuuaauuucuuaagugcuuuagacuuuaaacuguagaauucucugcuauccauuauuacauuagcauuuugggggaacuguaaugcagaauuugauuuuuccucaaugucaucacuucuuaguaaaaucauaccuaaaguccuguaauuuuuuucucuuuuguacuuuugaacacagcuuuauaaauguuugaaggucagcauuucaaaaaaaucacuuaaauauaguuucauacauuauucaguacagaaauuauaaaguucccaaguuugaaucuuugccuuuuugaguaucucacuucugcacuuaucccaccccacuacaccccccauucccugcaggauguuugaaaccauauauaaaugccucccaggacugagauuuugcucaaguaccugaaacguaacagaugcugcugugcuuuucauaguagagaauggugcuguaccagccaaaacaccucacuggagcaucaccccaagcagcagaaugagugugaugacuggcaaagggaaauuauacuguaguggagcugauagcuuuucucaucugcugaguuccauccacaaguccuggcagcagcccuuucacaaauggccugaauaauuuuccuuagggacgucacuuacauguaacaaaauuuguucaaagauacuguccugagugagugaacgaaucuggcaaaaaucuguucuuaaggcaagguuucccccaguucauaguucucaccuaauauuauuuugacagcaguuuuuaaaaaacuuuuaagaugacauauuuuuauaacuaugaaaacuuaaaaagccucuuuauuccagacauuuaaccuuuuaaauagaauuggcaauguucccuauacaugguuuugugcucccauuuuuuauugauuauauuauauucaacuaauauguuguguaauauauauagucauacuguauauuucauuaauccucaaaagcauuucuucuaauguaugcauuauauagcuaugccauaauuuauuugcauauuuuaaaaaagauucuuuuagauacuuuuguaaaagacauuaauuucuuuauuaccaucaauuauauucaaugauguuuuugagugaaugggagaauaaaggcuuuuauuuucccuacaaggcuaaaccuuuugauggaaauacuuauauauaggagauaacuuggcgucugucuagauuggcucuguucuaaucuguguugucaucuuaaacacauuacaguguuuaagcauacauuuacagcauacauuuucagaaauuuucuggauggcugcugcgggguucuguccugcagacccugacccaaugacugaugaauaaaguacacugacacacagauagucugcuuugccaguucuacugaguguccgggcuacuuagucacagccauggccccgaccagccagcgagacucacauuuauucaguaaagauuaauugacaaaggcuugagucaacaccacuagaagguaguugacauugugggcuuccugaguagaaagcaauuaagcacccaugguagaacaaagguuagcauuaagaccccaugaguaggcugggugcaguggcucacaccuguaaucccagcacuuugggaggcugaggugggcagaucaucugaggucaggaguucaagaccagccuggccaacauggugaaaccccaucucuacuaaaaauacaaaguuagccgggcgugguggcgcaugccuguaaucccagcuacucgggaggcugaggcaggagaaucgcuugaacccaggaggcggagguuucagugagucgagaucaagccguugcacuccagccugggcaacaaaagugaaacucugucucaaaaaaaaaaaaaaaaagaccacaugaguaaagaagugaguuagauaaacgccccacauuccuuuguuucuacucuaauuuauuuaacuaaagguaaggggacuaggcugccuucagccagauuuauuaccgaaauuuugcaaacucucaaggcuuccaagaggguuuguggcuauuauaacuaaaauuuuucccaccagccugacugaacccccacagaccuuugcagagauuauguuggaggccuagaggggaaggaucaucauguccugaaguacuagguugcgcauaccagcaaauagcagcuuuauggcuaucucauauaacuuguuggaaaacccugacauuuaacuaaucuuguacucauuuuacagauugagaaauagguuuagaaucaucacccaaccaagacuguauagacugcaugaaugaagcauuauuuuaauuuauucugauagguuggagcagagcucuacacuuaaagccaugcuuaucuuagaauaauuuggugucacuuggacuaauguuuucaaauauauauuuucuagugugacuuuuuacuuuacauaaaagucguuuacacuuuuguaugaaaagugauacaaauuaauguguauaaaaagcaacgaaaaauaaucauugaaauaaacacuguauguuuacaccguugcuaacaacaucucagugugacccucaccuugggaaguuuuauuaaucugcaggaauacugcaaauuaguauaaguagaaaacuuuuggaguuucucugaaugucuuaagauacucaaagugaauuucagcaagccugacuuucuuauuagaaccagaaaguuuuuagaauuuccugugcuucaaauuaauggggccuccccuucucauaacauguccugugggguugagucucuuccaggcagaccucucugacuguuggggaaucauugcuugagcaucagaggugauacugauugucuauuuaaugaucaaugacaagacagaaaucuagcuaucccuuugagguguuugaaaaacagaauuguuuaugguccugaggagugggcggugugauuugaauggcaagcagggagaauagcuuuggagaugcauuuaagacaccuuggaaaggcugagaagggaggguuguaagcaggcugugaauggcuaauuacugugauuuuaccuauagguaauuguacaagcagaaguuguggucaguuucuuaauacccagcuggcacacauauaaaucacauauuuuuguuuuaacucauauuucuuuuugaggacuauuuuuaggcccugcuugcauagcuauuucuacuaccuuuguccucgaguuuuuaauucugccagaaauauucagaguaagaggugaugauugguuuccugggucuaagugagaaugaauacuuuuaauacuacuauaaaaaaaauuucagucuauuguguauaugauccaggaguuucaucuauaggcaaguucguuuauaaaaugaaacaguuuauaaaauaaauuuuuauuuuuauugacauggcgauuaaaaaauuugaaaacagcuauugaagguauuguugccaagguggcaauauuuucaacagguuucuucaguacauugauccaaguuaguaucugguuuccccauuuccaccucacaguaguguuuguuuaggcgcuagcccucuuacauaggauggcccuuuuagccacugcuuauguuuccuuauuuaggacaaaguuccacauaccuuggugccugguauacugggcuucuguaaauuuagaaaggcuuacauagauuugaggaacugcuuuguauuuaggcucaugguuuucuugacugcauguuacuugcuacaaggaaugacaauguuuuuguaaaaaucuuagucuaggaguacggguuuccaccaugaaguaagaggcucacugacugaggaagaaaaaaaugaagugcucuuggcauaaaaucuuuguuuucuucaauuucuggcaaaccuugcagacauucuugaaagaaccuagggagaaaaggaggccuuuuugcuguguugacucuuguuuucuuuuugcuuaaguauuucaaguugauuaaggcaagcugauuaugaaguuacugcuuggcuuuaagauugaagccuacaucagguguuuuuaagaccuguauuguuuagcagugacucuuugauacuaacacuuuuagaaaaauguacacauguauauggcagugguucucagucuuuuuggucucaggaagccuuauguucuuaucucuucugaggaccugaaagaagauucuuuuauuuccuuuuuuguggguucauuuuauugauauuuacuuacuggaaaucacaccagggaaaauuuaaauuauauuaauucauuuaaaaauagcaauaaaaacaacauuuacauaaaguuacauuuauuuucauaaaaaauaaugauuuucccaacccauaaaaaauaauuagaaacaucagcaagacaguggaauaggacuucacagcgcuuguccccuggcagaaacaucgauuuaacaacuaucaaugcucaaaaaugccuucaaaagagauacaggaaccagaugagagaugauggcaccugaguauagcacagacaugaaaaaagaugcauugaagagauaggaaggacaguuuugcauuaccuguauuaccacuccccuaaucccaggcgguacagugaggagagggauagggauaccugugugggaaggagagugaugugagaaacagauuuugccucagaucccaaucuaagguccguugcagugaaacccagcaccacacagucccaccgcccuggauuccuggcugguaccugcagacugagccuccaggauugcuccagugucaggccaucucucagccucaagacuagcucaagugucaggucaguacccacauccuuagacuccagaccagcacccacggagccagccuccaagucugccucaacaguagccagcauuugcagucccagacuccaggcucacuccagagccaagacaacccccacagacccaggcuccaagcugguccccuggucuaggauguagagcagcacuuguggaccuggguuucaugccugcccuagugaacccuggguacaggucuaccauagaagacccuggcauugggccaacucccacagaccaaacauccaggaacaucccuguggaugcaguugacaggaccacaccaguggaauguuggugccaagcuggcccccgugaacccaagauccuggccuaacucaguagacccaagcuucaguucuuacaugguggacuuaggcuccagauccaaccccaugaacccagguaccaggccagcucacauacugacgcagacacaaggccggaggauuccaggagcaagccuacccuuggaccaugccagauggccugccuagaaaauuuggauggacugacuggugaaggguuguccaagccaaagccagucuacaaagguuggaauaagucacuaguucuucaaaugcauggauaccaacucauggucacaagaaucaugaauaaucagggaaacaugacaccacugagggaacaaaauaaaaccucaguaaccaacaauaaagaaauauagauuuacaaacugccuaaaaguaauucaaaauaauaaucuuaaagaagcucaaugagcugcaagugaauacagauagacaacuaaaugaaaucaggaagacaaugcacaaacaaguugagaauuucaacaaagagauagaagccauaaaagagaaccaaacauauucuggagguaaagaacacaauaacugaacugaaaaguuccacagagggcuucacauuucugccagccacccaagucugaaugacuguaguuugucugcuaauaauuuuuuucauggaaaaaguggcguuccaugaaaauggcagguaauucaaccugcaauucaauuaauugcucaagugcuuuuuuaaagaacacucuugaacuuuaguguguacagaaauauuuuaugcauacauucuuuuuuuuucacagauuuaauaaaauugaugcuuuuuuccccccaucaaagguguuauuaagagaaacugccuuuuuguuaccucuguaaguaugagguagucaauauaaugauuccuuuggugccacugccuugauucaugcugagacaccaacaauuuuacucucuacuacuuucguaucaccguuacaaaucucaaaugguuaauagucaaaucauggguguuauuaugaaaguaguuuugacuauguagaugccaugcaacaggguuguguauccccuggaguucacagaucauauuuugagaacugugguuaucuuucaauuccacuugacuccuugaacaucauugguuugaauuguuugacucuacuuacaugcaauuuuuuucaauaaauacauuagaacauuucucauagacucagaacaauuugaaaaaacucacaaaugaaucauguagccuagaaauauuuaaaaaauuaagaaaaagauaugucaugaaggcauaaaauauaugcagauacaagacuuuuaucauuuacuacuauaaacauaaaucuauuauaaaaaguuaaaauuugucacaacauaugcacacaaacauggauguaaccaaauauaaaggugcaguauuaaaucauaaaugcauaaaauuagcuguaguauauccuaugcuauaauaauuuuuuagccaucuccuuuugcuauuauggugaggccaagugcugcgagaaacagguuacauuuagagucagauuacuucauugcaaauauaggcaaagacucuuaucuuuuguuuucaaauacucuacccaugggugaauaccaaguguuuuccauuguaaaaauaauaacaacaacaaccaugauaacgugauuauuaugauaauaaugccacccuuugugcuacaguuggcauuugacauauuuugaguuauuuucagccucauucaguccuucccauuuugccaucagugcaaaucuaauuugacuuuuucuaaaacagguaagucaacaugggaagggcuggaacacacuuacucaccagugauuuguaguuaagcacauugcucuacaguauuuauugaucagacuuugaaagcuacuuaugcagauauuuagaaugugucacagcccuagacacugggugcagcuuuuauucuggccacuugcucugauguacugcccucugcuauaggcauugaagaguauuuuucuaacauguuugucuuucuguauuuuucuggugcucuguaagauuuuauaaagugcuguucuuguggaguaaagaaauauacauuuuagaccaggcucagugguucaugccuguaauuccagcacuuugggaggcugagguggguggaucaccugaggucaggaguucuagaccagccuggccaucauggugaaacuccacuacuaaaaauacaaaaaaaauucgcuaggcauggugguggguggcuguaauccuaacuacucagaaggcugaggcgguacaauggcuugaacccuggaggcggugguugcagugagcugagauugcaccauuguacuccagccugggcacgaagagcaaaacuccaucuuaaaaaagaaaaaaagaaagaaaaagaaauauacauuuuaaagacuugacucucuagggguauuuuaugagaagaucugacuagggauuuucuuuuauauccauguaaugccaguauauugcuugguacuuuauagcugcucuguaaauguuaauuguaauaaauucuugaacccagaauuuaauucaaugaaguucaguuaaacuuuuauugagccauguacuauguuagaugaagaaaguaaaaauauuggcaaaguaguuucuggacugugaauuccucucauaacuagaagauaaucucauacacauaaaccuguuuuaguauuggagcuuuuaccguagcaguagagacacggaagaaguaaugugggaaggagggaacaguguaauuauuucugguagggauagggaggguuacaaaaugagggugguugucuggccgugggaucugaucuagucuuugaggcuugaggaggauuauaaggcaacuucccuuauccuggcucucucaggauguauuugaaagacaaaguagguuugguuuccggccuuaauaucacagauucuguggaauguuuauuucuuuuguacucagggugauuguuuucccugguucccaugcucaugguauuuuccugccuucucccuuaagaauugccugagguucuguccauugaggaggaaguggaagaaacagagucuugggcgaaaccucucauccaccuuuggcagacgaaguccccuaacuucgcagcugagcaagaguauaaugcaacaguggccaggaugaagccacacugugccaucugcacucugcucaugccguaccacaagguaaaggagccugcuaucauaguucccuucacugcucugccuuccaugugaccacauaccacaagaucacuguaaauuguugugggcuuccuuugcacauaagaaggaagacguccuuagguagcugauggcuuucauagaaccacaaacaguuucuacaugauccuugagagacacuuuucugaaaguacuuuaucuuuuccuuuugagauagggucaugcucuguugcccaggcugaagugcaguggcacaaucaugacuccgugcaggcuuguacucuggcucaggcgaucccucugccucagcuuccacaguagcuacgacuauaggugugagccaccauaccugccuaauuuuuuaaauuuauuuuuuaauuuuuguagcgacugggucuuacuauguugccuaggcuagucuugagcuccuggccucaagcaauccuuccgcuuuggucucccaaaucuuuuuugaguaucuuauuuuauuucauggguggguuacuuucaacuuuucuaucucuuuuacuaagaaacacagaacuuaaagcuuacaaauaguagaagcuuucaaagagagaacuuaaacuuaaucucuguuuuuuuuuguuugaaaacgucauucucaaauaauagaaaugucagcccuagguccaaauuuuaagugucucuuuucaccuucccauguggaacaugcaaaagacacagccaagacucacuacaaacuaaauuuuccaguucauccucaucagcuggcugugcgugauguuguuuucagcgucauuccauagauauuauacugauagcaccucagcuaauggagggucacaguccucagcacucaaacaguugaaauauuuuuaggaaucucguaaggguggaacuaugugguucauuuuaagguacaauauauuaugaaguauauugacaugaacauuguguuuuggguuauauuuuuauuuauagaaacaaauauuuuauucaagauuaugucugucuuagaguuccuuauaaaaauaaacuguucuguucagacauuucagagcaagaaaaugugugauaucucacauuuucagaccuuuguaacagaggaaauaauuuauucccuucauguuuuuuaauguggcacuggugagugacaaacauuauuuuucucuuccuuuagucauuaaauuucuggguuuuaacuacuuauugauucuuauuucuauauuauaaucuguauauuucucaauaauuaaaaaauucaaacuaaaauaauaagauuuguggagauuuaauauaaaguaauacaguauaaaacauaaaguaauauaaaaucuguaagguaauucauuacuuauacuuucaaguaaguacuaaacuuuuuaaaaucuuuuggugugaggugauaauuuuguuugauacauuauccuuucuuauuuagugacaugugccaguucucucucacuugcuuucaaauacugcaagugaugaggcaaaaauucuuaaagccucucuuaauacugcugcacagauuaaaacuggggucuuuguacacuccuucaaguguagcaagguaugauucuucaguaaaugaaaacagaucuguuaacucuagugcauaugaagaagcaaaagaauugaugcuuuccacgaacuaauuuuggaaagacacaguuuuaguagccaguugcuuucuuauaugaacagacauauagaauauuguccuuuuccugcagauuaacauuugggugggagucugagguggaauauugauuuaaaaaaaacuaguaguuuggucaaggagaacaacaggaagaacaaaaguuagaaguuagugucuggaacaggaguuaguggauuugagugacuagaaugaugagcucuuuuccauguuuuucacucauguggaaacguuauguuuuucagccagauagcagcaaugaagaaaaugaugcuagaugggagacaaaauuagaugaagucguuacaucggagggaaagacuaagccccucauaccagagauguguuuuauuuauagugaagaaaauauagaauauucuccacccaaugccuuccuugaagaggauggaacaagucuccuuauuuccugugcaaagugcugcguacggguucaugcaaguaaauggaucuauaauucaucaaucacuggcuuuucagcauuucacaucaucuuuauuucucacuuuuuuggaaccugucagaucuguugcauggacuauuggcauucuuaaugguuauaucauucuuuuucauauuucugcugguaaaaguaugaguugguauauucauccuuuuuucaccacuuucauguaguauccguggagagcaggucugguuuuuuuuguugguuuguuuguuugggguccaguugaggagucaugaugggguuccuuucacauguuuggauuuuacuuacuuuaagaucuaguuuauaaaaacuuaauuugaaagucugauacugauugaugacugcuuuucuuugugacuuuuaaaagagaaaugaauguuccuuugguuguucugagaauuguuguacugaguuaacuuuuuuucauucgugaggauaggaaucucuauuguauuccaggggagaacagucauuacaguuguuuuaccccugcacugggauagucuccacaccuaucucaauuuauuauuuuuaacaauuggauaagugguaaauauuuauuggucugccauguaaauccuaugaacuauguaaaagggaucucauauaauacaacucuauuuuaaggcauuuuaauauuccagaucuuaccaaaucacacauucuaguaacacacuuagguauggccuguacuuugucaauguaguuugaaugguuuauaauauagauauuaucuucuguauuuaccucagaguaauaauuccuuuguauuaggguugaaacagcuuccucaucuaucauuuauuaauuaauuagagacuaccuacuuccucaagggauuuaaaugcuaucugcuugaaauauaaucguagccaucuucuuuuuguauugaaggcaauuuguaacacacacacacacacacacacacacacacacacacaccuuacauuauuauguguauacaauagguaaagcaccaggacacaaaauaauugggauauaaucugauuccugaauguagcagcuaugcaguguagccauacuauuuuauacacauaugcuuuaacucauuauuucauggacaugguuaacugugauagguuuuuuccuugggaaauuacauuucuguuauuuuguuuucaucucaaauguuacagaaauuuucaaaaauuacucauuaaaucuuaacccucuuauacggagggguuuuuaauauuggaaauauuaaaaauuacucauuuaaauauuucagaauucucuuaucucaagaagucagagugacauguguuccuugaugccauauaauugcuauguauauuugcaucaucagccaucaccuuagauaguuauuuugggucaggcgugaacugaauagacaaaucgaauugaaaauacuccuucauugcuaacucugaauuugcagcauuugcccuaucauugagguuaaagguaguuagacuuaauuuuugaagcaauuuuaaauuauauuaauuuaaaaauauuagguuaaaauguauuuauuauauuauuuuugacauuuccuuaaacuuugccccauggauugcaacuuauuuuaagaugucugugugugaacaaauuaguagacuugacaguuuaaaauuuuauuacccauucaagauguuccauaaguauucacuguaacuguuguguuaguuaucaguaagacucacauucaccuugcuuauguuuuguucuauacagugagaaucaagacaguaugguaggcuagugucccauuuuuauuuauuucaguacugagaucugcaauauuuuaaaggugaaaaagaccuaacgcauggauacauacuauuauuuuauagguuguuaugguauuccuucucaugagaucugugauggauggcugugugcccggugcaaaagaaaugcguggacagcaguaaguagcuuauuuuaguauugcuuaaccuuucuucccacccuacccacuguggacacauuuaagucuagggaaaagauaagauugcucaggugcuuauaugugcaguucugcacuuccuuguguuucuagucuucccucucaaaagcaucuuaccugcugguucuauauccauuauagaaauauuagguaaauuuauuuucuuuuuuuuuuuuugagacggagucucucucugucgcccaggcuagagugcaguggcaagaucuuggcucacugcaagcuccaccuuccagguucacaccauucuccugccucagccucccaaguagcugggacuacaggcacccgccaccacgccuggcuaauuuuuuguauuuuuaguagagacgggguuucaacguguuaaccaggauggucucgaucuccugaccuugugaucugcucgccucggccucccaaagugcugggauuacaggcgggagccacuguuccuggcuuuuuuuuuuuuuuuuuuugagauggagucucacuccauugcccaggcuggaaugcaguggcgugagcucagcucauugcaaccuccgccucccagguuaagcaauucuccagucucagccuccugaguaucugggacuacgggcgccugccaccaugccuggcugauuuuuguauuuuuaguagagacgggguuucaccuugcuagucaggcuggucuugaacuccugaccucauuugauccaccugccucggccucccaaaaugcuaggauuacagccgugagccacugugcccgacuauuagguaaauuucugguggcaguccucuacuuaggaagcugcagggacugucaauuuaucguguccacauuuacauuuucaaggcuucagaauuuuucuucauuuucuuguccaucccuauuuugcaauacuugaaaauaaguauuucaaguaacagucaaggugggggauccucagugaccccugaagaaacuguguucauauccaguguuuauuuuucucuuuuugagacagggucucacucugucauccagacuggagugcaguggugcaaucauggcucaccacagucucgaacuccugggcucaagugaucuucccacuucacccuccuggguagcugggacuacaggcaugcgccaccaugccuggguaauuuuuaaauucuuuuguagagacaaggucucacuauguugcccaggcuguucucaaacuccugagcucaagugauccucucaccuuggccuccugaagugcugggguuauagguaucagccccugugccugacaucauaucuaacuuuucaacuagcaugaggucuuuccccacuuacucauccuuacauuuauacuuuaauacauuuuagaguuucuggucuguacuaggcauugcugugaauuuuaggcagaauauuuaauaacaaaugauccccuauuuagagaccaagaauugacuugaccuaaauuguuuuucuaaagaccuuguuaaaaauuuaccuuacuacuuuccugcagauuuuuuugggggcagaagaaaauaauaauaauaauaauguuauaaaaguuuagcuuacuucaaaucuuuguuuuccauucuaacaaucuaugucaacuuuguugccauuugauuaaguuuuaccuuaauuuuucuuaaaaauugucuuucaagaggaaucagaacauucuugaaagugacgaacaaucagaccucagcaguguaugccucacucaugaucucagagcaggugcucagcucgaugauuucagcuguaauagcagcauuuacuuuauuccucaaugaucucuaaugacagagaauuacacuuccuugcaacugaaguuaaaaaccugaaugacaauauaaagaauacgccuuauaugaugaaaauuuuugucaugacuguguauauuuaguucucaguaagucugagaguggugucuuucuggaugauuuuauugcuggcauucacuuuggggagugaaagaagggauaaaaauauggacacucuuuauggucugaauaaucugguauauuuaauguuagagguuuuaccucccauuuaagaagucccugcaucagugggcccagaaagcauuuugguacagguaugcauuacuuaaugacagggauacauucugagaaaugcaucguuaggcaauuuugucauugugugaacauaauacaguguacugacacaaaccuggaugguauagccugcuacacaccuaggcuguacgauguagcccauugcuacuaauguccugaguaguguaggcaauuuuaacacaaugguaaguguucguguaccuaaacauagaaaagguacaaaagacauaacagccuuacaaucuuaugggacuacugucaugugugcaguccaucuuugaccaaaaugucuuuaugugacacaugaccauauuuccuuucaugugauuauuauguuaauaaauguaaagcauauuuaacacagccaggaaguccugcuucuaaucuugaccauacaaauauaucaagcucuuauuuauuauauagguccuauuccuaguauaugagccaacauaaaguauugcagaaucaguuuggucagugauguuaucuccuucgcccugaaucauaaauuuagaaguuagagauuaucugaucagcucaccaaggcauuaagaguucucuguuccauccacaguuacugccuggcuccugugcucacacacugagcaguccuguuguccaagguaccauugucuuugcauggcaaccuagggccaggccuaggccacucacccugauucuaaagcugguucugauugauuaugcuguuuucauguagcauguuucauacagaaaaugcuaugauuaaucacucuuuggaauagacuuaaagcaucuuucuauuaauuuuaacuccuugcccccucagaaaauacaaucuugcuauuuguauuuuaauauugaaacuauguaaaucucugucaauuuacaguugaacugggaacucuugaauauaacauuacaaugauuuuuagaccuacauaauuuauuucuaccuguaagugaucugaauucacaguggauuccacuuguuuuuucagcguauccauuugaguguacuuuuucuaugaagcucccuuccuauuucuguugaaaaaauaauugaaugaaguuuaaauauuguagaaaaguaacugacaguauugauauucugacuuuaacccucugauuuagugucguggugaguguuacaauauuaauuuuuacuaaacacuuaaguaugauuucuuuaaauuuuguggcugcaaugauugcauuuuuaaaguauccuuaaaacugacuucuucagcaaucaaucucauaucuucaguuuuacacuccagaggagcccuagccuccuuguaaauaaagggcucuaaaggagcucauggaaaucaaauagugcagcugaagucagaugauauuucauugguggcuuguaguucacuaacucucauuccuaauucccuggaauuuuuuuuuuaaaaaaccugccuugugaagguaagguuauucaucaggaacguaaaauauuccuauagcauauucaguuugagacacgugauuauacaacaaauuuaauuguucuguugguguuuccuuucaugguaagugcuuuucaacgccucguguucauuuuuuaugagguauaugagaauuguauguggugguucuauuuuuuaaagauucucuuuaaaaagagagacuauauuauaaaaauauaauauuuuuauauauaaaaauauaauauuuuuauauauaaaaauauaauauuuuuauauauaaaaauauaauauuuuuauauauaaaaauauuuuagaagcaaagacaucuuauuauuucacccauucccagacauaaauaaauaaauucauacuaaaauggaguaauuuuuucggcuucagccugggcaaaacagaaaguggaggguguacgcauggcuggagucaauaaucauagaucagcucucuuuuuauuuuccaauucuaaagaguagaugucgcucuagacucaaauuaggaagauagagaucauagugaugugggcuggaucuuuaucugugacuuucuguguccucaucauuucuaaagauuagcuucagacgucacucugauucauuguguucccauuuucuuacuuuuccauucacguccauuaaaauaaaaaccaaaauauauauugcagcuucaauugcauaugcuugaggagagauuaguuacaauuuuuuauuguacccuaauuuggauucuagaauuauggcccuaugcccaacuucaacugaaaugaaaugauacaaagaacuccacaaauaacugucaauccuuggauacaguuuauauauuucauaauuccaauuagauaucaucgcuuugagucccugccuuacccuauuucaguauuacccaaauaaauaggcacaacuaucugacagcuauagcguuugacuuauggcuuauaaaucagcuuuauuauuucauuuucagcucuguuugauugaaacccuuuuuggucaauuuauauaauucuuuuuggagcaauuuuuccuccuuuguuauauaaucauuuuagagcacguuccaaacauuaccaaauccagauuuuagguaucaaaagucaauacucuugauauuaguaucugugucucauuauguugacucuucauguacaucucacuacuuuuuaaaaaauauuuuuauuuguaauuuuuuugguauguuguaaguguauauauuuauggguuacaugagauacuuugauacagacaugcaguacauaauaaccacaucagguuaaaugggguguacgucauuucaagcauuuaugcuuuguguuacaaacaauccaguuauacucauugcguuacuuuaaaauguacaauuaaauuauuuuugacuguagucaccuugcuguguagcaaauacuguuuuauucauuuuccuuuuuuuuuuuuuguacccauuaaccauucccauuccccucacccccaccacccuuccuagccucugguuaccuccuagccucugguaaccauccuccuagucucuggcuucauguguucaauuaguuuuuucugauuuugugaagagugucaaugguugagcaccuuuucauacaccuguuugucauuuguacauacauauauauauguguguguguguguguguguauauauauauauguauuuuuuuuuuuuugagauggggucuugcucuguggcccaggcugcagugcaguggcacaaucucggcucacugcaaccucugccucccagguuccagcaauucucagccuccuggguagcugggauuacaggcgcaugccaccaugcccggcuaauuuuuguguuuuuaguagagaugggguuucaccauguuggccaggcuggucucgaacuccugaccucaggugaucugccuucgucggccucccaaagugcugggauuacaggcgugagccacugggccuggccugucguuugcauauuuucuuuugaggaaguucaauucagaucuuuugcccauuuuuuaaucagauuauuagauauuuuuccuauaguguuugaguuccuuuuauauucuaguuauuacuccuuugucagauggguaguuugcaaauguuuucucccuuucuguggguugucucuucacuguguuuuucuuugcugugcagaagcuuuuaaacuugaugugaucccauuuauccauuuuuacuucguugccuguguuuaugggguauuacucaagaaauuuuugcccagaccaguauucuggagaguuucccaauauuuucuguuaguaguuucauaguuucaggucuuagauuuaagucugcaguccauuuugauuugauuuuuguauaugggaagagauaggggucaaguuucauucauuuccauuuaaguaucuaguuuucccagcaucauuuauugaagagacuguccuguucccaauguauauucuugucaucuuuguugaaaaugaguuuacuguagauguauggauuuaccucuggguucucuauucucuuccacugaucuaagugucuguuuuuaugccauuaccaugucauuuugguuacuacagcucuguauuauaauuuuaaguuaggcaauaugauucuuccauuuuguucuuuuugcuuaggauaguuuuggcuguucugggucuuuugugauuccauauaaauuuuaggauuuuuuuucuauuucugugaagaaugucuuuaguauuuugauagggauugcauugaaucuuuagauagcuuuggauaguguggacauuucaacaguauugauucuuccaguucaugaacauggauuaucuuuccauuuuuuuguuuccucuucaauuuuuugcaucaguguuuuauaguuuucauuguagagaucuuucacuucucugguaaguuaaauccuagguauuuacuuuucuuuguagcuacuguaaaugggauuacuuucuugauuucuuuuuuagauuguucacuguugguauauagaaaugcuucugauuuuuauguguugauuuucugcaccuuuacugaauuuaucaguucuaguaguuuuuugguggagucuuccaguuuuuucaaguacaagauuauaucaucugcaaacaacaauaauuugaauucuuccuuuccaauuugcaaacccuuuauuucuuuuuuuuuuuuuugucugauuacgcuggcuaggauuuccaguacuguguugaagaacaguguugaaaauaggaauccuuguuguguuacaggucuuagagaaaaggcuuucaguuuuucaccacuuaaaauaauacuagcugugaguuggucauauauggcuuuuauuguguugugguauguaccuucuguacccaguuuuuugaggguuuucaugaagggauguuggacuuuaucaaaugcuuuuucagcaucaauugcagugaucauacgguuuuuguucuucauucuaaugauaugauguaucacauugauugauuugcauauguugaaucauccuugcauuccugggauaaaucccacuuggucaugaugaaugaucuuuuuaauguguuguugaauuugguuugcuaguauuuuguugaagauuucugcaucaguguucaucagggcuauuggcugugguuuucuuuuugauguuuccuuugauuuugguaucaggguaauacuggccucacggagugagcuuggaaguguucccucauccucuacuuuuuggaagaguuuaaguaggauugguguucuuauuuaaauguuugguagaauucagcacugaagccauuggguccuaggcuuuucuuuacugggagaccuuuuuauuauggcuuugaucucauuacuuguuauuggucuguuuggguuuuggauuucuuuaugauucaaucuuaguagguugaauauuucuaggaauuuacccauuuguuuuagauuuuccuauuuauuggcauauaguugcuccuaguagcuacuagugauccuuugaauuucuguaauaucagcuauaaugucuccuuuuucaucucugauuuuauuuauuuugaucuucucuccuuuuuucuuacucuggguagagguuugucaguuuuguuuuucuuucuuuuuaaaaaacaucuuuuuguuuuauugaucuguuguguucucauuucaaauucacuuauuucuacucugaucuucauuauuguuuuucgucuaauuuuguguuucguuugcucuugcuuuuguaguuuuuuaagaugcauuguuagguuguuuauuugaaguuuuucuucuuuuuuuauauaagcacuuacagcuguaaacauuccucuuaguauugcuuuugcuguaucccauagauuuugguguguuguguuucuguuaucauuuguuucaagaaauguuucaauuuccuucuuaguuucuacauggacccacuggucauucaggagcauauuguuucauuuccauguguuuguacaucuuccaaaauucuuuuuguuauugauuucuauuuuuauuccauuguggucaaagaagaugcuugauauuauugcacuuuuuuugaacguuugaagacaaguuuugugaccuaacaugaccuaucuuugagaaugaucugugugcagaggaaaagaauguguauccugugaccuucguaugaaauguucuguaaauaucuguuaggucgauuuggucuguaguguagauuacgugugauauuucuuuguuacuuuucuaucuggaggaucuguccauugcugagugugguguguugaugucuccagcuguuauuguauuggagucuaucucucuuuuuaucucuaauguuuucguuuuuuuuuuuuaauuuucuuuucaagguguuuuuuuuuugaauuuuuaaaauuauuauuauacuuuaaguuuuaggguacaugugcacaaugugagguuuguuacauauguauacaugugccauguuggugugcugcacccauuaaccugucauuuagcauuagguauaucaccuaaugcuaucccucccccguccccccaccccacaacagucccuggagugugauguuccccuuccuguguccauguguucucauuguucaauucccaccugugagugagaacaugugguguuugguuuucuguucuugcaauacuuugcugagaaugaugguuuccagcuucauccaugucccugcaaagggcaugaacucaucauuuuuuauggcugcauaguauuccaugguguauaugugccacauuuucuuaauccagucuaccauuguuggacauuuggguugauuccaagucuuugcuauugugaauagugcugcaauaaacauacgugugcaugugucuuuauagcagcaugauuuauaauccuuuggguauauauccaguaaugggauggcugggucaaaugguauuuguaguucuagaucccugaggaaucgccacaccaacuuccacagugguugaacuaguuuacagucccaccaacaguguaaaaguguuccuauuucuccacauccucuccagcaccuguuguuucgugacuuuuaauguuuucuucauauaucuaggugcuccacuguugaaugcauauauauuuaugauuguuauauucucuugcucaguugaccucuuuauuauuauauagugaccuuauuuuucucuucuuacaguuuuugucuugaaaucuauuuugacugauacaaguguagcuacuccagcucuuuuuugcuuuugucgccauggaauaucuuuuuuucaucugcuuauuuucagccuaugugugucuuuauaagugaaauguguuucuuguagacaacagauaauugggucuuguuuuuuuauccauucagagccacucugugucuuuugauuugagaguuuagugcguuuccauuguuauuaagaaguaaggauauguucugccauuguauuguuugucuuuugcuuguuuuguggucuucucuuccuuucuucauuccuucauuucuuuuauugaaggugauuuugucuugugguaugauuuaauuucuuccuuuuuauuuuuuagguauauguuauaugguuuuugauuugagguuaugaugagucuugcaaauauuaucuuacaaccuauuauuuuaagcugacaaccacuuaacauugcauaggcaaaaacacacagaggcaaaaagaaaaccaauaaaagcucuacacuuuagccucuugcuuuuuaacuuuuuguugucucuguuuauaucucauuauaauuucuaugucuugaaaaguugucauuauuaguuuugguugguucaucuuuuagucuuucuccuuaagaucagaguauuuuauauaucacauuuacaguguuauaauaugcugcauuuuuuuguguacuuacuauuaccagugaguuuuggaccuucaguugauuucuuauuacucaucaacuuccuuuucuuucugauugaaaaacucccaggcuggacacgguggcccaugccuguaaucccagcacucugggaggcugaggugggcugaucccuugaggucaggaguucgagaccauccuggaaaauguggcaaagcuccaucuguacuaaaaauauaaaaaauuaguuggguguuguggcgagcaccuguaaucccagcuaccugugaggcugaggcaggagaucgcuugaacccgggagacgaagguugcagugagccgagaucgcaccgcuguacuccagccugggugacagagcgagacgccaucucaagaaaaaaaaaaaaaagaaacagaaaaacucccuuuagcauuuauuguaggauagguaugauguuuaugaaaucccucagguuuuguuugucugggaaagucuuuuuuucuccuuuacguucagaggauauuuucaccagauauacuauuuuaggguaaauguuuuuuuuucuuucagcacuuuaaauaugucaugacacucucuccuggccuguuagguuuucacugaaaaaucugcugccagacagacauauuuggagcuccauugaauguuauuuuuuucuuuucucuugcugcuuuuaggauccuuuuuuuccccuugaccuuugggaguuugauuauuaaaugccuugggauagucuucuuuggguuagaucugcuugguauucuguaaucuucuuguacuuugacauuaauaucauucccuagguuugggaaauucucuauuauucuuccucuugaccaacuuucuacccucaucuguuucucugccucugcguuaaggcuagugacucucagauuugcccuuuugaggcuuucuugauccuguaggugugcuucacugguuuuuauucuuucuucuuuugucuccucucauuguguauuuucaaauaaccugucuucgaguucacuaguuccuucuucugcuugaucaguucuguccuuacaagacuuugaugcauucuucaaugucaguagcauuuuucaacucagaauuucuacuugauucuuuuuaauuauuucaaucucuucguuaaguuuaucugauauaauuuugaauuccuuccuugugguauguugaauuucuuugaguuuacucugagcaguuacuuugaauucuuugagaggucacauaucuguguuucuccaggacuggccccuggugccuuauuuaguuuacuuggugagaucauguuuuccuggauugucuugaugcuuauggauguucaucugucuaggcauuaaagaguuagguauuuacuguagucuuccaagccuaggcugguuuuuacccauucuccuugggaaggcuuuccagguauuuggaaggacuugagcauugugaucuaagcuguaucugcauuagcagacaccccaagcucaguaacacugugguucuugcagacuugcagagguacugucuucauguucuuggauaaaauccagaggaauuuucuggauuacuaggcagggacucuuguucucuucccuuacuuucuuccaaacaaagggagucucucuguuuguucugagccauguggagcuguagguagugugacagaagacucucuguuguuaccaccucuaggacugugcugguucagaacugaagcaagcacagcauuagaucucaccuaacgcuggcccacuguaaccacuacuuggcuaccagauacuauguuugcucaggccuugggacacuacagucagcagauggugaagcuagcuaggcuuguguccugcccuucaugauggugaguuguugugggcccaggugcguacugagguaccauccaggagcuagggacuggagugagaaaccuuagaagucuuucugguguucugcuguccugcagcugugcuggcacucaaaccagaagacacaguacuucucaccuuucuuucccauuucuacuggcagaggagccucagcccaugaccgccacuacuacaggcucauggagaauacugcugggcuaccaccaauauucaguuaaggcccuagggcucuuaagucaguuuguggugaauagugccagccugggacucacccuucgggacacugggcuccccgcuggcccagaacugguaaagaaaugcuaagagccaaggccuggaauugaggaccccaagauccugcuugguacuccaauuccuguggccaagcugguaccuaaggugcaagagaaagucaccuuuacuuuccccccuacuuuucuuaucagaaagaaucucuccuuguggccaccauuaccuaggaaugugcugacuugcaacuaaaguuagcaagucucggagucucacccaaggcucacgggguaccaucuggguaucacugcugguuauucagggcucaagggcuguuuagucagcagaugaugggucuugccaauacuggguccauuguuucaaggcagugaguucccuuccggccaagggugugucuagaaauguccaggagcuaggcccugcaauggagccuucaugacucugcccagugccauguccuacagugggugagcugguauccaagaugcaaggcaaaguccuuuuuacucucucuucuccucuccucaagcagaaggaagggaucucuuuaauugagcucugcugccugaaauugaggucggagguggcacaaguacuuccucagcugccucgacuggugucucaguaaguugaauguccaguggcucugagcccaguccagcaccaugacucgccuaggaguugcaguucuuguggccuagacugccuuucauguuuauuucgcaccccagaguacucuagcccgugguggcaaggcuugcuggaacugggaugugugaucucccucugacguggacugguuaaauauucccucugugggcaggcgccaggucagcucagccagguuugcuuucucuuguaacugggcagcacggaauucagugcauucucuuacaauuucugugcucuccugugccaugugaccguugccaggggauaagggaggggcggcguuggugauucaagacuguuucuccuaccgucuucagugccucuuucagugauaggaaguuaaaaaccagguacugugggugcucaccugauuuuugguucuuaugaagguacuuuuuuauacagaugguuguuaaauuugguguuccuccagaggggaugauucguggagccuucuauuuggccaucuuguucugcccugucuccaaaauccucucauuacuuuugacuuaaguuucuacaguuugugucuaaucugugcaucaguuucuccugcaggcuauugcuaauuuaaaauuuaaugccaauaugcucaccauaaaaauguagaauuuggagagcuuucuuucuggguuuccccccaccguuuuuuuuuuuuuuuuuugccuauacugaaaauuguuaaggcuaaguauuucugugaaauacaucaacacuacuuuagggauauacuuuuaauuaugaaggaggauguuaguuaaaugccuggaauauguugauaaccuaaauguuuaccucuauuccaauaaauuauaauccaaguccuuaaucuucuguagaguauuacaagguaauugcuaauaaguaauaggagaauuuuuugugugaucuucugaagaauuuaaauuauaaaauucuaaagaguaaauauaaaaauaaaauuaauauaagaauaaauuaauaaacaaaaaggaauguguguaagauuauuuuuuaauuugggggacaguauagcauuugguagauguuucucuccaggaaauuuggauguuucuuccaggaccuuucggggacugagggcugugggauuuuguuagagugccacaaauaugaaugagaacugcaugugaagauugauaauguaacaucauagaaagucacagaauguaacauccaacucccuuuuaugacuuugaccaaucaugaguugccuggaaucuguacauggcagcauuaagccuauggugucauuguuuauugccaguuugaaaaacuccaaauaaaguaucaguugugcuauguccuucuagggagcuuuuuuguuaccuuaaagaauucuuggaggucaggcaggguaaauacaguagccaguauaccuauaaucuagauauuaaaucaaaauugaaggaagauguaaaaguaauauaaugagaagauuuggcuuuauuaaagaucuucagccaagguucuuuuuggcccuagaauuuguuuauucuggcuugcuuuguauuuccauuuugcuuuaauuaguuugucuuaaaaauuagggaccuuaaauaaaacugaauuuacuuacucauugcauuuuuuaaccuagaggugguggguaagagaaauauagaagaauaacaugugacacugauaaauacugaccagaugacuaauuacaugucauuauauauuuucaucauuauacaucauucaucuaugaaaaugcuguguuugauaguauaaugguaaauauaugucauuauacuuuuguccaacccauagaauguacaacaccaagagugaauccuaaacuaaacuguggauucugggugaugaugugucaguguagguucaucaguuguaacaaaugugcugcucuggugggggauguugauaaugauggaagcuauguaugugugcaggcaagagauaauugggaaguuucuguacccuucaauuaugcuaugaacuuaaaguugcuauaaaaaauaaagucuaauaaaaaaguuauuuuaaggccuuacuguaacccugucugcuuugaugcaaaguacauuguauuuuaaauuccauuuuauuucaauauaugccuuacaguuaauucaggagaauuugaauauuuaugcuugauaguaauauaguacaacaaaaaaagcagcuauccauuauaccauuauaguuuuggaugacuauugccaugcuaucaaaaacuagauuuuguaaugaaaaauguaagagcacuuuauagguuggaauucucauuccauauaauggaaugcauaaacuagguaauuaugcacauuuauuauuuacugaaaagcauuuauuuuacucugcagaaucauaaagaaaguuguauuuauuauguacauauaauaaacauaacauucuuuuucuuuuucccaaaaugguuuuaagaaaucaaaacccaaacaugaaauggguuuccaacuuagccauacauguauucauuguguccuuuauuuuacuuguuuauuuauuuauuuauuuauuuauuuauuuauuuauuuauguauguuuugagauggagucuggcucuguugcccaggcuggagugcaguggugugaucuugguucacugcaaccucugccuccuggguucaagugguucucuugccucagccuccugaguagcugggauuacaggugcacacccccaugcccagguuuuuuguauuuuuaguagagacaggguuucaccguguuggccaggcuggugucaaacuccugaccucugguggucugccugccuuggccucccaaagugcugggauuacaggcgugagccauugcaccuggccaguuuuuuuaaaaauuguaguaacaauuagauauaagcaaacuauaucuugaugaucacuuggaauuagcuuuccuuuuccacuuacaaagaauggaauauacaauuggagugauuuuaaaaaaaacuauuuugguggcuguuuauguguacauauauacacacacagauacauauauauguauauauaaacagccaccaauauuuuauauauauauguguguguguauguguguguguguguauaaaauauugcuugguuauaaguaaguggcaucugcauauuaaguaaugguugccacuaaugcccuucagugcugcacguggccauuuuauuugucuucugaaccaaagugaagucauuugucugcauaaaucauaguuauagaauuaacuuccagaacuaucugagguguaauggucuucauaaaucccacuccccuaguacugcuaaauuuugugagcuagagauuguaagugacuuguugaaaaauauuuaucagaccucuggaacuuuggaguauaccuuagucuacuuuccaaccuuaaguuucagguaaagacaauucaugucuuagaaaacugguaacucuugacaucuuugugaaccacgaagcuccaaccccuguaacucuguauuuacuuuuccauaauauuaggcagguggugaaagaauguuagguagaaucuuugacucccaacacuguuugaagcugaguccaauaaauugagcguaauuccuguagauggaggcacaucucguaagaagcaaccuaacuccauucaguugaaucugaaggcaacuuucuguccugucuacagcaagaguuagcuuaggguagagauuauuaaagaaaauuuguaugguugaggauuauguuacuuuuauuccagaacacaaccuuuauuaccccuguccaaccucccaaauaaaaauaaugaugcugauaauugauguuagaaauuaccaagcauuugucucuuggaaucuucugcuuuagagaaaguaguuucauuuucgaacuuuggaccuauguguucagaauaacuauggauuuucauguaagcuaauauaacuagcagggauagacuuuucuuuauuuccacagaacuugauaccgauaaaggcuaaggaauucuucgucuaucucagaagccucguuuuacaacuaaugaaccggaggguguuagaguugugauuccuuugcccaggaucacucuuguguguccuaagagaaccaggaugccagaccaucucauucccaggccuugccuccucugcucagcuuuuguuuuuggaggggaaagaaggccaagccacugaccuaauccugaacaauguauuugacuaguuuuuguuuguuuacauugaaaauaaagccagcacuaacuucuggcguuacugguuuucuacuuaacguagaauaauuagcauuauugguuggaugagcagguucuuuucccuuucauauguacucuagguucugccuagaggaccuuucccagaacuggauaacgucuugaauucaauuucccaacugacaacagcauuggcauuuuucuuuuucgaagagcucugaagcggcuuuguagaucagagcgauugauuuugagaucagauuggcuuauggccuugagaguucaugguggcauugcuguucccucugaucuguuuuaugcuggauuuuuuuuuuuuuuuuuaauuccacgggauacugucaagaccaggugaugagaggcugucagccugcaaggccgacuuugaucuuuauacaaaguaaaacuaguggaaaaagaaaggcccgguucuugucaaaggcaggacauucaccauugggcggguagccaagugguugcuuuugcuaucuuauucuucccuacuguggugucucuuaaaacacuggacaggacucuccucucucauuugagguaauagauuuggcuucaaaaucaccucuugccuccugagguggcagauuauucugaauugcugcagacuuaaaccuuggccugcaaaggccauggugguaauaauuauuucacuuuaaccaaacagaagagcacauaagaggauaucaguuauccugacagcauagcuaugauguggaagccguccuguuagggaacugcugaguggcuaaaaagucacaaaucauuuuucucuguucuuuccucuuucuuuugcucaauaacaccccccaccucugcucuguaauggagagaaauaaaaagaaguuuagauagcuuacuguaaguggaacuguauucauaaauagcuucuugauugagaacaaaugccucauuaaucuuuagugcuucaacuagaaagcacaaguaaagucaagaagaauaaugagugacauuacagggagccuaacauacuguacuacacaccaggcugugcuugccuggaggucacugggcugcaaggcacaucucuuuugcaaugaggagagagauccccaggaagaguguggaaaaacugcagugcaggcauuucucuugaguggcaaaaauuaauucagugacaugaugaagaaaucauguacuuuuuuuuuuuuuggugguggugguggggcaucaguuggucucucaaucugauuguugcuuuucuuaaaaaauuguuuuuuaaauugacauaauuguacauauucaugggguacacagugguguuucaguacauacaauguauagugaucagggcaauuaacauauccgucaucucaaacauuuaucauuucuugauguugggaacaugcaauaccuccucuagcuauuugaaauuguauguuauuguuagcuauagucauccuacacugguauagaccacagaaauauagaacuuaguccuaucuagcuguaauuuuuuaucuuuuaacacaucucucccaauuccuccuuucugucuauccuucucagccucuaguaucguuuuacuuuuuacuucuaugggaucaacuuguuucagcauccacauaugagugagaaugugcaguguuuaauuuucuguuccuggcuuauuucgcuuaauguccuccaguuccuuccauguuguugcaaaugacaagauuucauuccaugguguauacaugccacauuuucuuuauucaucuuucauuggauaccuagguugauuccauaucuuagcuauuuucaacagugcuacaguaaacauagagggggcauauaugucucuuugauauaaugauuucuuuuccuuugcauaaauucccaguagugguauugcuguaucaugugguaguucuauuuguaguuuuuugaagaaacuucauauuguucuccaugguggcuuuacuaguuuacauucccaccaacagugauaagaguuccuuuuucuccacguccuuaccaguauuuguuacuuuuugucauuuaauaauacacauucucacuggggugaaaggauaacucauuguaguuuugauuuacauuucccuggugauguuuacccuuucuuuuuguauauuuguuuuccauuuguauguauuuugugaaauguauguucagaucauuugcccauucuuuguuucuuuuuguuuguuuguuuuugagacagggucucacuuccauugcccaggcuggaguuuaguggugcucucucagcucacuguauucucuacuuccugagcucaugugauccucccaccuuugccucccaaguagcugggacuacaggcacaugccaccacacccagcugaguuuuuguauuuuuaguagagaugagguuuugccauguugcccaggcuggucuugaacucuugggcucaagugauccucccgccuuggccucucaaagugcuaggauuauaggcaugagcuaccaugccuggccauuugcccauucuuaaaucagauuuuuuuuuuuucuguugagauguuugaguuccuuguguauuccagauaguaauccucuuuuucagaugaguaguuugcaaauauuuuuucccauucuguaguucuucuuuucacucuauuauuuccuuugcugugcagaagcuuuuucgcuugauauaucccauuuguuuauuuuugcuuuuguugcccuugcuuuugagguuuuauucauaaaaucauuucccagaccaauguccugaaguguuucccuuauguuuucuucucauaguuuuauuguuucagaucuuagguuuaggucuuugauucauuuuaaguugauuuuuguauagggugagaagugggagucuacuuucauucuucugcauguggauauccaauuuuuccggcacuguucauugaagagacugucaauucccuaacgaguguucauggcaccuuuguccaaaucguaugacuguagauaugugggguaauuucugggcucucuauucuguucccuugauguaugugucuguuuuuaugccaguuccaugcuguuguugguuacuacagcuuuguaguauauuuugaugucuaguagugugaugccucuagcuuugauauuugcuuaagcuugcuuuggcuauuugggaucauuugugguuccauacaaauguuaggguuauuuuuuucuguuucugugaagagugucauugguguuuugauagggauugcauugaaucuguagauugccuuggguaauacugucauuguaacaauguuaauucuuccaaucuaugagcuugggauguuuucccauuuauuuguaucuccuucaguuucuuucuucauuuuuuuauaguuucucuuauaguggucuuucaccuucuugguuaaauuuauuucuagguauuugaaaucaaguacuuugcuguuuguugucaguggucaugcugggaagaaagaauaagccagcuggguuuuuauuugaaaaccaaauguuguauaacguuaacaaaguaaagauguauguucaucuuggagucuuugcucaggacccuggaaauacuauuauguaaauguuguaagcuccauguagaguacuucugaccagucuuacauguuucuugccacuuaauaugugccuggcuuguaacauagcuaccagagcggugcucugaacaccucaaauuaauuuucauagcauuguaaacaaacagaacaugauuuucuguucuucuguucucuuuuauguaaauugucgucugcugauauuuaaauagauaaaauauaguaaguuuacuugguuaguguuguaaauuagaugaagaaaaacuaaauuucuguaaugcaaaaaauacugaaugaaaauucaguuuguauauuaugacuuucucaauauuuucaguugguuagaauucaagccuacuucacuuaaaagauuugucugcaccaccccccgauauaagucaacugugagggcaggaucuuugucauucacuguguugcucagggucuagagcacaucauggugauuaauaguuguugaauuaaugaaugaauguuuucacuaagugagagaacuuacuugccaguacagaauucauuacaggugaauuuuggauuugcaaauuuguggaauuuccauuuaaaagguacugcaggacacuugucauucaauuauauaaucacucagaacucauaccagcucuguccuucggugagagauccugucuucucuccagcccugauaaugagccacauauccagaaaugguucucccaugucuugcugaucagcacggguuuucuguuaaugugauuaauuacucuuuguuuucccagcucagagagcccuauuuuacgguuuuguguuucuguuaugaacgugucagauaaaugaggguguguuuguggggguacuucaaucuaauuauuuuucuaugacacugaaaauuggcuuuaguggcacuuauggauaugcuacuaaaaugagagcuuccuacaaugcagcuugagaauguugguauuggcauuucuuuaacugauguuuuauagaagagacauuggaacaugauuucccucggcugcaaauaaugaacaacugugacagccauauuacaacaaugcuguucucaccacugucaauguugugucagcauuuugauuauaaauacucuuuuccaugguuuaauaacugaggcauaaagaaaucauuccauguuaugaauugcuaugcuaacuuuucaucucaguggugauuuuuuaugaaaccaaauuuuaaaaauagcuggcauuguuaaaaggggauuuugucagugguauuaggugagcgaaagggaccucaucaggaaaaguacaaaacuguucagaauaugaucagauuuuauauuuuuucauuuaucuuuuaaccacccugaggaaaaaaauauacagcagaaugguuuuuuaaaugcuguucuuuggagacagaaauaacagcugccuuauagaguaaucauguuacaacaggcauuuuaguauauauauuuucuguuuuguuuuggggaacauuggcugacuagcaguauagccagaucuuuguaauagugaaucauuuuaugcuggguguuauuguuccuggaaaagccaugcucauuaaacauaaaacaaggcuggcaaugagcacagacuguuugauuuuauuuauuuauuuuguucuguaaggaugaacaguuuugauaucaccguagguuagauuggaaagaaguuauaguacacugaaagagucuggaagagaucauaggugccguuuuaaauuuucaucuaauuaaaagaaaauagaaaaaagauauaaauacccacagucacauuaauuuuaaauuguacguuucuuguaaaaagguuuaauuucuuuaugugugugucugugaguuugcuuucuuuaauacaaaggaacuagauauuaucaagaaagucucccauuuccaacacucucaaaaucucaaauuucauuuuuuacagaaaacuacuuaagcuguuuugucaguuggccuuucagcucuuuucuauguauuauaaucugguguuauggcuugcuguaugggacccaaaugauaucacaauuuauuuaacuuuccuuaguguuuucccuucauacuacuuguuuuaauucuuaguaucccaguggcuguggauuuaccaugucguuuucauuacuguuugaaauuuuaagcuuuguuauaaaaauuuugacauuacaaauaaaauuuuggcuucugauaauuccaguucccaccagagguaacuauuuucuccauuauaaacagaaaugaaauuauagucguuauauaguccuucuccauagauucaaauauuuagguuagauuauaagaagucagccugcugagucauuauuucugugcauuuaaauuuuaauggacaauguuaaauucuucuccguaaccaucauaacagcuuacaugacccccaaacuagauauauucugauuuaaaauguaagguuagaucucauucuuuuccuuuuucauuuucuuuauucuugagguugguuuucuuuucaugugcuuacuggcaaugaagagccauugaacuuuuuacauauuuuuuguaacugugggcuuuaaaaaauauuuuccagaaaacaauuuuugauauauguauugggaguauuuuuguguuauuuuauguuaauuauguuguauuuuauucuuuaugauuuuuaaauuuugauauguaucuuuugucuuuuaaaugucuucuuaaggagccguauuuguccuaacuucaucaguauauuuuccuauauuuucuuauaauacuuuuauaggucuguucuguuuuuaaguuuaggucuguaaaucaauuggaguauauuuuuuaugagugagggacauaacacauaaacacacacuccauucaguuggaucuggacauuuugaauacuguuacugaauaguuuuuggugugagguuuugguuauuuauucagcucugucuuucuccucucuaauucuguucuuaggaguaaucugcuauucaacauauuauuuauaagucuaauuucaauuuuuuuguagaauucuguaugguugauuucuaaaaauauaauuugucauuuagagucucuuuuuuauauuuuuaauauacuuauuuuuaaaaacuuauuaaaauacagcugacccuugaccaacauggaagucagaggugcugacccccaguucagcuaaaaaucugcauauaacuuuggacucccccaauaccuaacuaguaauagcuuacuguuuacuggaagccuuauugauauaacacaauuaacacacaguuuauauguuauauuuauuauaugcuguauuuuuacaauaacuuaugcuagggaaaagaaaauguuauuaagaaaaucauaaggaagagaaaauauauuuauucauugaguggaucaucauaaaggucuucauccuuguuaucuucauguugaguaggcugaaaaggaagaggaugagggguuggcccagcugacucagggguggcagagucuauauauaaauggccccaugcaguucaagcuuacauuguucauggguuagcucuauguauuuugcauuuuguggcucauaucauuuugcaucuaauuccacuacuaauuuuugcugauagaaccauguuucuuguguuuuauugaguuuugauugugagcuuauguuucuuagaauucaauacugggaaauuuuuagaggccuuuguuauaagugguugccaaaaauuacaauuuacauuuuugaaugagcacacucugccuucaaauaauauccuacuucaugaacaguguaagacucuuaaaacaguauaacuucauuagcacuucccuuugauuuguggucuuaucuuacauuuuacuucuucauauacuauacuccacaguguuauuauuuuuguuuuaagcauuugucuuuuaaugaaauuuguucauucucucuuucccuuuccuucccucccucccucugucucucuuucccucccucccucccuuccucuuucccucucucucuaccccacucugugugugugugugugugugugugugugugugugugcguguguaugugucugugugucuguuuguugaagauacuaaaaaaugauuuuauauuuacccagguauuuuuggaguucuucauuccuuccugcugauccuugguaacgugugauuucauuuuccucauucugaagaacuuuauuuuggcauuuguuaugauguggaucuccuggggacaaauucuguuagauuuuuaucacacugagaguguuucuauuuuuccuuuuuuuuuaaaagguuguuuucuugggagguagacuuuuaggcuggcugcuuuuucuuguaguauuuaauagauauuauuccauuaccuauuugccuucacaauuucagguuagaugucacuuguaacucauauaauuguuuacuaaauguggcuuuuuuuuucucugauuuuaagauauguucuuuuuauuugguuuccagaauuuugauugcuauguagccagguauguuuuauuuauauuuaucuguuuagaguuugcugcaauuuuuugaucuguagguugauaucuuuuaucaguuguggaaaauuuucugucaauaucucuuccaauauuaucaccccuuuucucuuuuuucaccuuuuaguacuccaauuauacauaaacugaguaguuuuuuuuuuucccuagaucuguauugguuuuuaaaauucucuuuuugucuuucaauucuauacauauggcccucuguauccauggguggauauguggauucaaccaacuguggaucagaaauacauuuaggccuauaaugguugugucuguacucaacauguacagacuuuuuuuccuugucauuauucccuaauugauacaguauaacaauuuacauaucuuuuacauuguauuaaguauuauaaguaaucuagagaugauuuaaaguauacaggaggauaugcaugguuuauaugcagauacuaagcuguuuuauauaaaggacuucagcaucucuggauuuugguaucugugaggggucuuggaaccaaucucccuuggauacugagggucgacuguacuuccuauucauuugucucuauagucauuaaacuuuuacucugccaauuccaguuugcuucucaaucuguugaaugaaaucaacauuuuguuuuuuccuaucuugaucauaaaugauuuuuuuuugcuuuuuauuauaucuuguacuuuuuugauugugugcuagacauuuugucuaugaugacugaaaugaguauuauuauuuccagaaagggugugcugcuuuuucucuuagguuccuacaguggggugaagucaaucugauuuauauuugagcugggcaugugcuuuauugcagcuuuaguuugauuaaguccacucagguuucagguguuuugagggugggauuaggacuuucccuucugcagggucuguuaucugggcgcugaggagauucugaagaucugccugccuuucauaguugagcuggcagcuuuuaagaacuauggaauaucuuuugcuguuuagaccacaguugccuggacuuugaguuccuggagaguuuucuuuucucuccacuucuauuucuugcuuuuugcaccucaagaggauuauucaucacagauccauauuuuuuuguuucccgcuaaacagcuacacugagauuauggacugacaauguuauauuuauguuaucuagaaccacaguuaaucuugugcauguuuaacuacuguaccuuucguauuuaguaugugcuuagggaauguuuuacauacauuaauuuagggaaguacuaauuuuuuccucuacagauaaaguaucugaggcacagagguugaguaacugaucacagucauaagaguaauaaauggcagaacuuuuauuugaaccuggccaucugcauuauauuaaacauugugauaugucauggcucuccaguuucacuguuguuccucucaguuaaauuugauucauuuagccugagguuauauugcguaacauaacuaaaaucuugguuuguuuuaaaugguaucauuacuucgaaggauaaaguagggaaaacuuaaugauguuauaccaaugagauguuuuauuagcuagauuaaugaaacaaauaggaacacaaauuguuauaugcugucggguaacacaauuuuuuaugauauggguucuuuugcagggauuguguuuugaaaaggaguucuugauuauuuauggaaaugagcaaauggagacuuaguaaugccucuaccaguaucaucuucgugguuuguuuaaguacauacaggaacuuucuucuugucaguugugaacuucacagggcaggcauugcuucuuguuuauuuuugcacucuacuuugauaccuuaugccuugccuuaugcuuuggggcagaagauguuagagaaaaggugcauggacauuuggauuaggcagacauaaguuugaaucucaauuguucuccuugcugauuggaucagauuuuggaaugcuuuaacccaugguccugaucuagcccacugccuauuuuguaaauaacaauguuguuggcauauaggcacaaccaguagcuuaaauauuuuccuccagaggcagaguugagugauuacaacuacucuauaguugugcaaagucuaaacuaguaaauaucuagucauuuacagaaaaaguuugauaaccauuggguuggaugauuuuaggaauaucacuuaaucuuuugaaucugaguuucuuuaucuauuaagugaaauaauaaauuacuuaauaaguuugugauaaagaagggaggugaaguauaugaaauuuuuggcaugguacguggaaugcauuaggcuuucaauacaugucucuguucuucuaauuuuuauucuugauaucaaguuuaaugacucagugucuugauggauacucuagcacuuuccuaccuucuccuuaaauucuuucauugaaagauuuggaggaaaaugauacagguacaauuacuguuuuguguagugccuuacauguaucagacauuguagauucuuaagaaaacuugggcugcuuuuugagugagaguuaaccuguuaauuuuuagaguuaucaauucuguucucugacaguaaaguacuauuuaaaaaaggaaagaaagguuaaaaauugucuuaucuguuauguuuucuacugggcuuuaaucauaggcauguaaugaaacuacaaaugaaugaauggacagguuggcaucuuuauguuuuuaccagaucaacuaguuugacccucugagggccauugagucaaacaaaugauguaacuugacaugacuuugguuguuuccuacuuuuuuuuuuucaaaauugggagaauagaacagaaacugugauaucauauaaauaacuuaugaguguaccuggccaugaauauuuuuguucuucacaaagaaauaagauuucuuaaguaaaucauggcaaaaauaacuuugucaacucacuaaagcuugcagcauacuuuacuuagaaagucccaguaugugaaaauggucuuugcauuuuauuaauccuuugcuaauuuucaagauuuucacucuucccuguuuugccauguuuuguuauuuauuuaacaaacucauauuaaggguauacucucuauuggauaucauaauagaguaagagcaauuaaccugacagauauuccaauagcacucagugaguuuacaguuuagugagggcagcagauagcaugcaacaaauaguugcaagaguaauaaagcuaauaaaaggggaguaucagugaaagugucagugggaaugccugagauagaaguaccugagccaggggauuggggauucuuguuugagggaguaacauuuagguugagauuucaagaauguguuuaguuuaauuauugaugaauggcgcaggcuggcucuaaaguguucaggacagaaggaaccucagggagguccuugaggugucuaaacacagugaggcuggccaagaccaagaccugaugauucuagcccucugaggccauauuagguacugagaagcauuaaaaaccuucucucaugggguucagaguagcucuggguggcuauugcaauaguuuaggucuggugaaggauacugggacuaucagcgaaagugauggcagugaugauggagagaacaggguggauuuggaggugggauugacagaacucaguugauuggaucuaaaggaugagaggaaaaauguguccuccaauaugagcuagaauggaugguaggcaccaaugauggaaaacagucggggaguacaggcuugagaagaagauaugaguucaguuuugcauguguguuugagauaccuguggcacuguuagucagacaccucagggaauuaaggugugagccauuggccuauagagagugaucggaaucaggguaguggaucagaugcucagcaggcauguguggagagagaaguaauagggccuauuacagaaauuccagugugugaggauagugaaagagaagccuguuaaaggaaacugagggucagcuagaggugcaggaggacaaugaggagucuaagggucauggaaaccacagggagaaaaucuuucaggaaggaucaacaguguuguauggugcuaagaggucaggugaaccaaggacuuggaauugucuauuagauacugugacuuggaggggaggcuaggaagagugaauaucuucuugugaugguggagaaucuuaaaauccauuuaaaaucuugagccuacacauuguauuuuagaagacuuuuuccucuuguuagauuagugcucuagaacauguguaccuguuaaugauccuaaucaggugcuuuugagcagcuuccaugcugcugcgcuguauuugacuuuccuaacuugucccuuuaggcuucuucucacugcuacuuucauuaaucagacaucuaauucucuuagagccugagugcuucacaguccacaacucuuugcugcauucccacuuugaaacuaacaucuucauguauacaacgaaaguacuugaccucaaguuuuguuuccuuuuucauucauucauuuucuuucucaccuccucuuucucuguagaaaguguguuaaauuacuggaaaaauaccuaaaauugagaacuuauaaaaugaacuaccagaguucucauuuucaguauuuggauugugaaauuuugcuuguugugauucaucaaaaccaguuauuccaaaggccucuaggauauggcuuugugguauggauagagaaaauucuucauugaguuguuaacuccuugagcuggguuuauaauggauucaaaucaauauacacaguguaucuuuuacuacucugaauccaggaauuuucauauagauuuacagagacuuuucagacacacaaaccuguuggacauuucuaguuguuugcauuuauuacugccuaacaaaaguuauacagauacaugauucuuuccaguuguuuugguaucguuuuccucagaaaaguaaaagcuaugaaguuucacaccucauuaauaguagaucaguuagauggauuccuuguaaagcuaggaaaaauugucaaaauuuguuaaggaacaucacuuuaguggacaggguaaagagguuucguauauaaacuuuggaggaaaaaacuccaaauaacuucuaccaauuuaaaaaauguauuaaugcagaaaauugagaggacaagcuugaaacaauuuaggucaagagaaggcagugcacugcucucugguccuccuuuuccuggucuuuuucaugagaguguagugagaaauaacuaauaaaaucuauauuuguagcaauuggagucaucuuggaguagaaaauuacauucuaagcuaagacacauaagagugcugaaagguuaagcuuaugugggaaggauaaagcaaaacguuucuuggugcuguuuucucgggccggauagcugggguugaucaggacacuuuuuauaacacuauuugcccacagaaagagugaggcgcaaguguuacuuuggugaaaagaguaucguuuaaaaauagccucuugcuuauccuuguaguagaaaaaagccugcccagacuccauucauuagccacccuguauccaggagugaauucccagagcacaaggcuacaccgucgugugugcauucucugcucuagaauucuugcauauacuagguguguggacuagguucucuggacugcuagguucucugugucacagcuuuccuuugaugacagugucaauuuaaaauuauaccagguucauuucaugaugguucccucugggagaauuuuauacccugaaauuugagggguguaccucuaccauuucccccuccgcugucuuucuuuuugaacuucucagagauagaccuucauguaauuccugaugguuuuaauuuuagaaugaaaaaucaggaucucugagaauauuuagaugaaugguaaugacuuuuguuaugugggucuggucaucaugugguauuuucuuuuccccccaggaaugcugucucugcaauuugagaggaggugcucuuaagcaaacgaagaacaauaaguaaguaauacauuaauuguguugaauuucauuauuuuucuuucuccauucuagaaccuuuggaugacaguucgcuuuaccucucauuguacacgugguuucaaagcuuuugcugcucagaucugagguuggaauucugugcuucagagacuucuacuguuugcacucucaucucggcagggcaagagcaguccaaguuaugcuucucuucuuuguauuugacaccaugaaaaauaaccccucuuuuacucacagaguuuugaaaauggaguuagcccauaucauccaggugccauuagaauccugguguuuaauaugaugaaugcuauuggucuguuaaaacagggcauaccugagaaagugaaaccgugaucuucagauaaaucagucauagcaaugauaauaaaacaaaaccauuuacuuuuuacauuagcaaauuuaugagaauguaaguguacuaaauuagaaaagauagggagaaaacauugauguuaagauuuaaagggaucagguggagaauaugaagagagucuugaaagagagucauaagugaacauaaaaggaaggcagucuaguuuuuaugacuguucugcauggauuuuauuuuuuuuucaugaccagguuuuaauauugaaaauggggccaaagcauauuacaggguccgcuggaauagagacaugucaaaauaaccugggcggauuuugcaggcuggcacuugagggccagauucaugucuaagauauguuuuguuggacccaggcaccauuuuauaaauugcaucuaaaauuuaaaauugagagauuuuuacauaaaaauccagauuuucaucuuuaauugaaaaugauuguauaucccuauaaggcaguaauaacaaguugggauagaacccagugucaguggggcagguacuccucaguucaccaugacuuccuaguauauguguauuugcuuacauuccgccuggcccccugggcacuggaguuaggacuccugguguaauguaaugguggauuuagcauaauucuuuacaugugcacauguuucugauugcugggaaggaggagugaagguauuuaucauuauuacauuaauaaaauuuguuguaaggaacuguaggguuugcuuaauuuuugaaagaagauguucuuccacaguccugguugauaugauucgcacuauacugaaagucuucacuaguucuuggauauugcacuggaugccauacugugagaugguuuaggugguuccuguaaaaacacgggugauaagacguucucuuccuaugcuuggaccacaacaaaaagaaauaguguuuucuguggaaugauaguauuuauuucgauguggaagaaugcccuggugggaucgauacuuguucucucuuccuguggucuugaaagacaggauagagucugauacuguuugagugaaguaaauaugcuuuggcuuaaaaauagguugauggauuugacaauucuuucaagaucucuucaaaccucaugauucuuuauauuuauuuugggauauaacauuuaugagacauuuaauaguauuaacgggaaaguugucauuuuucagaaagugaaaaaaguaggaaacuaggguaugagauaaacuucauuucuuuuugucucuggguuucauugauuauaguaagauugcagcaagaaacaauuuaauuaaagauuagcauuaauucuuuuggaaaacuuuugcuacuuaaacaaguuugcuucaugacauuuguauuauuuuaaaagguugugugcuauacccaguucauaccuuuuauuaauugaacuaaucuuuugccacauauugauuagcuuaaguacuuuaagcacauacaugcauauuccagcaucaaaugaaauaagaaacccacauuucaguauuuugcagaucaaguguagaaaaauaugugcacguuaauaggauagagucgugggccuuuaucagcucuucauggcacaauguuguugggcagcugugguacugagucuguccagguaucauucaggagguuuacaguucagaaucuguuugugauggauuuaggcuuuuggcuuucuugcucaucuguguauuucccaucugugagaacuggcaucaccaaguugaaguauguaaguuuagggaacuuuuguuuauguuuaaugucuccuuuccuguaggugggcccaugucaugugcgccguugcggucccagaaguucgauucacuaaugucccagaaaggacacaaauagauguaggcagaauaccuuuacagagguuaaaauuggugaguggcaaagcuucuuuuuuaccucauaaauuaguguuaauuucaaguucugaauuuuuccauuaaugcacacauucccaagguauauuuucuccuagcuuucuuuuauuuuucuacccuuauuuuccuuuagccuaaauuuauuuauucuuacaaauucuuuuccuguuauauuguaaguuugcauauaaccuuccucaauuucugucugaaaugaggaaaaagauaguaauacauuuccugaauuaaugugaacuuucaaacuauagguuaucugguaagauuugucaguacuggagcugagccaucuaacucuauuuaaauuguuuagauuuuucucucuugacucucuuugguuggucuuaaccuagcaaaauguaucuaaccuaauuucauuaucucuucaccaagaagagacacacagagaaauaaagaagcuuuuauuuuuacgaagauauuuucucacucuugaauagguacaagucacuuaauaugccaaacucucuggcuuguucagaaacuguguaaaaaucuucccauugguuucuguuaagagcauuuuucauugaaaauauaggccuuuauugucuuuaacauugaaguaacuuuguaguuuuauucaauuaugagccagcagauccuuaguuuaggcccuuauauugcauaccuaauuagaacuuuccccaaaguucaacugcaugaccuuaauguauuggagcacgucuuacagguggacuuaaaacucuagaauuuccugagucguuguuauuuuccacugaaggucuuuccacuguacagcauuucaggcaucaucacuaugacucuuuuuucuugacuguugcuuguuuucccacugcucuuuuccccaauggcgagcugggugugccgucucuggggcucucuuauaggaacucacagucuagccuacuguauuuuguuuucggagaagugaaagugaacacuguuauuugccaucauaccuccaucaagaauuucacuucacuaggaaauauaugggccuuucauggaacugaugauuacuguggcugaugugaguguugggcuuaggaugcucagcaugugguaguuggaaguuuuguaaucuaagauggaaaugagugggccauuuaaauggcccucuaaaggucacagugacugucagaagaaguaagaagagaguauaauucuucagcuccuggacuuccauaggaaagcuugaaaucuuauacccagauuaccaaaaaaaaaaaaagacaccaaaaaacaaacaaaacguuuguaagaauuaggacuauaagauaugauauccaaaaaaaaguugaacuaccacauguuaaauaauuuaauguuuggugugacaaauauuaacaaauguuaacauuuuaauauuuuuuucugauuauaaaaguaauagauauuugucaaaauucuacaccaccuuuuaaaaucaccuuuguuucuguguuauuaccagugcagugccccucagaaggaguagucacugcucuugaggcugccuccacaggccuaugucuuggcuucucuaguccauaagugcuuccuuaaagauuuaacguuacccacaucagucccaaaggguuuuugagagaacagcagggaagggcagcaggauuauuucauccacauucaggguguuauaucuagaaauaucauaauugcaaguaaagauggugaagcuugucgcuuuccucacagugcugugcuucaucuugauagugcauaucacauuucucauggaacauuuccuuccuuaagcagucgguaccuuuaaaagagcaugucuuaacugaaugucauuaucaccaaaagucuauucaaaugauaacauagagcuaugguuacagauguaaacugagaucugugaaauauuuuuggaugaaaauagcagccucuugaccagauuauuuuucauauaauguuauauuuauggaaaguuucuuagaaugauccucaucaaaaugcuuguaguaguuaucuuuaguggaauaauaauacgaggagcaacuucauuuggggggaagaaugucuaaguuuguaauaguuugacaggggcaaugacugaaagucuggauucuuuuucaccaagaguccucaggaaggaaucaucacccuugugaguccacugcaguccagugucugugccccagucuucauugauguuccauggugaucagacucagagaggauggcuuugaauaauacaauuuacuuauguggggaaugaaacgcaccuuuccagggaauaggaugcucugccuguaugucguguuaaggguacacuuuccugacauaggcauucuucugaaguuuaaaugguaaccuaacaaguucauggccggcaggaaagcagaguaguuuugugugguauuucauccaggcaaaaguaaguccagguaagcuauuuuauucugccuauuucauaaauauauaugugucugccagugucaguuucaauauuuuuuucuggagcugugggcauuccuuuucugaacucuagacuguccauucugccuuccucuucauacaacuggaaaauaauaagaauuauuuagaugucauaaucaauuuauuucaccaaacaauuaucacuugucuugccauguaguauacauuuuugaaucagacacaguuuuuguucugucaaccuuggcauuacugacauuuuagagcagauaauucuucguuguggaggacugucaugugcaucauaggauuccagcagccuucaccaaacaggcauugccagcuauccccugggaggcaaaaucacccucauuuaagaauccacgggucuacagcgaagauauagacagaaagagaacauuuucaauauuugucauuuuuagagaauaucuugguuggaagaacugaauucaagacugacagaacagaaauuguuaaauguuuuuaaaaacaaaccuggauuuuuuucuuuuuucaaauccaaauuucuuuuuuguuagcaaagcaauaaagucugguaacaugugcauaucagcuacuauauacuuauuaauuauauaaucucauuuaacaauuuaacauuaccuguucuuauggaaauugaacaaccaaauugaauacuaaucaaguuucaccuaagauuaaaauucugugauguauguguauaugcacauaguagucacugaguaaauauuuaugaaaugaauaaaaggcagcaaaucauuauucauuauuugcacgucaggcuuauaaugacuguggcuggaggagugcgaucagacaauaacaaauggccuuugccuuuccacgguuucuccuuuaaauguaacagaucuaauucacacacaugucugcauauugcucuaaagcaaggcauuacuuuacuuaucugcaucacaggagacauaugauuaaauuguagagcccagcaguacuccagagagccuaugaaacaugcaugcaguacucaucuuguugguugaaaauucugaucuuggaacuucuggucagcuggggauugaaaaugaguggacaagugguucaucccugaagcagcagcaagggcugcaucucuucaguacccacgagguggugcugcugcaccaguuucuuauguugcucuuaaacuaccaccucccuucucuagugccuaaccagagcucuggccacaccugcagagagagagagagagagagagagagagagagagagagcgagcgagugcccaagggaugacaauagagcaucgaaaguacugcucgugaugcauucaaaguguugaauuccaaaggacaguuuuuuaguuuaguuuuucauuuaacuguagaaaaagagcugcugucccuuggggcaaguuagaguuuuucugaauaaguaauaaacaacacuaguauaaagcuaguaacugcaagaggcuaauagaaugacuggugggcaagcauaaguuuaaaaugucuuccauuauaugaaggcuguuuauuuuuaaaaugcucauuauuagcagucuuucuagaauaugaaauacuggaauuuaugcagagguauuugaauauuuugguaacacuauuguuagucguuuauuuauucagagcuucaaccuacagcuuuugaaaagcuccucugguaaauuauucgugcaaggagaauuuuguggcggauacaggaaaggauuuguuuacuugagcagauuuuuuccucuuauguauaauggccaguuuuuaaaaaaugacaacuaauggaaaacaagccuuuuggugcucuucuguggauuuauugauccuaaaauggugugugcuucauggagauccuuuagcucauccagccaccuugcuugguaaugucacagguguggccuuuguucaucauacaauuaaauggacaacaaugaugacauuagacuuauuuucaagacauuauauuuucuuuuauuucuguguccaauuuuaaauacuuuaauaauuaacuuuuaaaaaccuaaaacauuuuaaugaaaaauaaguuuggcuguaguggucuccauccaguuaaauuuguucuuucuuucguuuucuuuaacaauauuucacuuuuguguaauuauuaaaguaauugcugccccagcuaaaaaaaugcuacagguugcuauccaaaacuaccggguuauuaaguagagucauccuguuacagggcagaaaugaaaaugcuaacaaaucuuaagaaaugaaaaguuagcugaaugggcuaaagacuucauauccaaaagggagaaccaguuucccugucagcuucagcauucuucugauauuuaaugcagguuuuauauuauguaguauuuuuauuaccuguccauuagaauaaauugcuuugcuucugaaugacuuuacuguaugggaaaaguuauccuuguggcaaguccuauuacugcaaaccccuucccugugcccugcagcaccuucucuguucaccaaaagaauaugugaggauuggcacuuuguaggauaauaggaggcuacugaggacguuuccuucuccccguagcccaucuaggggguugugugaagucacaggugauuggugugccugaggacugaaagaaaaagaauugaccccaagugguauagauuuagaauuuauucagaauuuuuuccuuuucuucuuucuuucuuauuuucucuacuaguaugauugauuggccguagucauaagugaaucucuggaagaagaacaaaauugugcacagacaaaaacaagggaacauagagauauauaaaacacacauuaagacagaauggccuauuuuguuuuuacaauauaaaaaugaucaggaagaaggauuaaggaugggacuuuagagauaacaaaugauguuuuuaugguaucacacagaaggaagaaggcgguaggguuuggagacagaucacuguaaaaaucuuagauuugauuauaaaauuuaagagaaggacauuuuaaaaaucuagcaaaaggaguuaaaaagaaguauggauuucugguaguugcuguauguuuaccaugaauguuuauuguauacauugaucacuuccugcagcuuaaauuaauuaaagaucugugguauuuuuguaaauaagccagcagagcagguuuguggguuuuaagaaaucuuaggaaguuguagcagauccuaaaugcaacuauuaguuuuaaauacucuauuuggagauaaaguuuucaaauaggacuguuguaugaauauuuaaauauuaaaucacaucuuucaaugcagcggaugucuguucugauugcugucauugcauaacaaacuuagcauugagaccauccuggccaacauggugaaaccccaucucuacuaaaaauacaaaaauuagccggguguggguggugcaugcuuguaguaccagcugcucgggagccuaucgcaggagaauugcuugaaccugggaggcggaaguugcagugaaccgagauggcgccacugcacuccauccuggcgacagagcaaggcuacgucucaaaaaacaaacaaacacaaaaaauuuggcauuguucaugggucacaaaugcauccguccucacagugguguagcacagugccuuugguuucuaugucuuuagaccuuucuaggacuuuuacauuugaaauccuauuucugcaaccaaauagagggagaaaugaauuuuggaauagcaggauuugccccugggcauucgaugaccucugauuuguguuugacaagugaacaaagcccaggcacaaguguucucugagugaagaacauuauuuugaaaaggaauuuacacuacaaugaugacugagcuacaagccuuuccgugucuggcugagaccauacuauucugcuuagaagccucuguacacuuuaaaauuuguaccugaaggcaaauaauagugaaccugcaagccaaagauuauaguuuugaaagguauaucaauucugaaaauagagugguuucacugugguauuccaucucaagaguugaaucaagggggagaaaauacaaucacacuuccuauuucuuagacgaaggcgcauguucucuugccaacugacucauguuaucagauauacugaauacuaaaaauagaauuauugagagguagagauagggucugccucuugugcuguaagaucacucagaguucuauuuaguuaauguuacagcaauguucgugagcaacuuggcuuucuuucugaaagaaucaagguuguauuugacagggccucuguuaaugcauuuuaggaaauguaaagacauauugauuaucuuucaucaugcuaaaagaaaagaaguagugucguaaaggcaaucagaaaaagucaguauguuccacauuaacucauguaccgauuuauucauaggcucagguauuuuuaaagacagagaaguucuaagaaaauaauaaacauugacaaugaugagaaaacuuauugcuuaaacaguaaucaguaguguuaaugugcacaaaaagugcuuugaauagugaacuauucuaaaggaggaguaagagguacuauacuacagaugacacgguugugguaugguauguggugucuuauuauuuaacacggccaguauaaaauuauauaacaucauuaagauaauguucuucaggauuucaacauacauaugucuccagcuuuguaagguuuuuaaauaaguguagugcaaaaaaaaaaaaguacauuaguagcuguauaguacuuaacugucagaaugauuugcuacagggacuagauccuauugcaagcugucaaauuuguauauugcuguaauaccaaaccauaaaaucuuuugaguaaaauggaaaaugucagaugggcauggcuacaaauaauauacuuucugaaggcuguagaugucuauaggagaaaauguguaaaugcaugaaauguuaucuuguuacuauggauuuuucuuuaucuguugagagaaaaacugugagacaaaaggaaauugacuggagccuuuaaauuuucaguuuugaagucauuuuuuccugagggcuaauuuuaaaaacauuauuagacaggugggacuucagauaauucaugauuaaagaguauugugaaaaaguaaucuuauuuucuagcuugcauugacgaaugcuccauuuuuuucugaucuugucugugugaguagugauuacugacagaucuuuuaauugagugagugagccagguuggaguuucagagacagggucauuccuuucacucuaguacugccugggucaauaccaacaaacacaugccaaaccgaggcagcuguuagacagcucuaaacaaucuguaggguuuugcuuggucaacagugauugaaagcaagagagguuauaguuuuggaaagguacggucauuauuguguaacaaugaauucauuauucuuuguuuuucugagaagaagggggucaggaauuaguuacuuuucuuuguuucauauuuuaauauaaauuagguuauucauuuccucagaaggguggguuuuaaaaauccacaaagaaagcuuuuuguguaaagugagaacauuuucauacuuggaguuagaauuucacugugguauauuuuagguguggucccacaauuaagugaagucuuuaucuaacaugagcuccugguuagacacagauacuaggacuguuuuagccagccaugggcuggauuuauugaucucaauaucaaaguuucucugcauucaucuauaucaugcuuuagaucacauaauuauaagaagccucccuuagguugagauggagaguacaggcucuggguuaagacugccugagcccuguauccuccacuugggcaaccuuggcuaugcagauuaacccucugaagcucaucuguaaauuauggugauugugaggaugaaaugaaaaaguuaacagucugacacagaguuugcacucaaagaacguuagcaauauuagcuguuauucucuuaagugauuuuucccccuuuauuuuuauaacacuguuaagaacauaacuguauuuuaaacagccucugggcaauuuguaagcaacaggaauuuucuuugaauggaggccuguuaaacuggcguguucugucaucuccgagggagcagggcauagaagggcucuucugcaaacgucugagauuccaccaacuuccccugcaguuauugcugaaaaccguaagaugaauagguugauguucucuaaaacagaaguucagagauacagcucuugcuucauuuugagcacggacaucgcauguugaaaagcgaucuuguucaggacgguuuugcuaaaaaugccauuuccuugcaugguacagcugggagucuucagcaguuuggggccuagagaaugacuaugacccaugaguacuguuauuuaccaggauacccucucaucuauuucuggcuuuuucuccaccuucuuguagaggaaaugaauucgacaaucucucagaaggcauugggauucuuucaaagcacaggggccagcagucagaagaguucagucucugcuauggugucuuuuggcugagccauuuugccuuugggggauaaaucacuguuuggaacagagcugugguucucaaaaugugaucagcauacuguuuccaacccuuuucagacauccuaaggcauugaauuuuagacuaacgaugcaagugcaacggcugguaaagcuacugauguggcaguaaauaagaagcagcucuccuaggaaaggggaaaaaagccccucauuuguuguguuugcacauuucauugguugaaauauucucaccguguccaguuucaaacuaccaauauaaugugaaccaacucucaaaauucuugaagaucuagcagucgcucucaggagcuuguacaagcuugcugcagcucacuguugaaaauggcuggcacuuaccauacaucaaaccaaggcaucaaauugcacuaguaaccauuguauucuccaaugccaggcaucuggcauuaaaaaaaaagccaguuucacuuaagaagguccuugaaauuuaaaaugguuaauuauauuaagucuggauucuugaacaugugccuuguuuacauuccgugugauacgauaggaaauacuuagaaagcacuuccacugccugcuauaauacaucauggccuugagguaaaacauuuuagugauaguuugaguugcaugcuguacuaccaguuuuuucaugcaaccuuuuuuuuuuucuauaaugaaugccaagcaaucauuacuuugauuuguguauuuggcagacauuuucuaaaaagugaaugacaagauuuguugccugugaaagaauuugagcuuucuacaugaaaacuggaauuuuagaaaacuuguauccaucagugugauaauuucccaguacuuacaggcuuuuuaaaugagauuaguggugauauuaauuaauguagacuuugauauuuuguaauaaaaugugccaacauuuggaagauugguguaacucagugacaguauuuuguauuuuuuguuuguuuuuggagcagggucuugcucugucacccaggugggagugcaguggcgccaucauggcucauugcagccuguaucuccugggcuuaagcgauccucccaccucauuuuuaaauuuuuuugguaaagaugaggucugauuguguugcccaggguggucucgggcuucuggguucaagcaguccucccgccucgaccucccgaguagcugggauuacaggacuaagccaccgcgccuagcccucgagaguauuuucgaaaugaugaaugcaugauguuaccaaauuaugccugggcaaacuaucuguuacaaaugccugauagacuaguggauuuuaagcuacugcaguacaugguaugaaaaguucauuaccuuuaggaacuaccauugaaguuuuggugaaguaucaugaagaauguccaugauuaucuggaaagguuauuaaaauacaucuccuuuuccaaguauuuaugugugucaaaccacauagucuucauauacuucaaccaaacaacauauuacaacagaccaaaugcuaaagcagauaugagacucuaacucucuuuuauuaaacugggcagagauuggcaaaaauuuaaaacaacgccacucuucaagcuguuuucuuuuuguuuuagaaaauaugguuauuuucauaaaaauauuuuacuauguaauggguuuguuauuuuuaaaugaauucauaaauauauauuuuuaaaaauuuccauuuuuaauuucuaauguaaaaaauauuguuagauaaaacccacauaaauagaaguuuuuugugauccuuaauaacguuuaagaguauaaaagaguccggauaccaaaaaguuugaaaaccacuggaauagagagaggauccccucauaauauaguauccuuucuucuucaauccaguguucucacauuccuugcaaugauuuuguuuguuuauuauuuaugauauccuguaacuuaucagguggaagggaauaguucuguccuccaccauuuuaggcacauggccuuugcuuucucuuguuccuuauuuuaugucauugucauguuuuuuuuuuuuucuucuucuuacuggcaagaacguggagaacagaggagagggacagcuauugcauacugucuguguaccuuguuacauauuugaguuuauugauuucuaacugcuuccuaugaauuuaauuugaaacuguuaacuguucuucucccucucccuugacccaguagcuccuaggauaguaguguuaauacuaauucuaaaucagggaugacuuuuuagcaguauuguuguuauuauuauuauuauuauuauuauuauuauuauuauuauuauuuugagauggagucuuggucugucaccaggcuggagugcaguggugcgaucucgguucacugcaaccuccgcgucccggguucaagugauucuccugccucagccuccugaguagcugggacuacaggugcaugccaccaugcccagcuaauuuuuguguuuuuaguagagacaggguuucaccauguuggccaggauggucucaaacuccugaccucgugauccgccugccucggccucccaaagugcugggaucauaggugugagccacugugccuggccaggauuuuauuucuuaaaggaguagacuuuugauguagcaguugcgugggcaugcauauuuguuuuagauuguuuagagaugguuuacauugucaaguccuucugcagguuauaaugugaaagacagcuguuccucuuccccuacuguccuuacuucccuuuccucaaaggaaaccaaauucaaccaucuuugucugucuguaucucucaaucuguccgcccauccaucucuuuauugucauuugccucuaaagagcuaaauaauaugccuguauuuacuuuguuuuuuagucucaagcaugaccuaugacaccuuauuuuggagaggggaagauuuagcucaauuugcuucggucaguugcacuauacagauguguccuucuucucccuccaguaguguuccauguauuuuacauacagugguuggauagguaauugaggguuuauguuauuauugcuuuguaaacacaauuuauucauaguugagccaugcuuacaucuccucaagauauucagauacaccaggaugcauaucaauuucauguccuuugagaaaccugucccggaaucuucugucccguuacaguuuuugacugccugucaucuaccugauuugguguuuaccuuccaugaggcuguccuuggaugucugauaauccuugguugcuugcccauuuuuaauaacgggagcugagcagaagccuggugcugguggguugggucggauaguuaacuugaaauauuaugaucuggcugggcauuuuauugggaagagauacuggucagguucucuagagaagacucguccagucuccagacugaaggguaaaagccuggcugugggcuccucagagcccaaugaggcaggagggcagguggucucagugcuccuuagggaaaaggucaguaaguccacuuuuuucccaauaucgacucuacccucagcaauggcuaguguuccagagacccucuuuuacuggcucugagaguaaaccuucagguuuuuuucuuauuuuguggcaguggaguugccuaauuucauagacugaagaaggagucugggaaacuaaccucuuguucagcggcuuucagccaguucuccguacauuaccccucacccuaauuucagcacuuccagagacaccugguaucaccaguaucuuuggcaaguccuggaguaugaauggucugguucuggcuuuucuugagacagagucugucucuguugcccaggcuggagugcaguguugcgaucuuggcucacugcaagcuccgccucccagguucacgccauucuccuaccucagcgucccaaguagcugggacuacaggugccugccaccacacacuggccaauuuuuuguauuuuuaguagagacggggugucaccguguuagccaggauggucucgaccuccugaccuugugaucugccugccuuggccucccaaagugcugggauuacaggugugaaccacugugcccggccacuuuuggcuuuuuuauuuugccuucuuaggaugcagcuuucucaguuuugcugaaguugucacuugucuuacuuucuagcuuccaaaauuuucuuuacuuuguguuuucuuuccuuucuuuuuacuuguuuauuuuugagacagggccuugcucuguugcccaggcuggagugcaguggugcagucauggcucacugcagccuuuacuuccugggcuuaagugaucuucccacuucagccuucugaguagcugggaauacagguuugcacuacuauuuccagcuaauuuuuuuuuugucaggguggggucuuuccuucuugucuaagcuggucucaaacuccugggcugaagugauccuccuaccuuagccucccaaagugcugggauuauaggcaugcgccaccgugcccagcccccuuuuuuuuuuccccaccauuugaacuuacagaauuauucccuuuacuguuuuaagggaaucuguggaaggggugaaauuagauuuguguguuuaguuuugccuuuuaacccagaaauuccaugaagugaccauugauguuuuugauacggggacacaaugcuauugacuucuuuuuuuccacuuugaggaggaauugacuucugaaacuauuagaaauauaaacuaauuuuucccuuauuuuaggaguaauuacagaauauauaugaaaauuauggaaaacuagaccuaagaagcacaaacuuuaugaaacucuuaauuaaauuuuuguauaaauacacuuuaauuucuuaaaacuagagaaaauguuucuguuuauggauauaaauaauuauggaaaugaaauagcauuagcaaaaaauagaauuugccacauaucuuuaguaaaauaauguaucauaaccaugagauuuugguaccguauguaagagauaguuuuggggaccaaaguagacaaaaaaauucuaauugcuuucaguucuggauuuaguaaauuaaauauuuuaaauuaaauuaacugaaaauauugcuugcgagugaacauuuuugcugucucaacauuuugaugucuaacaauuuauggaagauaccagcuugacugugacugucacuuccccauaagaacaaagagguaaauucauugccgauggcuaaugaccaacaguucuuugcagcauaaauuccuauaagcucuuguuuggucugucaggaucagagcagauuaauguuuuuaaggagggagcagaauuccugguggucucucacuuguuuauucauuuauucaauaaauauuuauugaggacuuaauauguaguuaggugauaaaguuacuugcuuucuggucuuaacgauauuacaggguaauggaaguuauugaaauuuaaacagacaauugcacagcagugugaaaaguuuuauuauuguaaaaaugcaaaauguagugaaggaccuuacuagauuugggcaugagacuuagcagugugggacaguagaaaaacuuucuggaagaaacagugccuaauaaugccuaaucugagcccuggagagcuagcugggagggaggguucagaagaaugaacagcaugcucuguggccuggcaguggagagaacuguaaggucuaggaacugaaauuucaguagagcuggagcgugaagcaugaagagggagcucugagucucaagaaguucuagguucuaggaagccucccgucuuuuggagcugugcugucuguguggugacugcuggcugcuuacagcuacccugcgcuuggaaugugucaguguuacugaagaacugaauuucaaauuguauuuaacuuuaaauuugcuauguguaaaaucugaagcagcuacauuuaaaaacugaagcacuuuagauacaacuauaguuuugguaggccuaccuuucacauguaaccacccuuaaacauuuaguauccgaacugagauacguuauaaguguaaauacacagcagauuucaaagacuuaguaugaaaaaggauguaaaauaucucacugauuauuuuuauauugucaauaugauauuuuagauuuauaagauuaaaguaaaauguauuacuaaaaucaauuuugcccuuuucuuuaaaguuuuaaaaugagccuccuagaaaaauuuuaaaagaugcauaauguggaguaugguggcucaccauguuggcagcaaggucaguuucaauagucaggugaaagaugauuuuagcaugaaccuagguuggagagaaaugaauugauacgaggcaggguuggucaggcuuggugaauacucagucacguuauggagcacgacagaauaaagccaagguccuggcauaaacagcugggugauugguccugcaacgugcaaggcuccucaauacugggagaggcauaggguuuagugggaggaaguauauauuggacuuucuuaauuugagguccuuguagaccaucuggguguggcucagaagagcgauaugcuaggggguuagaaucuuacugcuccuagguauguaguuguuuaacagagugcucuuagguuaauagugacugaagguaugugauguucaguuauuauuaucaggggacagugaacaacugucuucuucuagguguccauuuggccagugaugauaauguaucuaucaccccauuccccuuuugaaguauaauaaucaagugagacgacguaaguucuugaagucucuuguauauucucucuuagaauaaagagacuuaaauaaauugaaaacaaacacaagaccagaaggaaguccaguguucuagugaaagauaaauguguccuacagucaaucaaaacauaaucuaacaccgggauuuuguugccaagauguguggccaccuaucaaagggaauuugcauuaagaacuacacagaauuuugucaaacccaugaaaaugaguuuauuucggaaucccuuuuaguuuuaaauugaagucuucuuuucacuaauaguuuucugaaaugaaacuuccuuaaaacaaaauuuuaaacuauggacuuuuuuuuucuguugggaauauaaaauauauuccaucuuucuuuaauaauaaaauguuuuacuuaaauaaauggaaaaaguagucaaauaaauugacuacuuuucauuacaggaauagcgcuuaagguuaauuaaaacuuucaaauuuuuuuuccuagagccaucuguugcuuauaauugaauuuagaaagucaucaguuuuaaacauuuauuugcuuuggacaaagcaaaaaaguauggucaugaaauauuuuuacuaaauagcagacauauuuccgcaaaaagaaucaugacauucuggcaaagguauaauuuuaauagacuaaugagcuuucugaccagagcugacugagcuucaucugauuuuuacaaugaugaauugaccgugucaaaauuugcaguguaguccagugaaauauuuuacuaugaaaguuuaauucucauuuuuuauuuaugaaagcagugguagugucagagcagcuuauaauaugcuggccauuugguaugauuuauuuuaauaagugucacuuguugaugcauuuagugauuguugacccauauuuaauucuaaaaacucuaaauagugugaaauguaauaagucagugacuguaguuugaaaaagcaaaagacaaaaaauugugauccgcaggucuuuuccuagcuuucacgaugucacaguucuauauuugacaccuguugcuuugcggacaauggagggguaacagcuuuaaaaaaaaaaaaaaaacuguaauugagauccgcauaaaaauauuucugucacaaagcauauauuugaaauauaauaaaaucaucuucauuacaucaguuggggauuccagcuugucaucauuuuaaugguuuugagaaaaauuauagaauaaaggucacuuuuuucuuucauucauuuaucaguuuuuuauuuaauaaauacauacagagcugaucaugguggcuugcauucaaugacaggggcauaagauggacaggucaucccucucaugggauuuacauuccagaaggauguaugguaucccccucuccaccccgcaaaggauuuagaugaagauuuuacagaacuuucaaggaugucauuuguucuuuugguaguuuuggaaggcacaagagaagggcuagaauaaagcccuuuuucucagguauuucuuuacagagauauaauaagcauuucuguuuccuaaugucaggauauuuacauaguauagaucauuuaaacaaauauacucuuccaaauagcaauaguguauguuuuucagauaugauggaauuauuuuaagaucauuuuagaaaugacaauaaacauguuaaaucaaaauuuuaauuuuuauagugguauuuguuaacauaaaauuuuaaauuauucagagcucagaggaaaaugaaauaucugugagucaugaaacacuaugcauuguaguacugcuccaaauacuaugaugucuuggaguuguuuuuuguaaauaaugcagggauuauauuguuguuacuuguuuuaauguacacaguaaaaggcauaaacugaguagugcugcagauauuugcuuuaaaguuucucuaggaagaagccauccagagauaauuaucuuuugauauuauccucuucuuacguuucucaaagcaauucauaaauauuuuuuguauaagaauaugaacauuacagagcuguuuauuuggcaggucaacuuaaaaacaagagggaaucaguggcccagauauuuuuggaaacaacaaggaaauuuauauauuucucuaagaauccuauuuuucauaauuagaaaaugaaggaaccagcaacacaaaaucacuccuuuuccuggcaguccuagcacugaauauaugugcauuuucaggcuucucaauuuagcugggcaaucaccauuuaauuucaaaacuccauuuaucuuagugauagccuuugaacuauugacucucuuuuuccuguguaugacaguaguaucacuuuugugcuuuuagccucaggcugauaugggggaccccuucuuccuauagcuguggugcauaacauaaccacaacguacguucugcauagauaaagcacaacaguuuuuguaacuucagcuugcuguacauguggcggguggcagcccaccugcauuggggaaagcaaacgagcaagcaagauguguuuguccuugauuacauucuauuucucugagaaauguuccacuuaaaugacagaccaagcucagaguuuagguuaucagccugagacauacaaggugcagggcaacuccaaaggagguaaggcucaguugcacuguuaacugugacuugcuuauuugagguuagaauucaaauauauagaucauguuaagacucuuggucuuuauuuuuauauuuuauuuucaaaggccuguuguuuuaguuacaaaaguaacaugcuuaucuucaaaauauuuuuaaaaaccgaaguguauaaaauccaaaaugaaagucgucuuuagcuccaugccacuucacagaaguaaucauuguuaacauauuggaguaaugauuuuugacuuuuuuuuuugagaugaagucuugcccuguugcccaggauggagugcaguggugcgaucuuggcucacugcaagcuccgucucccggguucaugccauucugcugccucagccucccgaguagcugggacuacaggcggccaccaccacgcauggcuaauuuuuuuguauuuuuaguagagacgggguuucaccauuuuagucaggauggucucgaucuccugaccucgugauccacccgccucggccucccaaagugcugggauuacaggcgugagccaccgcacccagcugauuuuugacuuuuuucuauggagaaaauaacuugggaggaugcagcauuuuaccaugcuguguuagauuuaggagucuuuaaauagcauacuauauuggucugauaugcugacacauauaugugaaucuguuuuauaaaaauaaucaacuuuuucuuaaggguaguuguauuuuuccuccuuuggucuuacuauaaacccacuagcaucaugacauuuuacauacauuugcuuauuuuccgcacuuagaaguuuuccaggcugcauuucaaagcuuuuauguauacaauuugaucaccucaauuuuacuaaagguagugccaacgguuucucagguguaugauuugcugcaaaguaugaaaauaugaauguaauaauaaugguuguaagcuuuggagucagacaaccuggguucaccugucaacucugccacaugcuaauuauuucagaacgugccagcugccuugaaacuuugucccugauuuuccugacaguuccauguuguguucuuuuucuuuggcuaccugguuuugguuucuuugcuggcuccuuuucuucugucuauuucauacauguuuaugaugcccuuucuuuuuuuuuuuuuuuuuuuuuuuuuuugaaacagaauuuugcucuugucgcccaggcuggagugcaauggugcaaucuuggcucacugcauccuccuucucccagguucaagcaagucuccugccucagccuucugaguagcugggauuacaggugugcaccaccacgcccagcuaguuuuuguauuuuuaguagagacggaguuucaucguguuggccagacuggucucgaacuccugaccucaggugauccaccugccucagccucccaaagugcugggauuacaggcgugagccaccgcgccuggccuaugaugcccuacuuucuauccgaaccuuucuucucacucuacauucucaguggagcauucguagaaucaaaaucaccauaauaguagcuuuuaacauuguucugaguggcaaguaagauucagcauagaguacuccaccagggccuggcuguauaagugcucaauaaauauuccuucuuauuguuauuaugauguauuacacuacuaauaccauuacaacagugaaaugauguuaaaauaaugaugaauauguagucuacauuuuaaaauaaaugauauuaggguuguuuuaaaguuaacuuuuaucacguggaacacauuuucucauacauagaauauuacgcauauuuaauugccaggaaaguuuauacauguuuauuuaacuuuuuaaacaaacuuuaaauuuuaggccaggugugugggaggauugcuugagccuaggagcucuagguuacagugagccaugauugcaccacugcacuccacccuaggcuacagagcaagacccuguuucuaaaagcaaaacaaaacaaaacaaaaaacuuuaaauuuuaaaauaauuacagauucgugggaaguugugacaguucuaaaguuuugucucucaauuuccucuauugguuacuucuuauguaauuauaguauaauauuaaaaccaggaaaguaacauugauacaacagguguauauaguuuuauguaauuuuaucacauggaaauguggcugucauuuuuuucacaaggaaaugugacucccuaaauggguaaagggaagguaaagucaaaauaguaguaauguauugugguuuauaggacaugugaaaauaaagugugugacaauuacaaugugagacaugagguggacuaauugagaauauauuaagguucucacaccagauuugaagugcuacaauauuauuugaagauagauuguaauuggguauuauaaaguguagugugacuaagaauauuuuuaaaagagagguacagauuuaagucauuaguggagauaaaugaaauaaaaauaaauuuagcuaaaucaaaagcaggcagaacagggggaaaagggaacaacaaacagacugacaaaaucaaacaaguaguuguuacaguuuggaaaccuaggugacauggacaaauuucuuauaagaaacaaaacaucaaaacucacccaacaagaaauagcuaaauaagaaauaguguuuuauuuauuaauggaguugaauuuguaaacaaaaaucuuucuagaauaaaacugcaggcccagaugcugucauugguguauuguaaauuucaguauuaugauguaaaauguuaaaggaagaaauuauagcaguucuaccuaaacacuuuuaaaaaauuagaagugaagggaacaccucccaauucauugcauagggccagcauaacccugauacucaacucuugcaaaggaaaacuguagacccauauucaucaugaauauacauuucaaaaaaucccaucauaauaauuaacaaacugaaucagcaguauauaaaaaacuuaauuggguuuauccugagaacauaaggcuuauuuaacuuuuuaaaaucaaucaauguaauuagcuauaguaacagacuaaagaaaagccauaugauuaauauacuggagaaaaaaacauuuaacuggauuuaacauugauucccaauaaaaacucacagcagacuauccacagaaagaacuuccucauucuaauaaagcauacuuacaaaaaaaccuacugcgaacauuagacauaauggugauacacugaauucuuuccugugacugugaacaagguaaugaauucaguucccaucacuccuauucaaccucauacugagugcagauccuagcuggugcuguaaggcaagaaaaaugaauucaaaucauacugauuggaggaggacaugauuauuuccauaaagucccaaagguuuacaaaaaaagcuaauaaaaccuaugaaugagugugucaaguuuucagggguacaagguuaaaaaauuucauuguauuuauguaugcuagcaaugaaaaauuugaaaguuaauaaaaauccauuuccauuaaugccaaaauaaugaaaugcguagauauaacaugaaagcauauaugcaaaaucuguauguugaaaacuauaaaacgcuaauaaaggaaaucaaagaauagcuaaauaaguagaaaguuacaccugauuggaagacacauuguuguuaaaauauuaauucuccaccaaauugaucauagauucaguguaauucuaaugaaauuuccagcaggauuuacuauagaaaaugauaaucgaauucuaaaauuuauguggaaagggaaagccaaaauaauuuggaaaagaacaacaaaauuggaugaaucucacuaccugauuucaaugcuuauuauaaagcuacaauuagcaaguuaauguggugaagggauagacauauguaacaauagaaaagaauagaaauuucaggacuagacacauacaccuauggucauguguuuuucaguaaaaguuccaaggcaauuaguuuguuauuuaagugauguuggaaaaauuuggaaaauaaauacauaaaauugaaucuugauccauacucauuuuauguacaaaaaugaacugaaauuggaucauaaacaaacaucaaaccagaaacuauaaaacuuauagaagaaaaucuuugugaucauggguuuuacgucacaaaagcccuaugagauuucuuagauaaauagaucaaaauuuugacccauuaaaacaauugaaaaauugagccccauaaaaauaauacacuucugcucuuugaaaaacacuuuuugagucuacggccauaccacccugaacacaccugaucucaucugaaagacacuguuugagaagccacagacugggacagaauauuugcacaacacacacuugauaaggaacuugucuccaggauauauaaagaacucuugacacucaacaauaaaagaaccuuauaaaaaacugcaaaauuuuaucuuacacuucacuagaggacauacauagacagcacauaaguacaugacaaaaugcuuaaugucauuaucuguuagguaaagcaaguagaaccacaaugauaugucacuacauaucaauggaauagucaguguuaagauaacugacagugucaaguagugaugcugacguuuagcaacuggaaugcuuauaaauugcuugugguaaugcaaaaugguauagccaucuuggaaaacagccuggcaguuucuuauaaaauuaaacuuacaauuuagcauaccauccagcaaucccacuucuaggaauuuacuuaagagaaaugaaaauuuauguuuacauauaucauaaucacccaaaaaauggaagcaacucaguguuuuucaacuggggaaugaauucucaaaacaugguaccuucauacaauauaaugcuacucagcacuaaaaaggaacaaacuagagauuucaucaaccauggaugaaucucagauucauuacccuaagugaaagaugccugacucaaaaggcuccguacuguugaauucaauuuaugucacauucuguaaaagcaaaacacacaaggacagaaaauggauuagugcugggccuuaugcauggguggagucacugacuacaaaggggcacaaagaauuuuugugcugauggcacugugguguaucuugauugugguggagguacacaacuguauuguuuuguggaaacuuacagaaguauacacacuaaaggaugaacuuuauguuauuuacguugcacuuugaaaauuaaauauaaaacccuauauguuuuuaaagauuucauuuacauuugauguacaaucauuguacauacuuaugggguacaaugugaucuuuugauacauguauacauuguguaaucaucaaaaccacauuuuuaauguuaguagauugacuguggaaaugacugauacuaaugauagcucagugauguagggagaaggacaaaguggugaagaaaaguaguaggagaaguagugagaggaaagaauguagaugaucagagaaggggaaguguuuugggagaugagagcuacaguccaugacagcaacauuccaccccaugcucaguguuuacucuccucuggacgacaugggacucucagggguggaaucuucuucuuagaaugcuuuuggcauagaucuaccuccauuuagaauguuccgaucuaacauagcuauuucuguagcuaaaauccuacugccagaaucauuaauuagauauuacaguuucuauugcuuuuucauugugauaauuuucucauugcagauuaaaugagauauaugcgauguuagcacaaugguuggcacugaguaaguuucaguaauuuacucaugaaguaauuaugacaacucuuauuuuauauguuauauagauaauaguugaagagcuguguaaauccuggacuccugacccaacucccauguucucucccacuaagcuauacucaccuuuguggugguagcuucccgauauucucagaggcugaaaacaaacauggagaugcagaaauuaauuguuuccaguauuuuccaagaaaacgauuaucucaguucaguuauacucccuguuuuuuguuuguuuuacuuuucauuucagaguacuuuaaaugugugcagugugauaaaacuauaucugcauuauuucagcccuugggagauauaggcugcaggugaaugggagaaauauucuuaaauuaaguuugaacauauccucacaugguaccauuagccuugcagggcccaucaaauuguaguucacucuugccuggugucagaucuguuggaaagcuuugacaaacaguuggucugucagagacagcuaaaagccucagagaggugcagagagacgcauacaucuaucaucuaauaaacuccacuuguggcaggugucucggaaaccuaacucauagugaugugggcacauggguuuuguuaaccagaaauaacauuuuagcauugacagcuuuuaaaaaagacaguucuagacaggaauuugcuaucuaaagaacagcaaacuaaucuucccuucaaauaaaaagauuguagugcaucuuacuuuauagagaaaaaggaugucaguauugagcuuauuuccuaacaucugaaucuuuuaagugcugagcaaauuuuuuuuuuuucuuucugaguuggaguuucgcucugucacccaggcuggagugcaguggcgcgaucucagcucacugcaaccgcugucucuuggguucaaacaauucuccugccucagcuucccagguagcuaggauuacaggcaugugccaacuugcauggcuaauuuuuuuguauauuuuaguagaaaugagguuucaccauguuggccagggugaucucgaacuccugaccucaaaugauccacccaccuuggucugccaaaguccugggauuacggguaugagccacugugcccagcauugcugagcaauuuuuauauaaucuauucuugaaucucaaucagaaugaaaacuuuuguuuagaaagucacguauaaaugauguuugaccacguuauuuuucagcuuauaaguaaguuuugaucaaguccacgugacugucuuuauauuauaaaggaaugcauauauuuuugcaauauuccaggcaucuuauuaaauucagauuuagcaauuuaccuauauacuauuugcaguuuucauuacuugcuauuaacccuaaaggacuagaucauugaauuaguuguuuugcugagccuuuuuggcugcuguauaggguaucacuaagauaaugagugagccuaccuacccauccagcauggacaugcugauacguuuuuauuucuguauaucugaaugcacauuuuacaugaaaagguauguauucuauuugaauacaucaugaauuuaggaguuuacaaaggucucaggaugucugacaagaucuccugccauacccagcgaauggaugauuuucauccuugagaaugaugaacucauuaauuuguauaugaagagcaauaaacagagucuccucuuucuugaacaaaaguagggauaugaaacaacuuucuccccaacuggaccccagcagaaagcaucccagcugugauggugggcaugauaugcagucagucagacaauucugcagucagguguuuuguucagcaucccccagaacggaucccagcgcauaauaccucuuuacauguaguaaaaugacugguaauccauucugucuaugcucgguuaaugguuuguuuuugguuuuguguuuugaaguucaacuguccuguuucaucuucuaugguuucaucacauguguuuugucucugccaaaauucauguugaaacucgaucccaguguggcaguguuggggggugcgaccuaguggagguuuuugagucucuggggugcuucccucaugaauggaugaaugcccuucuguauggguuaaguccucacugacggaauaaguuagcuccugagagaguuuguuguaaaaaagagucuggcuuccucgguuucucucucauacccucuuucaccaugugaucucuuugcacucccaccccacuucugcuuuccacagugaguugaagcagccugagguccucaccacaugcagaugcccaaucuugaaccuuccagccagcaaaaucuugagccaaauaaaccucuuuucuuuauaaacuacccaaucucagguauucuguuacagcaacacugcuuaucaggaaggacaagcuggugaagaaaagagggagacuccaucuccugggcauacucuuuaaucauucugaggauuuuuuuuuuuucuuuuuuugagacagaguuucacuccugucacccaggcuggagugcaguggugugauccauucugaggauuuuuauuugggugaaaauuuaaaucuugggugugauaauuuguuaguuuauucucaaaguaggucaacccucccuuuuccucagucauagaaaagaacagcaacacagcuuaugggauagaacgaacauuuauggcaugugagccuugcacugagugcuguaccuggugccaucacauguguuaucuuugugauccuccacacuacuguauauauuugguauuucagucucuucuuugccaggcccaguucuggccauccuacuguaauaaaccaacagcaagaacaacagaagaaaaaaaaacccaaaaucuuccucuugcgauacuuuaugcuaagcauaauuucaaaccauuuuuacuggaaacuuagaugauuuuuaaggaaacauaaaugguaaacaguuuauucaaggaauacauaugggaagugucugagcugggauuaaauuaguuugucucaugcuaaagcccaugcuauuuucacuauaauuuauuaaaaucuggcauauuggacuuuuaaaauuugcauuguguuuuucagggaaggcugggaaucuagacacagcaacaguaacaacaacaacaauaacaaugaaggcucacugugaaaacaucaauucauuaggaaaguuacauccccuccgccacuguuucagaugcuguuucucauucuccaugggagcagccagcaucguguuuaggauggggauacaauagccugagcuccugauugagucagacccuggacuuucccuuuuguaucugucauuuuccucuggauccucacaccuuuguguuuaauuuuuuuaaauuucauuuguugacuuccuaugugggguaaaaugacuuccuuugauuaauguacuuucuguauccuagaguuucccuuucccuuugugauuuaguccaacguguccuacuacagccucaaaaauugucauuggaaucaaaagcuuuccaaggugcaucagguuaaugauuuggaugcauccugagguugucuccuguagcauggaggcauuauaauaggagucucagaaguuacaccauuuuucuacagcacaucacaggcccagaggcuugaaucuaagagaauccacucuaugucugucagccugaauccuuccuucuugcugcacaacaaagcaacugaacguauuuugaguuuaggugaaaacuaucacucauucaucaaaguucuaucugggugauauaugcuaucgaaacagauguggacacugggcugacagauguugagaacggaccuguugcugaagcucauguuaucacacaugcugugggaagagaggucauuggcauucaagaugcaacaccuacaauauggugaauuaaagaugccauuugcauggaucuuggauuagugcuuguaauuugauuugcguauuuacauugcuuuggacauauaguugucauccuaugccccuccccucaacuacggcugaaaaaaaaguaaauaugaaauagaauagcaugcuauuuagcauuuaucuguaagcuauacuaauguuuuuguguugaauauucuuuuucauuuuggcagcucugcacuaggccagacauugucuaguaaucuuccaacaacucuuucauauugauaucuuuauucccauuuuauauuuuguaaaacuggggcuaagaagaguucaauaauuugagcucauacagccacuaagugacagaacugcucaaccauuuugcuggcuguacugccucuggaauaugguggagucaagagaagugggaggucuaugacucccaggaacaccuuuaagcugccucaucaauccugagucucaucaucauugccuggacuucacaauguaagucagcccaucaaggcaacacagugcaugcaccacauuuucaacuugcagaccagucagucuacagagaaagaugucuaucuaauuucuguauauuugucaaauaauggcaugucugagccauggcaggaaacacauggucacccucuuaccuuggguuucucagguguuuuggccagcagauauuuaggcucugggaucaaagaccuccagguuccacaugugaggaucuccagcacaauuaaaggaaaguugaucaacaugucuguuuaauuaauguuucuaauauuucuuuaaaaaucaaguuuugaugagaaaaaaauuaaagacaaauuauauccagaauguucccauuuauuuauuuauuuuuuaaugcauugggagaagacucaaggaauaugccauauugucguugucucuggaugacaggauauugggugcuuuuuaaaaaaauaauuuauacaugcugugguguaauuugcagcuuuucuguaggaacuuuuuuauagcuuguaaaaucaaugggaaaaaaguaaaauauuaaaucagauaaaauguuauuuaaacaccauaguuuuuuauauaacuuugccuagugaccccaguaggaaggacauggacacagcuuuuagcagagaaauuguuccuagguuuccuuuuuuuuuuugucuucaacacagagccucuggguuuucuuuucuuuuucuuucuuuaaaaugcuggacacauuuuucuuauuaauguucacaauuccauauucauguucuccuuaaugguucucuucaacauggaagguucucuucugauaucuuuaguaguaauuuucagagaauccuuguuuuacuugcuagccaagcccaaggucuguauuuuacauguuuuccauuauugucuugcauuuuaaagguccauaguuuaauuagcuugaguauaaauuaccuucauccuuuucuagaggucccauagccaaaacaauaacuuaaauacaaauaugcugaaauaucuauauuuacaauguucuuaaauaucuugaaaucaaucuauacuuaucuguuggauguaacuuacauguacacuggagguguccaugagcaaccccaugauuggaugauugacugggagaauucacaggauguaacauguaguuguacucacagcuaagauuuauugcagugaaaggauacaaagcaaaguuugcuuauacaucagugcccagguuuuuauugagggcugaucacauaggcacccucugccuagcauguaccaaaauuucagacucccagaagaaaagcagguuuacagauucagcauaaaccauauuguuaguacauuuuugguacagugagccauucuuaucaaugaaugguggcaagcuuccugaaauucaaguuccuguaugucugccaggggccaaccuuggaagcagaacuuucaaggcauaacaguuucaggccuguuguauuaacucuucuauucaacauguaauaaaaagccagaaauauucuuuagugccaaaggccaaaaugaguuuguugaaguaaagaauagccccauuauauacauuaaucucuacaagagugacuuuguuuuuuguuuguuuguuuugagauggagucucgcuguguugcccaggcuggaauguaguaguacgaucuuggcucacuacaaccccugccuccugguucaagcgauucuccugccucaaccucccaaguagcuaguacuacaggugcaugccaccacucccagcuaauauuuuauuuuuaguggagacaguguuucgccauguuggccaggcuggucuugaacuccugaccucaagugaucugcccaucuaagccucccaaagugcugggauuagaggcgugagccacggcacccagccugagagugacuuugaacaaacuacccuuuaccucacuuuucaccucuauaaauggcacuuacacucugcauagucgaauucugugauucuauguguuuuguaauacuuuauauaauagagauuccuaaacugggauccguguauuccaggguuaaaugaagacuuuccuagaaguacaaugcacugauaucucuuagagaauuaauuuucuggcccucaacuuuuaacauguacucuuucccaagcuugaucugcaugagagugaaccuuggaaggggcugcugguucuccuuucccacaacuucuuuugcuuuacagaauaaaugcaucacucccagguaaacagauaaagguacaggcuuugagggcaagucucaaaagagcaaaguagagauagauuagguaauaaauacugaaaaaaaaaaauggcacuucaucuaggccauggauuuauugcagaauuuauguaccuuauccacuaggcauucccucaaacccauggugucuucuugguccacaacuaguccacauaacccagccucccuuacugguaggagcacagccacagguauuggagcagaagugaaauauauuacucucagguuuggcuccuaaauaacccccauguauucuccuccuuacuguuuucugaaauggaguugaccugcaaagagacccuagagcccaaauguugagaucacagcacuuugucagccuaggccccuaaauggcuguggaggagagcuaccccacugaacuauuugccagcccaguacuguuaucugagcaagaagugagguucuguuguguuaaggccauuguauaguugggacugucuuuuacucacuguugauuguuucucuuagaauucagaagugaaaugcuugauaugggaauguguauuaauacaauuuauuugaauugcaaaaggaauucagacuuuuucagauaaaaaacaagucuguuuuggcagauugcuuugauaaugaggacugccuuugucuauuggguuuuauauuuggggcagacauuuuacauaaauuggaaucugcugucucaaaauuugacaaaaaauauaauuuaagcgcacauauaauuauauucuggaauucuaugcugggaaauaauguccuuuugcaucuauuucaccuuaaaguuaaaaacaguacaaccccauaaaucucaacuuuaacauucaaggcgcguuauagucuuccagaauucuucuggggaauuguaagcaaaaacguucacugaccacuaguuuauaaaagagggcuguuagcuaguaguuuaaauaagucuugguugaccugauuaauaaacaggcccuuagugauucacuuguguaaaugagcuaaaugugugggcaaaccuaaggcacacgacagagacuaaugcuacagcuugaacaacuucugcuauuguaagucuuuuuacaaauuacccucuuaaaauauuuguagauucacaucaggcaggugaaugggaaggcugaguaacugaucuuccuguaagaaaaguauguggagggggauuacuucacuuaauguugucaguaaaccugaaguuuuauuguuccaucuucuucccugaaucucuuuuaugugccacguagacacguagauaugggguggacuucaggaccugggccaaguguuugugggaaagaaauugaagaauaacuaggugccuaaagcgcuaagggaagaacuuagucugacugaaugcaauuuccuaauuuuaugauuuggcaaggcuggcgugcacagagcuuuaaauaacuuuagggaaguauuccuaccagugccccauccagcauaccaaacucaccgugugugaggaacagcagagggaagccugugcuguuguccugcaggugaaugagugaaaaucaucugaucucacagguagugcugccccauugacugaaaaugucuccaguaguguguuccuggcauuccacuuugaagauguuggcaaucauaaaugccagaaucacaccuggcauuucuuuggaaaaacauuaaacaccucacgagcccagagccuacagggauaauggggaaaucuggaaguacgauaauuacgcugcaugaggaaauguucguguugaugaauccuugggauuuccacuauuugcaaagcaugugucuaaagccuuggagaugaguucagaggggcuaaugguagaagauagaccaggugcugguacggaaaggcauguauuaccuccgaaauucaagggacaggaugaacauuauauaucucuugugcuugcuccuuuagaaauugaaucagagcaggaacccagagagcuaguugccggcuaauggacuuuuuagaaagguguuuugguggucgauaucuagauaucagguguuuuccacuuagccuggccuuugccccugugaaaagcaucaugguggcccugagaacaaaggcaucaaauaaaugcuucugaaaccaccuucucuagagauucugccgugccuccaggacaaagacucugacuuguuugugucacuacagccucacauggggccugaguuuauacucaggaaaggcuuaaauuaugaaugaauccuccuggaaugggcauuagaagguuucuuuccaccuuagcccaccagaaugguacagagagacucagaccagaaggcccauuaggaauaauguguguuccaccugaguuucguuucagaaucuuuagcaagugggauucagcgggaguuacacagagagcccaagcaggcauaauacugugaccaagguaaggcacuaggggugaaggcaccccguuaagaaugaugccacaaaccaucacuggauuuuccagagccuuucaguuuggguccucaccagggcugaugguggaagggauauggcuuuuucaguagccuuaugcagauacagagcucugauugcuucccauccgugagucucagggugccuucauggggcugcgggcaguccuuuuccugugagagucuugcuuuguucccucagcuggcauuugucugcugacuugacacuucaucucaagccuacuguguugucacgcguggcuccaaaucccacacugcuuuagagcugcuuccuugaaggcaggaagaucuacagggaauaaacaaugaagcagacaauuuugucaagcauuugcaguagcaaaacacagagcugacaaaagggacuuaugccuuuuguucaguagaauuaauaaucaaguuguaugcaaaaaaaaauugucagauuuaggagaaaugauaaaauauaguaccaaacauuaaggacuuuuucuuuguuuacuauugauauuaauagccauuguuuauaguucagccuccagcagggauggaccugcaguuucucuauuaucuauuuuuaugaagugcuugcauuuuuuaaauuauuuaucgaauaaguagaguucucuguguucauaagccuggauauacucaacaguucaggaacauuuccuccccauucugagucaguauuucaagucacacacauagacccauauacacauugagguugaguaucucuuauccaaaauucuuguuaccagaaguguuucagauuuuggauuuuguaauacuugcauuauauacuuacugguugauuguuccuaaucuguaaaucuaagaucugaaauacuccaaugggcauuucuguugaguguuuuguuggcauucaaaaauuucaaacuuuggaacauuuuggacuuugaacuuuuggauuagauauauucagugugcauugcuuaacaauggggaugcauucugagaagugcaucauuacgcaguuuugucugugugcaaacauagagugugccuaugcaaaccuugauggcauagacuacuacacaucuaggcuauaugguauagccuauugcuccuagccuucauggggcugcuacagcaugcuauuguacugaguaugguaggcaguuauaacacaaugcuaaguacuuguauaucuaaacauagaaaagauauagccaaaauuagguauuacaaucuuaugggaccaccaugggauaugccauuugucauugacugaaacgucccauguagcacaugacugaugugugugugugugugugugugugugugugugugugucaaggugauugcauuguuuaaacaguaaaauuguuggauagauuauguuccuucccuaucaucacuucuuucaaagguaagauagaagagguuguguccacuguaacucugugagaauuugauuugaauuccucaacggggauuuuucauuugggcaaagauccuaugaguaaaaacauuauauagagagaggacaaaaaagcuauggagaauuauagugugcagggcagaguuacucaaauuaucaucuuuggauccuuguaaucaaaugcugagggcagucaaggcucuggguaaccuaguguuugcugucuuagaacauuuuagugaaaauaaggaauuuaauggcguuaguuucuugcuucuaacugugcuggggagcuuaggaagaaaagaucaugagcucugggcuucuaacuuaacacagguguugacgaccugugccacuacucagcugaagcuuucggagccacuacauggugccaccaucucucuuuguuuucccauuugugagaauggcauaguucauauaggggcugcucucucagccuggguccuagcuuaagcaagaccuggagcagagccacaaccaagauucaacaugagcaagacaaacguuuuguuagccacugugguguuagagaugauuguuacuggaacaugaaugauagauagucuauuaugaagugcuuuuagaaaaugcccacauagugcccuagaauaggguccauuauguuaauaggccuucuccuuaauaacuuucaaagcauugauuauggcuuuguguaggucugcaugacuauucauaaggcugcuaucaucaaugauucccagugcuacauuguauauauuuuaaacaauccguccauuuaggagcugcaugaucuuaguguaguuuuugaacugcucuguggcucaguuucuucaucuguaacacaguaauaauacuauugcuuaccucaaugaauggaacauguaauacccucaaagcaauaucugacauguaguugauuauuuucauuaaguuuaucuacaaauauugaaugggcacuuaccauguuccaguuccugagcaguuccuuauaaagaugaacaagaacauauggguucaaguguucuugggccucauagaucuaugaagagagauacguuaaacaaaugauuaguuaugaagaaguguugugccaugagagugcccaucagggggccuggccuaauuuggagggucaagaguggauggcucugaaggaaugacauuuaagaacuaaaagaucaguagguguggccaagaugaagguaagguugggaaaacaguuacccagguaaaggaaggguguauucgaggacccugagguggaaaggcacucagcacagcagaguacugagagauggccagaguggcaaggcagaaugaaaccaggaaggggcauuggagcccuguggcagaggaggagcacacugggcuuugaaggggcauauuuggcucagggccauuguuguguggcagugaguaaacacuucuucggaccucaguuucuucaucucuaaaacaaaugauuuuuuuucaguugcagaauucccauucuaagauuuuucuugcuuuuucuuuuuccuuguuucaaagagccagugugcugugccaaaaguuguuucuaauaaaaucuaauuguuuagagagaacuaugaggaacaacaaagagggagaaaaacaggcuuuuuucaggucuguugguuaaccugacuuuuacacuguaaaauacggggucaugauggcugacccuggaacagcucuggucuaggaugacauuuaauuuugcuugaggauggcaucauauugaaaccugugagaggaaggcugguguuuagguuuaugguuccugccacuccuucccugcucauaggagcgagaggguuuuuuuauauuuuaauuuauuuuuucuguuguuauguuuaucuucucagacugcguggugggauaaucugagcauuuauagaaaacggagcuccccacugggccuaugcguuaaccccuccugaagugaauggagcaugcagucucagaggaacuuagauauuuuuucccuuuuucuuucuuuuuuauuuuucauuaaaaaaaaaauuauugggccaggugcgguggcucaugccuguaaucccagcacuuugggaggccgaggcagguggaucgccugaagucaggaguucgagaccagccuggccaacauggcaaaaucccgugucuacuaaaaaugcaaaaacauuagccaggcauaguggcaugcgccuguagucccagcuacucgggaggcugaggcaggagaauugcuugaacccaggaggcggagguugcagugagccgagaucaugccacugcacuccagccugagcgacagagccagaccccgucucaaaaaaaacaaaaacaguuauucuuuuccagcauauuugauccuagagcaaacaggaauuuuuuaauaucaucuaaaauugguagauauuucuguauuuuauaacuccacuggcccuaauuaugaauuucugaguuaggccaaacagcauuuuuguguguccccucucauauacagugauugccgcaacaccagcaucggaauaguuauuacucuguugaguaaauaugccgucugucacagaggcaaguaaucauccacacuuuaugcuguguuucucaaugggaucuuuuuuagaaaggugaggcuugugagaaaugggugaguccacauuggaauaggcuugcucuaagagagacgcccacccucauucucaguuccaguccaucugcuccuccuaccacacugcccuuagguaagugcugugcugggcaccacccuguucagccuuugauccugucuggauugccuugaguguguucucuggccuuugauuuucuccucagauaacugcuacgggguuaccagcagauuccugagaucauggacuaugcaugcaggaucaucuggccggggucuuccagcugauacauacacacacccauguacccuuuauaaagacaguuacaaggacaguucuuuucuauaucccaacucucaaacauacuuuuuucuaaaguugaucugccugagagccagccugcagucugcagggucuccuguccccucuccuucacagaguggggcagacaguuggucuuucugccaucuaucugugauccuccaugcgucucugagcucaccguuguacucugcccugugguugaagaccucuggcaugccagaugcaaaauacuggcucucauaaagcuggaaaagggaaugaaucaaguagguggacaacaagacuuuuuauugcaacuuacguggcucuuuuuuuuuuuuucacuuuugacagaauuaaaggaguacccaaaugaugucagcugauacacagugauggguucugaccagcgugcguuuaggcauauaacucagaaagaguucgcauauaacucagaaagagacauuacugcaacaaaaccccucaaaucccauuuaguuuuuaauaugaaggcuuuuuuuuuugaaaaaagaaaaauauaauuaaaaugacacagaaacaugccuuaacuccagcagucuguaacauacauucauaaaauaauuuuuaaaggcuucaucuaucugagauacauuuccaauaaaaauauacuuuuuucuuuaauaauuaccaauguuauaguacauguguagcuuugaucaguuauaaacugaaaauaaguauaauagccaaacuagagguuuuuuaaaacuuagagucuugucauaggaaauuuuuuaaaaaaauuaaacuucaauuaauaugcauauuuuuguuaaagaggauuaugguacagugauaacuaaaagaguuucaggcauaaaauuaucuuacauucaguuaaaauucuggagggaaaguggaauaggaguaauauaaauuuaaagggaauaaggaaugcuacaaaacgugaaagaagagccuguucuuuuauuuguuaaauggaugauggaguuaucaaaugacaaugguauuuagagauacauguuuuauuucuaaaugucaauauuuaauccacaagaaguauagcuucuacaauuauuuaaacuuaugaugagaaauuuuguguccacuuaaaauugugugagagggcacguaguuuuucaaaauucuaucuacauccaguuuauggagaacgccgauuuguaaucuuacagugauuuuuaaauguggcuuugcacuagaauugcuuugagguacuacuuaucaaaaauacagauuucugggcucccacuuagaucuaugaaucagaacuucugguggcggggcagagauggacagugucuuuagcaggauucucugauuccucgugauuuuggugcaaccaauccugagagcaguguuuggcucccccguauccacuugcuucuuccuccaggccuggaggcccugcuuugucugccucggaaggacccuuaaagugggcaggagccauggggccaaaaguacucguugauaugaacccuggaaugggaccuaggagaaaugcuguuuuguucauucacauuuaagggagcaucacauucucucuuuaauccagcucuuguugucuuauccuaaaauguggcauuuuuaaacucuccuuuaagaaauuacaguucuuuauuacauuuuucuauacuaguauugacccacaaucugcuuaggaucacucaaaaacauugauuucaaaacuauuugacuucuaaaauuugagucuguuaaaauucagaaguaguccaugauuuguagccagcuuucuggaucuuuuaaugauaaaauauuccuucaacauaugagggguggcuauuauuagauaauaugcaaucgucugaaagguuugucuuaauggauuacauuugcuacauauuacaggaggugcauugucuuccuguauuccguaugugagagauuugucgccauuuccugugucucaacaagauaaaugaacuaauuuaaaauauuuuccaugccucaucuguccacuccacaagcugucaaugggcuuggauuggaagcuugcaugccagcaguccugagccaggaguacuguuauuuuggaaaaaaaagaaaaagaaaaaaaaaagcuguuuccauagcagcuuggaacuccuuugcaagugugcuuucacauuuuuguaggaucugguaagaaagccgauauuuuguccagcuuucuuaaagcacauuugccugacuuaaaugaaaucauuacuuuuuaaaaauugaaguggugggggaaaauuuucaagaauugaugagaaaaaaaaucgagaugaguuaaaaaacaaaacaggaaggaaaaagaaaaauauuagagcugcuaaaauuuggaauuauaaaaaucaaaauuggaaagugccauuuuuuucuagguaaauguuucuaauuuaccauguuuuaauguauuuuguggguugaauaacguaaaaaaaucaaauuguagaauccucacagguguauuuuauuuuauuuuuuuugcagucacuugaagucaucauauguuccuccauagcacauguaagggaaaaauuauauacagagcaccauaguggcacacaacuuugaggcauuuucaucuuuugcagcaggaucgaguucuucacaguauugacucagugguauuuguagggaggcagagcaaaggaaauaauaaguuggaaagcauuuuuacuguuagacggguuccuuuuggauuuucugaauuuuucuacuuaauaauacauuuuaaugagucuuugggggaagucauaacuucacuucacugcuuaucgcugcagccugcucacaugacacaauacucuugugagguauaauaugaaaaucaucucugguuaaaaguggauuuuggcuuuuagccuaauaccgagcaaauaaccuuuccaguccaaguuacauguucccauaaacuccuuaaaaccaaauuuuccuugcuuaaaaaaagucacugcauguaauucccaaaggguggggguauggaagcacuuuaaauuagacuuaaaaaaacccagaaaaacaaaaccuugccauauuuugcuggcucggccuuuccuuugcucagauuuggugggugcugcuuugcuagagucaugagaggucagaguucucaugagggauuuugaauggccgucagcuggguuccauuccuaagcuugaacuguggcuuaaagcagaaugcagcugccugccugcccaugccagugcaucuucccuggggaaucacugcagaaucccccaagccuccucuuuguacuugauugugaccuuguugcuguccaaugcuugaaacccccagcccuuccagcucccucauuacacagagcuaggcuuucugugguuuccccaguaggucagccuuaagguagaugaaaauuugauagaugcacuuauaaccucuucagagcuuccuguuggaacuugacaagcagauucuuucuccuaaauauuuugacacacagccuuuaaaaugacauuuaccucuucuaggaccauuuuugacaguagcuuguaguagauuuauuuuuauuuuauuugaaaacaucauuugggguuuuguagaaaaaaauaaaauauuuaucuccacagcuuguuaucagcagggaggguaggcauucuuggagggaugggagguuuauugguagaaagauucaagaagcuauuuugugauaaaggauuucuuugcacuuuuuccucuagucaaguaaauugcuuguggguucuugcuaaaaaaaaauaauuccucuggugcuacuuuuaauuuggucagguuuaaaauguuuucagaaggguuaagcuuccuuugcauuagugccugguguggucaaaugaaggaaugacuuuggaauggacugcuuguguuuauaaaugaccuccccauagaagguucagaacugcagaauagucaaaaccguaacacuauuucuacaugucuguuagauguguggugucuccuccuucccucagcagguauaguuuucuaggcauguuuaucuuugacucacguuguaagaauauauguuuccugugauauguccaguguguccagcugucacuuucaaaaauaggcacacaccagaauaucaauccauuguuaugauuucucauaugugacuacugagaacuguacuuuucuugcaaggggaagaaugaauuguacauccuauucauguccauuauguguuuacaagugaaacuauuaauacuaguggagcauggaugcauuuuaugggcaggugggccagguugugaaaacaccauuauaaagccuaaaauuugaggaaaacccccccaaaaccuccauugcuugggggcucuauuuuuaaucugaucuucuguugaguucaugaauauuucaaaugaaccugaccaggugacucuuucuuucgaggcucucagaugguuuucaauggaaacuuucuuuugucacugucaugagauuggcuuuaacccaguacaagucuagaguggaggucugaauucacuugggagagagguaaaaacuguggaagauuuuggcaaacuggauaaacauaggcaauaaaagaaaaaaaaaaagauuucggcaaacuucacacaagucuaguaauagaguacaauacuuuuuccacuccacuacuauagaauuuuuuuucacuaaaacacuuuauacuuaaaaucauuuaaagaaagaguuuuucccucuaggaaaaggcagaaauacacauccccuauacuuuaagaaauauauuugggcacagaugucuaguuucuuaucuuuuguugagaguuagacagaugugugauuuuagugaauguauuuauaaaaaaauaauuuacuaaacauggcuacaagaacaaaauacuucaaaguccuggcugaaaacccugaaucugacaaggauuuuuuuucuuuccauaaaaauaaaucugagaaacauagacugagaauauugaguuaagccuuggccaucacacuugccaugaaaaugggaagcaaggguugaagaacgagcacaucagccugcgacugggaagacaugggcaggaaaagucacauggugcugaggcaggccugaccagggaaccugguagagauuagauugagaagaaggaagaagaguuggugaugcuuguccugacacaggucucagacccugggcucagcacaugcuucucugcgcuguuuccugaaguguuauuuguuuaacgucccuuacuuuuugucucuuuuucauauauaccccugauaacuggggugaucugauuuuuuugucccauguggaucuuauacccaagcucuuuggccuuuugcauuggcaaacugaaaagaacugauguauuauuacauucugcuguuucuuuuuucuucuucuucuucauccuugaaagaaaauaguaggaaugaccguguuugugaugccucuuuuuguuuauagagcacuucuguauccauuauuccauuaaucaccacaguaauccucugaaguacagcuguggaaccugaggcucagagggacaugguaaccugcaucuuagugggagagcugggacuccuaugcacucuccuuuacucugccagguggggguaaggguauugaguuagccugaaaaucugcuuugauggcaguaucaugaaccgcaaguguuaccuuuauuacaaaaaacuagaggccuugaacucuucuuucucuguccucauuuugcauuaaucugaccagggcuguuuggauaggauuccagagaaauauguuucucuucauaauuuaucauugaaaacuaccacuuuggccucacaguugaagcaguaaaauauauauguagcuacacuuagaggcacuuugucuuuuacugccgugaagcuugcugggcacuucuucugugggcuucuuauugauacauaggcacccauagagaaauggaggugcaggaauuccaggauggacuggguaaucuucaucuuucacaaaaguccuggaggugauagaagaccacacuuuaguuguaugauugccagugagccagaacauaagcgguacacgucuuuuagaguaugaacguguucuugcacacaucugcuuggguaacugacuguucuguuugaagagaucucacagaaauggaauuuuuaaauauugagaagauuccauuaagaaauagagggagaauggaaagugcauuauaaaagccaugccaagaauagguaaaguguggccuagcauccacaaaauauuuacuuuuaauugaacuuuuagaaguuaacguucucacucuuuggcuaaagaguuaauugcugggcuuguccaauaucuguuuggagucagucauccaauuuuucaugacagaaaaagaacauuuuagguaauguagauggggugguguuacuuccaugaagaaaaugugcauguuugaauuuaccuuacuccucuguuguggccaccccucuuuugaggaccuguuaauggcuaacaggaaacacaggaaaaugaaggguggagcaugguguuguugauucauugugagagugaaucugccaguucugagucugaaacaauacgacgaauaaaauagcucuaaagauaaucaggguuuaugcuccaucuuuuuucauuauuauuauaaaaauaauaaaauaacaacacgaaaaaagaaaacggaaaacucaagccuccccuaauuacaccaugauguucuucauuuuugcuuauucauuuuaucucuguucacaugugugcgugguuauuguuacuguauucauguaacuuauaauccaggcuucucacuuggcauuggaugguccgcauuuuucauuguucuucaucuggguuuuuuuguguguguguccuggacuccuuuggcaguuuuugguaaagcguauggaccucuugucagaaaaauacuuuuuaguauuuaaaauauacaggauuacagaggagacaauuuuguuaaaguacaguuauuaaaauacuauaaacaucaguuuguacuauagcaaucuauuaaugcauuaaguacuuaguuguauaaugucuaaguaauuauaagcauaaauauuuugaaacugucucuggaucugaagguagaggggagggaaguugaggaauuucauuccccgugacugguauuaucuaggugaaggaagaggcacgacugucuuuagaaugugaggacuuugguucugguugaagagagguaauguuuuaaaacagauuuauugaaggauaaggguagcauuauuuaccuuuuacuguguaucagguacugugcuaaaccucuuacguaugcuaucuuuuuaagggcagcuucaugaggaauaggugcuguuaccaucuuuaccuauccagugaagcaacuaagcuuggagaagugacccauuguucuaaucacaaauagaucacugcagaaauauugaccauuuacuuguccucaaaggaagucggccugaauaauccggaagcaguauccugaugaguaauacagugcaaagccacaugguggcaggguuaggauucaggcuuuaacagugccuguuuuacuaccuuuuguccauuccuuaaguugggaaagguaaaaggaauuucuuuuuuuuuauuuuauuuuauuauuauuauacuuuaaguuuuaggguacaugugcacaacaaugagaacacauggacacaggaaggguaaaaggaauuucuaagugaccuuaagggccacuugagauuggaaaccccaaauuuaucucaucuagaagacgaaucuacaaacucacugcugcgugauuuuucucuuguagcaaccaucugagauacuuacguaggggaagguggugguugggggcuacaggagaagggaugggcucuggacuggacagccaguguccaugcggaggaacccuauacugaguuaacucuucucacagcugcaguugucuccccugaaaaggugcuuccucugaaaggucacccgggacaugucugcacugcauugacuuuauagcuuuucaucacuguuuccucaguuuuauuuggagacacaguguguggguauuucaacucaaucauaaauuuccucaaugugggcugcugcuagcauaauugaaagacaagaggcaaagagguuguggcaggucacagacagaacaauucaugggugacaguuucuaauaagggucagaugcacucaggggccuugggauagcuucugguguucagaaaaggaagacuaccccagcguagcagcuuguguaguuaucaaaggaaaaugaugagaucuuuuuauuguuccguuucccaaccacucuaaccaagguaaguauauauagcaggaauaucuacaaagguucaucuaaacuguuaaaaaaugccugggggaaguuggacaggauagaggugcuugaaacucacuugugggacacaauuucuucauugcacauccgugaaucagagauaccuuuacuguuccaccccgguccucauaaaugcauguguuucaguaaacauacaugaaacagagauuugaggaacuauacacuacucucugaaaaaacgucagcaaaccacagcugcaaccuuucaugcuguuggauauuuguacugcccaagaacaaaucuugcuaaggauaauuaguucuuauuuuugauuuauccuguuguuuuuuuucucagauaccuuuaggccuucaggcccaaggccaaaaaugaauagaaaauguguacuaguccuugcuuccauaaugccaauagcaaaucauaccugauauucauaauaaacaaagaucuuuuuuuuuuuuugcuuguucuuggagcaauagagagcuuguaagccagccuuccuaaauugugccauaugggaaaauuauguguccuuuaauuuaacuaaugugaauucaaucauuaaaauauuauaguuuccaacauuaauucagagagaucuaaaacuggguaaguugaauagaguuaaggaguucuucuaaguaauaaguaauuaaacgaaucuggguagauuuuuauaggguggagagcauacacaucagugacucuagcaggguacaguuguaucagaagggacggugacuuuuguuaaccaaauaauucaguaauucugaguucaacuaauaaaugcuuuauccaaugagaguaaggauuuguguaaacaguaauuucaaauaauggaauuuccuuuaggaaauaggugcucuuuaauacgaacauaaaaagaaauaaaaaugcaaauacagaaguacuuagaaaacaccuauuuugugguuuaggaggcuuucuuuccccacccaucagcugaaagauguuugguggcacuuaauaaguauucagaauaaagcucucuguauguuauaauugugugccccuuuugcccuuuaaauuugaaauaaaggauggaacccaaacaggcuaugagagaaauaaaaaugguaagugauugauuuuuuuucaacauacauaacaauugcuuauuuugugauucaucagcaaaugcugcugugugcuaucagcgaagugcuucuuucaacaugagauuguaauguugccuuuaauauuuaauuucuuuguaaaugcugcuuuuaugugugcguuuucugcacagcacagguaguuaagugcagaggggaagcacuauuuucugcuaagaggggucuaggaaaaaagggcaggaagcauccagaggcuggcuuguuucacccacagccuucucacccguucacuucuaucuguuugggccauguuaguuuugcaguuucagugacuugcccuuauuccugugccaagcuagaauucccaaccaggucagacugugaagucagacagacaacuaugaaauacuacauauucccuaccugggagacuagaggaguauggcaguuggucaagguacuccccagacacuuagcucguauacugugacaggugccuuuaauaaaaaggcagcuuagaauucguccaacuguaaaggagcaaaagauggacaaagagaugugccugaccaacaggcauuuccacuaaagaucaugcugauuuucuggguggucuggucuguagaauugcuugauugccugagguuuaacccagagccccucagagaauuguaauaaaaugguaguccuaauuuccaccuaaaaauuagcugcuacuacuaagcgaucgugagucucucaccugggcaagugaaguuugugccagaguacaguccaaggccuuucaggaucccaccuuuucagccugccaucccuuggcugugcuccuacuuccugacuccauuuugcucauguuuuuucaccucugagcuuuauuacuuccaucuagaauguuuuuccuccuucuucaucccacucccacaugcaguggcugaagccugcuaguccuucaggguaagcucacagucuacuucuucuuaguggcuuucuuauuccuuuaaaacccugcuggguagcuucucugagccaugaggcaggcccugggucccuguggcugcaggcucagccagcgugcagcaugucugccaauaagccuccagugcagagucugaucuggugcugacgcacugcacauagcaucuaaacuccgagaaauuaauuacagaaaacuuugagagaaacccuguuuuugcuuuauugugcauucuugggagccaucagguuggaacucauccagcugugucuggucucgguaacucuuggccuucaguucagaguggugcagaggugagcugccuacacucuccugccacaucaugggcuccuccaugaccugagucaucaaaguagagucauaccugcuuccuuguccuguauuuggugccccgcagguagcugucaugaaguucauccucuccugccccucuucuagaucugcucaguagaaugguuugagggcuggguggagguagguaaccaggucaggcucacaugcugccucgccuugcccugccaguccaaucgucucuuaaaucuaguagugcuuuaucuuuccuauugugauuauggcuguaaagcuuuuguuauagcuguuuuuuauaccaaauuaaguuccuuaaauacaaggauuguauaucuuuuucauuuuuucaucugccuuugcauuuugcaaaaugaucuuacauagaagauauuuaguaaguauugaaaugggugaaagaaugaauuaauacauuauacgcauuaagggaacauucauaugguuaauggcuguuuauguguucagucaguguucugcuacuuggcuuaaaaggugcuuccgcaaggauucuuacuugaucuuccuuguaauguaucuguugauccaaaauaaaacaaaguaugacugugcuguugguguaguacuuuucacaaaucauuuguuaauuugucuguuugugucugaaaugccuuggccuuuccaguucuagaauucuuuugugauuuuuauuuaacauuuuaucagugccaacagugacucauuagccuuauuuugaauacauguaaccuuauaucugaucccuggccaccucuguccauuuuuuuuagcucugucucuugaccuagcugagcucaucccacuggccuuucccugcuacuugacuuuucuuagcuuucucaccuuuugcagggugaaucucaccaaacaaaaagccaugagauaaauggcuucugauaccuuauuuaugauaaggauuuaauucaacacacuuggcauuaugagccauuuauuuuaaugcucugaacuuggagugcauaagaaauaacuuuuggggaagagagacagaggacuuaucauguuaugaccaguugcccaaguaaacaggauuuguuuuaucguaucacucauaugugggugaggcugcauauuaauugcugccucucacaaaacagcccaaacccuguggugucagugcacuggggacuuugcuuuucaguguccuccauuuccuucccuccccagccacucuuuagcugacuagauaaauugauuucucuuuauuaaucuacucucucuucuccuucugaaucucacucucaaauggcaguuguuccauucugcauuuuauuguggcuagacuauccucuuuacuguagaacucagacuucccccagugcuagccaguauugacacaugagugauugacuuaaugaauaauaaugagcagaacauaaaucuuacagguaggguuaaaaaucaaaggauucuauuacgaacccuguauuuaaggacuuggagcaaacugaagguuuuagccucgauccucugacuugccugcagcaauagugauguccguugagccaaacauuguucccuguuugagcugggaguguuaacuugcuguguggugcuuagaaaaaguguccuuagggggcaaaaggagaaagaaauuagcuaauguaucauuaucauuagccugugacuuaaucaggaaacaacaauuaaaaagcauucacaccuauuuuggaauaccugccuguuuguggaagaaaaaaacaucauaaaacuagcaaaacaaaacaauaaaaaaucagaaaucauauuaacaggaaaaagggggaaggagaugugcuuugaaccuccagcuccuucacaguucaucauuucuugaugcccuuugccaggcuggaugcucaaggaaaucuaaugauauacaaagccucauugccagauacuucauuacuuccucaauccauuaguagccuuaauggccuaugccacuggaauaaguauggaaauccagucccccaagaaaguacagugcucuauaaaucacaccugccugaggauucucucagcccuugacacugaagaauaggugaaaaaaaaucauugcacuuccuuaacucccuuguacuagaagcugucggcaugagugacaccuuuucacuuuuuaacccuguagccucuugguucucaaagugugagcuguggaucaacaguaucaguaucacugggaacuuguuagaaaugcaaauucaguggccccgccaagaugugcuggaauccuggggcggaagagagccacuucuguucuugucaucagccuugccagaacuguccugucagagauacccacuaacagcuuuuggcugggugaucagcucccuggaguccagugcucucuaaccuucuuucauuccccucccugcagaacauacacuuuucaauuuucaauuuuuucaauuuuauuuuuuaauuuaauuuaauuuuuuauuuuuuaauauauauuuuuauacagaaacuccauuuaucuugaggaguuuggggguugauucaagguuuuuucuacuucccucucuagccuugacucucagaugagacaggagcucugcccuggcauauuauuuacuuuaauuuucuaguaauucucauggcuuuauucugaaggcaaaaucaaggccgguuguggcgugauggcucaugccuguaaucccaacacuuuggaaggccaaagcaggcaaauugcuugagcucaggauuuugagccuaggcagcauggcaaaacccugucucuaauauaaaauuuacaaagaauugucagugucucaguagguuagggauacagaaaacauuaacuagccuaccuaaccuacaguaguguuuaucaaaucucaguaugcauaaagauuuuuuuuuccuuuuuuugagacagagucucacucuguuacccaggcuggagugcaaugccgugauuuuggcuuacugcaaccucugccuccuggguucaagcgacucuccugccucagccgcccgaguagcugggauuacaggugcucaccacaacuccuggcuaauuuuuguauuuuuaguagagaugggguuuugccguguuggccaggcuggucuugaacuccugaccucaggugauccaccugccucagccucccaaaguacugggauuauaggcaugagccaccacucucagccuaaagaucuuuagaaacaucauguuaaaaacauucugaguggcacuguuuuuaaaauaauuaccucauguugacccaggguuucugcugcuuuuaauuauggauucuuccuuuuuuucuuucuuuuuucuuuucuuuucuuuucuuuuuuuuauuguggauacuugguuugggguggcucugaggcuuuggggcugagaauuauucuuacuccuuugguauccuuugccuaaaggauauucuuugccaaacacuuauuuugcauuaguucuuaucuacuuugguuucucuguucguuuaguuccaccuguuucccauggucuaggaauuccauacauguucugguccucugauggcacugucucuuguuugucauugcuguuuuggcuucauccuuuuuccuauauaguuacguagggguugggccuggauagaugguagcagggauugaucuugauccaguucgucuuugcuuuucuuaaagcuuucuucccucuguuguccccaggcaugauucauuaauuguagcaugccuauucauguuauucuagugccagguagcauuucguucacuucuuucauagcauguauuucguuguaacauucuuaagugcacauagaugucuuuaaccuacuagauuccauucuguagcccagguaucuuuaggcaucaaauuccagagauuuuucugccagggaggaaaaaaaaccauuuuagcaacaaacaaaugaaaaugggggucugaaauacugcguuaacugucuuacaggaugcauucgcaauggcuccccucauagguuuuaugggguucucugucucugcaagaaccugugugauguuuaaguguucucaacucugaauaaacaucuugcaaagcauugaguuauaauaguuuacuguuagguuuacuuccuaaggaaacugugauucuguccuuagaaguccccacuucugguccuccuggaauagggcaagucccuccuuagguuccaaagauugaauccucucugggcuugaguguauucugucuucuuacgccuuuuuagugagucucaguuuaaugaaguuaauggugauggagguugggagauaccaaugcuuuaauuagcuaagucacaacacuguccuacucuuaaaagaucuuaagaaaauaagacauaauuucaccuuucauauaccugucaauaucuuaacuuauucaaacacugaccucuauguuguauaauuagauucuugaaagauugaaaaugcccggggcuccugauaggaguuuuugcuuuuguaucugccaucacauuucaaauaauuggaacugacaaaaagauaccaaaauacuaaaaauuacaaaaaauguaaugaaacugauagcauggauugucaaagagauaccaagacagaauauuaaauaaugcucuuaggcagauuaugaugucuuuuuaguuuuaugguucuguguauuuguguguguauauaugugugugauuuuuuaaucaguuaagccacauccucaaccuccacuuaaaaaugcuuaauuguacauugaaucuagauguauaaggaaaucacauaaguaccuaauguauaggguccuuauggggacuagugagaaguaacacuuagaccaugaagggccuuuuacaaacuuggcucuugcaccucaugguuuucccuuuuuuuuuuuuuuuuuuuuuuuuggagugacuuggagauaaagagaaaccuuuaauuauaugaaggauauuaaguacgaugguggugacaugagauucguguuguaaagaaucacucgggcagcuuuggggaagacaaauggagauagaaugaaauaaaggauggagauacacauugggaauccauuaugaugcugggcaagacaccgugggcggaggcaguggcaguugguauagaugguaggcagagaucagaguaagacugagggacagaaucuaaaagauuaagucaccgaucagaugugaggacacgaagaguuagaaguuaaaugcacauugauucuugcacgucucugauaaaauauuagucuucaaaagggcuugaguuuaaguaccuuuauugucccagaaaagaaaaucuaccuauaaaagaagagcaccaacauuugaucagauuucagauccuuuuuacucuucagaaugaaaauuugagcuuuugaucauuguuucuucugcuuuccagaccuaacccuauguuuuuccacaaccauuuuuuccuaacccucaaguauuaguucacaacuuacauuuagugaaguuguuuuucucuaucucucauaacaaauguacugauaauguuuagggcuaauuguaugcaauuuacuuuucgaauugugguaaucauuauugcuguuuuuauuuucaucuucucuuccccaggcaucaucagcuauagauauucaaccaaauuaugcccuuuggggugauuuucaauuuucucacuuugggaggcauauuuuuuuugucagucaugaaggguucagauuuggauuauuaaacgcuaguuuccacauuggaccauuuaacacuuuacauuuccuugucuuuggaaaacuuaacuugccccuaugcuguuuggguguuuuugaagaccacaucuaauuuaggaaagaaugaccuguccuccaaacccauauucuacuucuugaugcacagaaagaccugucaugcaggagggcaaaacagaaguagcuucaacauucauggauuauuuauaggagcaccucuggggucuuuucccgagcucugugccugcaggaguaugugcgaaaguguuuggcuuuccuugcuacaagaaauaguuaaacauaugucuggcagucugugaccguagcaguguguuuccuuuaaagaaaguagauuacauugccacagaugcugucaccacuagggccccuggaggggucaggacuuguugauguaaucaguuguuuuuuuuuuuuuuucuucucuaguagcuauuguucuguaaauugugggaacugacuggguuacagaaugugaauugauguucuucucuguuuuaaccuuccagaaaugcaucuucugcagacaccggguuaagagggucucuggagccugcauccaguguuccuacggucgcugcccggccuccuuccaugucacuugugcccaugcugcugggguacugauggagccugaugacuggccuuauguggugaacauuacaugcuuucgacauaaggucaaccccaacgugguaagaugugcccucccuuccucagugcuaagaccgugucuggauuuucuccuguuuuagacuaccucccagacauaaugugcuuuauucuguaauaugacucauuguugacaugucuagaccgugaguuccuugagggcagggauugcgcacuguuauuuccugguauuugccuaggaccugucaagugccuggugcacgcuaggcacaauaaaucugucugaguugaaugagugaaugaacagaugcaugcagaaaacucuccaugccuguucugguguuggaucuguacacagggcugcugagcuugguuguacacauugugcacugcacauauccaggaugagagugagaccauuucugcgaggggaucaccaccugagauuauguagugaacagucuaugaaacuguacacuguggucuugggcuguuauuuuaucuccuuuagaagaaacaaagagcagcagcacaguaaaggaagagguaggauggccaggagcuuuugggacuuugcugccuaaaauggcauaugugagggacagccuggggcccuggaaggagugaggauaaucucauagaaaaaaauagaaaaguagaggagaaauauagagaacaauuuuuuugagcuuauuucugggaaaaguguuugcaaccaaauaauaugaauuuagccauauuucuguugaccuguccuugucaaaugaaaucuuuccuguguuuuaaaugcuuagaaauauuaugacagcguagagauaguugauaugucuuuguuagcuuuccaguucaccaugauuguuucuggcuaccaaauaggaggcuaaagcauugucuagaugcucagcucugcuaacuugccgcacuuuguuuucccugagagacuuggccacaggcuauuagcagccuaacaugcuucuccuaugucccuaauaaccucuugugagcagccugccaagucgucagcauuggcuuguggagucacacacagcaaaucucccagcucuuuguaaugcuuucagcaauuuccauugacaucuugagagauauuugauguuugugggcuggggaucugggcagaugugagugaaugcuuaaauguacaaaaugaugucaccaacugucacaucuauuuuauuugucuuauuuuuucauuguuucagguuccaaguugcauauucauucaugccuuuuccauaguuucuugaguugauguccuuuugcuaagaauaguauuauguauccaguagaaaauacauuuuagcaacuuuuaaaaauaccuaguaauaacaccuuacaugacuguggugccuugcccuuaacagugugcagucaauaggauuaccucauuagaggauguauaugaaugcguuuugagaugugaacaaggucgugaccucugaagucagaguaguugguguucacacuuagauucugccaguaacagauugugcaacccugugcaaguucuuauuucugagccucagcuuccucaucuauaaaacaugguaucccaccucaccauguuguuuucaguucacagcacagaguaagcacucaaaaaaugaaaguuguauugcuacuacuacuucugcugcugcugcuggugcuacaaucuuaugugaacugggccacgugaguaguguuuuuccuguuucgaggauaagaaaccuaaguucagagagguuuaauuccuugcccaaauagaugcagauaaugaguggcaggugcuggaauguaaaugccuuuuuagcucauacucuauuauuuggugaauuccaaaccccaaaccucaaauggugcuagagguguucaucugaagcuuugcuugggaucauacauuaccguuuuaauauuccaaagcccugugguuacugaugacuauauugaaguugcuauuaaagagauccagguguuuaaucaggaccucauuccucuuaacucucaugugugguucagucaaguuuagguuacuaauguguuuccuaaaugaugaugaaaaagaaaauagaugaguuugaggugauuuagaaacuacugucuccuacagauccacuuucagcuugguauacuuuguaaagacuggggaaaagaucauauaauuuacaacaucacgugaggcagcuuuuccugaugagggaacaauuuuaguguucuuaaauugccuuugcuacauuuucuagguggaagcacuguuagcacuguauuucccaaguauauuucuaguagcuguuacuuauccauucuucuuccauucgacuccaaguacggauuccuccccaaaguguuugggaacuaaccaguaggaauuuauagaaucuggcaacuuugguuaagaacauugugauuugccccuauugcuuuaaauguucuuuccuuaucaagcauagaaaaguucagauucaaucaaauauuucucuuuguguaaacuaucaaugcuaagagguaugcuucuuagagcagaaacuguaguuugucuguguucucaaccaugcauugauuauuugaaaguaauaggcaauugccgaaucauagcagugaaaacuguaaaauaaaguucaggcuaacuuggcagccuggcccaguuguuuuacagaauaauggaggaugccuguaugauuuaggugaaaugaaguauaaaccuacuguugcuucaauagagucuccauuuuuacucacuuuaggguuuuugauucccuuauuuuuuuauuucucccaauuauuugcuauaaagcauccaaaaggaccauuuuaaggaaaauucaacuauuccauuagugucauaaauuauuauuuuguaauuaauauauuuuuaaaauaguucucauuauguuguacaggcuggucucaaacucuugagcucaagagauccuuuagccucagccucccaaagugccggaguuguaggugugauccaccgugcccagcuaauuauuuuaaauauaugagcuuauucauuguuuguugagcuuuggauguaaaauuauuuugaauaauuguauaaaauucaucugauuuguuaauacauuauuccaucaagcaguaagcagaguuuauaauuagaauaggcagugcuugaaaaaaauaggguaaaacuuccuaaagauggaaaaaagugugucacaggaaguacacagcugaucccuguuauuucaaccuaaauuuuuagcauguguuugccagcguuuuuguugaacaccuuuguugaaugucacugcuguguuucagauguaaggucuccuucaugugugcacaugagugugugcucaucugucgguguguguagucaugcuguccgcuucaccacccugugccaugauucauuauaaccuaguuucuggcuguauuuccaaagguuccacuuggauauauuccuaacccaguuaucugaauguugcacagauguuuguaaggaaaagacaacacaauaaauaguaguuaugaaacuggaagucuuggaaauguauuuuuucuucaaacaaauagucagcuaccuauacacuauauacuucugcaaaauauagcaccacagggccaucucacacuugaguaaacuagacagaugcccuguggaagggaugccugaauaacagaggugagaaaauggcaugcaauguuuuuuccuggcaaguuacuuaguaaacuuucauauuagguuagaauaaucugcauauuuaguguagcagcaccagaaucacuugcacuuuguuaauucacugcaaugaacauggccucuuuauacaucuuauaugagguacauaguguuuuuucuuaauauucuuuccucuagaaaagugugacauuuaaguuguauucauagcuuuagaaaccuuagaagucguggcuguuaacauggagacagauaccuauuuaaaagagaggaagaacuuuuauagagaaaacgcuguauugguuaauuuaugugauuuuguguauuuuuccuuuaguauuauuguagcuaggucauaaggacagaaaguauuuguuguuguuguuguuguuguugucuuuuuauuucuaucaacuagcacuuggcuauccauaggagcagcuugguauaaauuuguuaaaauaauuauccgaugcuagggagugggauuaguggagaagaacgagaacuuguauuuauugagcaucuuuuaugucaaguguguguuagguauuucacauaugcaccuuauucagagcaguguuuuuugugugcauaauggaaagcaggguggguaggguggcuucuguuuuggcagcucccguucuagaaacuugucuaggaucuuguuauuccaccaucuggcccucuuccaugugucuucuaacucucaucucaguaauacaacugaguccuugcucagcacuuacugaaugcuuuuuuguuuuuuauuuuuuuuugggacagggucuuacucuguuacccaggcuggagcgcaguggcaugaucucgacucacugcaaccucugcuuccugggcucaagugauccucccaccuuugccucccaaguagcugggacuacaggugugcgcccccauguccugcuaauuuuuguauuauuuauagagacuggguuguaccauguugcccaggcuggucuugaacuuuuggacucgagcgauccaacugccuuggccucccaaagugcugggauuacaggcaugagccacugcgcccagccugaaugcuuuuuccagccucugggucuuuaggccagcucccaggccaguuuuauugcaacuccuuccuguccucaugaggcaugggcuuaggacaggagaggacaccacaauacacagaaucuggugaagggcucaaagcaagggcucuguggguuaaccuaugacuauauaacuaaucuuggggugaugauggaaugggcuaccucucauugcuaacaacagugaaacauucuaggccucaacaauguggaaagauggauguuugaggcucccaaauucuauacccuagaauaguaguucuuauccuguauuguauuguauagcauauuauucuuuuagugucuguuauugagaaaauacuuaaugaaaaaaauaagaaucaguacacuuuuaugugaauuuauuaauuguaaaagggcaggcaguauuucagguugauuauggauugacagggagagacuccaaaacauucacucccacuguaacauucucuuuuaauuagccaaggaugcagaauuguaguagaaguggauuugguaaauaggguagaagugaaugcagccuaucauaacaaaacuucccccuggguccuguuucccuaaugggcauaugcagugguauguguguaggcuguugccagaucugaaacuaaagauauauuuuugcuguaccacaggauuuuauacuugggucucauucaggaaaacugauuauccaugcuucucauuuuaauaaaauuuuuauaaacaugaagaugcccuaguucuuaaaccaaaaucaaggucaacaguacuauauaaucaacuaggggaaaaaaguaguucuguucccagauggggaccugaacaauaucucucuccaacuuucuagaauuuuuagaaagccuguuuccuccagagccuaccccugauucugguuuauacauuucaauccaauucguuccaacaggauuuuuauuuggaaggccagaauuacauuucagcauauacgcauuucacuauauuguugugccccuuggauguaagacggguggucagaugauuguguuuuuguaauuaagcagcauucagcuaauuuauaucaguggguaggacuucgcuuagcuuacuuuauguuacuugacucuuuuaaacaucaucaugguuuguagcuuuuuaugagcccauugcguaccaguugaccaaaauuuucuucuugauguucuugcuccccuuggaccuuuuggagccucuucuaggugacugcuuuauuucuaauuuuaaaccacuuuuaaaugguuuggcuguguccccacccaaaaucucaucuugaauuauaacccccaugugucaagggcaguccagguagagguaauuggaucaugguggcaguuugucucacaagaucugauggcuuuauaaagggcuuuccccuucacucagcacucauucucucuccugcuguccugugaggaggugccuucugccugaggccuccccagccauguggaacuaugaggcaauuaaaccucuuuccuuuguaaauuaccuagucucaggcgguucuuuauagcagcaugagaauggacuaauccacacuucuagacaucuuugaaacuaucuuuguuuuuuucgcagugggaaaugccaaaguuaucuugguuucuauuguaccaaacugggaaucagugauucaucaaagagcccugguucuuuuuuaugggagcucuacuagagaccaaauuugccaugaaaggugcacauuaccauguuuuguuucauuugagugcuggcuaauuuaggacuagagccacuuuagugacagagcagauaaauagcauuuuuuuucaaaugguucaggguucauguugauauauccaauucuccuggcuuuaauaaauuuauuuuuauauuguucuaacuugagggcuuauuaaugcaauuucuccuuuccuaagugaugccuaaagauuuggaccuguuuuucuaaaauucucuuaacucuuccuagguuuguaugguuuagugggugggaaugagguauggguugggccuaccaccuccucauccucuacgcgcuuggauccacagccugauuauggugcacauacucuuccacagggggccucugcuuuucuggucucuuucuuuaagagcaaaguuuacaguuccuuugaagacaguuucccgcauuugaaaauauuuuaaaccuauugaagaagggaugaaagugggguagaaaucucagaaacugacuucaucccaagauuuuuaaaccgaccugaaaccaaggaaaauacagccacuuuucuaagacuugcaguauuggagagaaacugauaacuaauauggcaacuauacugcuugcuuucccuuucuuaucccagcacuuguuuagccagaucaucaaaaauauggcuuagcacaaaaguuaguuauggagaacuuuagacugccuuaaaacuguucaguucaauauauguagggaccaugaagcauccuggaaguaaacguaaccuuuuuucuuuaaacuucuccauccgacuucauucuugcugaccagaccucauucacacaagugugucaagcaaacauuuuuguuuuuuuuuugaugagacaguggugggaaacauuuauuuaauacaaugugauaagcugcguucuaaaggcuuuucagauauuaacuuauuuaaucuucagugucccauucaugguagguauagguugagcauccaaauccaaaaugcuccaaaaucugaaacuuuuugaguaccaacaugacacacaaaggaaaugcucauuuaagcauuucagaauucacaauuuaagauuugggaaacuaaaucagugaguauaaugcagacacucugaaauucgaaaaauucugaaauaauucugcucccaagcauuuuggaugagagaugugcaaccuguacuauuauuaucuuuuuauuuuuuuuuaacagaugaggaaauggaaacagagugaguuuacguuuauauaacuugcuguaaguuauacagguaguagguggaagagccaggauacaaagccaggcaaucugacucagaguccaggguguucuaagcacagggaauagugugugcacaaacuuccucaaaggccugguauaucugaggaaggcugaagaguucaguguuacuggcucuaagacaugucagguuuacgggggagucaggauggaguggugagugggaaguugaagcuggugaaguagauugggugaucagaaugugaagacugucuuucauaaaaagugaaaccccguuuuuauauaucccugaauuaaaauuuuaaaaaucucucaucuucaaguuagggaaauguucuuggcuaaacaaggaucuguuuuuagggacgaggugagggacaggaaggauuauccuuucuagaggagaugggucauggugaggagaagauuguuuuggggaggcuuccugggagcaagacccacagguacucaguucaccccuugguggggugcaaacguguuacccaauagcugucucucacaugcgcccacaugcacaaagugggucaugcugagaucaggcaggagaggcuauuauuuaucuuguuucaagaguuccucaaaguagggaagauuaaaaagaaagaagaguuucucauuuaggcauuacucuugcgacuuuccuucauccauguuccccgggggauuccuugaacuccuuugccacugcuucaggcaaauuuaggggaguucugcuuuauucuacaguggauggucccaugcgagguuuauguguggggcaguauuaggaagcucaaucuugaggccaagugggaguggauuagagaguagaagggauugauuagagacaggaagcugaugcuccagagagggugagaagaaacagagaccuggauuuccaccauggccaugucccaggaugaggagaagggucuugauuaugaggacacuuuggagguggaauuauaggccuugguaaaucagauguaguggggaagggagagagaagaccccaagggacaacuaguuaauuuagaacugauuaugaggaagaauuuugccuacugucacuuucagugugcccaucuaaugccagugagcuugcccuggcccccacagggcugauacaucauauguagcuauggguugaaucuauccuuucaguuuccuuuuuauuuucccucacuucgucuggagcucacuuccauggcuugauacugucuuccuuuaguuucugcuuucuccuuuucauaaagugaaccagaauuuagcuaacacuuaucucacagugaucugaauggugucauuuccacaaauccucauagugucucuaagauccugggugucuuuauguuuugccgaugauagaauuguuuuuccuuuaacaauuuggauauugcaaacuaaaauucuguuuaacaaaguuuguuuugaccagcuauacucuuuuuuuuuccuuagacuucuacauaaucaucuuguuuuuguauaugauuuguuucuucuacauaagcuuuuuaacaaauggccugcugaauuugcaguguuauuauugacaaagagagauuucugaccaaagcaaagggauggaguaaugagaauucuuagcaaggauuuaaaaaaauacuauagcgauucaaaccugaaucugaucgauauuccuaaaucuaacacacauuuuuuaaaagaaaucccucaccuuucuaucaauagaaggguuuuguugagcucucucuccacuuaucccagaugauagaaagugaagguuagauuugccuggaaggaggaauauuuagcacagaccuuuuagaauauugacauucagaaccuaucuuucucuuauucacauuaucagguaaagccagagaagauaaaauuuuucuuaauuuugcuaggaaauuuaaauauaucccauuaaacauuuuugaacccuauucagaacccccuaauuuguuuucccacugcugaucuuuugccauuuccauaggaagggcugggucagugagcaucaugcuucucucccugugcuuucuguugauagagcaagggcuugaggagagccacugcaaacucccaugcucacaacagccucagcauacucuacgaaagaaggcaagagaguuuaacgugaucuuggaaagauuacucuaaaaaugguugaacucuaggcuauucuucgugcuaaugaaaaauaauuucucgagcauuugaugagcuccuauuauguugaucaaucuucaaagucugggaaaugagcuucagaggacugguacuucucagaauucuggauucaugaaggcucgugcuggagagcaucaggaguugccagcaucuaggagugugguguauucaaaacaaucuugacuccaggcaguccugcauucagguuccugcucugcuucuuuacugcuugccacuuagaaccaugcugaagucccguugagagacuuacccauaucuuaaagcccugauaaaaauacugaugugaggccaaaugguacaucccaggaugaacauaugaaauugcuguuuuauagguuaaaacugguuuaauaccagcaauuucauauuauuugauguaaaacauauucagaggagaggggcugcuaccauacuacuccuuauucuguuuucuggggagagauccuuuaggccugguucaugguaguuaacaucuuguaguuugggaagcaccuguaaaaucucucugcagcuauacuacucggcuuuauucuggaaauagcugacauugugccugucagcuaggaauucauguuccugagucuagucacccucagggacaaaaacacaaaauuuuaucuguucugauauguauauggguacauugagaaauuaauaacaauugauaacauuuuaaacuuaauuagaaugaagggaauuagcaccuauuuaguuaugaauaaucacagcaauguauucgcauuuucauuaguaaaacuuaauagcuuucaucucucucaaaauacgguuuuaguucuguguggaauaaugugguuucaggagaaauauuuaccuaaauuuuuuauucuguccuuauaaaacugcaaauugacccugauuuuuaaaaaauucaagacaaaggcauuuugguguagguguuugguuuuuaucacaaaagcagacccaucagaaugcuuaggugaaacuugucagugcucuguuuuaugcuuggcucugucauuuccaccacagagugcaccguggaaccagggagccccuuagcagaccuagaccccacggugggggcaccugcauucagaaauacuuacauggggcuaggugcaguggcucccaccuguagucccagcacuuugggaggccgaggcgauaucagccugggcaacacaacaaaaacccaucucuaccaaaaauacuaaaauuagcuggucgugguggugugcgccuauggucccagcuacuugggaggcugaggcuauaggaucacuugagcccaggagguaaagauugcagugagccaagauugcgccacugcacugcaauacagccugggugacagagcaagaccuccaucucaaaaaaacaaaacaaacagacaaaaagaaauaauuuacaugggacacuugauacuugacaacuucaagggccaacuuacugaggaaaaucaacucuuccauuccaaggaccauuuauuugguuauuuauuuauuuuuuucguagauaagguguauuuucaugcaaaaugcuugcuugcuuuuugcacagaauuaauauuucuccguucccaggaaauuuuaagcuuuucaacaauuuguacuuuuuuaaaaaaauaauuaaggcacgcagaaucgucugauagcuuguuaagaaaauuaaguagugacacuaaucucauauuuuaauauugguauuagagucaagcaucauagauacaguagaaaaauauaaauggaaugugucaacagacacacaacagcaaaggguauuugacauuccaacaucuuguaacacauaagagguaggauauucaauuccuucauguagaaaacaguaauuagaugccauagccguaaugaaaaccuuagauacugacaaaauguaaugaaaguauauuuuuaagacuauuaacugcaagcaauagaaaaggcaauuaaaugaaauaacuuccaauauuucuaacuaaaaggcuacucuccaagccuugauuguauguccacuuucaacaaauaugauacacaaaagucuggauuagcucaaaaggccuccugaagccucuuggcaggaagccagugauuccagaggaaugccuuaucuucuuugucauguccuuccauggaauauuggagcauccugggcucugcacauuucucacauacaagucaauacgucuuuucuuuccagggaaaauggguaguuucuucaccauugccagucagaaguuggcaucuuuucaucuugaagugucacauguccuuucuugucuucucauccuacacugguguagugggucacugaaauuauaaugucugaagaaacguaagaaauuccuguuucuucugaaaugauguucugaaauaucauuuuggcucucuuagccauuccugggcagaccuggcacucggacgcuuuugcuuggagcaggagacauggagaagugaaacuuucuucuuugcaagcaucagauaccuuaaugaguuauuuuccauuuuguuugucccucgagugggccuuuuaguuaaguuuguucaccuuuccccauacauuucucaggaauuagaagaaaaugcaaaauuuggaaauccuuaaauucaacaacuuuuaauuauaccuuaaaaaugucauguuuauuacauauuuggagaacagagcaguguccuuacuguaucugagaaaguaacuuuaauugagguuauauggaccuuaggugaucaagaacaggagggccacaggcaggaaacuaggaaggaugcaguuaccauuagagcaccccaguucuuucccauccugcccccacgugaaccccauaacauaccucucuuucaugcacagugcuggguacguggguccacucaguuaacacuagacaaucugacagauggauuuaguuugcugauuaauacuggacuuuaaacaguuuguggauuuaucccuuuugaguaacauuggcgagguaggcagaaucugcacuccugccguggaugugauggacauuagaaagcuuuuggcugacuucccuuucaccguaccuuuaguugcuucuccugaaguccagagaaaccuaggaaguuuguguuuucucuuucucugucauucucuccucauguaagcagugugucuuuauaggcacaguuaccucuuccucucuaauuuugucucccgcucaaaaugaccacccaucuuuguuggggacaguguaucaauguagauaagaguuacaaaaguauaauaauaacuaacauuuguauagugucuuuuauaguuacacguaguacauuaugucauuugauguucauaguaaacuugugugugguacauauuaugauuauacccaugugacagguuaugaaauugaauuucagagagguucaacagucuucaaaaguuauagaacauucagguugucagaaucagagcacauggcauuucauuuggauugugcuguuuuaguagucauuuuucuaauuugagacuaugacuuggauuuguuuacaugguauuaagauuuaccuggacuuccuucuuggugguacagaaaaucuguuaaacuauuuaauuagucuguuuugcuuuggguuaccuuguucaauaacaaaauauuugcaucuguuuuaguguguuuaacccauucaccaacuguaauugagagucagaaaucguuauaggcaggaguuaccacugagugauacccugugucgcuugcuucucucauuugaaagugucccaucagacgucauuuaaaggaaauauuaccuuauuguugaguaaaugcuuuccuucucauuuuauucucuccaaauuguaauuccuccaacuuuguuauuuuauuuucaacauugcuuugaguauuuucgguucuucacauuuuuguauacauuuuagaaucaucuuguuaauuucuacacacacacacacacacacacacacacacacacacacacacugcuguuaaugauugagauugugggaauauauugcucuuccuaaauuauauuguuggcacccaagaagccugaagaacuccugaaauaaaaaagcccaaggcagagcuucuagggucuagcaucugggaacucacugauucucuagcaacaguaaugaaauuggaugugacuguaggcgaagcucaugccagguuuuagcuuagcaguggcccacuaccagcuccaccugucuaacuaaugugaacucucaucucuguucuuuaugaauuaaauugcuuacucuuuagaauacguagcaagcaggugguauguuccuguugagagguuuacacauuaacacagugaggcaaagauucugcuauagcuaaagaugguucucucuucccaguucucuucacuuaccaaacagggccacuaccuccgaggugagcucaugauucagauggaaaaaaauuaguuuuuucucagcaucuaaugcagccuguuguuugugcuucuacagacauuaaagugaauaagaccuuaaaucugcugggaaacugcuuaccaccauuucccacuguauuauauguuuguaauuaaaaacccaugagaaauaaaaguacacgugaacauacacacauguggaaaauuaaauacuugugacguuuugaugagucauauguguauuugugcuguaagaacaaguauuucuucaugaagccccagggauuuagguuuuucugggcagaggauuuuuaccuagcucuuguaauuuacaaagaaagcuuucacuaugacaaggcaaguuuagaugagugguuccugcugcauaccuuugguaaacgaagaauaguuuguauugauuuauuuauugcaauccuuguagaaauuuuuaucagauggauacuuugaaaaaauacaauaauaauauuucacagguuauuaauucauagaaauuaaggauaaauaacaaaguugagauggugaaagggucauugcguacaaauggaaaccugcucuuuggccuguacgucggcuaaguuacuuacuuugguuucuucaccuguucagccuugcuggugcuguggguuucuacauacauuauugcauuuggauuuacgcccuuuauuaacaucauauguagauagagaacccaguuggggauuuucccaaggugacaucuccgcccaugacucauccugcuagaugaugggugacccuccuuccagauguaaacacaggucagccuugccaggucugauaagagacuaccuauacggccaaagcaaagaaucuucccucauucuaccucacaaaagcccuucccccugugcucuugcccuagagauuaacuguuuucucucuggucucugucaaaaacucaguggggagaaaugauauuuaagaaugcagugcauauguccacuugaguauuuaaguuagauucccgugucagguuaggccaccaagaaauuaccuauuuuagcuuccauaacuuaacccuuuauaaggugccuucauugaguuucauuucauuacugugucuuuuuagugacaguauauacaagcaccauuauauaaauagcauuguugccauuuucccaagucuacuguuaaaagauuggcugcugcgucauuaaauaucccaggugauaaaaucuuuuuaauaauuaugaagaaaaauuugugucuuagaaaaugggaaaagauacuauuuucuuucauuaauucuagcacaaauuuaacaguucugucaaucuugagcauaggcagagacugcauuaacaguuuuuguaacugucuacaauggaaaucauauuaccauuuuaacagaaauuuaaaaaauauuauuuaugcucaucaacaacuuuguaaucaggauauuaauaguuguuagaccuaccuuuagauauuaguauuuaaugcauuauuuuaaaagcauauuuguuuuuccuuuccggucagggaaccaaaaaggaaaaagaaaaaaaaaaagaaagaaaaacaaguuuauuuuucuaauauaauuauuuguuuguaaucuucuguguuuauuuuaugcauuugaaaacauaguucugaguagggcuucacaaaguagccagagaggucccuggcacauacuccaacagccuuccuggggcauguguacuuccuggcagccucccuccugguucagauguuuaccugcauuuucuuuucuggagggccucuuccuucccugaucugagcucucuuaauaccuugcauuaugaucagccaugucugucucucuuacuaguaugugagcuauuugagagaagggacucucucauuauuuuauuuuuauucuuagcaccuaggaaugugccuuauuuuuagugagccauuaguaauuaaaugccacuuuuuuuaaaccccaucccauucuaguauugcucuuccucguggcauugauugacagguuguucuuggcauuuuggcucagaguucacugcuguagaaugcucaucaggcaaggaaugaugauuuuuuuuuuucauuggauuuucucaaugcuaacuuuaaauuuuuuuaagucagccuuuuggauguuguugugccuuugaugaagcaguccagguauuaggaacauacuuuccuccuucuucagguuguaaucauugguaguuagcugucuuuuguuugaaauuuggcuauuuauuucaacauugguagucuuaggaaagcuagagaguuuucuuauaagggccuguauaauuuccaaguucacacuugauugaaggcagcaugguaucaguggagagaaaacucuucuacauuugaacaauuggaucuuauuauuagugcugucccuuagagguggcuuaguaugaugggaaggacaggaauaguaaugaauuccaaaaagaccugauuaguuuuuuucuuaauacagccccaaaccugagaaugaaauuauuuauuugauugaaacaacaugucuuuggaaucaguggugauuauuaaaaacaguaaaagugcaauuuuuuucuuauaucacauuugccuuaaauaugagauguagguaagucagaugaaauuuuaugaccaaauuuuuaucauuucacuuuacaaaguguucguucucucaagucuuucuuacaucauauuuacugaacugaagaauaaauguuggagaugguguuuucuuccuaacucacuuggucagcuguuuuucauuuuuguuuucagcauaucaguugaauaguucugacuauacaugggcuggcugauauuuaaggaauuuuuaaaaauuggaaggacucuuaguuuuuuauauguaguauuucagaaauuauuaaauauauaauccaugaaaaauacagagaaacacauaaagaaguacuaaauaaaucccauuacccagaguuauacaucacuaacauuuuaguauguauuuucucaguguuccuuuuuucuaggcauacauaucugugugagugacacaucaucacaagauuuagcgguuuaaaccagugauaacuauuuagcucaugauucuguggguuaucaauuuaggcuaggcuuggcugagggguucuucuggucuaagcuaugcugccucaugcaucuguggucagcugcagaauagcuugucugaucuuggcuggguucucucacagguuuauggccuguggucagugugaucucucaucuccaacaggguaacuugggcuuguucacaccccagagucugagguucuuagagagaaagcagaaguguucaagcccucuugaacgaaggacuaugaaucuguguaccauuacuucugcuauauucuuuuggccagugcaagcuaagccacagucuaggccagauucaaagggugggaaauaaacuucaguccuugauaggaggaucuacaaagucguaugcacaggauguggaaacggggaggagugaagauuuuugggcaguuuggaaauuuaccacaguguacacguguguuuacauauguguacguagaugaaaagugagagcauauacauucugcauuuuuaucaccagacaugcuccaaauccaaguuacuaauccaacccuguggauauauuggggaaaguaaguaaaucuuaaaugggaagugccucaacaaguaucuagaacaauaccuuccauucaaucaauggaaggcuuaaaaaaaaaaaaggaaauguaauuucuuuaggccacugcuugaauucuauugguguuacuuccugguuggcuuuauuuccuugcucauguuuuucuauguuuacuuccugguugguuuuauuucuucacucauuuuuucccaugcuuauuuucugguugguuuuauuuccuuuucuuuccauguuuauucuuuugguugauggucuggagcaccuauguuguguuagucuauuuucgcauugcuaugaagaacuaccugagacuggguaauuuauaaagagaagagguuuaauugacuuaugguucugcaggcuguauaggaagcauggauggggaggccucagaaaaccuacaaucauggcagaaggcaaaggggaagcagcucaucuuauauggucugagcaggaggaagagauagcagugggagaugccacacacacacacacacacacacacacucucucucucucucucucuuaaacagccagauccugugagaacucuaucacaagacagcacuagggagauggugcuaaaccauuagaaaccacccccgugauccagucaccucccaccaggccccaccuccaauauuggggauuccaauucaacaugagcuuuggguggggacacagagccaaaccauaucaccugucaugggagagcacugcucuagacuacuucuaaacuguucugagaucuuggaaaagucacuugacuuugucaagaguaucaguagauguuacaucaucuauuuagucaaaauaaaaacuaccucacaaaauuauugggagaauuuaauuaccucaugaauauggacauaugcuggaaacuagauguguuaucguuccuaggaauuauuuaugcuuuuauggaaugucuguaacguuuuuuuacuuaacauuuuggccauguccccagcaucucuaacuggcccuaccauuuuuuaaaaugacguguauauuuuuuuaagccacuguugguucauuucugcuuaguucauauuaaagaaaauucaaguuuuacagccuuagcuuacacacuaaucuucagaacaccauagccauuucuuuaaucugauggaugcccucgcaugaugccugucuucucugaucagaaaugacauucuuaacaucaauagauucuuagacuuuucugacaggaaauauuuuugaggauauguaaucaguuaugggguaugcuugucaauacauuuuuccugcaaaaauaaaucagaaauccuaucaaaauagcauuaugaaagaauccauuucccuuaauacuccucaugaaauggucaugccugaaguuucugagaauuuuuauuuagaugaagguuguguauuuaauuuauauacuggccauuuuucuaaccagccaaucugcauaaauuucauauccuaagcaggaagaaaaugguugugaucuggagccagccucuuccuuauaaagccugcaucaccuuccuuuucccuuggcuagccucuucuacuuuccagacccugugaguuucaccauaaaccuucuuuauucccuuccgcuacccacauacaugcacaccuagccaaagaaagagaaaccaaagaaacagaaccuguagggauaaauagggauaucacucuacagugccccuuugcuucucuuugcccuuuucuggacaggagcagauagaauucauuccucuuccauuuugaaaguuugucugugccuauucacuuacccacucauuuauccauccauucauucauucacuguucaucugucaggaacaguguuacagacaccgugcuggguucuguggauaaaaagacaaguucuggcacugauucguagaguuuacccugucauuaaagggaugguaacugaaagagucauguggccagggucuuaagagaguuguuaacaaaggcuuugggagcccuggggauggagaggagaccacauuaugccuuccuuccuggggacaauagccaugugccugaauuugacaagaguagagucggaggcuacuggagcgggugaggugaagggugggugccuggauuguuuuccuggcagugauuuggggcuggacugauccuugucagugagaagucagggugcugcccacucauccaugccaaugacucagauaccauaggaaagugguugacucaccugagcugaaggucucaguauguucuucauuuccuagaugaagccgguuaggauuugcugagagucugcucccaaugaggcugggccuccuuugugcuucauccuguuucauagcaccccuuugauuuagguguaauuucuuccacagaugaccaaacugaggcugacgaggguuauguaacacccccaagaucauccagcuaguaagaguaaucagcuuauaaugcaaauccccacacauuguccccuuggagggcaaacaauuuuuauucaacuuccaauuuuaacaaaauauacacuaaauaacuaauaucauaauaaaauacaaugcuuguaaugcugacaaugacuguuuuucaguuugacagagagggcaacaucugcaagaaaguucugccaagaugaagcugugugugucccuaauccacaucacucagggccacugucuguggccacacagguugugaauguggccuccuagaguuaguuguaaccuguaagaaguagcugucacaggcccaaucuuggagucaacaucagucugcaugcugugccuccacucauauuaauuacuacauccaagucacucucuuacuuuaaaagguuggauauauuuaaaggggaugaauggggguaaagucguaaacugcguaauuauuucaguauauguuauauacugucaccuagcuguuaaagauuucuacuucaaguauagugcaauuaaaucgggcuucuuacuguugugcuuugucaaauguuuacauaccuaccgacaccuaaagguacagaaaauuuucccaagcaacccaguaaucacuggggaaugauuucaggaaggaaagaagggaaauauccuuuuguucugucaggugugugggacacuagaugacagagaugguuagagacccuuacgaagauguuugcugggagggggcuuuccccuuuguccaaaucaugagcauucuuguccgcaguuccuuucuucagacccucaucucccacuauacugucgcacuaagcuccaccagccccuugucuauggccauacagaccuggaucaccugucuucuacaucuaaaccccucaguggcuuccuagguucacagaauaacauuuagauucccuaggauggcauaagaacuguucucccccacccccagugcccugaccccugcuccccgggccauuucucuaguuucuccuacuuugcacaccauagcaagaccucuugcauuccccacaacagaauggcuguuuccugcuucugggccuuuggucaugccugucacucugucuguccuugauuguguucuuccccuaauucugacugcugcaagcccaggaaugaggaguccugcuguagauggcaugcuagaauguguuccaucagucuucucucacgccaccugugagauggcuucauggcacauaccuguguaggccuguuccaggaaacaguaauauagccuuagugguuuuguguauuugacucuccaacaucagauguggugcccacuggcuagcuacaaaugacuguugaggaaauuagugaaugaaugacucucugggaaugucuuuguuugguuucuagaagaaaaagauaagcauaacacucuguacacuacaagguguuuuagcuuuuuugaaauucacgggggaaacaaaagcaaagccucugauugacuagugauucuggaugaugauaaacuguauuucccaggaguguucuaaauauccaugcaagaaaagacugggguuuaaugagucccugcuuucuguagguacagaugacaugucaggcuaauuuuggucccuuggggauuaugaaggccuggaccuucccaugagcuugguucagggccuucccagcaggucagagcucaugacaucaaacaaaucagaguugauaccugagcuuuugaggcugguauaaagaagauccagucuugagagcagacuuuggcauuagauguuggcugcagucucuuccuaguagguacaggcuuuguaggaguuccugaaaggggaacggggacuauagccuuaucuugaaaaucaaaacaaacaacccaaaugacaacaaacuaacauuucuagagcacuuaauaugugccaaucacucugcagaguauuucugagagaagucauuuauucuuaagucuuguuuccuuagcaugauguauauacccugaggccuacacaugguuuuuuaggaugccaggaauauguguggaaggagaagagggggagggagaaaaugaaauaaagauggagucuacaauucaugcccauauucuuagguaaggacugcaacccagcuguugucaguaugagcugguaauugaacuugagucuuaauucuuaauuuaaaaauaaaaugaauugucauuuguguuaguuuuucuagucuaaaacuauuaauacagcucuucuacaggucuuaaaaauuacuuggguguauuuagggauugagcaaaugaguaaauggguuuauauuguagaagccaagguuuucacugaaaaaggaugaagauacaaauauggaauagagggaggcaagaaagaaccugcagggaugaauagggauaucacucugaacuggugauuuccaauauauguguguuuguggcaaauugauauacgcauguguguauuuaugcacauauaugugcacauguuaaaugcauguauuucauuguuccaucuacuggaaagguugagaaucaaagauacuccucuaauaagagcauaccuaagcaccuguaucugaguuucuaaugucacugccccucuaaacugaaccauacuccuggaauggcuaauuucaggacuggugcaagaugauccugaaacaucuuaucagacaagauaguaaagaacugcuguuaaaaaaaaaagaaaagaaaaagaaagaaagaaagaucacaagaaccaguacgaaggggcucuuauuggucaaaucugggacaguuugaacaccaaaauaauaaaguaaaguaugaacuauaaacaacuggggaggaggaauucaucagcccauaaugacaauggguggauagaaggaaagauggauggauggauugauggauggaugguuggauggauggaugggugcagggaaauauggaagacuccugcuuaccaaaugucaacuaaguaauaaauguggaugggugauagagcaggaaaaaucagcauacaccaccauugcaguaaagauuaugcacaaaacucaacggacacuaauuccaaacagagauuuaagaggaacaggacauuuacauacugaugaaauugucuuucacagauugcuuuaguauaauagaaaaauaguaauuaaguggagaaauugaacuauacuuugaucaggaucaaaauuaacauuaucauugagggguaagcaaacaucaugugccuucagaauauccugagaacaagagaacaucaccuauuugggauucuggccaaaaauguauaaccugaaucuaaucaugaggaaacuuaagacacaugcuuuauuaaaaagcaggaagaggaagaauuguauccuuccaaaguagcacuaccauaaacaaagacagaggaaaugguccugauuaaagaagccuaaagagguguggcaacuaaaugcaauacuugacucuagacuggauucugugcuugggaguuugaggguagggaaggugaauaccauaauggccauuauuggaucauuugaccaacuggaguauagauggagauuaaaguauccuaucaguguucaguguccugaaguugauauauuugcauauacacauacacguguguauauauauacauacauauuguuuucucucucucuuuguauaugcauacacacacaaaaccaauggaugaaccuggguaaagaguguuaguauaaacaaguaguguuuauacuauuugucuucuugcaacuuuucuguaaguuugaaauuauucuucaauauuaaguuaaaaauuuuuuuuuuaaaucuuggccaaauaaaugauuguuuuucaaaugaauauuuuuuauuuuacguccuuucuuuuccuguucucuuacuucuuuucuuccuuuuuugugucccuucuuuuagaaguccaaggcuugcgagaaggucauuuccgugggucaaacggucaucacgaagcaucggaacacccgguauuacaguugcagagugauggcugugacaucgcagaccuucuaugaggucauguuugaugauggcuccuuuagcagagacacauuuccugaggauaucgugguaaguaggcuuccuugagugccugcuacccagaguaauuuaaaaaaaaaaaccaaaguaacugagcccuucagaauuuuucuuuuggcuuuuugaguagcucauucacuugguucauagacuuuaucauucuaaauaauauccaggugaacuuagacugaucuucccacauucuuuuuuuggccaaacguuauuuggccaagaaauaagggagcagcccucacgaccuaaucaccucuuaaagguccaccuguuaauacuaucacauuggcaacaccugaauuuuggaugggaccuauucaaaccauagcagauaugaauccaccuauucuuuccuguuacaagaugugaacaaauuugaauucuuuuaugacuuucuuuucuuuaugcuuaacuagagaauguggcuuugauuaaucugacucgacaguguauuuaaaucuuuggauauuccacaugggaguaacaaaagucacacagaagaaaggcuguggcauuuaaguaguuucguuacuguggcggagacuagaacucugugugugugugugcgugcgcgugugugugugucuggcugucuuguuggucugucuccaucuccuccuuccucuguccccucagcaaacaccuuggggcucauucugaggaacuagugaacgugugccaggguaaugacugacuuuguuucagggcuugcuuuuuagaaggguguuuucacaagaagagcacuuuccacagaggguuuuuuuugacaccgaaaucaaaucucgugacugagaggagagugaguuagucuggugcugauccuguuaucccuucuccuuucggggggugugugaguuuggggagcugacccuuaauaauguagucaucacuucugccucauucugggucucuguugaugcuuugcuuuuguuuguauuuggaaagauauuuucagcgacuuuuuaauagucauaauuguguauuaugugcacuugaaaauuaaauguaaccuuuugaaauugcuaaagacaguuucuaggauuuuggucuccagguguugaagaaacauugauucaguuaguuuuguuauacuuaccucucucuaugcugguaagaauggcaaguauauaaacaaaagugaccuuauuugaaagauuuuaaagcaaaugaauguaaguuauuuaaaaaucccagaacagugaauuguguuucuuaccaggguucuagcuggaguuucccuuuacugcauugccacuguuauucauaaacagcaucccuuaggugacauacuccccuuguuagaauuagucaucccuucaagcacucaaucugcauucacugaauaccugcugugugucacuuacuuaccacacuaggugcuggaaacauaaagagaaagaagauguaauccuugcucagucuuggugggagguaggcggguaaauggaugcuuucucuaccguggacccaugucuagaacccaugugguucuauacuugaacuacaagcaaucuaccaccuguuggggcuggaagaauaaguaacacuuacugacauuuaccauguuccaggcacugcuccaagaacuggaaccaugaacucaguucauccucauaacccuacacacuaggcacuauaauuuuucacauuuugcuguugaggaaacugaggcacaacauggugaauaauugucucaaggucacacauaauuaagaaguuucagaaacaguauuugauuacauguaauccgucucuagaacuuccacucuuaacccuggggaagaaaggacauuuaaagcaauaggagaagggauaugcaggagcaagagaggcaugaaaagccauugguagaaugaggccccuggacuuucaccagcccugugcaggcuacauaguuguuucagaauuagccuucucuugugaagacugugaauauugagcuggcaaaagacagaagaccuuuuggugaggaacacugugguggugggaugaaagacuucugagcacuaauuucaaaaccugagcacaguuaaacagguaaaacagugaggucuuuagccaugauaggaauuaaugaacccuaaauucucuuuuacaucauaagccuauacacaccaugccaguuugaggcuuuccuggaaugucuuuacauuggaaaagaaugucugugauccuguaauguuugaaauccugcaagucuuuccuuugacacccuccauuuccuuccucugugaaccagaacaaauaugauuuuaaguacacuugaguguugugagaagaacacagaagcuaacccgcagaagaguuuucuggagcgcaugccauuuaaaucaaugagaaugaaaaagcaaaacucuuuacagcuugguuagcugucacuuagcauuuuugauaaggauuugaggcuuaacagcaguugcauaugcccauguggccacaacuguugcccuggaggggggcagguaccauggaguggcaugaauucacauagauuggaaaggacgcaucuaucuaaaugugggugaauaguaaugucuuuuuuuucuuuuuucuuuuuugagacagggccucauuuugucgccuaggcuggagggcaguggugugaucacagcucacugcagccuugugcuccugggcuccggugauccucucgccucagccucuugaguagcugggaccacagcccugugccaccaugccuggcuaauuuuuuuuuuuuuuuaauuuuuuuguagagauggugucgaacugcguugcccgggcuggucucaaacucuugggcucaagugauccucccgccucggcaucccaaagugcugggauuacaguugugagccacugccauuggccuaauaacuucuucaggaaaaaaacaaaacaaaaacugaauucaucuuugugcaggucuucucuauuuugucugaucuuuccuccuuuugugcuccccacugcaauauccuaaucucuugccuucuugguuccccguuccaggcuccuaguaggaauaauucaaucguguuguguuucaaguuccauauacuuucuaacagugucaccguuguuagcugcuguagccucuucccucucuuacuuuggugaugaaugaggcuuccucagcucacuauugcugacucuauaggggaaguuuuuuuccccuuauaauauuguauuaggcaggguucuccagagaagcggaaccaauaggagauacacuuguagaaagagaugauaaggaauuggcucugugauuauggaggcugagaagucccaagauauuuuuguagagauggggucucaccauguugcccaggcuggucuugaacucccgggcucaacuuaaucuucugccucagccucccaaagugcugggauuacaggcaugagccacggugcccagccccacacaccauuauuuaagucauggauuuaauugcuaagaucaucccacuuccacuuuugauaauucaucuacaucagaacuguugucugggagauggguacccugcucaguacccuaauggaaaguuucaucaggacguaaaaaaaaaauguaaucagguuuguuucugucucaguaucuugaagaucguggcagaauaauuauauggugaaaacacuaacuacauuucacauuccucagagaaaucuuguuuucauuaggugauauaccuguagcaugagcaacuggugguagaaaaugauguuuuucuucuguuuguccaaaaacucucuaauccacacaaugugcauaucagaugugagugccacugggaagaauuauucaucaaauuauucaucaaauguagugugaccccaauguuacuggcuacugaagaacuaguucucuaagccucagguacugguuaacuagaacugcuuuaaggguacagugcaauuucaguuuccuaugaaaaucaaauuuaggauaucaaguuuaaucaucccaagcuauuuaucuauguaugacacaaauagagucccuuauggagccugaugcuuuaguaaagaaaguuacauucccauauuuauagaguugaugauuacaaaucauuucauaaacccaacagaugagaauccuuuaaugcaggcuggccuauccauguuugagaauuuuggcaggcguuaaaaaugcuuacguuagcguuaugugacuggagagagcauuuggagcaguaaggagaaacgcucuuugaacuaucaggaaaugucuuucccuaccuagguacuuuauuucugugcuagccagaaaaaaugugcaaaaaauucuuucucaacaaugcaccugcaaaauguguguaucagcccaguuaaacuccacaugcaaucuguagcugucaagggaaguaauaaaagguguauuauuacacaccuccaucugucagucuaugaaauugggacacacuucugaugaauuuuuuugccuuccacuauuuugaugggcaugaaaguugcccaccugaaaguacucaaugagcauaaagauuccagggucucuguuagccucugccaaaaccugggauccucuagcaugcaccuguuuacaguagagugaugacugcuuccuuuccucugaacuuugagcucacuuugagggaggagaaugguacgguggacacuugaguucucacuuaacauucaccacugggcaugagaagagaaacaggaccauuuagaaauuugauagcaggaguccaucacugaaauuuccaugaggacuggcuacauuuuucagcuuugguugaaaugugaaagaagcaugaaaacaauacucuucaagauucugggggugaguaguuauggccuuuaguuuugagggcugugcaaugcaaacugagguucuugcagccaauguuuuuuucucacauaaaggcaguuugcuuaaauuuuccagccccaguuuuuuuccccuacuaauuugaaaggagcaaauaaacuaaaugccugacauauaguaggaaaaguccaauuuuuuagaauauuaacuuuaguauguagaacuuuuuuuuucuuuuuccuucccaucuaguuuauacuaaccuuuucuggucuugaaauuuggaguuagaagauguguccucagaacuucaugccuacuugucagauuagaugagaaccuguacuugugagauuuugcuggguccauuuaucauucccacuugcuauaagguagucccagcaucuuuuagacuuuauaauagccuaguucccuacauuuaugcuuguguuuucugaguguauuuuuucaguguuauuucaguggcuuucuguaacaaacccugcuccagaguaaguucacacucauuucacagacguguuacuugccaagucgcacaaaagcuccucaaaauacacggugacagagguagguccugauugcagguuaguccccuuguuccauugcuuauugccuuagaaguucugcucuuuguggcuuagugcagcugagguagaagacgcugugccugcucuaagggaaaacacagauccaguaggacaugguguaaaacccguuucaguguugagccccgcacaagcccucgcuuggcaagcauagguguaggagagaucuggguauuccagaggcaaaagaaaauauccaaguggguuugagaaacuagaacagaguuguucccagaaacguucucuacugugggaucccgggaaacauuguuggaucccucuugccuccuagauuuugagguguccuagauguucaggucagguagccaugcauauauggcauuggcagauaccccuugucagugagcucaccucagcuuuggaagcccugucccaucccagaccauuuguguuaugugugcuccagagggcugcccuucuccucuucccucucccccucccugccaggaaguucugguucuuuuggaaucaguggacauuugccagagaaggcuuuggaaacuuucuuugguuuagaggucugcaggcauggcccacauggccuuucacucuuuaggguucucucgcuuuucuaucuugacuguggaguugggaauccgugagaugaaaggcuucaccaaauuccaguuaauuuuuaguuacgagggaaaccuuuuauacauguaaaagagugucuaaauuuacuuuucuaaauguuuaaauuuaucugacaaauuuuauuuauaaaucuaauauuugcauaaaaaaagaacaaacucauuuguuccuugauuaauguucacaugaugcauaaaucaaauccuaaccguuauguuuauguagccaaauuuccuuggacauuuuaacuaugauuauaaauuuaauauauacauuucucacaaaugucacaauuuuucuaggcauuuaaugcccauaacuuuaauaaaucagacauuaguuagcuugaauucuccuauuucagacauuuucaaaaacaguauguaaaccaguauaauauuuacagaacacagaugcaccuuuauaaacacaauuuacauaagaucgauagauaaguagauagacuuugcccaaucaaggggaaacaauauuaccauauuggcuaggagucuacuaagaagaaauaaucauagaaucugaaggccauuuuagaggcauagaaucugguuaugccuuugaagaauaaaccugcaguuauugggcaggggcuccuaauuaaggucagguuucauuugauucaucaacucuguaaaccuugugccuuucacugggguccugacuagucuuacaaguuucgugaacugucucugaaguccauggaggugguacuucccagguccuagaauuuuauuuccuuuuguguaacucauaugacuuuuuacauuacagccuuggacauaggaaugaaauguugaagccuuuacucaaguugcaguugcaucuuguuccuuuguuuuacgaauugugugugucucacugaccccaauucuguaggcaucauagcgacaguuuccacucaucacuggggauccucuggagaaaguaugucguugcccugaugucccaugcaggagauucaguaguugccacaaagacagacugacaguuacguuuuucuucaaauauauaccucccucacuugaggguauuucucuuauuuucugugcuggcaguuaucucaaggugauuggcauugggaacuuauucccaaaggacagguuccuggcacuuccuucccacuuuuuucuuuccaggagagacucagguauagcauuucaucuucagccuaaagaaucaaaauaacuaccuugaacuugagagcaguguuauuaauuuccaggacuucaucaucuuuucucagugcugaauauucaugggugagccugcuuaaacccaugggcagcgggcaccaugagccaaauccacuccauguuugggaguauccagugauguuguccguucugagcuauguguugaacacuguguuaggcaucaugggggauucagagauguguaaacacagauguaggaggagugacauggauguucuggaggcaaaauacaauacccaaggaaguuggaaagacuaagaaaaaagccauucccagaaacuuuuucagcuaugggaucuugggaagcaauuuuggaucuucgucggugucuacacuuugaggugcucuggaguuuugggccaaguggccaagacaguggcagacaucucucaucagugagcccaucucagcuuugggaagucacaucccaucccagcccacugauguauuaugcugcuccacacugaugcaguuauacucccucaccaccaccaggagcucaucugaaauauuuuacaagaaaaacacccaguggagguuauugacaguaaauucggggaaugaagcaauugugaugggccagaguguuuaaagaagucacguugaggaagagagaugucaacuggguuacugacuuagaagaguuuuuuguguauucuagauacaaguccuuuuucagacgcuuugcaauguuuacucccugucugcauaaugucccauuuuauaguaugaauauaacacauuuuguuuauccauucaccaguugauggacauuuggauuauuuccuguuuggggcuauuauaaauaauucugccgugaaauuugcuuucaaggcuuuguauggacauguguuuucauuucucuuggguaaagacuuaggagugagauuacuaaguuauaugguaaguguguguucaacuuuauaggaaacugccaaacuguuuuccaaaguggcugugccauuuuaucuucccaccagcaacauuugagguuacaguuucuucacauccucaccaacaccuguguugucagucuuuuggacaauaaccauuguaguggauguauaguguuauuucacgguauuguaauuuauguuucccuauugacuaaugauuugagcaucuuuucaagugcuuauuagccauucaucugucuucuacgaugaaaagccuauucaaaccaguaauauauuuuacauuuuauugaguuuucuuauauugaguugugggaauuuuuuaaauagucuguacauauccuuuaucagaucuuugauuuacaaacacuuucuccugguucgugucuuguuuugucacuuucuuaauaguguauaaagagcaaaaguuauacauuuugaugaagcccaauuugucaacuuuuucuuaauggaucaugugcuuuaaaauuugaguucaugaaguuucauguccuuucuagguaaagaauauuuuuuccucagagcucuagcaagcagcuccagggaaaacucaagccuucaauguuuuagcuuucuugugagauuuauuuauuuuuuaaauaaaucagaaaccucucuuucuauagauaugugaacuuucuuuaaacgaggagaucucuggcccugaaaaacuuugaaaccacugguucaggugaagucgaucauuaccugcuauuucacugccaugagagugagaagucugucgugagagaggguuaagggagucagggcauuggcgcaccugcugguccccugugccagccugagagcagaacuguugggaaaugucuccaguggccuuggcaggcuuacccaugaauguucagcaccaaauuaugaauauccaugacaucauaucuaaauguuaggguagggcugaaucaacuuccauuuaauacaaaauauaaacauuaugaaaauucuuuguuucuucuaauaacuaacguggccagaugucacuaucacuucacaucguaauaucagauugucaccauucauuauugacccuucgauuacucuuuaaaugaaaaugguacguuagcugccuaugaugcaaaauuuuacacuuuuaaaucguuucuugcuguaauuuuauuuuuaucucaaaucuagauaccaugacuaaguguaguauaaucagguugcuauaugcauguuucagaaaugucugaaauuuuccagagcugaccuuuccuguagcgcauuuguaagcacagcuuucugcauacaauuucugaaauauauggcgaauggcaagagcuuccugaggcgaguugucaacagggagcugccuguuuacaagccauuaucuuucaccucuauccaaccccaggugcuaacaccccaggauauagcacauaaauuggugacacaucccagaagauaugaggcccauaaaucaaugaagaguuuauguuccuuuucgaccaugggauuuaaauuauuuuggcaauagagugaacuuagauucuuauucgauagauauauccagaagaagucaguacuaucuacuuauugaugagcaacauuaccuucauuuuauuauuuccuuuuuguaccuuauuuaaaagaaguuaguuaauuuucaugggugagaaagaaccaguaauaaaucuugccuuuugcauuauuaaauaaauuauaauuuugaggucagaguaugugggcaaauggagaagaggaaugauagaagaaaaggcagagagaauggagugaguguauuuuuguccuucaguuucuaaucuucccuacagagaguguucuaugcuaagaagugagugaaaugcuuggaagcuauugccugcuauaaugcuuguugguuguguguguuucugcaaaucaauuucccucuaucaucuaauuuuuugccuuuuauaaaauggaggauauauuugaaagucuucugugcuuuagauguuuuauccaauaccauuauagaauuuuauauuuguauaauguuuaauuucuucuaaagguuaaaauaguacaauauguugaauaauguuauaugcauaguuuucagaucaaaguagauuuuuccacgaguaauuaaagcuggugugaucugugccugaaaaagaucucuuuugggccaggcacgguggcucacaccugaaaucccagcgcuuuggggcaccaaagcaggaggauuauuugaguccaggaguuugagaccagccugggcaacauagaaagaccucuucuuuacaaaaaaauuuaaaaaaauuuagccaggcauggugacguguaccuguaguccuagcuccuugggagacugaggcaggaggaacccuuaagcccaggaaguuugagguuacagugggcuaugaucacaccauugcauuccugccugggugacagagccaaacccugucucuaaaaaaaauaaaauaaaagaugccuuuuguagauuuaugacuaacaaaucagcaaaaagggaagggguaguuaaauuaugcauacuuccaguagcauaguuauauuuguagguuauguuuuuaaaacaugcuagauauuuacucuuucuagccuuuaauuaauaaucuaggccaggcgcaguggcugacaccuggaaucccagcaccuugggaguucgaggcaggcagauggcuugagcucaagaguuugauaccagccugggcaacauggcaaaaacccaucucuacaaaaaaauuucaaaaaauuagccaggcauggugguaugcaucuuuagucccagguacucaggaggcugaggugggaggaucacuugagccugggaggccgagguugcaaugagcugagauucugccgcugcucuccagucugggugacaggaccagacccugucuuaaaagaaaacaaaaaaauaaauaaucugacccaaugauugccuuauguguuauauuaucauucuuuuccccugaguaacagauaauauugaaucaucuaaagcagcuucuuugauuuacaccauaaaagaaagugacuggcacaaaacaagccaggcuuuaguccuuauguucuaagcagccaacaccugaagucauguugaaauacagacuauaagagaacuauggaaagaauguggaugugagugccauugauauuaagugagacucuaaaauuauauguauauauauuguaaagacugucucaucacacuauaacccuuagaccaggcugcaaguggccacacuagacccuguaacuuuuccuauuuuguucccuacaugaauuuugaaauaauuuauguaucgcauaugaauuuaauauuuuccuuacaguuuuaaaauguauuucaauacuaguaaaaccuuuuuucuauauuauuuaugcuggaacuuuaucucauaucauuauguaagcagugguaguugucuguaugagucugcagcaaccucaauucuugcugccucagaagacaauaauuugacucaggggcauaaggcagaaggagagacugaggcaaguuuuagagcaagaguuaaaguuaauuaaaaagcuuuagagcaguaaugaaaggaaggaaaggacacuuggaagagggccaagcaggugacuugagagaccacaugggcagcuucaccucuugacuugggaucuuauacacugacauacuucuggggcauugcauuccuucucgucacuccugagaucuuauccagaagcugcugcucaccaguuucagguguuucccauguauuaggagacagccuuucccuggugccagcugugaccaauuauuaguuuagcgagacaguuaacaaccugaccaucaccugauggucgcccuacacuccugguguauguggcaggggcugaggaggccucuuccgcccugcucauaccugacugacuauguacuguaacaacuaguuguguuuguacagggcuuuauguuuguuuugcuuuuuuguuguuggguuuuuuuguuuuuguuuuuuguuuugcaugaaauuaaaagggcaaaaauguaaccagugucuaagaguagguucccuccaggagaaaucuaaugaggaugaggaaauaguauguguggugcucaaguccucuuucuucuuagaguuggggacucauaaagauggggaaggcuaaugcuucccaugaaggcccuucuuuugguagauagggaauuccugcagggcuggccuugauaagccgcaucuggguaccugcauauggucauacauggauucucuagucaagaaauaccuuauccuuccaugaugguagccuuaugcccccaaguuuucuuacagugagcaccuacuacaugccacccaucaugcuggguucugggaaaaugauagcaguaaaauucgaaugguuuuugaucucauggaguuuacaaucuagugggagagagugacauacgcagcauguauaaaagaugugcuucgaauugagagaaguccugggaugacaggaauaugauccaguaagagcauguaacuagaaauaaacaucuuaucuagaugggugaucagugcgaccugaaugaagaucuguaaggugaguucacuaaacacagggcagagggaaggcaagugcagcugcuggaggagguaaaucaugagccuggagaagaaggaaagggccagacuggguggggccuugaggccaucuuauaggguugggguuuuauucuaaaagcaggaggaagcccccuuggacuaucuugagcagaagucaaagagauuuguuaugaaguagguuuuuuuuggcucuagugaaaaagaauuggaaaguccacagggguguccaaagaagagaauacagucauggguucuuaguuucuauuucugguuaggccaguagaaccccuuucucaucccucuuuucccauuaucacuagagagaaacuaaaaaggauggcuucaggcugcuaaaauacagacuauaagagacuauaaaagccuaaaaacaaaacaaaacagaacaacaacaacaacaacauaagguggguuggacaagcuugccugaauacugggaggccaguuaggagaauguugcaguaaaucagaggagaaaugaugguaauuuggacuaauuuaggaucugaaauauauuuagaagguaaaaucaagaguaccaggugauggauugauaaugggggccaaggaagaaagaugugucaaauauaacucccaggauucuggcuugcucagccaaguggaaggugacaccugucauugagauagggaacuucggaagaagcccagacuuccaggcccaggaugaugaguucagacuugguuguguuggaguuucuucccuucugcucuguuuuauacaccuagagcaguuaccauaauuuagggccauuccaagcccccugguuugcaaagcauaguuuuuguuguuauuagguuuuuuuuuuuucuuuuucuuuuacauagaauguaagggaugcugagugaaaagucccaugccucaaugugagaagagacaucucauguuuuagaagugacgugaccaggcacuucaucucuaaauggaugugucaucacacacacauaaaccccauuaacuaacuuucacccauuugauaaaauagucauuuugcccaagaaauucuucaguaugaaaauauauuuacccuuuauggggcuuccaucuugacacacgaacauuuaaauugagcauuuaucccucuugaauuuggcuguuuuaaaaauaaauaaauaaauugagcauaugauuacacauauguagacuuggccucacuauauagcugauucuaacgucucuuaauccuuagcucucuucaguacucauuuguguuguuuuguuuccaacccuuuauucugugcaugcagccuugugugcucuaccccggaacuuuuaaucccccuguuuccuuuuuaaaauuuucauagagauggggucuuucgcuauccaagcuguucuggaacuccuaaagcaauccuuccacuuuggccucccaaaaugcugggauuacaggugugagccaccacaaccagccuaguuucccuuucuauucaguggcuuugccuccccuccccugggcucccucaucaugaaccaguguagaggcugaugcaucugcuauguugcccugagaagagcugucauuuucugaaggagauggacuacaugacuuaccgagucuugaacaucucucauuuugagauucauuuaccuuuuuuaaagggaaagaauagaugacuaacuuugguagauaaaaugugugugguuagugguaauaauaauaauuagcaacuaauauuuaauaauuguagauguacaauguuuugcauaacauacccauggcuggcuaaagucccaagaaauacagaaggauuuaagaugaaaagugcauuccugcaccucccacaucuggaaaucaccgucucaccugcuucucauauauccucccaggauuuuaaaaaugcucauacaggcuguguguguguguguguguguacacacaauguauucauuugaaugcaccuggcaucauauuaacaugcuaaaagcuaggaauuacauccuguauauuguuaaugucauaguuacuguuaauuggaugauguuuaaaguuugcaagcaggcccaucuccuuuuauccuuuaucuuccucuaccuccuuaccuacuuguuuuaucacugaagucccacucccuccccucccagcuuacucuauaaaagcuagucucagcuguuccaguaccagcaucgcuuauacugaccccacuuucaggugcccacuuacccugggagccccaacacuuuggcauguuuugguuuccaguugccucuauacgcagaucuauaucagugggugucuguuucaaggaaaguaacugaggaugcuaacuaaccuuguuacuuuuuuaguagauugaaaaaagauaucacaauugaaauauuaauugaccaacuauucaguguucauuaagcaaaucagauguuagcaagaaucagccuucaaaugaagacuaauaucuggugugaaaagaauagaaaagcucuuacuucagagguucauuaacugucagaaaaagggcaugacauaauccuugaugugauucugaaccgggcauuccacaguugcgugcaucaguaaagcgaaauuuaccacccuccuuuuauguguuuuuaagccuugguggauuaaaagcucuuguuuggauaaaucuaacaaugguguguuaucuacauauuauuuucauucuccuugccugggaaucuacaaacagcaaaauucuucuuaauuucacauuaagaauauuuugauuugacagguuuucaacaacacaagaaucauuugggggaguuucugacuucccuuuaagcauaauaauguugacuaaauagauugauucauuauccacuccuuaaccaucuuagcuaucugucugucauuuuugacagaguagucucuguugaaaugcugguaguaauuacacauaucccugucugcauaagucaguguauaaugagcaugauugguuaacuuuaugcauuuacauuuaaucuaaaaggaaggacauguuaaacucacagagauagaagcuguagcuuaugugaaaaguauuucuagaauggcauugcucacauuuuuuuacugugcucaggaacacauuuccagcuuugaggauauccugaauuacuucauuuuugcauguauacucauuacuccucuuuuuguuuuuuuuuuguuuuuguuuuuguuuuuuuugugugacuaggucuugcuguguuguccagacuggucucaaacuauugggcucaagcgauacgcucaccucggccucccaaacucaaacuuugggaggccaaggugagagagauuacaggcaugagcuaccaugcccggccacuccucaguuucugaauaccaugagcugauauuuucugacaaaucauauucuuacagguucuuugguuggucgucaccuggcucugcuuuuuaauccccuaguuaaaauucuccccaaguguuacccauuugcucaaaaccuugcacugcugggcugugaaaugcaagguuaaauuauaggcagcucuuggggacuugugacugugcaagucauuucauuauucagcccuucccuuucaacuggggacauuggccuaggggaucucucaggucucuucccauucucguaggggagaacagccauaggugaucucuagucaucucugacuauaaacauuggaauguggccccuggccccaccauuccacucauccgcauauacauuucuuuccccuuucccggauuccuggcguggagcaccaccuguguggugaaugugacaggaguacaugcucagucagcuugggugaaguggagagugaaaaugcuguucauguggacacagccuccacacuguaagacguggcaugccacuuguaucagaauauuacauggagucaaagggagcuaagcuauucuuaggucucagcccaggagugagcaaucuuugacguauuuuuaggcaccgugaugucuuugcaguuguagcuuuaccacagaagcuuugugaaagcuuuuucuaccacaguggcugagacccacacaccuguugccuucauccuuucuaugcauuuugcuucaccccuuugcgcaucaccuggcugauugaguuaaaccagccucccucugggcccaccagagaauaagguggugcugcauuaacaggccuccuccucggguguugauccucaaaggaugcuccucuccuuugaccaaagaggaagcugacauuauagaguuaaaggugcguggccagaggguggcgggggagaaagcuaacuacgugucugcguuugauuuuuuuccugccauccuuuugcauauucucuaugcuuuggugaaggaggaggaucacuagaaugggacuugaaaauuuagaaaccguagucucagccuugcccauacuucuaaugagaguuggacaggccauugaauggcuggaaguucugagucgcugugucucaguucaggggugcugcguaggugagacaggcugauggggggcgcacuccccucucaccucaucccuuaacuguucauucuuacccccacucugcugugcucuauuuuucccccaacuccuccagaacucccacccacagccagacaucuccucugccauaccucuggugaggaguuuucagauccauucuggaacgcugcaaaugacaggagcucacucucaauuuuugcugcaauuguuaggaagcaagggcuucuuucugugaagucuaacugcugccucuucggaacacccaggagccuuccuaguucucgaucucuagagcaaaacugaauaaacacacucucuuucgcuuaaguuucuuaacauguuuguggagaggucucaagucccugcuaagucuucucaaauccaaacaauacaguccucauuucucagucauggggcaggaaugaaggauuuaauaaacagaaagugguuccugaaugcucuuccuccaggacacucugaggaugaaauuuucuuggacagugucccacugaagauguugcucucagguguggaaacacagugccccaaacacaaucuggcuagugcaagcaugacggcucuuuguuccuuugaucuggacauugaacacuuaccagugcagccaggaggaagguuaaaugaauuauuuaugcagccauuaaaaucauguuuucaaaggauauuuaaugaugcaauauaauaaauggaaaaaucaggcacaaaauuguauguacaguaagaucccaauuauguauaaaaauauaaauaugcaagggaaaaauccucaaaggaaauacaucaaaauguuacugauuaucuuuggagaguguaaucauaggugauuaugauuuucaacuuuaucaccuucuuauaguuuccauaugaacguguuuuauuuuuauaaucagaaaaaguuuuuuuaaaaaagaucuuaacccuucugagaacuacuuauauccuuacucuuuuccccuaauuuuccuuaucuagaucuuuacagauugcuuugucaaaauuucauuuuugaucucuagcucuuguggcaucuugaagcucucuggaauauaggaaccauauaguugccaauaaucugucaaaugcuucugcuuuacacuguuauuccuuauguaggaguucuuauacuuaauuuuuuuuaagucaaugccugcauuuuccaaugaagcaguuucuaugaaguaaaaaacuauaucuguuuaacucacuacucauuccuuuguucccuaaaacacgagaugcuugaaaauucccagguaagugagugacagccccacccaucuacuuauuagcccuguggccucaggcgagucacucuucucuaccagugcuggaggauguugacgcuugccugccuacccuaccaggcuguuucagauuccaaugaggauaacaaacacgauuguccucuguaguucuguguucuguuguagccuccuuucucucguagucaggguucuuggcuucucaguguuuccuucacuauuuuuaaucccaaagguggccucccaaggguuuugucuccucccuauccucuagguauauuccuguugaugggaauuaaaucuagaugugauucacucaauauucacuagcugccaggaauuggguuuugcuuuucuguucucuucucucauucucccugcaagauugcauuaauaucgccauuugauuaaugagaaaaccaggacauaagguuuauuaaugagaaaaccaggacauaaggugguugaguagcuuaugcacaguaauggguuuucuuugacugugaguggccugaccccagaucuuggaagcaguacaugcaucacuucagugugaagcguccuggguaggucaagcugugcucccagaaguagaacaaacauugcagagcagagccagagccuuggaaagccggacauauaaacacagggcagccuucucuccccugcgugccuauccuuagcuuuccuuucaucuuucuuuuuuuagcuuuuggaacugacauguauuuuuagaaaccacuacagagaaauucaccccaagccugucuuucuccauuuugcaacauaaauuuuuauugacauaguaaaauauuuuauuccccucauacauuuuagucccugccaacaacaauaaaaaaggggagaaaaucuuuccuauauagauggagcuuuuuuccccguguuugggggugagaaguuaaaguccugggguguucuacaggaggacacagugagcccuggggcagucaucagggccgauguuggcucucuuacccagguaggaagagcuacauguguggcaggcagacccagggugcuccuugcucugcuaauuagcugugcaaccaggcaagggaguugacaccaguuaccuuaucuguaaauuggagauaguaaugucacaggagccuuaggguguugcuuugccagcuggaaaccucuguggcugguggcgccucugcuugaguuuugcucaugcccgcuaggcucguuccguccacucagcccagcaggcugugcucggcucaugcuacuggcccggaucccgugccugccaagggcaagccaggcuuggagcggcgagguugugugugagcacagggccaggccacugcacacagcaaggcaugccagcuguugugguggggugggcagcuccaggugccggcuccaugugaggcuguggcuggaccagauauacgacaagcagcuucugcuguggauaucagcauccggacaaggggaacaugguggcgcccaaaagcuuggagacgccaggaagugcagagccccagagaggauguuacaguguguuacagcccuggcuuggggaaccugaaggucugggcucccagaagagcugcagcuuuucucuccuccuugcccacagugcggugagccggggggccauguuucagcccauuuguguuacagcucuuucaguaccaccaccccacuucagcuugcagcucaugggcuggccuggccccacagcucuuucccguuguguggggcagcugcccaguagcaguggagaacaggagggcuguaguguuacggcagcucuggcucagggaauuccaaggucugggcacccagaaggguuggcacucuucacugccacugucugggaguguaucacugccuacagcuuggugaggcagccaggaacguguuacaacccauuucacucccaccauuuggcaggucccaaguucuuguccugcguccaggaagaaugagauuauguggacaauuggagggugagcaagacagagaaaggcuuuauuggaugaccgaacaccucuuaguggagaggagaccugaaguggguagcuccuauccacaggcagguagucccaaggagugucugaguccagcugagucugggguuuuuauggggucagaauggaggaagugcuugcugauugguccauggaugggccuggaaaaagcaccacuugauuggcuaaaacuucaucaaggaaguucucacucccuguugcagacuucacccggaauuggcagcccagccccaggcuucaggccaucccuggcuugaaggugggguuucaccagggaucccucccaucccuccuaauaaccugucugccuuuugccgucaucaacugccacuuauggcacccagguuuucugcaccaaggggcacuugcaugcccaugccgagccgcccucaggccccuuggccucacucccgugcuccucagcacccaaaaugucagccucagaacuaguuucuggaggugcugagacagucuggggucugguguguuagugccauccugagcaugcacacgcccggcugggucgcuacagugccugggcucagcuaucaagacacgauggcaacuuuguuccacugcagagugcauaccaggagcggggagaagccagggaguggaagcaggcacuuccgagccugccggggcaggggccuuccugggacccugagagcacagggaugcccggguccagagccacggcugggcagcugcagcugcaccugggagcaugggcucccgcccugccagcucaguagggcacggggcucccacugggaucaccuguucccagcccccaugugcagccuuggccaugccucccucgcugcagcuggcauccucacaguggcugcuucagacaggccgccgccaccaguaguaaugaauacuggaauuuguguugggauuauugaaacguaaugcauaaagcaguuaguguggugcccagcacauaguaaacaaaugcagguaguguuuguggcugugguggcaguggugauuauggucgaugguggcagccaguaauuuuuggucagcucauuggucagagagucccuaagcacaagauuucuagaaacauuuuuucacccuacaucuuccauaccuuuaaauaaagaagagguuacugaaagaaggaucuaagaggaagugucagaaagcuuuacacguauaaauuccuuauuuaaguaguuuuuauauuuggagcuuucaggaguugaacuuggaagauuuccuauuuuggcuccugguaugguggggcacagcccugagaucacgagugggaucauuccagaauacuguagaaagggagaggaaggggucagggcuacaacucugucuccuguuuggcuacaccacucaacacggucagugggauagacugaccagcuaugcgagcccaaacgaaaucagguugacaaugccggagccccaaacagugguccccacagagugccgcaggagccgcccucuggcuucucccuuucaccucuuucuuuaaggccuguauuauugcucucaccacaacuuguccugagagaggugucuauaauuagcucaguuugugugcaggguggcuuaacguggaggaaguggcaugaggaacuuugguuaaucuuaagaggaaaguccugaacacaguugauguccugggagggcgggucacagacacagaguucccaccucuuugccuaacuaccuacagucacacacagugccuuguauugcagauauucauguguguauuugaguccccagcuggaucugaauccuuggagagaaaugucuccgagagggcugggucuuuuuugucucuguuuucucagugcugagcucagucccuggcccagaggacacacucagagggaaggagaaggcaggaaugcagagaaucucuuaccaguggguuagaacugcugcucuugugcccacauugccuuccuggucccuccccugcaggcccuuuuggguguggucaaccccgcagugucaacccuguuucuaguuauuggcguuuguuaugcuuccucacuucaaaggaaccagaaaaauaauuuccaaaaacagcugccuuuguacuuucuaggccuuuuaagguuuuugcaugccagaaucucaccuauuucuaauaucauaaagauguggcugcuuuggaaaauauaccucugaggcuuaaugcuauaauaacuuccagaauaauaaaacaaccuccgucucugggaccucaguaccuuaaccaagcaucguguccacuuugggcucaucauuggagggaaaguacguacuaacaaagcagcggaccaggcacuguggcucacaccuguaaucccagcacuuugggaggcugaagcaggaggaccuuuugagggcaggaguucaagaccagccuugccaacauagugagaccuugucucuauaaaaagcaacaaccacaaaaaacuagauggccuucaggaauucaccaaauaaguuuuagugcuuuuauuuuugugaaaauaacagaccuaucuuuuagaaaauagguauagcuguguaugaggacauuggccaagugugacugguggaaaaaaaaaaauuggcuguuugaguaagcaagaugggcuucauuucagcuuaagggacaaccacagcaucuuggaguucagaaaggguguguauguguccuuuagaaacaaacaaggccaggcgugcuggcucacaccuguaaucccagcacuucgggaggcggaagugguugugcccagcuauguugcugggcaacauagcaagaccucaucucuacuuuuaaaaaaaaauuagccaagcaugguggcacgcaccuguauucucagcuauuugggaggcugaggugggagaaucaccugagcccgggaagccaaggcugcagugagcugugauagugccacugcagucacuccggccugggcgacaggagugagacccugugucaaaacuauuaaaaagggaaaguggacaguagacuuggauagacuuggaguuucccagaaugauuagugucaguauagaagcagcuuggcuugaaucgauuaacccagagccugaaauuacaggggucuagaaccagcacagaacacgcuuagauacagauaccucaguguggaagcauuccacauuuucuucuaagcauguuagaaagcucucacucugaaaaagacgcagucagaagaaggggcacagaauugguucuuucguuauacacagaauguauaguuuaggcugcgagauaaccuccuagaacagcaguucccacccugcugagcaugagauugccuggaaaggcauuuggcuuggaccagcugaaucagaaauuucucuggugguuaacauuagauuuauuuacugcacuagagaaaugagucugauguugaauuuuucaaagcugaugaaacuaaguuuauaaauaguuuauaugccuuuuuaccaaguaacucuuauucuaggagucuaagaauagagucaguaauucagacaaagauuuaugauaacaaauauacaauagcauuauguaugauaggggaaaauugcagugaccuaaauauuuaauaaaggaguggcuaaauuaguugugguucaucuauacuguugcauauauuuggcaaguaaaacagaguuuuuaaaagauaauuaauagcuaacaaaaugcucaugauguaaucguagguggcaaauagcaagguacaaaauuauauauguccacgaaagaaauauuguaggauuucgcuuacaugagguaccuagaauagucaaauucucagagacagaaaggagaauggugauugccaggggcugaugagagagagaaugaggaguuaguguuuaaugagugcagaguuucuguuugggaagauaaaguucugaagauggagaguggugaugaagucacaacacuuugaacuuaaugucacugaaauuuacaauugaaugugguuaaaaugguaaauuuaguguuauggguauuuuaccccaauaaaaaagaaagggccuccaccccaaaaugcuguggaaggaggcgaaggaacauggcaugaacucaguuccaagcucuugacaaauagcuuuagagacagaucagcuguauucuaacaugaaagaaaauaaaggcuggaccggcugcaggggaaagauugugcauguauaggauguccuaauucuuaaagaaaagagcacagagaaaaauucuuuaaauuaguuuuaaaaauuagaaguacagggaaaaaacuccaaauguggugacagugaucacuugugauagaaauaugagguuuuaaaauuuuuuccuaucuuuaagaaauuuuacaguuucucccuaaugaauauauagaagcucagaauuacucauaaaaauacuuuuucuucuuuuuuguuuuauagagauggggucuugcuauguugcccaggcuggucuugaacuccugagcucaagugauccuuccaccuuggccgcccaaagugcugggauuacacuuugggugagccaccaugcccagccuuaaaaauaauuuuuaaguguuugcauucuuugcuaaucucuacaugaagggugcuuaugacauguuuaacaagcaguccaaagugguguauccccaucagaguagcccccuugagaggccauugcuaagagcuggccauuccuccggugcuuggugacuuuauugucuggaauacauucuuguggauauccucagagagcgcacauccuuacacugggggguauugaaaacuugggagacugcugccggucaucuaggaccaagccuugugaacagguagaugcuuccaucaauaugcucccuucuuuuugaggaggaugguuuugcagcugggccuuugcauggugugggaaguccuccaguuuuauauuccauuguuaagugagagguuucuuuccauuuugugggaggagggaucugucaucaugcaaacuagcgguuacuuaucaggguuguuaauggcaaccaacagaaacugacauugauuuagccuguacagaaauuuagugaaagguuauuggggagcuuccagaaucuccaggaaugcagaagaacaaaggucagaaaauaggcaagaacaaaaaggaggcuguucagcugcagcuaugggcaagaccagaccacagaugccauccaggaaggacacacugccuccccuuauguggugagacuggaccuaaccucugcuguaggccugugggugcugcugcugcugcugcugucugagagaauucucucuucuacuuguuucucugcaucucugaucacagguucuaaauccugggcuggugcagcccacuggccaggccgcuguaguugucuuugcugugagggaagcuggggaagggagugucuggcaguguucagugacugugaugucaggccagcucagcccccauuagacuggggagaaggggguuccaaagcugggcagccgaacagaugacagauagccacuaugauacuuacguggcugucugucagucuuguuaaucccugccaggguccaguaaugagcaggugauuaucucuggaaacgauagcagcuguuggcauuucgccccaggucaccuaagcauucuccccaagggggacugccagaggagccaaacuauaugccgauuaacuacugggaacacaugugccacgucuucaucuggugcaacucugcucacagauggggcuaccugcucugugguuuauacacguaaggaguagugauggggguggggauagggcuaaggcaacauuugaggacagcagcuucuagggaucccuuuagaagggucucguaagaguuccaagaacucagugacuucagaauucagguaaucagacuggcagaugaauuuuuccuuuuaguugauggagcaaguauaggaguuuggcccugacuuuggcaggaauguaaugacaccauccucuugcccuagguugaguacuccuaucaguccuugaaguaacugaucacagccaaaaggccacucuucaccgugauuaugauuucugucuuuaauuuucacaucaucuauuuaguacugcagcuacgggcuuacuggcagcuccagacaccaguguccuugugaacaaggcucugguagauuucaggcgaguuuacacaucccuagaggcaguacagcaaacggcaaacagcuauuuauguuaggugaagauggacugcuucaaagagucuggacagcaacugagaaaaaugcauuugucaagguuuuaaugcauauaauuuuccagcaaagguguuuacuuacuccaguaacauacuaaguaaacugcauuaggaaaagccucuuuaguauuuuacauccuuuucuauaauugaccuuagauucuagauugcuuaaaagaagucgcccaagucagagagagcuuuggggauaccuggaauucucauuuuuaaugugugccccaggguugggaacacgcuuugagaagcugugcucuagugccugguuccuggugcugaacccaaggauaugugaaccagcuggagaccuguaagagggagggcagaccacucaaguuguugcauuucauaaauuaaaucccuucauuuuuagaccuuuugauauacuuaauuuuuuucagaccuuuuauuuauuauuuuuuuuuaaauuauacuuuaaguucuaggguacaugugcacaaugugcagguuugauacauagguauacaugugccauguugguuugcugcacccaucaacucgucauuuacauuacguauuucuccuaaggcuaucccucccgcauccccccaccccucaacaggccccggugugugauguucccugcccuguguccgugugaucucauuguucaguucccaccuaugagugagaacaugcaguguuuggguuucuguccuugcgauaguuugcugagaaugaugguuucuagcuucauccaugucccuucaaaggacaugaacucauccuuuuuuauggcugacaugguauuccaugguguauaugugccacauuuucuuaauccagucuaacauugauggacauuuguguugguuccaagucuuugcuauugugaauaguguggcaauaaacauacaugugcaugugucuuuauaguagcaugauuuauaauccuuugggaauauacccaguaaugggguugcugagucaaaugguauuucuaguucuagauccgugagcaaucgccauacugucuuccacaaugguugaacuaauuuacacucccaccaacaguguaaaagcguuccuauuucuccacauccucuccagcaucuguuguuuccugacuuuuuaaugaucaccauucuaacuggugugagaugguaucuugugguuuugauuugcauuucucugaugaccagucaugaugagcauuuuuucaugugucuguuggcugcauaagugucuucuuuugagaagggucuguucauaucccuugcccacuuuuugaugagguuguuuguucuuuuucuuguaaauuugaguucuuuguagauucuggauaucagcccuuugucagguggguagauugcaaaaauuuucucccauucuguagguugccuguucacucuaaugguaguuucuuuugcugugcagaagcucuuuaguuuaauuucaugccauuugucaauuuuggcuuuuguugccauugauuuuggugcuuuagucaugaaguccuuggccaugccuguguccugaaugguauugccuagguuuucuucuaggguuuuuaugguuuuaggucuaacauuuaagucuuaauccaucuugaguuaauuuuuauauaagguguaaggaagggauccaguuucagcuuucuacauauggcuagccaguuuucccagcaccauuuauuaaauagggaauccuuuccccauuucuuguuuuugucagguuugucaaagaucagaugguuuuagaugugugguguuauuucugaggccuguguucuguuccauuggucuauaucucuguuuugguaccaguaccaugcuguuuugguuacuguagccuuguaguauaguuugaagucagauagcgugaugucuccagcuuuguucuuuuggcuuaggauugucuuggcaauguggguucuuuuuugguuccauaugaacuuuaaaguaguuuuuuccaauucugugaagaaagucauugguagcuugauggggauggcauugaaucuauaaauuaccuugggcaguguagccauuugcacaauauugauucuuccuauccaugagcauggaauguucuuccauuuguuugcguccucuuuuauuuuguugagcagugguuuguaguucuccuugaagagguccuucacaucccuuguaaguuggauuccuagguauuuuauuuucuuuguagcaguugugaaugggaguucacccaugauuuggcucucuguuugucuguucuugguguauaggaaugcuugugauuuuugcacauugauuuuguauccugagacuuugcugaaguugcuuaucagcuuaaggagauuuugggcugagaugauagguuuuucuaaauauacaauuaugucaugugcagacagggacaauuugacuuccucuuuuccuaauugaauacccauuauuucuuucucuugccugauugcccuggccagaacuuccaauacuaucuugaauaggaguggugagggagggcauccuugucuugugccgcuuuuuaaagggaaugcuuccaguuuuuguccauucauuaugauauuggcuguggguuugucauagauagcucuuauuauuuugagauacaugccaucaguaccuaguuuauugagaguuuuuagcaugaagugcuguugaauuuugucgaaggccuuuucugcaucuauugagauaaucgugugguuuuugucauugguucuguuuaugugauggauuacauuuauugauuugcguauguugaaccagccuugcaucccagggaugaagccaacuugaucaugguggguaagcuuuuugaugagcugcuggauucgguuugccaguauuuuauugaggauuuuugcaucagugcucaucagggauauuggucaaaaauucucuuuuuuuuguugugucucugccaggcuuugguaucaggaugaugcuggccucauaaaaugaguuagggaggagucccucuuuuucuguugauuggaauaguuucagaaagaaugggaccagcuccacuuuguaccucugauagaauucggcugugaauccgucugguccuggacuuuuuuugguugguaggcuauuaauuauugccccaauuucagagccuguuauuggucuauucagugauuuaacuucuuccugguuuagucuuaggagaaucuuuguguccaggaauuuauccauuucuucuagauuuucuaguuuauuugcauagagguguuuauauuauucucugaugguaguauucucugugggaucaguggugauauccccuuuuucauuuuuuauugcaucuaugugauucuucucucuuuucuucuuuacuauucuugcuagcggucuaucaauuuuguugaucuuuucaaaaaaccagcuccuggauucauugauuuuuuuuuuuuuaaggguuuuuugugucucuaucucuuucaguucugcucuggucuuaguuauuucuugucuuccaguagcucuugcuucucuaguucuuuuaauugugauguuagggugucgauuuuuagaucuuuccugcuuucucuugugggcauuuagugcuauaaauuacccucuacacacugcuuaaaugugucccagagauucugguauguugucuuuguucucacugguuucagagaacaucuuuaugucugccuucauuucguuguuuacccaguagucauucaggagcagguuguucaguuuccauguaguugagcgguuuugagugaguuucuuuauccugaguucuaauuugauugcacuguggucugagagacaguuuacagugauuucugugcuuuuacauuugcugaggagugcuuuacuuccaacuauguggucaauuuuagaauaagugcaaugugguguugggaagaguguauauucuguugauuugggguggagaguccuguagaugucuuuuaggucugcuuggugcagagcugaguucaaguccuggauauccuuguuaaccuucugucucguugaucugucuaauauugacagugggguguuaaagucucccauuauuauugugugggagucuaagucucuuuguagucucuaaggacuugcuuuaugaaucugggugcuccuguauugggugcauauauauuuaggagaguuagcucuuuuuguugaauugaucccuuuaccauuauguaauggccuucuuugucucuuuugauuuuguugguuugaagucuguuuaaccaggauugcaaucccugcuuuuuuugcuuuccauuugcuugguagaucuuccuccauuccuuuauuuuguaccugugugugucucugcacaugagcugggucuuccgaauacagcacacugaugggucuugauucuuuauccaguuugccagucugugucuuucaauuggggcauuuagcccauuuacauuuaagguuaauauuguuaugugugaauuugauccugucauuauguuguuagcugguuauuuugccuguuaguugaugcaguuucuucauagcauugguggucuuuacaauuucucauguuuuugcaguggcugcuaccgguuguuucuuuccauguguggugcuucccucaggagcucuuguaaggcaggccugguggugacaaaaucucucagcauuugcuugucuguaaaggauuuuauuucuccuucauuuaugaagcuuaguuuggcuggauaugaaauucuggcuugaaaauucuuuucuuuaggaauguugaauauuggcccccacuuucuucuggcuuguaggguuucugcugagagaucugcuguuagucugaugggcuucccuuuguggguaacccuaucuuucucuuggcugcccuuaacacuuuuuccuucauuucaaccuuggugaaucugccaauuaugugucuugggguugcucuucucaaggaguaucuuugugguguucucuguauuuccugaauuugaauguuggacucgcuugcuagguuggggacguucuccuggauacuauccugacgaguguuuuccaacuugguucuauucuccccaucacuuucagguacaccaaucaaaugcagauuuggucuuuucacauagacccauauuucuuggggcuuuguucguuucuuuucacucuuuuuucucugaccuugucuucucacuuaauuucauuauuuugaucuucaaucacugauacccuuucuuccacuugaucgaguuggcuguugaagcuugugcgugcgucacaaaguucucgugccaugguuuucagcucugucaggucauuuaaggucuucuccacacuguuuauucuaguuagccauuugucuaaucuuuuuucaagguuuuuagcuuccuugcgauggguuugaacaugccucuuuagcuuggagaaguuuguuauuaccgaccuucugaagccuauucugucaacucgucaaagucauucucccuccagcuuuguuccguugcuggcgaggagcugugauccuuuggagaagaggugcucugauuuuuagaauuuucagcuuuucugcucugguuucuccacaucuuugugguuuuaucuaccuuuggucuuugauguuggugaccuacagaucggguuuuggcguggaugucuuuuuugucgauguugaugcuauucccuuccgguuguuaguuuuccuucuaacagucaggucauucagcugcaggucuguuggaguuugcuggagguccacuccagacccuguuugccuggggaucaccauuggaggcagaacagcaaauauugcugccugauccuuccucuggaagcuucgucccagaaggggagccaccuauaugaggugucuguuuaccucuacugggaguugucucccaguuaggcuacaugggagucagggacccaccugaggaggcagugugcccuuccucagagauuaaaugccucacugggagaaccacugcugucuucagagcugucagacagggaaguuuaagucugcagaaguugucugcugucuuuuguucagcuaugcccugcccacagagcuggagucuagaggcagugggccuuguugagcugcggugggcuccacccaguucaagcuucccagccgcuuuguuuaccuacucaagccucagcaauggcagacgccucucccccaaccaggcugccaccucgcacuucagucucagacugcugcgcuagcagugagcaaggcuccauggccacgggacccaccgagccaggcacgggagagaaucuccuuucugcugguugcuaagaccuugagaaaagugcaguauuggggcaggcgugucccauuuuuccaaguacagucugucaaggcuucccuuggcuaggaauuggaaauccccugacuccuuguacuucccagcugaggugaugccccacccugcuucagcuugcccucugugggcugcacccacuguccaaccagucccaaugagaugaaccagguaucucaguuggaaaugcagagaucacccgucuuuugcaucaaucacgcugagagcugcagacgggagcuguuccuauuuggccaucuuccagaccuuuuauuuuuaaaagaaacuucucuaccccgaaugaaaucuuacucagaaaccuuauuuguaaauaaaaucaaaguucuacucugaagcccucauagaucuccccccuugcaaggacccugaagaccugcaccccacagagccaugggguuuagugugacaggccucacgugugggugcaaugcccucugucugucccuggcuugggcugcugggcuuuauugccuccuagugucucacacacauuagguggucaguaaauagguuuugaauuagugauugaaacaauuuuggggacacccaccagcuucuacuuuggagagaucagagaagccuaaauaucaaaccuuucaacuucuuuucaucagcucacaugcuucuagucucauucuuguuuaaauuuauaccccacauagucauaggaaguugcuggcaaacucaaaaugugaaacagcugaugaauugacacuauuucuuuauggaugaaaguagauguuacagaaauaagcucuuuuauguuuuacuccgagcuaccuuaacuucauuuggaaaguagcuaaggaguaaauacugaauuuuacauacuaaauaaaguuauaugcuaaucaaaauauauguccuuccagcugaaugaccuggugcagggugagaaaggagcuguuauggaugagaaucgugcccccugguuuuggaggugggggaggcacagaauaacuuaucuuguuacauaguugguuuguuauuuuucuucuucuauaaguaaagaaaaagaguucugaaagcaagaagauugagaaagcaaacugaaaugucuucuugaguuuggcaugaaagauuaugaauuuuaucuuuguggcugauagagagcaacauuaggauacagagcaacguuaggaggaggcugagcaguaagugguuaguugaggucaggcacugccaaugcuggauuaagauuuccugugagugaaaggugaauuuacaauuaguaauaaaagauaucuaacuaucucaggcauuguuuccaaaagguuuuugaaaaaagaauugucacuuaguaaaguucaucuauucaguuuguuaauaaaacuauguuuuuaggauuaaacugcucgaaugcaauuuaugcuuguccaguccacguuuccaugucccucagcucuccuuggugauaugguaccuaaaauugcaagucaggauuuauuuugagggauuuuauuuuaaagguuaauaaaguucugcugaagggcaaaucuguaaaauuaaggaccuaaaugauaaagaaggggaggccguaacucuccugcuugaaaguuguuugugguggguaagaaagugcaggguacagccucauguauuuccugaggcguugacuugccucuguugggauucgagaaggacccaauaaauagcaugucucgcccugccugaggaaaagcgagacaaaggagucaggauuuggagauguaaaguaucaccuuuaugagugauaaagcagauauugaggaguguggcuuauaucuguuggcaaacagguuucaaauacuggacccuggaauuagacaggcuuaccuagugaugggccgugcaggaaagugcaggcuccucuccguggaaggagcagagcagagugcagguucucugucugcaugauggcuccagagagaaagggaaggagcugagcuagaggucaccaaacuuucuuggcuugcaggcacccuuaguaccucagcaugcuuuuuauagugccucucagucaaaagaaguaccuaacaguucuauguguuaaguaaauuagguccaaauaacucaucaguauuaguaagcuaggugccucacaagugucaccgugcuucucuugaauguaucccacagggucccugugaguuugcuguagcacugcagagcaccauggcacauaguuugggaaauacagucuccuucagaauucaaaaauaaaauuaagucguaacuaauccucuuguaaaaggcuaagagggggugaagaugagccagauguauuacccaaguggagaucccuccacaugggagacaucuuuagcagcaggagaagcauaugccaccuccugccgccacacuuaccccagcaccugggcuucagcucagaggaauccagagcugaugcgacucucuaaccucggagacugacgcauguaaucaguuuguacucagaagcuauaccuuccaguguucucgguaccgcauaaaucuugggaagggaaauggagagaaaggugauaaccccaugggaauacauugaguacaucuccacagccuacccuuucaauuccacaugcccugaggucaaguccuaugagggccaaggauagacuuacuuucauuuggcuaaguuagaugcauauugucaguucuguagagccuccgagcaaacuauuuuuuucuuugcuuuagcuccaauggaagcauagccugcaguuagaaaaaugaacagccgggccuuccauguauacuccuaacccagcaaucaaauggccacuccuuuauaaggcacaauuucuauuaguaauaagaaauaguacaugguagauuuccaaucauaaacaacuaaauacuuccuguguaugccucucauuuaaaccacagaauaugcccagucugcauuuauagcuugauuggucaagugugcauuucauucagauuguccucaucaguaaaauaccaguauuagcaaaucaugaauugcuaaaugugcaaaaauaaaaauuaccauagucaaguauuuaauucccuuguauuaaaauuguauuguguccuacucaauacauacaaauuuaaaaguuugcaaacuaugucugaacaaauguuuaaauguuuuacuaacuucccugucccccugccacgccuuaaaaaaacaaaaagcaccuuucaggauuaaucaccuggggaguuugcucugaauuacugccuugggagguggcaauaugaaacagaagaucugaaaugaaaagauucugguuaugggugccaccaugauuaccugcagaaaaaggugggcucgucaauuaacaggagaugcuggcagaagcacauuuauguagggggguccagggugucuuuagaagggccgugcuaaacaggacacacccacccagcuccacccgccgugcugcaggugcuccuguuuucccuucucugcuuuauuggcaaguccuaccggcuucaaucgcacgccauuuguccccugcuccacuuccaccugggugucuuuuagucucccauagcuucacuccuccagagauccuggcaacuuaaagccucgcaggagucucaguuuccuugucaguaaaauggggauaauuaauagucucuuucuaugucauggggugauuauaagaucacaugagauguaugcugaagcauuuuguuaacugcaaaaugcuauauaaaugucagguguuauaaaucauuagcuggucuauuccucagcuaaagcgguuucuaugcauauuuuaguuacccccuaaacaauucuuuuucaaauagcaaauguaaaugcugcuguuuuuuucugcuuggauuaugguggcuccuuugcaacuuuaugauguaggcugaaucuuuaaauacuccuuuggcucauaucucuuccccugaacacccaugcgagaucauaauccauaaaacacagaggcaauaacuccuuuuaauugccaggaguucaucauuugcuaaguucuaaaugcagucacuuaggcacuccuuuugaaaagccugucucuguuuauucugcagagccgagacugucugaagcugggcccaccugcugagggagaagucguccaagucaaguggcccgauggcaaacucuauggagcaaaauauuuuggaucaaauauugcccacauguaccagguggguucuuccuucucugugaugcuugcuaagauugacaugauaagucagaaggagauaguaucucaagugugcugcugaacaauaagccacaugaauuugggacaccucuuauuuuaugcaggaggcaaagauucaauguguaaugacccaggucgaaacccuggaguuuuauuaccaaguuggacacugggaaacucuuaacagcauuugaugaaugguuuaauuguaaggaauaugguucugccagaaagauaagugacuagaagacaggcugccucccacuguuucuguuguauggggaacgacuaguuggccgauucaucuaaccuucagccaagacagcgauggccacucuucaaccagcagccccugaagugguggcuuuugcugagagacauagucuccccacuccccgcuaucucagcaaagcuagacaacagugcauugacauagauguggccaguuaaugucacaaggagcugaugguuaucauccacccaagcuuaaaggaaugcuuguuuaaaugaaaaguacagcuaucaguuggacguucuguucaccagggaacccuacguaguauuaaagaguauauauacaauuuuaaaaugaauuacuuuuauuucacccagaaaugagaaugaguuaagcuuuaauaagggaaacaacauggauagcacgugcacauuuauauuccuucagaaagguuuuaaaaggggacauuuagagccaauacauuguagaauuuucaguaacacugugucagaaaucaagauucucaggcuaaacuguagagugaaaacaagaagguugaaguaaaaggagaaaaagcaagaagguucaggccuguugaaaaacagcuugagaaugauaagacugucaguuucaacagagaaauuguucaaagacugauaaggagcaagagcuuaaauggaagagugcauuguaagauacugcgucaggaccuggagcacaguguaauuaaagguguucaaagaaguuugaaaaacuuaggagagaguguuuuucauggucuagaaaaaccuaaggggaauggauaggggaggauguauacacauacauuguguguguauguguguaugugugucuguguguguaaaggccauuucccccuuugcauaugguauuggugacagucucaagauacaaauucaaguuauuuauaauaguaaagguacuggagcuucauugcauuagaaugaccagaauuaggcaaaaauugcaagacaggcuauaauaccggaggauccuggaaaagaagcauuacuacauaaugcaaaauaaaauaauuacauuuaauuaaauaauaagugcaaaagcaaagcuucuuacauguagcaaagccauuugcuacaugaaaagaaucacauaaugagaauauguugaaauucaggcuaauuaguaaucaguguguuaacuucaguugaauuuaugauggucuaucaacauaaaacuaugagcauauuuauagacucaaugaaaaaguuaagacuaauauuaaaauugucucucaagcacaaguaguuuaaaauuccucauuaagccaaguggccuuuugagaucuuuuuguguuuugugucuaauuauucaacuucaccaucaaauaaacaaagacaguuuuaaaaauagauaugacagauaaauaaauaccugcugcacagugcuuaauauccuaggcauaugcguuuuuugacccucagaguaguccuacaaaauagauguuauugacuccugucuuacaaaugagggaagaaaggcugugaacaaaauuuuuaaugauuuaagaauaauuuuuuaauaauuuguccgagagcacgcagcugguaaagagagggccaaaauucucucucagcucugcccuaacuaggguggacaaccaucccugcuugccugggaccaucccugauuuuaguacugaaaauaacuacaucccaagggacccuugagucccaggcgaacuaggacgguugguuacccuaguccuagcacagcauacucccuucuagguuuguaauugccuuuuugucuuuucgauguuuuaaguggucuaaaacaaaugaaaguaggcacaggugguucuagcuaugcuaucaacuaaguuggguaaaucagaugacacuauggccuaguucaauguuaaagaaauguuucugcucaaacaaggccaggaagaaaacccuucccauuguuagcccucccggaagugacagcaaggguucucaugugacuggcaccuaauuccacuguauuguuuagcuuauucaaaaugcuaacaguacguggauaauaauacguucaauuguauguuugaucuuuauuaagaccgugguggauguucaucaaccagaauugguaacuugugccugagagacauacccaccugggugucucagcaaagcuagaccaaugcauuggcacagauguggccaguuaauauuaucauccacucaagagaguguuugcuuagugcaaagugcagcgauauaucaguuggacauucugugaauuaaacaauaaguguagcugggcacaguggcucaugccuguaaucccagcacuuuggaaggccgaggcaggcagaucaucugaggucaggaguucgagaccagccucgccaacguggugcaaccccgucucuacuaaaaaaauguauaaaaauuagccaggcaugguuggcggcaugcuuauaauuacagcuacuugagaggcugaggcagaagaaucacuugaacccaggaggcagagguugcagugagccgagaucgcgccguugcacuccagccuaggcaacaagagcgaaacuccgucucaagagaaaaccaaaaaccaaaaaaaaauuaguguaaauuuuuuucaaacucuagauuuuuuuuuuauuaacauggcacagcugugugguuuaacuuaccuuuugacuagaaguauaagcauauuuucauuucuuuaaaaaauucagacaaaauuuagggacuucaaaaauaccaugugguucagaguuagaacauauuaaguauucuaccugauuacauccguuuuguuuccugcuagauuaguucauguuguauuaaaccuaaaccaaucuaaaccuaggugcucuagguuucuguuagcugguguuauuuaccuuuucuuugacaaaaucuuuuaaaauguuaaaaacaauugguuaugaaauuauuugcuuccauuugguuagugcgagaaaaguuuuaaacauuuuguuuuagaugaugauguauuuucacacauugaugagguuuacauguuaggagguugagaaacagauuuucccagcuccuuugauggcauuugauugaauuugacacgugaauuuugaaaguucaagcucuguaagaaaugcauaaauuauuuuaucugggaggauuauuauauaagaguaaacaggccgggcaugguggcugacaccuguaaucccaacacuuugggaggccaaggugggagaauugcuugagucuagucagaccuuaucucuacuaaaaaacuacaauaaaauaaaauagcugggcguuguggcacacagcuaugguuccagcuucucaggaggcagaggugggaggauugcuugagccugggagguugagguugcagugagcugagaucaggccacugcacucuagccugagcaacagggcaaggcccugucucaauuuaaaaaaaaaaaaaaaaaaaggaaauauauuaucuuuucuuucacagagagaaacaauucuccuuguuacguugucagagccucuuaaagaaaugaaccgugcugacagacccaacccauuuuaaugcugaauuucccacagucucauguuuugugauuuccauuugaucagcagcuacuuuucuuuguuguugcuucgccagauaaaguuuucauauccuguauuccaagacacucauuuccaagaauuuuggccuguuuugaaauguauuuuguauuuaguuuauuuauuuauuuuuuuguuuugagacggagucuuacucugucaccaggcuggagugcaguggugcgaucucagcucacuacaaccucugccucccagcuucaagcgggucuccugccucagccuccugaguagcugggacuacaggcaugcgccaccaugccuggcuaauuuuuguauuuuuguuagacaggguuucaccauguuggccaggauggucucgaucuccugaccuugggaucugccugccucagccucccaaagugcugggauuacaggcgugagccaccaugcccggccucuacuuaauaagggaaauaacucuucuuacuuccuugguuguuggcugguucccuuguuuguucuguuugaguccuuuucaucuuuucauguaguuaauuggagccuuuaaaaauggucagugcuguuuuuuuaauauguaucauguuauauuaucuuucauuagguugaguuugaagauggaucccagauagcaaugaagagagaggacaucuacacuuuagaugaagaguuacccaagagagugaaagcucgauuuguaagugcuggcagaugccacuuggggaccugccaagugaauuccuuguccucaccucauguuucccaagcccagcaggaaacauacuugggcuuuuggauuaauucuaaaaaaagccaaugcaacauuuuccuuaguggaaccuauugaaugcaaacuucaaauucaaccaaaaucggggaaauuaaugcaugugcuuuacuuuucuucuaaugaagucacaugaugcuucuuuguguugacauuuauuggugcacaaaaauacuuacugaaugugugcucuguguaaaacaccaggagcaaacaaagauaccaucaaggcauuugcaaucuuguuaguagaagcaacauuaaaaguauucaggaguagaucaaaggggacucggcauaauugaaugucugucuauucuuuuauagguuuuucauggauugacuaccuucugucucagaaaguuacugauguuugugucaguucaucauuaagcuaaacucugacuuucauaauaaaagggauaaacaaagccuaaaugcuaguugugggaauacuaaagcaguuuuuuaaaaaggaaauaguaguuucaugcccucacauaccauuaaaagaugaacaaacauggacaaauauucaaaacugcagucauugaaaaauauaauucacaauaauuuagacuucauauuauuguaucauaaaauauucaguggacccugaaaugaagucaguuuuauucauuuagaauuauaucuauugugucugugaaaugauaaauccuaaauagagaaauuugaauggaugggguuuuucugacuaaaaugaaauuuuuuuucugaauaauucaguuuagugagugcuuaugauauacuugucugcagugauagagucacuauagauuauuugguuauuuuggaaaaaccaaggguuuucuuaaaucagggauguccaaucuuuuugcaucccugggccauacuugaagaagaagaauugucuuuggccucacauaaacuacacuaacaauagcugaugagcuacuaaaaaaaaaaaaaaaaaaagcaaaaaaaaacucauaauguuuuaagcaaguuuacagauuuguguuuggccgcguuaaagccauccuggguagcaugcagccggcgggccauggguuggacacgcuugccuuaaacguucaguuguguaugcagcuuuuuuccagucagaugggauccugacagcagaguaacugcaucaggugggaacugacuuuccucucagcugcauccuucagaggaagguccuucaaagugaaaucgucaagaggaguggugguauugcugcccacucgaugggaaauguggcucagaggggacccacacaccuguaaauagaguaacuacuagauaaugacagcaagcaaagaaaaaauuaaauauuccuguuguaaagauaccagccaaaucuuaccaagaccgaaaaaccuuagaugacuugucgcuguucugagaccugaaauuucuugagaaaaacuuuccuuuucgagauguuagagauagcuucgucucguucuguauuccugucuuccuuggacuccccucuucccugccuuauucccagcuccucccgcuccuuucuuuuccuuuuucagcaccuagagauuuagaggauggggaguggaguagguagccucucaaagucucuugggucuuucauuuucuaaucgauguaugacuaagcauccuaccagcugagucuuguagauuucaaauacuguuucuuaaucacaugagaagaaagcucauugcuuucauacucugaucacaaucucuuuguuucacaguagauuucgcucagauaccaggaugccuuccccuguggcugucucggaacacagguccuggauuuucuaaggucuauuucacugaacaagcucaccaacauucaauuuuuuuuuuauucucugaaaaaauuuuuaauuaaaaaaaaagugaaaauauguaaaucacauccauacacucugaaugcagccugcuauucugagcggcuaagccaaguagaaaauaucuuagggaacaaaggcucacggucacuaaguccuguuggccaccuuuauugaaucaaagacauacacagucuugucguagccagccuguuucuccccuggguugguacauagcccucagacccuugguuagucuguccaugauuauuacuauuuuuuuuccaguuggcaaaacaaaucuaauuggaaaacucauugauggaagauguuuuaugguuagaaaagucuuuuuuguuuuuuaaggauggagguuagccgcccuugucaggaggccuuguauuuuaaugacuucggcucacccagacacacgcugacugggggagaaacuguucaaaagagccagcaguccaccucagugauugugugggguucuuuuccacucacuucagaagcagccccguuaccuuuuauugucucacagaauaaccauagcaacggugcauaauuagcuagagcuccugguaaaucgguuuuauuauuguauuugagaggccgacuuuugcuguuucugcacaguggcaacacuuucauagauguuuuauuuucuucuuugauaacuuuagcacuuacacaagugaaagauuacucagaggaaguauuuugccaagaaugaaugaaacaaaaguguuuucuccuaauggcagagggaacccaaccagcccauaaugauuuaguuuucuucucuagugaaacuaggugguaugugggggaagccguggagguggccuguuacccugaguaacugucccaugaacuggcuggaaacaugaacagcuuuacgcuucgguacauuuuuuguuuucaggcuuccuuguggcuguuuucuuguuuuucucuucuuuacuauggaccguguguuuucaaguccuaaagugucuuucaccucugccucugccagcagccaggggaagcagucucagcacagugaaaugugcuguguguugaugucaucagaagucauccaccucagugaaaacagcugccagugcauuuuaggaggcaagauaguagggaauugggaagcaaaaauagugccuaccauagacuuuaggcuuuaucugauuaucacagaaaaagccacaugcccucacucagcaaacacuuacugaacagcagccaaauacuagccacauuguuugcuguggggaacacauguaaaauuggguacacagucccuaauauccucaccuuuaugggguuccccugauggggagaaacuuacuugccccuuaccucuaccacugcccuccucuuacugaguggaugugucagggccacaggagucccaaagaaggacccuuaagcuugccgagggcagagacaguagaauagaauaacuuucacagaaaugaaacaguguguccaaagacagagaagcauggggcccugagccaggcaaguaugaccaggcccugcaacugaugccgucugagcagagcacggggcaggcuucuggccagguuauguaggucuagccuggggaguggggaugucaucuugaaggcaguagguugcuggaaaauuacaagcaagggcauaugaucauguagagucuuauaauaagagggcuuuuagagagcuuucuuccagugguacugugggaaauagguuggagguacagcauuuauugcagugcuuugcagaggugagggccugccccauaggguaaggaucaagaagaaaggcugaagggcuucaagguacaugcaggaggaauccuggacacgguggggaaaugucuacagugccuuuagguuucuggccaauguaacugggugcaugggcaugguggugccuuuuauggaauguaggaaggacagcaaugaagaaggaaggcuuucaguucaauuuaggacagguugauuugaagggccucugagacagggacuuugugaugccugcuggggaaaugcacuuacaggccugagcuggagcagaugugagcaucuccugcagacacugaagccaggggugugggcacaaaggcccagggaacaggaguggagaggagaaggcccagugccaaaccuuagggcaucguaguugagcagauaguuaagaaagggaaccccugagacaucaaaagugagcagccagagaaggagaagcaggagaguggguuuacaaaaugacagagaagagagcuuuaagcaguaauuaguuggcagacuagucaagucaguuuagggauaggaaggugucacaggaauuagcaacuaggacuucauucagcaagaacaguuucagggaagggguggggcagaggcccaaagcuaaguaggaguaaagguaacuuagagaugacuguugacauuugucaaaaacagaggggagaugaaaaaugagggaaguuuaaaacgagaagacuuuaaucuugcuuuuguuuggggaaggucccugggguuggaggguggggagauccuggagaaaguagggcuaaauggagccccccacuuugggugggagaggcgagggaaagcccaaagccaugccuggggcccuuuuagccugagcuggugaccugggcaucugcacccuaaccccagcugaccgagucagaucuuuguccaguguucugaagaucaaaugccgugcccuuuugcaauauaacaccagcugcuuuuaguccacagccucugacaugcgauuugaagacacguuuuauggagcagacauuauccaaggggagagaaagagacaaagagugcugagcuccagguuuaagaaugaauauguggccgacccuguauaccgcacuuuuuugaagagcucuuuccagaagaagugccagaagagacaguagucugcauacaucgcugcaggccacagagcagcuuggguuggaagagagaagaugaagggacauccuuggggcugugccgugaguuuugcuggcauaggugacagggugugucucugacagugguaaaucggguuuccagaguuuggucaccaaaaauacaaaauacacccaaugaauuggacgcagcaaucugaaaucaucucuagucuugcuuucacuugugagcaguugucuucuaugaucccaaagaaguuuucuaagugaaaggaaauacuagugaaucacccacaaggaaaagccacugccacagaggaggcggguccccuugugcggcuuagggcccugucaggaaacacacggggaccucucucucuagcuccagcagguggcaccucgguacccagcggguagggcgauaauuuauauauuuuccacagucagggaaggacucucacuuauuuguuucaaauugcaguuuuuauaaaacauuuuuaaaacacaaauggcauguaugcuaaugagauuuacccgugugcuaucuguauuucccuuguacagaacuuuuacauuuuugaauauuccuauuacuuuugauugugucugaugggaacugaguuguuggccuuugugaaaugaaauuuuuggcucuugagaaagaauucuuaugaauuguuaugcgaauuuuauauauuuaaagagggagaucuggggcuguuauuuuuaaacacuuuuuuucauaauacauauuccgaguagauauuuauaaaauauauguuucuuucauuauguguuuguaaaauuagaguuuaaauaaauaugcuuugaugcauaguuuugaacuaauguaacaugauuuuucuuuuuuaaaacagccugaaaauguacuaguguuuaaaaauaaagauuuccauuuucucca

SEQ ID NO: 192986 - RNA, 454786 nt, Homo sapiens
uggagaaaauggaaaucuuuauuuuuaaacacuaguacauuuucaggcuguuuuaaaaaagaaaaaucauguuacauuaguucaaaacuaugcaucaaagcauauuuauuuaaacucuaauuuuacaaacacauaaugaaagaaacauauauuuuauaaauaucuacucggaauauguauuaugaaaaaaaguguuuaaaaauaacagccccagaucucccucuuuaaauauauaaaauucgcauaacaauucauaagaauucuuucucaagagccaaaaauuucauuucacaaaggccaacaacucaguucccaucagacacaaucaaaaguaauaggaauauucaaaaauguaaaaguucuguacaagggaaauacagauagcacacggguaaaucucauuagcauacaugccauuuguguuuuaaaaauguuuuauaaaaacugcaauuugaaacaaauaagugagaguccuucccugacuguggaaaauauauaaauuaucgcccuacccgcuggguaccgaggugccaccugcuggagcuagagagagagguccccguguguuuccugacagggcccuaagccgcacaaggggacccgccuccucuguggcaguggcuuuuccuugugggugauucacuaguauuuccuuucacuuagaaaacuucuuugggaucauagaagacaacugcucacaagugaaagcaagacuagagaugauuucagauugcugcguccaauucauuggguguauuuuguauuuuuggugaccaaacucuggaaacccgauuuaccacugucagagacacacccugucaccuaugccagcaaaacucacggcacagccccaaggaugucccuucaucuucucucuuccaacccaagcugcucuguggccugcagcgauguaugcagacuacugucucuucuggcacuucuucuggaaagagcucuucaaaaaagugcgguauacagggucggccacauauucauucuuaaaccuggagcucagcacucuuugucucuuucucuccccuuggauaaugucugcuccauaaaacgugucuucaaaucgcaugucagaggcuguggacuaaaagcagcugguguuauauugcaaaagggcacggcauuugaucuucagaacacuggacaaagaucugacucggucagcugggguuagggugcagaugcccaggucaccagcucaggcuaaaagggccccaggcauggcuuugggcuuucccucgccucucccacccaaaguggggggcuccauuuagcccuacuuucuccaggaucuccccacccuccaaccccagggaccuuccccaaacaaaagcaagauuaaagucuucucguuuuaaacuucccucauuuuucaucuccccucuguuuuugacaaaugucaacagucaucucuaaguuaccuuuacuccuacuuagcuuugggccucugccccaccccuucccugaaacuguucuugcugaaugaaguccuaguugcuaauuccugugacaccuuccuaucccuaaacugacuugacuagucugccaacuaauuacugcuuaaagcucucuucucugucauuuuguaaacccacucuccugcuucuccuucucuggcugcucacuuuugaugucucagggguucccuuucuuaacuaucugcucaacuacgaugcccuaagguuuggcacugggccuucuccucuccacuccuguucccugggccuuugugcccacaccccuggcuucagugucugcaggagaugcucacaucugcuccagcucaggccuguaagugcauuuccccagcaggcaucacaaagucccugucucagaggcccuucaaaucaaccuguccuaaauugaacugaaagccuuccuucuucauugcuguccuuccuacauuccauaaaaggcaccaccaugcccaugcacccaguuacauuggccagaaaccuaaaggcacuguagacauuuccccaccguguccaggauuccuccugcauguaccuugaagcccuucagccuuucuucuugauccuuacccuauggggcaggcccucaccucugcaaagcacugcaauaaaugcuguaccuccaaccuauuucccacaguaccacuggaagaaagcucucuaaaagcccucuuauuauaagacucuacaugaucauaugcccuugcuuguaauuuuccagcaaccuacugccuucaagaugacauccccacuccccaggcuagaccuacauaaccuggccagaagccugccccgugcucugcucagacggcaucaguugcagggccuggucauacuugccuggcucagggccccaugcuucucugucuuuggacacacuguuucauuucugugaaaguuauucuauucuacugucucugcccucggcaagcuuaaggguccuucuuugggacuccuguggcccugacacauccacucaguaagaggagggcagugguagagguaaggggcaaguaaguuucuccccaucaggggaaccccauaaaggugaggauauuagggacuguguacccaauuuuacauguguuccccacagcaaacaauguggcuaguauuuggcugcuguucaguaaguguuugcugagugagggcauguggcuuuuucugugauaaucagauaaagccuaaagucuaugguaggcacuauuuuugcuucccaauucccuacuaucuugccuccuaaaaugcacuggcagcuguuuucacugagguggaugacuucugaugacaucaacacacagcacauuucacugugcugagacugcuuccccuggcugcuggcagaggcagaggugaaagacacuuuaggacuugaaaacacacgguccauaguaaagaagagaaaaacaagaaaacagccacaaggaagccugaaaacaaaaaauguaccgaagcguaaagcuguucauguuuccagccaguucaugggacaguuacucaggguaacaggccaccuccacggcuucccccacauaccaccuaguuucacuagagaagaaaacuaaaucauuaugggcugguuggguucccucugccauuaggagaaaacacuuuuguuucauucauucuuggcaaaauacuuccucugaguaaucuuucacuuguguaagugcuaaaguuaucaaagaagaaaauaaaacaucuaugaaaguguugccacugugcagaaacagcaaaagucggccucucaaauacaauaauaaaaccgauuuaccaggagcucuagcuaauuaugcaccguugcuaugguuauucugugagacaauaaaagguaacggggcugcuucugaagugaguggaaaagaaccccacacaaucacugagguggacugcuggcucuuuugaacaguuucucccccagucagcgugugucugggugagccgaagucauuaaaauacaaggccuccugacaagggcggcuaaccuccauccuuaaaaaacaaaaaagacuuuucuaaccauaaaacaucuuccaucaaugaguuuuccaauuagauuuguuuugccaacuggaaaaaaaauaguaauaaucauggacagacuaaccaagggucugagggcuauguaccaacccaggggagaaacaggcuggcuacgacaagacuguguaugucuuugauucaauaaagguggccaacaggacuuagugaccgugagccuuuguucccuaagauauuuucuacuuggcuuagccgcucagaauagcaggcugcauucagaguguauggaugugauuuacauauuuucacuuuuuuuuuaauuaaaaauuuuuucagagaauaaaaaaaaaauugaauguuggugagcuuguucagugaaauagaccuuagaaaauccaggaccuguguuccgagacagccacaggggaaggcauccugguaucugagcgaaaucuacugugaaacaaagagauugugaucagaguaugaaagcaaugagcuuucuucucaugugauuaagaaacaguauuugaaaucuacaagacucagcugguaggaugcuuagucauacaucgauuagaaaaugaaagacccaagagacuuugagaggcuaccuacuccacuccccauccucuaaaucucuaggugcugaaaaaggaaaagaaaggagcgggaggagcugggaauaaggcagggaagaggggaguccaaggaagacaggaauacagaacgagacgaagcuaucucuaacaucucgaaaaggaaaguuuuucucaagaaauuucaggucucagaacagcgacaagucaucuaagguuuuucggucuugguaagauuuggcugguaucuuuacaacaggaauauuuaauuuuuucuuugcuugcugucauuaucuaguaguuacucuauuuacagguguguggguccccucugagccacauuucccaucgagugggcagcaauaccaccacuccucuugacgauuucacuuugaaggaccuuccucugaaggaugcagcugagaggaaagucaguucccaccugaugcaguuacucugcugucaggaucccaucugacuggaaaaaagcugcauacacaacugaacguuuaaggcaagcguguccaacccauggcccgccggcugcaugcuacccaggauggcuuuaacgcggccaaacacaaaucuguaaacuugcuuaaaacauuaugaguuuuuuuuugcuuuuuuuuuuuuuuuuuuuaguagcucaucagcuauuguuaguguaguuuaugugaggccaaagacaauucuucuucuucaaguauggcccagggaugcaaaaagauuggacaucccugauuuaagaaaacccuugguuuuuccaaaauaaccaaauaaucuauagugacucuaucacugcagacaaguauaucauaagcacucacuaaacugaauuauucagaaaaaaaauuucauuuuagucagaaaaaccccauccauucaaauuucucuauuuaggauuuaucauuucacagacacaauagauauaauucuaaaugaauaaaacugacuucauuucaggguccacugaauauuuuaugauacaauaauaugaagucuaaauuauugugaauuauauuuuucaaugacugcaguuuugaauauuuguccauguuuguucaucuuuuaaugguaugugagggcaugaaacuacuauuuccuuuuuaaaaaacugcuuuaguauucccacaacuagcauuuaggcuuuguuuaucccuuuuauuaugaaagucagaguuuagcuuaaugaugaacugacacaaacaucaguaacuuucugagacagaagguagucaauccaugaaaaaccuauaaaagaauagacagacauucaauuaugccgaguccccuuugaucuacuccugaauacuuuuaauguugcuucuacuaacaagauugcaaaugccuugaugguaucuuuguuugcuccugguguuuuacacagagcacacauucaguaaguauuuuugugcaccaauaaaugucaacacaaagaagcaucaugugacuucauuagaagaaaaguaaagcacaugcauuaauuuccccgauuuugguugaauuugaaguuugcauucaauagguuccacuaaggaaaauguugcauuggcuuuuuuuagaauuaauccaaaagcccaaguauguuuccugcugggcuugggaaacaugaggugaggacaaggaauucacuuggcagguccccaaguggcaucugccagcacuuacaaaucgagcuuucacucucuuggguaacucuucaucuaaaguguagauguccucucucuucauugcuaucugggauccaucuucaaacucaaccuaaugaaagauaauauaacaugauacauauuaaaaaaacagcacugaccauuuuuaaaggcuccaauuaacuacaugaaaagaugaaaaggacucaaacagaacaaacaagggaaccagccaacaaccaaggaaguaagaagaguuauuucccuuauuaaguagaggccgggcaugguggcucacgccuguaaucccagcacuuugggaggcugaggcaggcagaucccaaggucaggagaucgagaccauccuggccaacauggugaaacccugucuaacaaaaauacaaaaauuagccaggcaugguggcgcaugccuguagucccagcuacucaggaggcugaggcaggagacccgcuugaagcugggaggcagagguuguagugagcugagaucgcaccacugcacuccagccuggugacagaguaagacuccgucucaaaacaaaaaaauaaauaaauaaacuaaauacaaaauacauuucaaaacaggccaaaauucuuggaaaugagugucuuggaauacaggauaugaaaacuuuaucuggcgaagcaacaacaaagaaaaguagcugcugaucaaauggaaaucacaaaacaugagacugugggaaauucagcauuaaaauggguugggucugucagcacgguucauuucuuuaagaggcucugacaacguaacaaggagaauuguuucucucugugaaagaaaagauaauauauuuccuuuuuuuuuuuuuuuuuuuaaauugagacagggccuugcccuguugcucaggcuagagugcaguggccugaucucagcucacugcaaccucaaccucccaggcucaagcaauccucccaccucugccuccugagaagcuggaaccauagcugugugccacaacgcccagcuauuuuauuuuauuguaguuuuuuaguagagauaaggucugacuagacucaagcaauucucccaccuuggccucccaaaguguugggauuacaggugucagccaccaugcccggccuguuuacucuuauauaauaauccucccagauaaaauaauuuaugcauuucuuacagagcuugaacuuucaaaauucacgugucaaauucaaucaaaugccaucaaaggagcugggaaaaucuguuucucaaccuccuaacauguaaaccucaucaaugugugaaaauacaucaucaucuaaaacaaaauguuuaaaacuuuucucgcacuaaccaaauggaagcaaauaauuucauaaccaauuguuuuuaacauuuuaaaagauuuugucaaagaaaagguaaauaacaccagcuaacagaaaccuagagcaccuagguuuagauugguuuagguuuaauacaacaugaacuaaucuagcaggaaacaaaacggauguaaucagguagaauacuuaauauguucuaacucugaaccacaugguauuuuugaagucccuaaauuuugucugaauuuuuuaaagaaaugaaaauaugcuuauacuucuagucaaaagguaaguuaaaccacacagcugugccauguuaauaaaaaaaaaaucuagaguuugaaaaaaauuuacacuaauuuuuuuuugguuuuugguuuucucuugagacggaguuucgcucuuguugccuaggcuggagugcaacggcgcgaucucggcucacugcaaccucugccuccuggguucaagugauucuucugccucagccucucaaguagcuguaauuauaagcaugccgccaaccaugccuggcuaauuuuuauacauuuuuuuaguagagacgggguugcaccacguuggcgaggcuggucucgaacuccugaccucagaugaucugccugccucggccuuccaaagugcugggauuacaggcaugagccacugugcccagcuacacuuauuguuuaauucacagaauguccaacugauauaucgcugcacuuugcacuaagcaaacacucucuugaguggaugauaauauuaacuggccacaucugugccaaugcauuggucuagcuuugcugagacacccagguggguaugucucucaggcacaaguuaccaauucugguugaugaacauccaccacggucuuaauaaagaucaaacauacaauugaacguauuauuauccacguacuguuagcauuuugaauaagcuaaacaauacaguggaauuaggugccagucacaugagaacccuugcugucacuuccgggagggcuaacaaugggaaggguuuucuuccuggccuuguuugagcagaaacauuucuuuaacauugaacuaggccauagugucaucugauuuacccaacuuaguugauagcauagcuagaaccaccugugccuacuuucauuuguuuuagaccacuuaaaacaucgaaaagacaaaaaggcaauuacaaaccuagaagggaguaugcugugcuaggacuaggguaaccaaccguccuaguucgccugggacucaagggucccuugggauguaguuauuuucaguacuaaaaucagggauggucccaggcaagcagggaugguuguccacccuaguuagggcagagcugagagagaauuuuggcccucucuuuaccagcugcgugcucucggacaaauuauuaaaaaauuauucuuaaaucauuaaaaauuuuguucacagccuuucuucccucauuuguaagacaggagucaauaacaucuauuuuguaggacuacucugagggucaaaaaacgcauaugccuaggauauuaagcacugugcagcagguauuuauuuaucugucauaucuauuuuuaaaacugucuuuguuuauuugauggugaaguugaauaauuagacacaaaacacaaaaagaucucaaaaggccacuuggcuuaaugaggaauuuuaaacuacuugugcuugagagacaauuuuaauauuagucuuaacuuuuucauugagucuauaaauaugcucauaguuuuauguugauagaccaucauaaauucaacugaaguuaacacacugauuacuaauuagccugaauuucaacauauucucauuaugugauucuuuucauguagcaaauggcuuugcuacauguaagaagcuuugcuuuugcacuuauuauuuaauuaaauguaauuauuuuauuuugcauuauguaguaaugcuucuuuuccaggauccuccgguauuauagccugucuugcaauuuuugccuaauucuggucauucuaaugcaaugaagcuccaguaccuuuacuauuauaaauaacuugaauuuguaucuugagacugucaccaauaccauaugcaaagggggaaauggccuuuacacacacagacacacauacacacauacacacacaauguauguguauacauccuccccuauccauuccccuuagguuuuucuagaccaugaaaaacacucucuccuaaguuuuucaaacuucuuugaacaccuuuaauuacacugugcuccagguccugacgcaguaucuuacaaugcacucuuccauuuaagcucuugcuccuuaucagucuuugaacaauuucucuguugaaacugacagucuuaucauucucaagcuguuuuucaacaggccugaaccuucuugcuuuuucuccuuuuacuucaaccuucuuguuuucacucuacaguuuagccugagaaucuugauuucugacacaguguuacugaaaauucuacaauguauuggcucuaaauguccccuuuuaaaaccuuucugaaggaauauaaaugugcacgugcuauccauguuguuucccuuauuaaagcuuaacucauucucauuucugggugaaauaaaaguaauucauuuuaaaauuguauauauacucuuuaauacuacguaggguucccuggugaacagaacguccaacugauagcuguacuuuucauuuaaacaagcauuccuuuaagcuuggguggaugauaaccaucagcuccuugugacauuaacuggccacaucuaugucaaugcacuguugucuagcuuugcugagauagcggggaguggggagacuaugucucucagcaaaagccaccacuucaggggcugcugguugaagaguggccaucgcugucuuggcugaagguuagaugaaucggccaacuagucguuccccauacaacagaaacagugggaggcagccugucuucuagucacuuaucuuucuggcagaaccauauuccuuacaauuaaaccauucaucaaaugcuguuaagaguuucccaguguccaacuugguaauaaaacuccaggguuucgaccugggucauuacacauugaaucuuugccuccugcauaaaauaagaggugucccaaauucauguggcuuauuguucagcagcacacuugagauacuaucuccuucugacuuaucaugucaaucuuagcaagcaucacagagaaggaagaacccaccugguacaugugggcaauauuugauccaaaauauuuugcuccauagaguuugccaucgggccacuugacuuggacgacuucucccucagcaggugggcccagcuucagacagucucggcucugcagaauaaacagagacaggcuuuucaaaaggagugccuaagugacugcauuuagaacuuagcaaaugaugaacuccuggcaauuaaaaggaguuauugccucuguguuuuauggauuaugaucucgcauggguguucaggggaagagauaugagccaaaggaguauuuaaagauucagccuacaucauaaaguugcaaaggagccaccauaauccaagcagaaaaaaacagcagcauuuacauuugcuauuugaaaaagaauuguuuaggggguaacuaaaauaugcauagaaaccgcuuuagcugaggaauagaccagcuaaugauuuauaacaccugacauuuauauagcauuuugcaguuaacaaaaugcuucagcauacaucucaugugaucuuauaaucaccccaugacauagaaagagacuauuaauuauccccauuuuacugacaaggaaacugagacuccugcgaggcuuuaaguugccaggaucucuggaggagugaagcuaugggagacuaaaagacacccagguggaaguggagcaggggacaaauggcgugcgauugaagccgguaggacuugccaauaaagcagagaagggaaaacaggagcaccugcagcacggcggguggagcuggguggguguguccuguuuagcacggcccuucuaaagacacccuggaccccccuacauaaaugugcuucugccagcaucuccuguuaauugacgagcccaccuuuuucugcagguaaucaugguggcacccauaaccagaaucuuuucauuucagaucuucuguuucauauugccaccucccaaggcaguaauucagagcaaacuccccaggugauuaauccugaaaggugcuuuuuguuuuuuuaaggcguggcagggggacagggaaguuaguaaaacauuuaaacauuuguucagacauaguuugcaaacuuuuaaauuuguauguauugaguaggacacaauacaauuuuaauacaagggaauuaaauacuugacuaugguaauuuuuauuuuugcacauuuagcaauucaugauuugcuaauacugguauuuuacugaugaggacaaucugaaugaaaugcacacuugaccaaucaagcuauaaaugcagacugggcauauucugugguuuaaaugagaggcauacacaggaaguauuuaguuguuuaugauuggaaaucuaccauguacuauuucuuauuacuaauagaaauugugccuuauaaaggaguggccauuugauugcuggguuaggaguauacauggaaggcccggcuguucauuuuucuaacugcaggcuaugcuuccauuggagcuaaagcaaagaaaaaaauaguuugcucggaggcucuacagaacugacaauaugcaucuaacuuagccaaaugaaaguaagucuauccuuggcccucauaggacuugaccucagggcauguggaauugaaaggguaggcuguggagauguacucaauguauucccaugggguuaucaccuuucucuccauuucccuucccaagauuuaugcgguaccgagaacacuggaagguauagcuucugaguacaaacugauuacaugcgucagucuccgagguuagagagucgcaucagcucuggauuccucugagcugaagcccaggugcugggguaaguguggcggcaggagguggcauaugcuucuccugcugcuaaagaugucucccauguggagggaucuccacuuggguaauacaucuggcucaucuucacccccucuuagccuuuuacaagaggauuaguuacgacuuaauuuuauuuuugaauucugaaggagacuguauuucccaaacuaugugccauggugcucugcagugcuacagcaaacucacagggacccugugggauacauucaagagaagcacggugacacuugugaggcaccuagcuuacuaauacugaugaguuauuuggaccuaauuuacuuaacacauagaacuguuagguacuucuuuugacugagaggcacuauaaaaagcaugcugagguacuaagggugccugcaagccaagaaaguuuggugaccucuagcucagcuccuucccuuucucucuggagccaucaugcagacagagaaccugcacucugcucugcuccuuccacggagaggagccugcacuuuccugcacggcccaucacuagguaagccugucuaauuccaggguccaguauuugaaaccuguuugccaacagauauaagccacacuccucaauaucugcuuuaucacucauaaaggugauacuuuacaucuccaaauccugacuccuuugucucgcuuuuccucaggcagggcgagacaugcuauuuauuggguccuucucgaaucccaacagaggcaagucaacgccucaggaaauacaugaggcuguacccugcacuuucuuacccaccacaaacaacuuucaagcaggagaguuacggccuccccuucuuuaucauuuagguccuuaauuuuacagauuugcccuucagcagaacuuuauuaaccuuuaaaauaaaaucccucaaaauaaauccugacuugcaauuuuagguaccauaucaccaaggagagcugagggacauggaaacguggacuggacaagcauaaauugcauucgagcaguuuaauccuaaaaacauaguuuuauuaacaaacugaauagaugaacuuuacuaagugacaauucuuuuuucaaaaaccuuuuggaaacaaugccugagauaguuagauaucuuuuauuacuaauuguaaauucaccuuucacucacaggaaaucuuaauccagcauuggcagugccugaccucaacuaaccacuuacugcucagccuccuccuaacguugcucuguauccuaauguugcucucuaucagccacaaagauaaaauucauaaucuuucaugccaaacucaagaagacauuucaguuugcuuucucaaucuucuugcuuucagaacucuuuuucuuuacuuauagaagaagaaaaauaacaaaccaacuauguaacaagauaaguuauucugugccucccccaccuccaaaaccagggggcacgauucucauccauaacagcuccuuucucacccugcaccaggucauucagcuggaaggacauauauuuugauuagcauauaacuuuauuuaguauguaaaauucaguauuuacuccuuagcuacuuuccaaaugaaguuaagguagcucggaguaaaacauaaaagagcuuauuucuguaacaucuacuuucauccauaaagaaauagugucaauucaucagcuguuucacauuuugaguuugccagcaacuuccuaugacuaugugggguauaaauuuaaacaagaaugagacuagaagcaugugagcugaugaaaagaaguugaaagguuugauauuuaggcuucucugaucucuccaaaguagaagcugguggguguccccaaaauuguuucaaucacuaauucaaaaccuauuuacugaccaccuaaugugugugagacacuaggaggcaauaaagcccagcagcccaagccagggacagacagagggcauugcacccacacgugaggccugucacacuaaaccccauggcucuguggggugcaggucuucaggguccuugcaaggggggagaucuaugagggcuucagaguagaacuuugauuuuauuuacaaauaagguuucugaguaagauuucauucgggguagagaaguuucuuuuaaaaauaaaaggucuggaagauggccaaauaggaacagcucccgucugcagcucucagcgugauugaugcaaaagacgggugaucucugcauuuccaacugagauaccugguucaucucauugggacugguuggacagugggugcagcccacagagggcaagcugaagcaggguggggcaucaccucagcugggaaguacaaggagucaggggauuuccaauuccuagccaagggaagccuugacagacuguacuuggaaaaaugggacacgccugccccaauacugcacuuuucucaaggucuuagcaaccagcagaaaggagauucucucccgugccuggcucggugggucccguggccauggagccuugcucacugcuagcgcagcagucugagacugaagugcgagguggcagccugguugggggagaggcgucugccauugcugaggcuugaguagguaaacaaagcggcugggaagcuugaacuggguggagcccaccgcagcucaacaaggcccacugccucuagacuccagcucugugggcagggcauagcugaacaaaagacagcagacaacuucugcagacuuaaacuucccugucugacagcucugaagacagcagugguucucccagugaggcauuuaaucucugaggaagggcacacugccuccucaggugggucccugacucccauguagccuaacugggagacaacucccaguagagguaaacagacaccucauauagguggcuccccuucugggacgaagcuuccagaggaaggaucaggcagcaauauuugcuguucugccuccaauggugauccccaggcaaacagggucuggaguggaccuccagcaaacuccaacagaccugcagcugaaugaccugacuguuagaaggaaaacuaacaaccggaagggaauagcaucaacaucgacaaaaaagacauccacgccaaaacccgaucuguaggucaccaacaucaaagaccaaagguagauaaaaccacaaagauguggagaaaccagagcagaaaagcugaaaauucuaaaaaucagagcaccucuucuccaaaggaucacagcuccucgccagcaacggaacaaagcuggagggagaaugacuuugacgaguugacagaauaggcuucagaaggucgguaauaacaaacuucuccaagcuaaagaggcauguucaaacccaucgcaaggaagcuaaaaaccuugaaaaaagauuagacaaauggcuaacuagaauaaacaguguggagaagaccuuaaaugaccugacagagcugaaaaccauggcacgagaacuuugugacgcacgcacaagcuucaacagccaacucgaucaaguggaagaaaggguaucagugauugaagaucaaaauaaugaaauuaagugagaagacaaggucagagaaaaaagagugaaaagaaacgaacaaagccccaagaaauaugggucuaugugaaaagaccaaaucugcauuugauugguguaccugaaagugauggggagaauagaaccaaguuggaaaacacucgucaggauaguauccaggagaacguccccaaccuagcaagcgaguccaacauucaaauucaggaaauacagagaacaccacaaagauacuccuugagaagagcaaccccaagacacauaauuggcagauucaccaagguugaaaugaaggaaaaaguguuaagggcagccaagagaaagauaggguuacccacaaagggaagcccaucagacuaacagcagaucucucagcagaaacccuacaagccagaagaaagugggggccaauauucaacauuccuaaagaaaagaauuuucaagccagaauuucauauccagccaaacuaagcuucauaaaugaaggagaaauaaaauccuuuacagacaagcaaaugcugagagauuuugucaccaccaggccugccuuacaagagcuccugagggaagcaccacacauggaaagaaacaaccgguagcagccacugcaaaaacaugagaaauuguaaagaccaccaaugcuaugaagaaacugcaucaacuaacaggcaaaauaaccagcuaacaacauaaugacaggaucaaauucacacauaacaauauuaaccuuaaauguaaaugggcuaaaugccccaauugaaagacacagacuggcaaacuggauaaagaaucaagacccaucagugugcuguauucggaagacccagcucaugugcagagacacacacagguacaaaauaaaggaauggaggaagaucuaccaagcaaauggaaagcaaaaaaagcagggauugcaauccugguuaaacagacuucaaaccaacaaaaucaaaagagacaaagaaggccauuacauaaugguaaagggaucaauucaacaaaaagagcuaacucuccuaaauauauaugcacccaauacaggagcacccagauucauaaagcaaguccuuagagacuacaaagagacuuagacucccacacaauaauaaugggagacuuuaacaccccacugucaauauuagacagaucaacgagacagaagguuaacaaggauauccaggacuugaacucagcucugcaccaagcagaccuaaaagacaucuacaggacucuccaccccaaaucaacagaauauacacucuucccaacaccacauugcacuuauucuaaaauugaccacauaguuggaaguaaagcacuccucagcaaauguaaaagcacagaaaucacuguaaacugucucucagaccacagugcaaucaaauuagaacucaggauaaagaaacucacucaaaaccgcucaacuacauggaaacugaacaaccugcuccugaaugacuacuggguaaacaacgaaaugaaggcagacauaaagauguucucugaaaccagugagaacaaagacaacauaccagaaucucugggacacauuuaagcaguguguagaggguaauuuauagcacuaaaugcccacaagagaaagcaggaaagaucuaaaaaucgacacccuaacaucacaauuaaaagaacuagagaagcaagagcuacuggaagacaagaaauaacuaagaccagagcagaacugaaagagauagagacacaaaaaacccuuaaaaaaaaaaaaaucaaugaauccaggagcugguuuuuugaaaagaucaacaaaauugauagaccgcuagcaagaauaguaaagaagaaaagagagaagaaucacauagaugcaauaaaaaaugaaaaaggggauaucaccacugaucccacagagaauacuaccaucagagaauaauauaaacaccucuaugcaaauaaacuagaaaaucuagaagaaauggauaaauuccuggacacaaagauucuccuaagacuaaaccaggaagaaguuaaaucacugaauagaccaauaacaggcucugaaauuggggcaauaauuaauagccuaccaaccaaaaaaaguccaggaccagacggauucacagccgaauucuaucagagguacaaaguggagcuggucccauucuuucugaaacuauuccaaucaacagaaaaagagggacuccucccuaacucauuuuaugaggccagcaucauccugauaccaaagccuggcagagacacaacaaaaaaaagagaauuuuugaccaauaucccugaugagcacugaugcaaaaauccucaauaaaauacuggcaaaccgaauccagcagcucaucaaaaagcuuacccaccaugaucaaguuggcuucaucccugggaugcaaggcugguucaacauacgcaaaucaauaaauguaauccaucacauaaacagaaccaaugacaaaaaccacacgauuaucucaauagaugcagaaaaggccuucgacaaaauucaacagcacuucaugcuaaaaacucucaauaaacuagguacugauggcauguaucucaaaauaauaagagcuaucuaugacaaacccacagccaauaucauaaugaauggacaaaaacuggaagcauucccuuuaaaaagcggcacaagacaaggaugcccucccucaccacuccuauucaagauaguauuggaaguucuggccagggcaaucaggcaagagaaagaaauaauggguauucaauuaggaaaagaggaagucaaauugucccugucugcacaugacauaauuguauauuuagaaaaaccuaucaucucagcccaaaaucuccuuaagcugauaagcaacuucagcaaagucucaggauacaaaaucaaugugcaaaaaucacaagcauuccuauacaccaagaacagacaaacagagagccaaaucaugggugaacucccauucacaacugcuacaaagaaaauaaaauaccuaggaauccaacuuacaagggaugugaaggaccucuucaaggagaacuacaaaccacugcucaacaaaauaaaagaggacgcaaacaaauggaagaacauuccaugcucauggauaggaagaaucaauauugugcaaauggcuacacugcccaagguaauuuauagauucaaugccauccccaucaagcuaccaaugacuuucuucacagaauuggaaaaaacuacuuuaaaguucauauggaaccaaaaaagaacccacauugccaagacaauccuaagccaaaagaacaaagcuggagacaucacgcuaucugacuucaaacuauacuacaaggcuacaguaaccaaaacagcaugguacugguaccaaaacagagauauagaccaauggaacagaacacaggccucagaaauaacaccacacaucuaaaaccaucugaucuuugacaaaccugacaaaaacaagaaauggggaaaggauucccuauuuaauaaauggugcugggaaaacuggcuagccauauguagaaagcugaaacuggaucccuuccuuacaccuuauauaaaaauuaacucaagauggauuaagacuuaaauguuagaccuaaaaccauaaaaacccuagaagaaaaccuaggcaauaccauucaggacacaggcauggccaaggacuucaugacuaaagcaccaaaaucaauggcaacaaaagccaaaauugacaaauggcaugaaauuaaacuaaagagcuucugcacagcaaaagaaacuaccauuagagugaacaggcaaccuacagaaugggagaaaauuuuugcaaucuacccaccugacaaagggcugauauccagaaucuacaaagaacucaaauuuacaagaaaaagaacaaacaaccucaucaaaaagugggcaagggauaugaacagacccuucucaaaagaagacacuuaugcagccaacagacacaugaaaaaaugcucaucaugacuggucaucagagaaaugcaaaucaaaaccacaagauaccaucucacaccaguuagaauggugaucauuaaaaagucaggaaacaacagaugcuggagaggauguggagaaauaggaacgcuuuuacacuguuggugggaguguaaauuaguucaaccauuguggaagacaguauggcgauugcucacggaucuagaacuagaaauaccauuugacucagcaaccccauuacuggguauauucccaaaggauuauaaaucaugcuacuauaaagacacaugcacauguauguuuauugccacacuauucacaauagcaaagacuuggaaccaacacaaauguccaucaauguuagacuggauuaagaaaauguggcacauauacaccauggaauaccaugucagccauaaaaaaggaugaguucauguccuuugaagggacauggaugaagcuagaaaccaucauucucagcaaacuaucgcaaggacagaaacccaaacacugcauguucucacucauaggugggaacugaacaaugagaucacacggacacagggcagggaacaucacacaccggggccuguugagggguggggggaugcgggagggauagccuuaggagaaauacguaauguaaaugacgaguugaugggugcagcaaaccaacauggcacauguauaccuauguaucaaaccugcacauugugcacauguacccuagaacuuaaaguauaauuuaaaaaaaaauaauaaauaaaaggucugaaaaaaauuaaguauaucaaaaggucuaaaaaugaagggauuuaauuuaugaaaugcaacaacuugaguggucugcccucccucuuacaggucuccagcugguucacauauccuuggguucagcaccaggaaccaggcacuagagcacagcuucucaaagcguguucccaacccuggggcacacauuaaaaaugagaauuccagguauccccaaagcucucucugacuugggcgacuucuuuuaagcaaucuagaaucuaaggucaauuauagaaaaggauguaaaauacuaaagaggcuuuuccuaaugcaguuuacuuaguauguuacuggaguaaguaaacaccuuugcuggaaaauuauaugcauuaaaaccuugacaaaugcauuuuucucaguugcuguccagacucuuugaagcaguccaucuucaccuaacauaaauagcuguuugccguuugcuguacugccucuagggauguguaaacucgccugaaaucuaccagagccuuguucacaaggacacuggugucuggagcugccaguaagcccguagcugcaguacuaaauagaugaugugaaaauuaaagacagaaaucauaaucacggugaagaguggccuuuuggcugugaucaguuacuucaaggacugauaggaguacucaaccuagggcaagaggauggugucauuacauuccugccaaagucagggccaaacuccuauacuugcuccaucaacuaaaaggaaaaauucaucugccagucugauuaccugaauucugaagucacugaguucuuggaacucuuacgagacccuucuaaagggaucccuagaagcugcuguccucaaauguugccuuagcccuauccccacccccaucacuacuccuuacguguauaaaccacagagcagguagccccaucugugagcagaguugcaccagaugaagacguggcacauguguucccaguaguuaaucggcauauaguuuggcuccucuggcagucccccuuggggagaaugcuuaggugaccuggggcgaaaugccaacagcugcuaucguuuccagagauaaucaccugcucauuacuggacccuggcagggauuaacaagacugacagacagccacguaaguaucauaguggcuaucugucaucuguucggcugcccagcuuuggaacccccuucuccccagucuaaugggggcugagcuggccugacaucacagucacugaacacugccagacacucccuuccccagcuucccucacagcaaagacaacuacagcggccuggccagugggcugcaccagcccaggauuuagaaccugugaucagagaugcagagaaacaaguagaagagagaauucucucagacagcagcagcagcagcagcacccacaggccuacagcagagguuagguccagucucaccacauaaggggaggcaguguguccuuccuggauggcaucuguggucuggucuugcccauagcugcagcugaacagccuccuuuuuguucuugccuauuuucugaccuuuguucuucugcauuccuggagauucuggaagcuccccaauaaccuuucacuaaauuucuguacaggcuaaaucaaugucaguuucuguugguugccauuaacaacccugauaaguaaccgcuaguuugcaugaugacagaucccuccucccacaaaauggaaagaaaccucucacuuaacaauggaauauaaaacuggaggacuucccacaccaugcaaaggcccagcugcaaaaccauccuccucaaaaagaagggagcauauugauggaagcaucuaccuguucacaaggcuugguccuagaugaccggcagcagucucccaaguuuucaauaccccccaguguaaggaugugcgcucucugaggauauccacaagaauguauuccagacaauaaagucaccaagcaccggaggaauggccagcucuuagcaauggccucucaagggggcuacucugauggggauacaccacuuuggacugcuuguuaaacaugucauaagcacccuucauguagagauuagcaaagaaugcaaacacuuaaaaauuauuuuuaaggcugggcaugguggcucacccaaaguguaaucccagcacuuugggcggccaagguggaaggaucacuugagcucaggaguucaagaccagccugggcaacauagcaagaccccaucucuauaaaacaaaaaagaagaaaaaguauuuuuaugaguaauucugagcuucuauauauucauuagggagaaacuguaaaauuucuuaaagauaggaaaaaauuuuaaaaccucauauuucuaucacaagugaucacugucaccacauuuggaguuuuuucccuguacuucuaauuuuuaaaacuaauuuaaagaauuuuucucugugcucuuuucuuuaagaauuaggacauccuauacaugcacaaucuuuccccugcagccgguccagccuuuauuuucuuucauguuagaauacagcugaucugucucuaaagcuauuugucaagagcuuggaacugaguucaugccauguuccuucgccuccuuccacagcauuuugggguggaggcccuuucuuuuuuauugggguaaaauacccauaacacuaaauuuaccauuuuaaccacauucaauuguaaauuucagugacauuaaguucaaaguguugugacuucaucaccacucuccaucuucagaacuuuaucuucccaaacagaaacucugcacucauuaaacacuaacuccucauucucucucucaucagccccuggcaaucaccauucuccuuucugucucugagaauuugacuauucuagguaccucauguaagcgaaauccuacaauauuucuuucguggacauauauaauuuuguaccuugcuauuugccaccuacgauuacaucaugagcauuuuguuagcuauuaauuaucuuuuaaaaacucuguuuuacuugccaaauauaugcaacaguauagaugaaccacaacuaauuuagccacuccuuuauuaaauauuuaggucacugcaauuuuccccuaucauacauaaugcuauuguauauuuguuaucauaaaucuuugucugaauuacugacucuauucuuagacuccuagaauaagaguuacuugguaaaaaggcauauaaacuauuuauaaacuuaguuucaucagcuuugaaaaauucaacaucagacucauuucucuagugcaguaaauaaaucuaauguuaaccaccagagaaauuucugauucagcugguccaagccaaaugccuuuccaggcaaucucaugcucagcagggugggaacugcuguucuaggagguuaucucgcagccuaaacuauacauucuguguauaacgaaagaaccaauucugugccccuucuucugacugcgucuuuuucagagugagagcuuucuaacaugcuuagaagaaaauguggaaugcuuccacacugagguaucuguaucuaagcguguucugugcugguucuagaccccuguaauuucaggcucuggguuaaucgauucaagccaagcugcuucuauacugacacuaaucauucugggaaacuccaagucuauccaagucuacuguccacuuucccuuuuuaauaguuuugacacagggucucacuccugucgcccaggccggagugacugcaguggcacuaucacagcucacugcagccuuggcuucccgggcucaggugauucucccaccucagccucccaaauagcugagaauacaggugcgugccaccaugcuuggcuaauuuuuuuuuaaaaguagagaugaggucuugcuauguugcccagcaacauagcugggcacaaccacuuccgccucccgaagugcugggauuacaggugugagccagcacgccuggccuuguuuguuucuaaaggacacauacacacccuuucugaacuccaagaugcugugguugucccuuaagcugaaaugaagcccaucuugcuuacucaaacagccaauuuuuuuuuuuccaccagucacacuuggccaauguccucauacacagcuauaccuauuuucuaaaagauaggucuguuauuuucacaaaaauaaaagcacuaaaacuuauuuggugaauuccugaaggccaucuaguuuuuugugguuguugcuuuuuauagagacaaggucucacuauguuggcaaggcuggucuugaacuccugcccucaaaagguccuccugcuucagccucccaaagugcugggauuacaggugugagccacagugccugguccgcugcuuuguuaguacguacuuucccuccaaugaugagcccaaaguggacacgaugcuugguuaagguacugaggucccagagacggagguuguuuuauuauucuggaaguuauuauagcauuaagccucagagguauauuuuccaaagcagccacaucuuuaugauauuagaaauaggugagauucuggcaugcaaaaaccuuaaaaggccuagaaaguacaaaggcagcuguuuuuggaaauuauuuuucugguuccuuugaagugaggaagcauaacaaacgccaauaacuagaaacaggguugacacugcgggguugaccacacccaaaagggccugcaggggagggaccaggaaggcaaugugggcacaagagcagcaguucuaacccacugguaagagauucucugcauuccugccuucuccuucccucugaguguguccucugggccagggacugagcucagcacugagaaaacagagacaaaaaagacccagcccucucggagacauuucucuccaaggauucagauccagcuggggacucaaauacacacaugaauaucugcaauacaaggcacugugugugacuguagguaguuaggcaaagaggugggaacucugugucugugacccgcccucccaggacaucaacuguguucaggacuuuccucuuaagauuaaccaaaguuccucaugccacuuccuccacguuaagccacccugcacacaaacugagcuaauuauagacaccucucucaggacaaguuguggugagagcaauaauacaggccuuaaagaaagaggugaaagggagaagccagagggcggcuccugcggcacucuguggggaccacuguuuggggcuccggcauugucaaccugauuucguuugggcucgcauagcuggucagucuaucccacugaccguguugagugguguagccaaacaggagacagaguuguagcccugaccccuuccucucccuuucuacaguauucuggaaugaucccacucgugaucucagggcugugccccaccauaccaggagccaaaauaggaaaucuuccaaguucaacuccugaaagcuccaaauauaaaaacuacuuaaauaaggaauuuauacguguaaagcuuucugacacuuccucuuagauccuucuuucaguaaccucuucuuuauuuaaagguauggaagauguagggugaaaaaauguuucuagaaaucuugugcuuagggacucucugaccaaugagcugaccaaaaauuacuggcugccaccaucgaccauaaucaccacugccaccacagccacaaacacuaccugcauuuguuuacuaugugcugggcaccacacuaacugcuuuaugcauuacguuucaauaaucccaacacaaauuccaguauucauuacuacugguggcggcggccugucugaagcagccacugugaggaugccagcugcagcgagggaggcauggccaaggcugcacaugggggcugggaacaggugaucccagugggagccccgugcccuacugagcuggcagggcgggagcccaugcucccaggugcagcugcagcugcccagccguggcucuggacccgggcaucccugugcucucagggucccaggaaggccccugccccggcaggcucggaagugccugcuuccacucccuggcuucuccccgcuccugguaugcacucugcaguggaacaaaguugccaucgugucuugauagcugagcccaggcacuguagcgacccagccgggcgugugcaugcucaggauggcacuaacacaccagaccccagacugucucagcaccuccagaaacuaguucugaggcugacauuuugggugcugaggagcacgggagugaggccaaggggccugagggcggcucggcaugggcaugcaagugccccuuggugcagaaaaccugggugccauaaguggcaguugaugacggcaaaaggcagacagguuauuaggagggaugggagggaucccuggugaaaccccaccuucaagccagggauggccugaagccuggggcugggcugccaauuccgggugaagucugcaacagggagugagaacuuccuugaugaaguuuuagccaaucaaguggugcuuuuuccaggcccauccauggaccaaucagcaagcacuuccuccauucugaccccauaaaaaccccagacucagcuggacucagacacuccuugggacuaccugccuguggauaggagcuacccacuucaggucuccucuccacuaagagguguucggucauccaauaaagccuuucucugucuugcucacccuccaauuguccacauaaucucauucuuccuggacgcaggacaagaacuugggaccugccaaauggugggagugaaauggguuguaacacguuccuggcugccucaccaagcuguaggcagugauacacucccagacaguggcagugaagagugccaacccuucugggugcccagaccuuggaauucccugagccagagcugccguaacacuacagcccuccuguucuccacugcuacugggcagcugccccacacaacgggaaagagcuguggggccaggccagcccaugagcugcaagcugaagugggguggugguacugaaagagcuguaacacaaaugggcugaaacauggccccccggcucaccgcacugugggcaaggaggagagaaaagcugcagcucuucugggagcccagaccuucagguuccccaagccagggcuguaacacacuguaacauccucucuggggcucugcacuuccuggcgucuccaagcuuuugggcgccaccauguuccccuuguccggaugcugauauccacagcagaagcugcuugucguauaucugguccagccacagccucacauggagccggcaccuggagcugcccaccccaccacaacagcuggcaugccuugcugugugcaguggccuggcccugugcucacacacaaccucgccgcuccaagccuggcuugcccuuggcaggcacgggauccgggccaguagcaugagccgagcacagccugcugggcugaguggacggaacgagccuagcgggcaugagcaaaacucaagcagaggcgccaccagccacagagguuuccagcuggcaaagcaacacccuaaggcuccugugacauuacuaucuccaauuuacagauaagguaacuggugucaacucccuugccugguugcacagcuaauuagcagagcaaggagcacccugggucugccugccacacauguagcucuuccuaccuggguaagagagccaacaucggcccugaugacugccccagggcucacuguguccuccuguagaacaccccaggacuuuaacuucucacccccaaacacggggaaaaaagcuccaucuauauaggaaagauuuucuccccuuuuuuauuguuguuggcagggacuaaaauguaugaggggaauaaaauauuuuacuaugucaauaaaaauuuauguugcaaaauggagaaagacaggcuuggggugaauuucucuguagugguuucuaaaaauacaugucaguuccaaaagcuaaaaaaagaaagaugaaaggaaagcuaaggauaggcacgcaggggagagaaggcugcccuguguuuauauguccggcuuuccaaggcucuggcucugcucugcaauguuuguucuacuucugggagcacagcuugaccuacccaggacgcuucacacugaagugaugcauguacugcuuccaagaucuggggucaggccacucacagucaaagaaaacccauuacugugcauaagcuacucaaccaccuuauguccugguuuucucauuaauaaaccuuauguccugguuuucucauuaaucaaauggcgauauuaaugcaaucuugcagggagaaugagagaagagaacagaaaagcaaaacccaauuccuggcagcuagugaauauugagugaaucacaucuagauuuaauucccaucaacaggaauauaccuagaggauagggaggagacaaaacccuugggaggccaccuuugggauuaaaaauagugaaggaaacacugagaagccaagaacccugacuacgagagaaaggaggcuacaacagaacacagaacuacagaggacaaucguguuuguuauccucauuggaaucugaaacagccugguaggguaggcaggcaagcgucaacauccuccagcacugguagagaagagugacucgccugaggccacagggcuaauaaguagauggguggggcugucacucacuuaccugggaauuuucaagcaucucguguuuuagggaacaaaggaaugaguagugaguuaaacagauauaguuuuuuacuucauagaaacugcuucauuggaaaaugcaggcauugacuuaaaaaaaauuaaguauaagaacuccuacauaaggaauaacaguguaaagcagaagcauuugacagauuauuggcaacuauaugguuccuauauuccagagagcuucaagaugccacaagagcuagagaucaaaaaugaaauuuugacaaagcaaucuguaaagaucuagauaaggaaaauuaggggaaaagaguaaggauauaaguaguucucagaaggguuaagaucuuuuuuaaaaaaacuuuuucugauuauaaaaauaaaacacguucauauggaaacuauaagaaggugauaaaguugaaaaucauaaucaccuaugauuacacucuccaaagauaaucaguaacauuuugauguauuuccuuugaggauuuuucccuugcauauuuauauuuuuauacauaauugggaucuuacuguacauacaauuuugugccugauuuuuccauuuauuauauugcaucauuaaauauccuuugaaaacaugauuuuaauggcugcauaaauaauucauuuaaccuuccuccuggcugcacugguaaguguucaauguccagaucaaaggaacaaagagccgucaugcuugcacuagccagauuguguuuggggcacuguguuuccacaccugagagcaacaucuucagugggacacuguccaagaaaauuucauccucagaguguccuggaggaagagcauucaggaaccacuuucuguuuauuaaauccuucauuccugccccaugacugagaaaugaggacuguauuguuuggauuugagaagacuuagcagggacuugagaccucuccacaaacauguuaagaaacuuaagcgaaagagaguguguuuauucaguuuugcucuagagaucgagaacuaggaaggcuccuggguguuccgaagaggcagcaguuagacuucacagaaagaagcccuugcuuccuaacaauugcagcaaaaauugagagugagcuccugucauuugcagcguuccagaauggaucugaaaacuccucaccagagguauggcagaggagaugucuggcugugggugggaguucuggaggaguugggggaaaaauagagcacagcagaguggggguaagaaugaacaguuaagggaugaggugagaggggagugcgccccccaucagccugucucaccuacgcagcaccccugaacugagacacagcgacucagaacuuccagccauucaauggccuguccaacucucauuagaaguaugggcaaggcugagacuacgguuucuaaauuuucaagucccauucuagugauccuccuccuucaccaaagcauagagaauaugcaaaaggauggcaggaaaaaaaucaaacgcagacacguaguuagcuuucucccccgccacccucuggccacgcaccuuuaacucuauaaugucagcuuccucuuuggucaaaggagaggagcauccuuugaggaucaacacccgaggaggaggccuguuaaugcagcaccaccuuauucucuggugggcccagagggaggcugguuuaacucaaucagccaggugaugcgcaaaggggugaagcaaaaugcauagaaaggaugaaggcaacaggugugugggucucagccacugugguagaaaaagcuuucacaaagcuucugugguaaagcuacaacugcaaagacaucacggugccuaaaaauacgucaaagauugcucacuccugggcugagaccuaagaauagcuuagcucccuuugacuccauguaauauucugauacaaguggcaugccacgucuuacaguguggaggcuguguccacaugaacagcauuuucacucuccacuucacccaagcugacugagcauguacuccugucacauucaccacacagguggugcuccacgccaggaauccgggaaaggggaaagaaauguauaugcggaugaguggaaugguggggccaggggccacauuccaauguuuauagucagagaugacuagagaucaccuauggcuguucuccccuacgagaaugggaagagaccugagagauccccuaggccaauguccccaguugaaagggaagggcugaauaaugaaaugacuugcacagucacaaguccccaagagcugccuauaauuuaaccuugcauuucacagcccagcagugcaagguuuugagcaaauggguaacacuuggggagaauuuuaacuaggggauuaaaaagcagagccaggugacgaccaaccaaagaaccuguaagaauaugauuugucagaaaauaucagcucaugguauucagaaacugaggaguggccgggcaugguagcucaugccuguaaucucucucaccuuggccucccaaaguuugaguuugggaggccgaggugagcguaucgcuugagcccaauaguuugagaccagucuggacaacacagcaagaccuagucacacaaaaaaaacaaaaacaaaaacaaaaaaaaaacaaaaagaggaguaaugaguauacaugcaaaaaugaaguaauucaggauauccucaaagcuggaaauguguuccugagcacaguaaaaaaaugugagcaaugccauucuagaaauacuuuucacauaagcuacagcuucuaucucugugaguuuaacauguccuuccuuuuagauuaaauguaaaugcauaaaguuaaccaaucaugcucauuauacacugacuuaugcagacagggauauguguaauuacuaccagcauuucaacagagacuacucugucaaaaaugacagacagauagcuaagaugguuaaggaguggauaaugaaucaaucuauuuagucaacauuauuaugcuuaaagggaagucagaaacucccccaaaugauucuuguguuguugaaaaccugucaaaucaaaauauucuuaaugugaaauuaagaagaauuuugcuguuuguagauucccaggcaaggagaaugaaaauaauauguagauaacacaccauuguuagauuuauccaaacaagagcuuuuaauccaccaaggcuuaaaaacacauaaaaggagggugguaaauuucgcuuuacugaugcacgcaacuguggaaugcccgguucagaaucacaucaaggauuaugucaugcccuuuuucugacaguuaaugaaccucugaaguaagagcuuuucuauucuuuucacaccagauauuagucuucauuugaaggcugauucuugcuaacaucugauuugcuuaaugaacacugaauaguuggucaauuaauauuucaauugugauaucuuuuuucaaucuacuaaaaaaguaacaagguuaguuagcauccucaguuacuuuccuugaaacagacacccacugauauagaucugcguauagaggcaacuggaaaccaaaacaugccaaaguguuggggcucccaggguaagugggcaccugaaaguggggucaguauaagcgaugcugguacuggaacagcugagacuagcuuuuauagaguaagcugggaggggagggagugggacuucagugauaaaacaaguagguaaggagguagaggaagauaaaggauaaaaggagaugggccugcuugcaaacuuuaaacaucauccaauuaacaguaacuaugacauuaacaauauacaggauguaauuccuagcuuuuagcauguuaauaugaugccaggugcauucaaaugaauacauuguguguacacacacacacacacacacagccuguaugagcauuuuuaaaauccugggaggauauaugagaagcaggugagacggugauuuccagaugugggaggugcaggaaugcacuuuucaucuuaaauccuucuguauuucuugggacuuuagccagccauggguauguuaugcaaaacauuguacaucuacaauuauuaaauauuaguugcuaauuauuauuauuaccacuaaccacacacauuuuaucuaccaaaguuagucaucuauucuuucccuuuaaaaaagguaaaugaaucucaaaaugagagauguucaagacucgguaagucauguaguccaucuccuucagaaaaugacagcucuucucagggcaacauagcagaugcaucagccucuacacugguucaugaugagggagcccaggggaggggaggcaaagccacugaauagaaagggaaacuaggcugguugugguggcucacaccuguaaucccagcauuuugggaggccaaaguggaaggauugcuuuaggaguuccagaacagcuuggauagcgaaagaccccaucucuaugaaaauuuuaaaaaggaaacagggggauuaaaaguuccgggguagagcacacaaggcugcaugcacagaauaaaggguuggaaacaaaacaacacaaaugaguacugaagagagcuaaggauuaagagacguuagaaucagcuauauagugaggccaagucuacauauguguaaucauaugcucaauuuauuuauuuauuuuuaaaacagccaaauucaagagggauaaaugcucaauuuaaauguucgugugucaagauggaagccccauaaaggguaaauauauuuucauacugaagaauuucuugggcaaaaugacuauuuuaucaaaugggugaaaguuaguuaaugggguuuaugugugugugaugacacauccauuuagagaugaagugccuggucacgucacuucuaaaacaugagaugucucuucucacauugaggcaugggacuuuucacucagcaucccuuacauucuauguaaaagaaaaagaaaaaaaaaaaaccuaauaacaacaaaaacuaugcuuugcaaaccagggggcuuggaauggcccuaaauuaugguaacugcucuagguguauaaaacagagcagaagggaagaaacuccaacacaaccaagucugaacucaucauccugggccuggaagucugggcuucuuccgaaguucccuaucucaaugacaggugucaccuuccacuuggcugagcaagccagaauccugggaguuauauuugacacaucuuucuuccuuggcccccauuaucaauccaucaccugguacucuugauuuuaccuucuaaauauauuucagauccuaaauuaguccaaauuaccaucauuucuccucugauuuacugcaacauucuccuaacuggccucccaguauucaggcaagcuuguccaacccaccuuauguuguuguuguuguuguucuguuuuguuuuguuuuuaggcuuuuauagucucuuauagucuguauuuuagcagccugaagccauccuuuuuaguuucucucuagugauaaugggaaaagagggaugagaaagggguucuacuggccuaaccagaaauagaaacuaagaacccaugacuguauucucuucuuuggacaccccuguggacuuuccaauucuuuuucacuagagccaaaaaaaaccuacuucauaacaaaucucuuugacuucugcucaagauaguccaagggggcuuccuccugcuuuuagaauaaaaccccaacccuauaagauggccucaaggccccacccagucuggcccuuuccuucuucuccaggcucaugauuuaccuccuccagcagcugcacuugccuucccucugcccuguguuuagugaacucaccuuacagaucuucauucaggucgcacugaucacccaucuagauaagauguuuauuucuaguuacaugcucuuacuggaucauauuccugucaucccaggacuucucucaauucgaagcacaucuuuuauacaugcugcguaugucacucucucccacuagauuguaaacuccaugagaucaaaaaccauucgaauuuuacugcuaucauuuucccagaacccagcaugauggguggcauguaguaggugcucacuguaagaaaacuugggggcauaaggcuaccaucauggaaggauaagguauuucuugacuagagaauccauguaugaccauaugcagguacccagaugcggcuuaucaaggccagcccugcaggaauucccuaucuaccaaaagaagggccuucaugggaagcauuagccuuccccaucuuuaugaguccccaacucuaagaagaaagaggacuugagcaccacacauacuauuuccucauccucauuagauuucuccuggagggaaccuacucuuagacacugguuacauuuuugcccuuuuaauuucaugcaaaacaaaaaacaaaaacaaaaaaacccaacaacaaaaaagcaaaacaaacauaaagcccuguacaaacacaacuaguuguuacaguacauagucagucagguaugagcagggcggaagaggccuccucagccccugccacauacaccaggaguguagggcgaccaucaggugauggucagguuguuaacugucucgcuaaacuaauaauuggucacagcuggcaccagggaaaggcugucuccuaauacaugggaaacaccugaaacuggugagcagcagcuucuggauaagaucucaggagugacgagaaggaaugcaaugccccagaaguaugucaguguauaagaucccaagucaagaggugaagcugcccauguggucucucaagucaccugcuuggcccucuuccaaguguccuuuccuuccuuucauuacugcucuaaagcuuuuuaauuaacuuuaacucuugcucuaaaacuugccucagucucuccuucugccuuaugccccugagucaaauuauugucuucugaggcagcaagaauugagguugcugcagacucauacagacaacuaccacugcuuacauaaugauaugagauaaaguuccagcauaaauaauauagaaaaaagguuuuacuaguauugaaauacauuuuaaaacuguaaggaaaauauuaaauucauaugcgauacauaaauuauuucaaaauucauguagggaacaaaauaggaaaaguuacagggucuaguguggccacuugcagccuggucuaaggguuauagugugaugagacagucuuuacaauauauauacauauaauuuuagagucucacuuaauaucaauggcacucacauccacauucuuuccauaguucucuuauagucuguauuucaacaugacuucagguguuggcugcuuagaacauaaggacuaaagccuggcuuguuuugugccagucacuuucuuuuaugguguaaaucaaagaagcugcuuuagaugauucaauauuaucuguuacucaggggaaaagaaugauaauauaacacauaaggcaaucauugggucagauuauuuauuuuuuuguuuucuuuuaagacagggucugguccugucacccagacuggagagcagcggcagaaucucagcucauugcaaccucggccucccaggcucaagugauccucccaccucagccuccugaguaccugggacuaaagaugcauaccaccaugccuggcuaauuuuuugaaauuuuuuuguagagauggguuuuugccauguugcccaggcugguaucaaacucuugagcucaagccaucugccugccucgaacucccaaggugcugggauuccaggugucagccacugcgccuggccuagauuauuaauuaaaggcuagaaagaguaaauaucuagcauguuuuaaaaacauaaccuacaaauauaacuaugcuacuggaaguaugcauaauuuaacuaccccuucccuuuuugcugauuuguuagucauaaaucuacaaaaggcaucuuuuauuuuauuuuuuuuagagacaggguuuggcucugucacccaggcaggaaugcaauggugugaucauagcccacuguaaccucaaacuuccugggcuuaaggguuccuccugccucagucucccaaggagcuaggacuacagguacacgucaccaugccuggcuaaauuuuuuuaaauuuuuuuguaaagaagaggucuuucuauguugcccaggcuggucucaaacuccuggacucaaauaauccuccugcuuuggugccccaaagcgcugggauuucaggugugagccaccgugccuggcccaaaagagaucuuuuucaggcacagaucacaccagcuuuaauuacucguggaaaaaucuacuuugaucugaaaacuaugcauauaacauuauucaacauauuguacuauuuuaaccuuuagaagaaauuaaacauuauacaaauauaaaauucuauaaugguauuggauaaaacaucuaaagcacagaagacuuucaaauauauccuccauuuuauaaaaggcaaaaaauuagaugauagagggaaauugauuugcagaaacacacacaaccaacaagcauuauagcaggcaauagcuuccaagcauuucacucacuucuuagcauagaacacucucuguagggaagauuagaaacugaaggacaaaaauacacucacuccauucucucugccuuuucuucuaucauuccucuucuccauuugcccacauacucugaccucaaaauuauaauuuauuuaauaaugcaaaaggcaagauuuauuacugguucuuucucacccaugaaaauuaacuaacuucuuuuaaauaagguacaaaaaggaaauaauaaaaugaagguaauguugcucaucaauaaguagauaguacugacuucuucuggauauaucuaucgaauaagaaucuaaguucacucuauugccaaaauaauuuaaaucccauggucgaaaaggaacauaaacucuucauugauuuaugggccucauaucuucugggaugugucaccaauuuaugugcuauauccugggguguuagcaccugggguuggauagaggugaaagauaauggcuuguaaacaggcagcucccuguugacaacucgccucaggaagcucuugccauucgccauauauuucagaaauuguaugcagaaagcugugcuuacaaaugcgcuacaggaaaggucagcucuggaaaauuucagacauuucugaaacaugcauauagcaaccugauuauacuacacuuagucaugguaucuagauuugagauaaaaauaaaauuacagcaagaaacgauuuaaaaguguaaaauuuugcaucauaggcagcuaacguaccauuuucauuuaaagaguaaucgaagggucaauaaugaauggugacaaucugauauuacgaugugaagugauagugacaucuggccacguuaguuauuagaagaaacaaagaauuuucauaauguuuauauuuuguauuaaauggaaguugauucagcccuacccuaacauuuagauaugaugucauggauauucauaauuuggugcugaacauucauggguaagccugccaaggccacuggagacauuucccaacaguucugcucucaggcuggcacaggggaccagcaggugcgccaaugcccugacucccuuaacccucucucacgacagacuucucacucucauggcagugaaauagcagguaaugaucgacuucaccugaaccagugguuucaaaguuuuucagggccagagaucuccucguuuaaagaaaguucacauaucuauagaaagagagguuucugauuuauuuaaaaaauaaauaaaucucacaagaaagcuaaaacauugaaggcuugaguuuucccuggagcugcuugcuagagcucugaggaaaaaauauucuuuaccuagaaaggacaugaaacuucaugaacucaaauuuuaaagcacaugauccauuaagaaaaaguugacaaauugggcuucaucaaaauguauaacuuuugcucuuuauacacuauuaagaaagugacaaaacaagacacgaaccaggagaaaguguuuguaaaucaaagaucugauaaaggauauguacagacuauuuaaaaaauucccacaacucaauauaagaaaacucaauaaaauguaaaauauauuacugguuugaauaggcuuuucaucguagaagacagaugaauggcuaauaagcacuugaaaagaugcucaaaucauuagucaauagggaaacauaaauuacaauaccgugaaauaacacuauacauccacuacaaugguuauuguccaaaagacugacaacacagguguuggugaggaugugaagaaacuguaaccucaaauguugcuggugggaagauaaaauggcacagccacuuuggaaaacaguuuggcaguuuccuauaaaguugaacacacacuuaccauauaacuuaguaaucucacuccuaagucuuuacccaagagaaaugaaaacacauguccauacaaagccuugaaagcaaauuucacggcagaauuauuuauaauagccccaaacaggaaauaauccaaauguccaucaacuggugaauggauaaacaaaauguguuauauucauacuauaaaaugggacauuaugcagacagggaguaaacauugcaaagcgucugaaaaaggacuuguaucuagaauacacaaaaaacucuucuaagucaguaacccaguugacaucucucuuccucaacgugacuucuuuaaacacucuggcccaucacaauugcuucauuccccgaauuuacugucaauaaccuccacuggguguuuuucuuguaaaauauuucagaugagcuccuggugguggugagggaguauaacugcaucaguguggagcagcauaauacaucagugggcugggaugggaugugacuucccaaagcugagaugggcucacugaugagagaugucugccacugucuuggccacuuggcccaaaacuccagagcaccucaaaguguagacaccgacgaagauccaaaauugcuucccaagaucccauagcugaaaaaguuucugggaauggcuuuuuucuuagucuuuccaacuuccuuggguauuguauuuugccuccagaacauccaugucacuccuccuacaucuguguuuacacaucucugaaucccccaugaugccuaacacaguguucaacacauagcucagaacggacaacaucacuggauacucccaaacauggaguggauuuggcucauggugcccgcugcccauggguuuaagcaggcucacccaugaauauucagcacugagaaaagaugaugaaguccuggaaauuaauaacacugcucucaaguucaagguaguuauuuugauucuuuaggcugaagaugaaaugcuauaccugagucucuccuggaaagaaaaaagugggaaggaagugccaggaaccuguccuuugggaauaaguucccaaugccaaucaccuugagauaacugccagcacagaaaauaagagaaauacccucaagugagggagguauauauuugaagaaaaacguaacugucagucugucuuuguggcaacuacugaaucuccugcaugggacaucagggcaacgacauacuuucuccagaggauccccagugaugaguggaaacugucgcuaugaugccuacagaauuggggucagugagacacacacaauucguaaaacaaaggaacaagaugcaacugcaacuugaguaaaggcuucaacauuucauuccuauguccaaggcuguaauguaaaaagucauaugaguuacacaaaaggaaauaaaauucuaggaccugggaaguaccaccuccauggacuucagagacaguucacgaaacuuguaagacuagucaggaccccagugaaaggcacaagguuuacagaguugaugaaucaaaugaaaccugaccuuaauuaggagccccugcccaauaacugcagguuuauucuucaaaggcauaaccagauucuaugccucuaaaauggccuucagauucuaugauuauuucuucuuaguagacuccuagccaauaugguaauauuguuuccccuugauugggcaaagucuaucuacuuaucuaucgaucuuauguaaauuguguuuauaaaggugcaucuguguucuguaaauauuauacugguuuacauacuguuuuugaaaaugucugaaauaggagaauucaagcuaacuaaugucugauuuauuaaaguuaugggcauuaaaugccuagaaaaauugugacauuugugagaaauguauauauuaaauuuauaaucauaguuaaaauguccaaggaaauuuggcuacauaaacauaacgguuaggauuugauuuaugcaucaugugaacauuaaucaaggaacaaaugaguuuguucuuuuuuuaugcaaauauuagauuuauaaauaaaauuugucagauaaauuuaaacauuuagaaaaguaaauuuagacacucuuuuacauguauaaaagguuucccucguaacuaaaaauuaacuggaauuuggugaagccuuucaucucacggauucccaacuccacagucaagauagaaaagcgagagaacccuaaagagugaaaggccaugugggccaugccugcagaccucuaaaccaaagaaaguuuccaaagccuucucuggcaaauguccacugauuccaaaagaaccagaacuuccuggcagggagggggagagggaagaggagaagggcagcccucuggagcacacauaacacaaauggucugggaugggacagggcuuccaaagcugaggugagcucacugacaagggguaucugccaaugccauauaugcauggcuaccugaccugaacaucuaggacaccucaaaaucuaggaggcaagagggauccaacaauguuucccgggaucccacaguagagaacguuucugggaacaacucuguucuaguuucucaaacccacuuggauauuuucuuuugccucuggaauacccagaucucuccuacaccuaugcuugccaagcgagggcuugugcggggcucaacacugaaacggguuuuacaccauguccuacuggaucuguguuuucccuuagagcaggcacagcgucuucuaccucagcugcacuaagccacaaagagcagaacuucuaaggcaauaagcaauggaacaaggggacuaaccugcaaucaggaccuaccucugucaccguguauuuugaggagcuuuugugcgacuuggcaaguaacacgucugugaaaugagugugaacuuacucuggagcaggguuuguuacagaaagccacugaaauaacacugaaaaaauacacucagaaaacacaagcauaaauguagggaacuaggcuauuauaaagucuaaaagaugcugggacuaccuuauagcaagugggaaugauaaauggacccagcaaaaucucacaaguacagguucucaucuaaucugacaaguaggcaugaaguucugaggacacaucuucuaacuccaaauuucaagaccagaaaagguuaguauaaacuagaugggaaggaaaaagaaaaaaaaaguucuacauacuaaaguuaauauucuaaaaaauuggacuuuuccuacuauaugucaggcauuuaguuuauuugcuccuuucaaauuaguaggggaaaaaaacuggggcuggaaaauuuaagcaaacugccuuuaugugagaaaaaaacauuggcugcaagaaccucaguuugcauugcacagcccucaaaacuaaaggccauaacuacucacccccagaaucuugaagaguauuguuuucaugcuucuuucacauuucaaccaaagcugaaaaauguagccaguccucauggaaauuucagugauggacuccugcuaucaaauuucuaaaugguccuguuucucuucucaugcccaguggugaauguuaagugagaacucaaguguccaccguaccauucuccucccucaaagugagcucaaaguucagaggaaaggaagcagucaucacucuacuguaaacaggugcaugcuagaggaucccagguuuuggcagaggcuaacagagacccuggaaucuuuaugcucauugaguacuuucaggugggcaacuuucaugcccaucaaaauaguggaaggcaaaaaaauucaucagaagugugucccaauuucauagacugacagauggagguguguaauaauacaccuuuuauuacuucccuugacagcuacagauugcauguggaguuuaacugggcugauacacacauuuugcaggugcauuguugagaaagaauuuuuugcacauuuuuucuggcuagcacagaaauaaaguaccuagguagggaaagacauuuccugauaguucaaagagcguuucuccuuacugcuccaaaugcucucuccagucacauaacgcuaacguaagcauuuuuaacgccugccaaaauucucaaacauggauaggccagccugcauuaaaggauucucaucuguuggguuuaugaaaugauuuguaaucaucaacucuauaaauaugggaauguaacuuucuuuacuaaagcaucaggcuccauaagggacucuauuugugucauacauagauaaauagcuugggaugauuaaacuugauauccuaaauuugauuuucauaggaaacugaaauugcacuguacccuuaaagcaguucuaguuaaccaguaccugaggcuuagagaacuaguucuucaguagccaguaacauuggggucacacuacauuugaugaauaauuugaugaauaauucuucccaguggcacucacaucugauaugcacauuguguggauuagagaguuuuuggacaaacagaagaaaaacaucauuuucuaccaccaguugcucaugcuacagguauaucaccuaaugaaaacaagauuucucugaggaaugugaaauguaguuaguguuuucaccauauaauuauucugccacgaucuucaagauacugagacagaaacaaaccugauuacauuuuuuuuuuacguccugaugaaacuuuccauuaggguacugagcaggguacccaucucccagacaacaguucugauguagaugaauuaucaaaaguggaagugggaugaucuuagcaauuaaauccaugacuuaaauaaugguguguggggcugggcaccguggcucaugccuguaaucccagcacuuugggaggcugaggcagaagauuaaguugagcccgggaguucaagaccagccugggcaacauggugagaccccaucucuacaaaaauaucuugggacuucucagccuccauaaucacagagccaauuccuuaucaucucuuucuacaaguguaucuccuauugguuccgcuucucuggagaacccugccuaauacaauauuauaaggggaaaaaaacuuccccuauagagucagcaauagugagcugaggaagccucauucaucaccaaaguaagagagggaagaggcuacagcagcuaacaacggugacacuguuagaaaguauauggaacuugaaacacaacacgauugaauuauuccuacuaggagccuggaacggggaaccaagaaggcaagagauuaggauauugcaguggggagcacaaaaggaggaaagaucagacaaaauagagaagaccugcacaaagaugaauucaguuuuuguuuuguuuuuuuccugaagaaguuauuaggccaauggcaguggcucacaacuguaaucccagcacuuugggaugccgaggcgggaggaucacuugagcccaagaguuugagaccagcccgggcaacgcaguucgacaccaucucuacaaaaaaauuaaaaaaaaaaaaaaauuagccaggcaugguggcacagggcuguggucccagcuacucaagaggcugaggcgagaggaucaccggagcccaggagcacaaggcugcagugagcugugaucacaccacugcccuccagccuaggcgacaaaaugaggcccugucucaaaaaagaaaaaagaaaaaaaagacauuacuauucacccacauuuagauagaugcguccuuuccaaucuaugugaauucaugccacuccaugguaccugccccccuccagggcaacaguuguggccacaugggcauaugcaacugcuguuaagccucaaauccuuaucaaaaaugcuaagugacagcuaaccaagcuguaaagaguuuugcuuuuucauucucauugauuuaaauggcaugcgcuccagaaaacucuucugcggguuagcuucuguguucuucucacaacacucaaguguacuuaaaaucauauuuguucugguucacagaggaaggaaauggagggugucaaaggaaagacuugcaggauuucaaacauuacaggaucacagacauucuuuuccaauguaaagacauuccaggaaagccucaaacuggcaugguguguauaggcuuaugauguaaaagagaauuuaggguucauuaauuccuaucauggcuaaagaccucacuguuuuaccuguuuaacugugcucagguuuugaaauuagugcucagaagucuuucaucccaccaccacaguguuccucaccaaaaggucuucugucuuuugccagcucaauauucacagucuucacaagagaaggcuaauucugaaacaacuauguagccugcacagggcuggugaaaguccaggggccucauucuaccaauggcuuuucaugccucucuugcuccugcauaucccuucuccuauugcuuuaaauguccuuucuuccccaggguuaagaguggaaguucuagagacggauuacauguaaucaaauacuguuucugaaacuucuuaauuaugugugaccuugagacaauuauucaccauguugugccucaguuuccucaacagcaaaaugugaaaaauuauagugccuaguguguaggguuaugaggaugaacugaguucaugguuccaguucuuggagcagugccuggaacaugguaaaugucaguaaguguuacuuauucuuccagccccaacaggugguagauugcuuguaguucaaguauagaaccacauggguucuagacauggguccacgguagagaaagcauccauuuacccgccuaccucccaccaagacugagcaaggauuacaucuucuuucucuuuauguuuccagcaccuagugugguaaguaagugacacacagcagguauucagugaaugcagauugagugcuugaagggaugacuaauucuaacaaggggaguaugucaccuaagggaugcuguuuaugaauaacaguggcaaugcaguaaagggaaacuccagcuagaacccugguaagaaacacaauucacuguucugggauuuuuaaauaacuuacauucauuugcuuuaaaaucuuucaaauaaggucacuuuuguuuauauacuugccauucuuaccagcauagagagagguaaguauaacaaaacuaacugaaucaauguuucuucaacaccuggagaccaaaauccuagaaacugucuuuagcaauuucaaaagguuacauuuaauuuucaagugcacauaauacacaauuaugacuauuaaaaagucgcugaaaauaucuuuccaaauacaaacaaaagcaaagcaucaacagagacccagaaugaggcagaagugaugacuacauuauuaagggucagcuccccaaacucacacaccccccgaaaggagaagggauaacaggaucagcaccagacuaacucacucuccucucagucacgagauuugauuucggugucaaaaaaaacccucuguggaaagugcucuucuugugaaaacacccuucuaaaaagcaagcccugaaacaaagucagucauuacccuggcacacguucacuaguuccucagaaugagccccaagguguuugcugaggggacagaggaaggaggagauggagacagaccaacaagacagccagacacacacacacgcgcacgcacacacacacacagaguucuagucuccgccacaguaacgaaacuacuuaaaugccacagccuuucuucugugugacuuuuguuacucccauguggaauauccaaagauuuaaauacacugucgagucagauuaaucaaagccacauucucuaguuaagcauaaagaaaagaaagucauaaaagaauucaaauuuguucacaucuuguaacaggaaagaauagguggauucauaucugcuaugguuugaauaggucccauccaaaauucagguguugccaaugugauaguauuaacagguggaccuuuaagaggugauuaggucgugagggcugcucccuuauuucuuggccaaauaacguuuggccaaaaaaagaaugugggaagaucagucuaaguucaccuggauauuauuuagaaugauaaagucuaugaaccaagugaaugagcuacucaaaaagccaaaagaaaaauucugaagggcucaguuacuuugguuuuuuuuuuuaaauuacucuggguagcaggcacucaaggaagccuacuuaccacgauauccucaggaaaugugucucugcuaaaggagccaucaucaaacaugaccucauagaaggucugcgaugucacagccaucacucugcaacuguaauaccggguguuccgaugcuucgugaugaccguuugacccacggaaaugaccuucucgcaagccuuggacuucuaaaagaagggacacaaaaaaggaagaaaagaaguaagagaacaggaaaagaaaggacguaaaauaaaaaauauucauuugaaaaacaaucauuuauuuggccaagauuuaaaaaaaaaauuuuuaacuuaauauugaagaauaauuucaaacuuacagaaaaguugcaagaagacaaauaguauaaacacuacuuguuuauacuaacacucuuuacccagguucauccauugguuuuguguguguaugcauauacaaagagagagagaaaacaauauguauguauauauauacacacguguauguguauaugcaaauauaucaacuucaggacacugaacacugauaggauacuuuaaucuccaucuauacuccaguuggucaaaugauccaauaauggccauuaugguauucaccuucccuacccucaaacucccaagcacagaauccagucuagagucaaguauugcauuuaguugccacaccucuuuaggcuucuuuaaucaggaccauuuccucugucuuuguuuaugguagugcuacuuuggaaggauacaauucuuccucuuccugcuuuuuaauaaagcaugugucuuaaguuuccucaugauuagauucagguuauacauuuuuggccagaaucccaaauaggugauguucucuuguucucaggauauucugaaggcacaugauguuugcuuaccccucaaugauaauguuaauuuugauccugaucaaaguauaguucaauuucuccacuuaauuacuauuuuucuauuauacuaaagcaaucugugaaagacaauuucaucaguauguaaauguccuguuccucuuaaaucucuguuuggaauuaguguccguugaguuuugugcauaaucuuuacugcaauggugguguaugcugauuuuuccugcucuaucacccauccacauuuauuacuuaguugacauuugguaagcaggagucuuccauauuucccugcacccauccauccauccaaccauccauccaucaauccauccauccaucuuuccuucuauccacccauugucauuaugggcugaugaauuccuccuccccaguuguuuauaguucauacuuuacuuuauuauuuugguguucaaacugucccagauuugaccaauaagagccccuucguacugguucuugugaucuuucuuucuuucuuuuucuuuucuuuuuuuuuuaacagcaguucuuuacuaucuugucugauaagauguuucaggaucaucuugcaccaguccugaaauuagccauuccaggaguaugguucaguuuagaggggcagugacauuagaaacucagauacaggugcuuagguaugcucuuauuagaggaguaucuuugauucucaaccuuuccaguagauggaacaaugaaauacaugcauuuaacaugugcacauauaugugcauaaauacacacaugcguauaucaauuugccacaaacacacauauauuggaaaucaccaguucagagugauaucccuauucaucccugcagguucuuucuugccucccucuauuccauauuuguaucuucauccuuuuucagugaaaaccuuggcuucuacaauauaaacccauuuacucauuugcucaaucccuaaauacacccaaguaauuuuuaagaccuguagaagagcuguauuaauaguuuuagacuagaaaaacuaacacaaaugacaauucauuuuauuuuuaaauuaagaauuaagacucaaguucaauuaccagcucauacugacaacagcuggguugcaguccuuaccuaagaauaugggcaugaauuguagacuccaucuuuauuucauuuucucccucccccucuucuccuuccacacauauuccuggcauccuaaaaaaccauguguaggccucaggguauauacaucaugcuaaggaaacaagacuuaagaauaaaugacuucucucagaaauacucugcagagugauuggcacauauuaagugcucuagaaauguuaguuuguugucauuuggguuguuuguuuugauuuucaagauaaggcuauaguccccguuccccuuucaggaacuccuacaaagccuguaccuacuaggaagagacugcagccaacaucuaaugccaaagucugcucucaagacuggaucuucuuuauaccagccucaaaagcucagguaucaacucugauuuguuugaugucaugagcucugaccugcugggaaggcccugaaccaagcucaugggaagguccaggccuucauaauccccaagggaccaaaauuagccugacaugucaucuguaccuacagaaagcagggacucauuaaaccccagucuuuucuugcauggauauuuagaacacuccugggaaauacaguuuaucaucauccagaaucacuagucaaucagaggcuuugcuuuuguuucccccgugaauuucaaaaaagcuaaaacaccuuguaguguacagaguguuaugcuuaucuuuuucuucuagaaaccaaacaaagacauucccagagagucauucauucacuaauuuccucaacagucauuuguagcuagccagugggcaccacaucugauguuggagagucaaauacacaaaaccacuaaggcuauauuacuguuuccuggaacaggccuacacagguaugugccaugaagccaucucacagguggcgugagagaagacugauggaacacauucuagcaugccaucuacagcaggacuccucauuccugggcuugcagcagucagaauuaggggaagaacacaaucaaggacagacagagugacaggcaugaccaaaggcccagaagcaggaaacagccauucuguuguggggaaugcaagaggucuugcuauggugugcaaaguaggagaaacuagagaaauggcccggggagcaggggucagggcacugggggugggggagaacaguucuuaugccauccuagggaaucuaaauguuauucugugaaccuaggaagccacugagggguuuagauguagaagacaggugauccaggucuguauggccauagacaaggggcugguggagcuuagugcgacaguauagugggagaugagggucugaagaaaggaacugcggacaagaaugcucaugauuuggacaaaggggaaagcccccucccagcaaacaucuucguaagggucucuaaccaucucugucaucuagugucccacacaccugacagaacaaaaggauauuucccuucuuuccuuccugaaaucauuccccagugauuacuggguugcuugggaaaauuuucuguaccuuuaggugucgguagguauguaaacauuugacaaagcacaacaguaagaagcccgauuuaauugcacuauacuugaaguagaaaucuuuaacagcuaggugacaguauauaacauauacugaaauaauuacgcaguuuacgacuuuacccccauucauccccuuuaaauauauccaaccuuuuaaaguaagagagugacuuggauguaguaauuaauaugaguggaggcacagcaugcagacugauguugacuccaagauugggccugugacagcuacuucuuacagguuacaacuaacucuaggaggccacauucacaaccuguguggccacagacaguggcccugagugauguggauuagggacacacacagcuucaucuuggcagaacuuucuugcagauguugcccucucugucaaacugaaaaacagucauugucagcauuacaagcauuguauuuuauuaugauauuaguuauuuaguguauauuuuguuaaaauuggaaguugaauaaaaauuguuugcccuccaaggggacaauguguggggauuugcauuauaagcugauuacucuuacuagcuggaugaucuuggggguguuacauaacccucgucagccucaguuuggucaucuguggaagaaauuacaccuaaaucaaaggggugcuaugaaacaggaugaagcacaaaggaggcccagccucauugggagcagacucucagcaaauccuaaccggcuucaucuaggaaaugaagaacauacugagaccuucagcucaggugagucaaccacuuuccuaugguaucugagucauuggcauggaugagugggcagcacccugacuucucacugacaaggaucaguccagccccaaaucacugccaggaaaacaauccaggcacccacccuucaccucacccgcuccaguagccuccgacucuacucuugucaaauucaggcacauggcuauuguccccaggaaggaaggcauaauguggucuccucuccauccccagggcucccaaagccuuuguuaacaacucucuuaagacccuggccacaugacucuuucaguuaccaucccuuuaaugacaggguaaacucuacgaaucagugccagaacuugucuuuuuauccacagaacccagcacggugucuguaacacuguuccugacagaugaacagugaaugaaugaauggauggauaaaugaguggguaagugaauaggcacagacaaacuuucaaaauggaagaggaaugaauucuaucugcuccuguccagaaaagggcaaagagaagcaaaggggcacuguagagugauaucccuauuuaucccuacagguucuguuucuuugguuucucuuucuuuggcuaggugugcauguauguggguagcggaagggaauaaagaagguuuauggugaaacucacagggucuggaaaguagaagaggcuagccaagggaaaaggaaggugaugcaggcuuuauaaggaagaggcuggcuccagaucacaaccauuuucuuccugcuuaggauaugaaauuuaugcagauuggcugguuagaaaaauggccaguauauaaauuaaauacacaaccuucaucuaaauaaaaauucucagaaacuucaggcaugaccauuucaugaggaguauuaagggaaauggauucuuucauaaugcuauuuugauaggauuucugauuuauuuuugcaggaaaaauguauugacaagcauaccccauaacugauuacauauccucaaaaauauuuccugucagaaaagucuaagaaucuauugauguuaagaaugucauuucugaucagagaagacaggcaucaugcgagggcauccaucagauuaaagaaauggcuaugguguucugaagauuaguguguaagcuaaggcuguaaaacuugaauuuucuuuaauaugaacuaagcagaaaugaaccaacaguggcuuaaaaaaauauacacgucauuuuaaaaaaugguagggccaguuagagaugcuggggacauggccaaaauguuaaguaaaaaaacguuacagacauuccauaaaagcauaaauaauuccuaggaacgauaacacaucuaguuuccagcauauguccauauucaugagguaauuaaauucucccaauaauuuugugagguaguuuuuauuuugacuaaauagaugauguaacaucuacugauacucuugacaaagucaagugacuuuuccaagaucucagaacaguuuagaaguagucuagagcagugcucucccaugacaggugauaugguuuggcucuguguccccacccaaagcucauguugaauuggaauccccaauauuggagguggggccuggugggaggugacuggaucacgggggugguuucuaaugguuuagcaccaucucccuagugcugucuugugauagaguucucacaggaucuggcuguuuaagagagagagagagagagaguguguguguguguguguguguguguggcaucucccacugcuaucucuuccuccugcucagaccauauaagaugagcugcuuccccuuugccuucugccaugauuguagguuuucugaggccuccccauccaugcuuccuauacagccugcagaaccauaagucaauuaaaccucuucucuuuauaaauuacccagucucagguaguucuucauagcaaugcgaaaauagacuaacacaacauaggugcuccagaccaucaaccaaaagaauaaacauggaaagaaaaggaaauaaaaccaaccagaaaauaagcaugggaaaaaaugagugaagaaauaaaaccaaccaggaaguaaacauagaaaaacaugagcaaggaaauaaagccaaccaggaaguaacaccaauagaauucaagcaguggccuaaagaaauuacauuuccuuuuuuuuuuuuaagccuuccauugauugaauggaagguauuguucuagauacuuguugaggcacuucccauuuaagauuuacuuacuuuccccaauauauccacaggguuggauuaguaacuuggauuuggagcaugucuggugauaaaaaugcagaauguauaugcucucacuuuucaucuacguacacauauguaaacacacguguacacugugguaaauuuccaaacugcccaaaaaucuucacuccuccccguuuccacauccugugcauacgacuuuguagauccuccuaucaaggacugaaguuuauuucccacccuuugaaucuggccuagacuguggcuuagcuugcacuggccaaaagaauauagcagaaguaaugguacacagauucauaguccuucguucaagagggcuugaacacuucugcuuucucucuaagaaccucagacucuggggugugaacaagcccaaguuacccuguuggagaugagagaucacacugaccacaggccauaaaccugugagagaacccagccaagaucagacaagcuauucugcagcugaccacagaugcaugaggcagcauagcuuagaccagaagaaccccucagccaagccuagccuaaauugauaacccacagaaucaugagcuaaauaguuaucacugguuuaaaccgcuaaaucuugugaugaugugucacucacacagauauguaugccuagaaaaaaggaacacugagaaaauacauacuaaaauguuagugauguauaacucuggguaaugggauuuauuuaguacuucuuuauguguuucucuguauuuuucauggauuauauauuuaauaauuucugaaauacuacauauaaaaaacuaagaguccuuccaauuuuuaaaaauuccuuaaauaucagccagcccauguauagucagaacuauucaacugauaugcugaaaacaaaaaugaaaaacagcugaccaagugaguuaggaagaaaacaccaucuccaacauuuauucuucaguucaguaaauaugauguaagaaagacuugagagaacgaacacuuuguaaagugaaaugauaaaaauuuggucauaaaauuucaucugacuuaccuacaucucauauuuaaggcaaaugugauauaagaaaaaaauugcacuuuuacuguuuuuaauaaucaccacugauuccaaagacauguuguuucaaucaaauaaauaauuucauucucagguuuggggcuguauuaagaaaaaaacuaaucaggucuuuuuggaauucauuacuauuccuguccuucccaucauacuaagccaccucuaagggacagcacuaauaauaagauccaauuguucaaauguagaagaguuuucucuccacugauaccaugcugccuucaaucaagugugaacuuggaaauuauacaggcccuuauaagaaaacucucuagcuuuccuaagacuaccaauguugaaauaaauagccaaauuucaaacaaaagacagcuaacuaccaaugauuacaaccugaagaaggaggaaaguauguuccuaauaccuggacugcuucaucaaaggcacaacaacauccaaaaggcugacuuaaaaaaauuuaaaguuagcauugagaaaauccaaugaaaaaaaaaaaucaucauuccuugccugaugagcauucuacagcagugaacucugagccaaaaugccaagaacaaccugucaaucaaugccacgaggaagagcaauacuagaaugggaugggguuuaaaaaaaguggcauuuaauuacuaauggcucacuaaaaauaaggcacauuccuaggugcuaagaauaaaaauaaaauaaugagagagucccuucucucaaauagcucacauacuaguaagagagacagacauggcugaucauaaugcaagguauuaagagagcucagaucagggaaggaagaggcccuccagaaaagaaaaugcagguaaacaucugaaccaggagggaggcugccaggaaguacacaugccccaggaaggcuguuggaguaugugccagggaccucucuggcuacuuugugaagcccuacucagaacuauguuuucaaaugcauaaaauaaacacagaagauuacaaacaaauaauuauauuagaaaaauaaacuuguuuuucuuucuuuuuuuuuuucuuuuuccuuuuugguucccugaccggaaaggaaaaacaaauaugcuuuuaaaauaaugcauuaaauacuaauaucuaaagguaggucuaacaacuauuaauauccugauuacaaaguuguugaugagcauaaauaauauuuuuuaaauuucuguuaaaaugguaauaugauuuccauuguagacaguuacaaaaacuguuaaugcagucucugccuaugcucaagauugacagaacuguuaaauuugugcuagaauuaaugaaagaaaauaguaucuuuucccauuuucuaagacacaaauuuuucuucauaauuauuaaaaagauuuuaucaccugggauauuuaaugacgcagcagccaaucuuuuaacaguagacuugggaaaauggcaacaaugcuauuuauauaauggugcuuguauauacugucacuaaaaagacacaguaaugaaaugaaacucaaugaaggcaccuuauaaaggguuaaguuauggaagcuaaaauagguaauuucuugguggccuaaccugacacgggaaucuaacuuaaauacucaaguggacauaugcacugcauucuuaaauaucauuucuccccacugaguuuuugacagagaccagagagaaaacaguuaaucucuagggcaagagcacagggggaagggcuuuugugagguagaaugagggaagauucuuugcuuuggccguauagguagucucuuaucagaccuggcaaggcugaccuguguuuacaucuggaaggagggucacccaucaucuagcaggaugagucaugggcggagaugucaccuugggaaaauccccaacuggguucucuaucuacauaugauguuaauaaagggcguaaauccaaaugcaauaauguauguagaaacccacagcaccagcaaggcugaacaggugaagaaaccaaaguaaguaacuuagccgacguacaggccaaagagcagguuuccauuuguacgcaaugacccuuucaccaucucaacuuuguuauuuauccuuaauuucuaugaauuaauaaccugugaaauauuauuauuguauuuuuucaaaguauccaucugauaaaaauuucuacaaggauugcaauaaauaaaucaauacaaacuauucuucguuuaccaaagguaugcagcaggaaccacucaucuaaacuugccuugucauagugaaagcuuucuuuguaaauuacaagagcuagguaaaaauccucugcccagaaaaaccuaaaucccuggggcuucaugaagaaauacuuguucuuacagcacaaauacacauaugacucaucaaaacgucacaaguauuuaauuuuccacauguguguauguucacguguacuuuuauuucucauggguuuuuaauuacaaacauauaauacagugggaaauggugguaagcaguuucccagcagauuuaaggucuuauucacuuuaaugucuguagaagcacaaacaacaggcugcauuagaugcugagaaaaaacuaauuuuuuuccaucugaaucaugagcucaccucggagguaguggcccuguuugguaagugaagagaacugggaagagagaaccaucuuuagcuauagcagaaucuuugccucacuguguuaauguguaaaccucucaacaggaacauaccaccugcuugcuacguauucuaaagaguaagcaauuuaauucauaaagaacagagaugagaguucacauuaguuagacagguggagcugguagugggccacugcuaagcuaaaaccuggcaugagcuucgccuacagucacauccaauuucauuacuguugcuagagaaucagugaguucccagaugcuagacccuagaagcucugccuugggcuuuuuuauuucaggaguucuucaggcuucuugggugccaacaauauaauuuaggaagagcaauauauucccacaaucucaaucauuaacagcaguguguguguguguguguguguguguguguguguguguguguagaaauuaacaagaugauucuaaaauguauacaaaaaugugaagaaccgaaaauacucaaagcaauguugaaaauaaaauaacaaaguuggaggaauuacaauuuggagagaauaaaaugagaaggaaagcauuuacucaacaauaagguaauauuuccuuuaaaugacgucugaugggacacuuucaaaugagagaagcaagcgacacaggguaucacucagugguaacuccugccuauaacgauuucugacucucaauuacaguuggugaauggguuaaacacacuaaaacagaugcaaauauuuuguuauugaacaagguaacccaaagcaaaacagacuaauuaaauaguuuaacagauuuucuguaccaccaagaaggaaguccagguaaaucuuaauaccauguaaacaaauccaagucauagucucaaauuagaaaaaugacuacuaaaacagcacaauccaaaugaaaugccaugugcucugauucugacaaccugaauguucuauaacuuuugaagacuguugaaccucucugaaauucaauuucauaaccugucacauggguauaaucauaauauguaccacacacaaguuuacuaugaacaucaaaugacauaauguacuacguguaacuauaaaagacacuauacaaauguuaguuauuauuauacuuuuguaacucuuaucuacauugauacacuguccccaacaaagauggguggucauuuugagcgggagacaaaauuagagaggaagagguaacugugccuauaaagacacacugcuuacaugaggagagaaugacagagaaagagaaaacacaaacuuccuagguuucucuggacuucaggagaagcaacuaaagguacggugaaagggaagucagccaaaagcuuucuaauguccaucacauccacggcaggagugcagauucugccuaccucgccaauguuacucaaaagggauaaauccacaaacuguuuaaaguccaguauuaaucagcaaacuaaauccaucugucagauugucuaguguuaacugaguggacccacguacccagcacugugcaugaaagagagguauguuaugggguucacgugggggcaggaugggaaagaacuggggugcucuaaugguaacugcauccuuccuaguuuccugccuguggcccuccuguucuugaucaccuaagguccauauaaccucaauuaaaguuacuuucucagauacaguaaggacacugcucuguucuccaaauauguaauaaacaugacauuuuuaagguauaauuaaaaguuguugaauuuaaggauuuccaaauuuugcauuuucuucuaauuccugagaaauguauggggaaaggugaacaaacuuaacuaaaaggcccacucgagggacaaacaaaauggaaaauaacucauuaagguaucugaugcuugcaaagaagaaaguuucacuucuccaugucuccugcuccaagcaaaagcguccgagugccaggucugcccaggaauggcuaagagagccaaaaugauauuucagaacaucauuucagaagaaacaggaauuucuuacguuucuucagacauuauaauuucagugacccacuacaccaguguaggaugagaagacaagaaaggacaugugacacuucaagaugaaaagaugccaacuucugacuggcaauggugaagaaacuacccauuuucccuggaaagaaaagacguauugacuuguaugugagaaaugugcagagcccaggaugcuccaauauuccauggaaggacaugacaaagaagauaaggcauuccucuggaaucacuggcuuccugccaagaggcuucaggaggccuuuugagcuaauccagacuuuuguguaucauauuuguugaaaguggacauacaaucaaggcuuggagaguagccuuuuaguuagaaauauuggaaguuauuucauuuaauugccuuuucuauugcuugcaguuaauagucuuaaaaauauacuuucauuacauuuugucaguaucuaagguuuucauuacggcuauggcaucuaauuacuguuuucuacaugaaggaauugaauauccuaccucuuauguguuacaagauguuggaaugucaaauacccuuugcuguugugugucuguugacacauuccauuuauauuuuucuacuguaucuaugaugcuugacucuaauaccaauauuaaaauaugagauuagugucacuacuuaauuuucuuaacaagcuaucagacgauucugcgugccuuaauuauuuuuuuaaaaaaguacaaauuguugaaaagcuuaaaauuuccugggaacggagaaauauuaauucugugcaaaaagcaagcaagcauuuugcaugaaaauacaccuuaucuacgaaaaaaauaaauaaauaaccaaauaaaugguccuuggaauggaagaguugauuuuccucaguaaguuggcccuugaaguugucaaguaucaagugucccauguaaauuauuucuuuuugucuguuuguuuuguuuuuuugagauggaggucuugcucugucacccaggcuguauugcagugcaguggcgcaaucuuggcucacugcaaucuuuaccuccugggcucaagugauccuauagccucagccucccaaguagcugggaccauaggcgcacaccaccacgaccagcuaauuuuaguauuuuugguagagauggguuuuuguuguguugcccaggcugauaucgccucggccucccaaagugcugggacuacaggugggagccacugcaccuagccccauguaaguauuucugaaugcaggugcccccaccguggggucuaggucugcuaaggggcucccugguuccacggugcacucugugguggaaaugacagagccaagcauaaaacagagcacugacaaguuucaccuaagcauucugaugggucugcuuuugugauaaaaaccaaacaccuacaccaaaaugccuuugucuugaauuuuuuaaaaaucagggucaauuugcaguuuuauaaggacagaauaaaaaauuuagguaaauauuucuccugaaaccacauuauuccacacagaacuaaaaccguauuuugagagagaugaaagcuauuaaguuuuacuaaugaaaaugcgaauacauugcugugauuauucauaacuaaauaggugcuaauucccuucauucuaauuaaguuuaaaauguuaucaauuguuauuaauuucucaauguacccauauacauaucagaacagauaaaauuuuguguuuuugucccugagggugacuagacucaggaacaugaauuccuagcugacaggcacaaugucagcuauuuccagaauaaagccgaguaguauagcugcagagagauuuuacaggugcuucccaaacuacaagauguuaacuaccaugaaccaggccuaaaggaucucuccccagaaaacagaauaaggaguaguaugguagcagccccucuccucugaauauguuuuacaucaaauaauaugaaauugcugguauuaaaccaguuuuaaccuauaaaacagcaauuucauauguucauccugggauguaccauuuggccucacaucaguauuuuuaucagggcuuuaagauauggguaagucucucaacgggacuucagcaugguucuaaguggcaagcaguaaagaagcagagcaggaaccugaaugcaggacugccuggagucaagauuguuuugaauacaccacacuccuagaugcuggcaacuccugaugcucuccagcacgagccuucaugaauccagaauucugagaaguaccaguccucugaagcucauuucccagacuuugaagauugaucaacauaauaggagcucaucaaaugcucgagaaauuauuuuucauuagcacgaagaauagccuagaguucaaccauuuuuagaguaaucuuuccaagaucacguuaaacucucuugccuucuuucguagaguaugcugaggcuguugugagcaugggaguuugcaguggcucuccucaagcccuugcucuaucaacagaaagcacagggagagaagcaugaugcucacugacccagcccuuccuauggaaauggcaaaagaucagcagugggaaaacaaauuaggggguucugaauaggguucaaaaauguuuaaugggauauauuuaaauuuccuagcaaaauuaagaaaaauuuuaucuucucuggcuuuaccugauaaugugaauaagagaaagauagguucugaaugucaauauucuaaaaggucugugcuaaauauuccuccuuccaggcaaaucuaaccuucacuuucuaucaucugggauaaguggagagagagcucaacaaaacccuucuauugauagaaaggugagggauuucuuuuaaaaaauguguguuagauuuaggaauaucgaucagauucagguuugaaucgcuauaguauuuuuuuaaauccuugcuaagaauucucauuacuccaucccuuugcuuuggucagaaaucucucuuugucaauaauaacacugcaaauucagcaggccauuuguuaaaaagcuuauguagaagaaacaaaucauauacaaaaacaagaugauuauguagaagucuaaggaaaaaaaaagaguauagcuggucaaaacaaacuuuguuaaacagaauuuuaguuugcaauauccaaauuguuaaaggaaaaacaauucuaucaucggcaaaacauaaagacacccaggaucuuagagacacuaugaggauuuguggaaaugacaccauucagaucacugugagauaaguguuagcuaaauucugguucacuuuaugaaaaggagaaagcagaaacuaaaggaagacaguaucaagccauggaagugagcuccagacgaagugagggaaaauaaaaaggaaacugaaaggauagauucaacccauagcuacauaugauguaucagcccugugggggccagggcaagcucacuggcauuagaugggcacacugaaagugacaguaggcaaaauucuuccucauaaucaguucuaaauuaacuaguugucccuuggggucuucucucucccuuccccacuacaucugauuuaccaaggccuauaauuccaccuccaaaguguccucauaaucaagacccuucuccucauccugggacauggccaugguggaaauccaggucucuguuucuucucacccucucuggagcaucagcuuccugucucuaaucaaucccuucuacucucuaauccacucccacuuggccucaagauugagcuuccuaauacugccccacacauaaaccucgcaugggaccauccacuguagaauaaagcagaacuccccuaaauuugccugaagcaguggcaaaggaguucaaggaaucccccggggaacauggaugaaggaaagucgcaagaguaaugccuaaaugagaaacucuucuuucuuuuuaaucuucccuacuuugaggaacucuugaaacaagauaaauaauagccucuccugccugaucucagcaugacccacuuugugcaugugggcgcaugugagagacagcuauuggguaacacguuugcaccccaccaaggggugaacugaguaccugugggucuugcucccaggaagccuccccaaaacaaucuucuccucaccaugacccaucuccucuagaaaggauaauccuuccugucccucaccucgucccuaaaaacagauccuuguuuagccaagaacauuucccuaacuugaagaugagagauuuuuaaaauuuuaauucagggauauauaaaaacgggguuucacuuuuuaugaaagacagucuucacauucugaucacccaaucuacuucaccagcuucaacuucccacucaccacuccauccugacucccccguaaaccugacaugucuuagagccaguaacacugaacucuucagccuuccucagauauaccaggccuuugaggaaguuugugcacacacuauucccugugcuuagaacacccuggacucugagucagauugccuggcuuuguauccuggcucuuccaccuacuaccuguauaacuuacagcaaguuauauaaacguaaacucacucuguuuccauuuccucaucuguuaaaaaaaaauaaaaagauaauaauaguacagguugcacaucucucauccaaaaugcuugggagcagaauuauuucagaauuuuucgaauuucagagugucugcauuauacucacugauuuaguuucccaaaucuuaaauugugaauucugaaaugcuuaaaugagcauuuccuuugugugucauguugguacucaaaaaguuucagauuuuggagcauuuuggauuuggaugcucaaccuauaccuaccaugaaugggacacugaagauuaaauaaguuaauaucugaaaagccuuuagaacgcagcuuaucacauuguauuaaauaaauguuucccaccacugucucaucaaaaaaaaaacaaaaauguuugcuugacacacuugugugaaugaggucuggucagcaagaaugaagucggauggagaaguuuaaagaaaaaagguuacguuuacuuccaggaugcuucauggucccuacauauauugaacugaacaguuuuaaggcagucuaaaguucuccauaacuaacuuuugugcuaagccauauuuuugaugaucuggcuaaacaagugcugggauaagaaagggaaagcaagcaguauaguugccauauuaguuaucaguuucucuccaauacugcaagucuuagaaaaguggcuguauuuuccuugguuucaggucgguuuaaaaaucuugggaugaagucaguuucugagauuucuaccccacuuucaucccuucuucaauagguuuaaaauauuuucaaaugcgggaaacugucuucaaaggaacuguaaacuuugcucuuaaagaaagagaccagaaaagcagaggcccccuguggaagaguaugugcaccauaaucaggcuguggauccaagcgcguagaggaugaggaggugguaggcccaacccauaccucauucccacccacuaaaccauacaaaccuaggaagaguuaagagaauuuuagaaaaacagguccaaaucuuuaggcaucacuuaggaaaggagaaauugcauuaauaagcccucaaguuagaacaauauaaaaauaaauuuauuaaagccaggagaauuggauauaucaacaugaacccugaaccauuugaaaaaaaaugcuauuuaucugcucugucacuaaaguggcucuaguccuaaauuagccagcacucaaaugaaacaaaacaugguaaugugcaccuuucauggcaaauuuggucucuaguagagcucccauaaaaaagaaccagggcucuuugaugaaucacugauucccaguuugguacaauagaaaccaagauaacuuuggcauuucccacugcgaaaaaaacaaagauaguuucaaagaugucuagaaguguggauuaguccauucucaugcugcuauaaagaaccgccugagacuagguaauuuacaaaggaaagagguuuaauugccucauaguuccacauggcuggggaggccucaggcagaaggcaccuccucacaggacagcaggagagagaaugagugcugagugaaggggaaagcccuuuauaaagccaucagaucuugugagacaaacugccaccaugauccaauuaccucuaccuggacugcccuugacacauggggguuauaauucaagaugagauuuuggguggggacacagccaaaccauuuaaaagugguuuaaaauuagaaauaaagcagucaccuagaagaggcuccaaaagguccaaggggagcaagaacaucaagaagaaaauuuuggucaacugguacgcaaugggcucauaaaaagcuacaaaccaugaugauguuuaaaagagucaaguaacauaaaguaagcuaagcgaaguccuacccacugauauaaauuagcugaaugcugcuuaauuacaaaaacacaaucaucugaccacccgucuuacauccaaggggcacaacaauauagugaaaugcguauaugcugaaauguaauucuggccuuccaaauaaaaauccuguuggaacgaauuggauugaaauguauaaaccagaaucagggguaggcucuggaggaaacaggcuuucuaaaaauucuagaaaguuggagagagauauuguucagguccccaucugggaacagaacuacuuuuuuccccuaguugauuauauaguacuguugaccuugauuuugguuuaagaacuagggcaucuucauguuuauaaaaauuuuauuaaaaugagaagcauggauaaucaguuuuccugaaugagacccaaguauaaaauccugugguacagcaaaaauauaucuuuaguuucagaucuggcaacagccuacacacauaccacugcauaugcccauuagggaaacaggacccagggggaaguuuuguuaugauaggcugcauucacuucuacccuauuuaccaaauccacuucuacuacaauucugcauccuuggcuaauuaaaagagaauguuacagugggagugaauguuuuggagucucucccugucaauccauaaucaaccugaaauacugccugcccuuuuacaauuaauaaauucacauaaaaguguacugauucuuauuuuuuucauuaaguauuuucucaauaacagacacuaaaagaauaauaugcuauacaauacaauacaggauaagaacuacuauucuaggguauagaauuugggagccucaaacauccaucuuuccacauuguugaggccuagaauguuucacuguuguuagcaaugagagguagcccauuccaucaucaccccaagauuaguuauauagucauagguuaacccacagagcccuugcuuugagcccuucaccagauucuguguauugugguguccucuccuguccuaagcccaugccucaugaggacaggaaggaguugcaauaaaacuggccugggagcuggccuaaagacccagaggcuggaaaaagcauucaggcugggcgcaguggcucaugccuguaaucccagcacuuugggaggccaaggcaguuggaucgcucgaguccaaaaguucaagaccagccugggcaacaugguacaacccagucucuauaaauaauacaaaaauuagcaggacaugggggcgcacaccuguagucccagcuacuugggaggcaaaggugggaggaucacuugagcccaggaagcagagguugcagugagucgagaucaugccacugcgcuccagccuggguaacagaguaagacccugucccaaaaaaaaauaaaaaacaaaaaagcauucaguaagugcugagcaaggacucaguuguauuacugagaugagaguuagaagacacauggaagagggccagaugguggaauaacaagauccuagacaaguuucuagaacgggagcugccaaaacagaagccacccuacccacccugcuuuccauuaugcacacaaaaaacacugcucugaauaaggugcauaugugaaauaccuaacacacacuugacauaaaagaugcucaauaaauacaaguucucguucuucuccacuaaucccacucccuagcaucggauaauuauuuuaacaaauuuauaccaagcugcuccuauggauagccaagugcuaguugauagaaauaaaaagacaacaacaacaacaacaacaacaaauacuuucuguccuuaugaccuagcuacaauaauacuaaaggaaaaauacacaaaaucacauaaauuaaccaauacagcguuuucucuauaaaaguucuuccucucuuuuaaauagguaucugucuccauguuaacagccacgacuucuaagguuucuaaagcuaugaauacaacuuaaaugucacacuuuucuagaggaaagaauauuaagaaaaaacacuauguaccucauauaagauguauaaagaggccauguucauugcagugaauuaacaaagugcaagugauucuggugcugcuacacuaaauaugcagauuauucuaaccuaauaugaaaguuuacuaaguaacuugccaggaaaaaacauugcaugccauuuucucaccucuguuauucaggcaucccuuccacagggcaucugucuaguuuacucaagugugagauggcccuguggugcuauauuuugcagaaguauauaguguauagguagcugacuauuuguuugaagaaaaaauacauuuccaagacuuccaguuucauaacuacuauuuauuguguugucuuuuccuuacaaacaucugugcaacauucagauaacuggguuaggaauauauccaaguggaaccuuuggaaauacagccagaaacuagguuauaaugaaucauggcacaggguggugaagcggacagcaugacuacacacaccgacagaugagcacacacucaugugcacacaugaaggagaccuuacaucugaaacacagcagugacauucaacaaagguguucaacaaaaacgcuggcaaacacaugcuaaaaauuuagguugaaauaacagggaucagcuguguacuuccugugacacacuuuuuuccaucuuuaggaaguuuuacccuauuuuuuucaagcacugccuauucuaauuauaaacucugcuuacugcuugauggaauaauguauuaacaaaucagaugaauuuuauacaauuauucaaaauaauuuuacauccaaagcucaacaaacaaugaauaagcucauauauuuaaaauaauuagcugggcacgguggaucacaccuacaacuccggcacuuugggaggcugaggcuaaaggaucucuugagcucaagaguuugagaccagccuguacaacauaaugagaacuauuuuaaaaauauauuaauuacaaaauaauaauuuaugacacuaauggaauaguugaauuuuccuuaaaaugguccuuuuggaugcuuuauagcaaauaauugggagaaauaaaaaaauaagggaaucaaaaacccuaaagugaguaaaaauggagacucuauugaagcaacaguagguuuauacuucauuucaccuaaaucauacaggcauccuccauuauucuguaaaacaacugggccaggcugccaaguuagccugaacuuuauuuuacaguuuucacugcuaugauucggcaauugccuauuacuuucaaauaaucaaugcaugguugagaacacagacaaacuacaguuucugcucuaagaagcauaccucuuagcauugauaguuuacacaaagagaaauauuugauugaaucugaacuuuucuaugcuugauaaggaaagaacauuuaaagcaauaggggcaaaucacaauguucuuaaccaaaguugccagauucuauaaauuccuacugguuaguucccaaacacuuuggggaggaauccguacuuggagucgaauggaagaagaauggauaaguaacagcuacuagaaauauacuugggaaauacagugcuaacagugcuuccaccuagaaaauguagcaaaggcaauuuaagaacacuaaaauuguucccucaucaggaaaagcugccucacgugauguuguaaauuauaugaucuuuuccccagucuuuacaaaguauaccaagcugaaaguggaucuguaggagacaguaguuucuaaaucaccucaaacucaucuauuuucuuuuucaucaucauuuaggaaacacauuaguaaccuaaacuugacugaaccacacaugagaguuaagaggaaugagguccugauuaaacaccuggaucucuuuaauagcaacuucaauauagucaucaguaaccacagggcuuuggaauauuaaaacgguaauguaugaucccaagcaaagcuucagaugaacaccucuagcaccauuugagguuugggguuuggaauucaccaaauaauagaguaugagcuaaaaaggcauuuacauuccagcaccugccacucauuaucugcaucuauuugggcaaggaauuaaaccucucugaacuuagguuucuuauccucgaaacaggaaaaacacuacucacguggcccaguucacauaagauuguagcaccagcagcagcagcagaaguaguaguagcaauacaacuuucauuuuuugagugcuuacucugugcugugaacugaaaacaacauggugaggugggauaccauguuuuauagaugaggaagcugaggcucagaaauaagaacuugcacaggguugcacaaucuguuacuggcagaaucuaagugugaacaccaacuacucugacuucagaggucacgaccuuguucacaucucaaaacgcauucauauacauccucuaaugagguaauccuauugacugcacacuguuaagggcaaggcaccacagucauguaagguguuauuacuagguauuuuuaaaaguugcuaaaauguauuuucuacuggauacauaauacuauucuuagcaaaaggacaucaacucaagaaacuauggaaaaggcaugaaugaauaugcaacuuggaaccugaaacaaugaaaaaauaagacaaauaaaauagaugugacaguuggugacaucauuuuguacauuuaagcauucacucacaucugcccagauccccagcccacaaacaucaaauaucucucaagaugucaauggaaauugcugaaagcauuacaaagagcugggagauuugcugugugugacuccacaagccaaugcugacgacuuggcaggcugcucacaagagguuauuagggacauaggagaagcauguuaggcugcuaauagccuguggccaagucucucagggaaaacaaagugcggcaaguuagcagagcugagcaucuagacaaugcuuuagccuccuauuugguagccagaaacaaucauggugaacuggaaagcuaacaaagacauaucaacuaucucuacgcugucauaauauuucuaagcauuuaaaacacaggaaagauuucauuugacaaggacaggucaacagaaauauggcuaaauucauauuauuugguugcaaacacuuuucccagaaauaagcucaaaaaaauuguucucuauauuucuccucuacuuuucuauuuuuuucuaugagauuauccucacuccuuccagggccccaggcugucccucacauaugccauuuuaggcagcaaagucccaaaagcuccuggccauccuaccucuuccuuuacugugcugcugcucuuuguuucuucuaaaggagauaaaauaacagcccaagaccacaguguacaguuucauagacuguucacuacauaaucucagguggugauccccucgcagaaauggucucacucucauccuggauaugugcagugcacaauguguacaaccaagcucagcagcccuguguacagauccaacaccagaacaggcauggagaguuuucugcaugcaucuguucauucacucauucaacucagacagauuuauugugccuagcgugcaccaggcacuugacagguccuaggcaaauaccaggaaauaacagugcgcaaucccugcccucaaggaacucacggucuagacaugucaacaaugagucauauuacagaauaaagcacauuaugucugggagguagucuaaaacaggagaaaauccagacacggucuuagcacugaggaagggagggcacaucuuaccacguugggguugaccuuaugucgaaagcauguaauguucaccacauaaggccagucaucaggcuccaucaguaccccagcagcaugggcacaagugacauggaaggaggccgggcagcgaccguaggaacacuggaugcaggcuccagagacccucuuaacccggugucugcagaagaugcauuucuggaagguuaaaacagagaagaacaucaauucacauucuguaacccagucaguucccacaauuuacagaacaauagcuacuagagaagaaaaaaaaaaaaaaacaacugauuacaucaacaaguccugaccccuccaggggcccuaguggugacagcaucuguggcaauguaaucuacuuucuuuaaaggaaacacacugcuacggucacagacugccagacauauguuuaacuauuucuuguagcaaggaaagccaaacacuuucgcacauacuccugcaggcacagagcucgggaaaagaccccagaggugcuccuauaaauaauccaugaauguugaagcuacuucuguuuugcccuccugcaugacaggucuuucugugcaucaagaaguagaauauggguuuggaggacaggucauucuuuccuaaauuagauguggucuucaaaaacacccaaacagcauaggggcaaguuaaguuuuccaaagacaaggaaauguaaaguguuaaaugguccaauguggaaacuagcguuuaauaauccaaaucugaacccuucaugacugacaaaaaaaauaugccucccaaagugagaaaauugaaaaucaccccaaagggcauaauuugguugaauaucuauagcugaugaugccuggggaagagaagaugaaaauaaaaacagcaauaaugauuaccacaauucgaaaaguaaauugcauacaauuagcccuaaacauuaucaguacauuuguuaugagagauagagaaaaacaacuucacuaaauguaaguugugaacuaauacuugaggguuaggaaaaaaugguuguggaaaaacauaggguuaggucuggaaagcagaagaaacaaugaucaaaagcucaaauuuucauucugaagaguaaaaaggaucugaaaucugaucaaauguuggugcucuucuuuuauagguagauuuucuuuucugggacaauaaagguacuuaaacucaagcccuuuugaagacuaauauuuuaucagagacgugcaagaaucaaugugcauuuaacuucuaacucuucguguccucacaucugaucggugacuuaaucuuuuagauucugucccucagucuuacucugaucucugccuaccaucuauaccaacugccacugccuccgcccacggugucuugcccagcaucauaauggauucccaauguguaucuccauccuuuauuucauucuaucuccauuugucuuccccaaagcugcccgagugauucuuuacaacacgaaucucaugucaccaccaucguacuuaauauccuucauauaauuaaagguuucucuuuaucuccaagucacuccaaaaaaaaaaaaaaaaaaaaaaaagggaaaaccaugaggugcaagagccaaguuuguaaaaggcccuucauggucuaaguguuacuucucacuaguccccauaaggacccuauacauuagguacuuaugugauuuccuuauacaucuagauucaauguacaauuaagcauuuuuaaguggagguugaggauguggcuuaacugauuaaaaaaucacacacauauauacacacacaaauacacagaaccauaaaacuaaaaagacaucauaaucugccuaagagcauuauuuaauauucugucuugguaucucuuugacaauccaugcuaucaguuucauuacauuuuuuguaauuuuuaguauuuugguaucuuuuugucaguuccaauuauuugaaaugugauggcagauacaaaagcaaaaacuccuaucaggagccccgggcauuuucaaucuuucaagaaucuaauuauacaacauagaggucaguguuugaauaaguuaagauauugacagguauaugaaaggugaaauuaugucuuauuuucuuaagaucuuuuaagaguaggacaguguugugacuuagcuaauuaaagcauugguaucucccaaccuccaucaccauuaacuucauuaaacugagacucacuaaaaaggcguaagaagacagaauacacucaagcccagagaggauucaaucuuuggaaccuaaggagggacuugcccuauuccaggaggaccagaaguggggacuucuaaggacagaaucacaguuuccuuaggaaguaaaccuaacaguaaacuauuauaacucaaugcuuugcaagauguuuauucagaguugagaacacuuaaacaucacacagguucuugcagagacagagaaccccauaaaaccuaugaggggagccauugcgaaugcauccuguaagacaguuaacgcaguauuucagacccccauuuucauuuguuuguugcuaaaaugguuuuuuuuccucccuggcagaaaaaucucuggaauuugaugccuaaagauaccugggcuacagaauggaaucuaguagguuaaagacaucuaugugcacuuaagaauguuacaacgaaauacaugcuaugaaagaagugaacgaaaugcuaccuggcacuagaauaacaugaauaggcaugcuacaauuaaugaaucaugccuggggacaacagagggaagaaagcuuuaagaaaagcaaagacgaacuggaucaagaucaaucccugcuaccaucuauccaggcccaaccccuacguaacuauauaggaaaaaggaugaagccaaaacagcaaugacaaacaagagacagugccaucagaggaccagaacauguauggaauuccuagaccaugggaaacagguggaacuaaacgaacagagaaaccaaaguagauaagaacuaaugcaaaauaaguguuuggcaaagaauauccuuuaggcaaaggauaccaaaggaguaagaauaauucucagccccaaagccucagagccaccccaaaccaaguauccacaauaaaaaaaagaaaagaaaagaaaagaaaaaagaaagaaaaaaaggaagaauccauaauuaaaagcagcagaaacccugggucaacaugagguaauuauuuuaaaaacagugccacucagaauguuuuuaacaugauguuucuaaagaucuuuaggcugagagugguggcucaugccuauaaucccaguacuuugggaggcugaggcagguggaucaccugaggucaggaguucaagaccagccuggccaacacggcaaaaccccaucucuacuaaaaauacaaaaauuagccaggaguuguggugagcaccuguaaucccagcuacucgggcggcugaggcaggagagucgcuugaacccaggaggcagagguugcaguaagccaaaaucacggcauugcacuccagccuggguaacagagugagacucugucucaaaaaaaggaaaaaaaaaucuuuaugcauacugagauuugauaaacacuacuguagguuagguaggcuaguuaauguuuucuguaucccuaaccuacugagacacugacaauucuuuguaaauuuuauauuagagacaggguuuugccaugcugccuaggcucaaaauccugagcucaagcaauuugccugcuuuggccuuccaaaguguugggauuacaggcaugagccaucacgccacaaccggccuugauuuugccuucagaauaaagccaugagaauuacuagaaaauuaaaguaaauaauaugccagggcagagcuccugucucaucugagagucaaggcuagagagggaaguagaaaaaaccuugaaucaacccccaaacuccucaagauaaauggaguuucuguauaaaaauauauauuaaaaaauaaaaaauuaaauuaaauuaaaaaauaaaauugaaaaaauugaaaauugaaaaguguauguucugcagggaggggaaugaaagaagguuagagagcacuggacuccagggagcugaucacccagccaaaagcuguuaguggguaucucugacaggacaguucuggcaaggcugaugacaagaacagaaguggcucucuuccgccccaggauuccagcacaucuuggcggggccacugaauuugcauuucuaacaaguucccagugauacugauacuguugauccacagcucacacuuugagaaccaagaggcuacaggguuaaaaagugaaaaggugucacucaugccgacagcuucuaguacaagggaguuaaggaagugcaaugauuuuuuuucaccuauucuucagugucaagggcugagagaauccucaggcaggugugauuuauagagcacuguacuuucuugggggacuggauuuccauacuuauuccaguggcauaggccauuaaggcuacuaauggauugaggaaguaaugaaguaucuggcaaugaggcuuuguauaucauuagauuuccuugagcauccagccuggcaaagggcaucaagaaaugaugaacugugaaggagcuggagguucaaagcacaucuccuucccccuuuuuccuguuaauaugauuucugauuuuuuauuguuuuguuuugcuaguuuuaugauguuuuuuucuuccacaaacaggcagguauuccaaaauaggugugaaugcuuuuuaauuguuguuuccugauuaagucacaggcuaaugauaaugauacauuagcuaauuucuuucuccuuuugcccccuaaggacacuuuuucuaagcaccacacagcaaguuaacacucccagcucaaacagggaacaauguuuggcucaacggacaucacuauugcugcaggcaagucagaggaucgaggcuaaaaccuucaguuugcuccaaguccuuaaauacaggguucguaauagaauccuuugauuuuuaacccuaccuguaagauuuauguucugcucauuauuauucauuaagucaaucacucaugugucaauacuggcuagcacugggggaagucugaguucuacaguaaagaggauagucuagccacaauaaaaugcagaauggaacaacugccauuugagagugagauucagaaggagaagagagaguagauuaauaaagagaaaucaauuuaucuagucagcuaaagaguggcuggggagggaaggaaauggaggacacugaaaagcaaaguccccagugcacugacaccacaggguuugggcuguuuugugagaggcagcaauuaauaugcagccucacccacauaugagugauacgauaaaacaaauccuguuuacuugggcaacuggucauaacaugauaaguccucugucucucuuccccaaaaguuauuucuuaugcacuccaaguucagagcauuaaaauaaauggcucauaaugccaaguguguugaauuaaauccuuaucauaaauaagguaucagaagccauuuaucucauggcuuuuuguuuggugagauucacccugcaaaaggugagaaagcuaagaaaagucaaguagcagggaaaggccagugggaugagcucagcuaggucaagagacagagcuaaaaaaaauggacagagguggccagggaucagauauaagguuacauguauucaaaauaaggcuaaugagucacuguuggcacugauaaaauguuaaauaaaaaucacaaaagaauucuagaacuggaaaggccaaggcauuucagacacaaacagacaaauuaacaaaugauuugugaaaaguacuacaccaacagcacagucauacuuuguuuuauuuuggaucaacagauacauuacaaggaagaucaaguaagaauccuugcggaagcaccuuuuaagccaaguagcagaacacugacugaacacauaaacagccauuaaccauaugaauguucccuuaaugcguauaauguauuaauucauucuuucacccauuucaauacuuacuaaauaucuucuauguaagaucauuuugcaaaaugcaaaggcagaugaaaaaaugaaaaagauauacaauccuuguauuuaaggaacuuaauuugguauaaaaaacagcuauaacaaaagcuuuacagccauaaucacaauaggaaagauaaagcacuacuagauuuaagagacgauuggacuggcagggcaaggcgaggcagcaugugagccugaccugguuaccuaccuccacccagcccucaaaccauucuacugagcagaucuagaagaggggcaggagaggaugaacuucaugacagcuaccugcggggcaccaaauacaggacaaggaagcagguaugacucuacuuugaugacucaggucauggaggagcccaugauguggcaggagaguguaggcagcucaccucugcaccacucugaacugaaggccaagaguuaccgagaccagacacagcuggaugaguuccaaccugauggcucccaagaaugcacaauaaagcaaaaacaggguuucucucaaaguuuucuguaauuaauuucucggaguuuagaugcuaugugcagugcgucagcaccagaucagacucugcacuggaggcuuauuggcagacaugcugcacgcuggcugagccugcagccacagggacccagggccugccucauggcucagagaagcuacccagcaggguuuuaaaggaauaagaaagccacuaagaagaaguagacugugagcuuacccugaaggacuagcaggcuucagccacugcaugugggagugggaugaagaaggaggaaaaacauucuagauggaaguaauaaagcucagaggugaaaaaacaugagcaaaauggagucaggaaguaggagcacagccaagggauggcaggcugaaaaggugggauccugaaaggccuuggacuguacucuggcacaaacuucacuugcccaggugagagacucacgaucgcuuaguaguagcagcuaauuuuuagguggaaauuaggacuaccauuuuauuacaauucucugaggggcucuggguuaaaccucaggcaaucaagcaauucuacagaccagaccacccagaaaaucagcaugaucuuuaguggaaaugccuguuggucaggcacaucucuuuguccaucuuuugcuccuuuacaguuggacgaauucuaagcugccuuuuuauuaaaggcaccugucacaguauacgagcuaagugucuggggaguaccuugaccaacugccauacuccucuagucucccagguagggaauauguaguauuucauaguugucugucugacuucacagucugaccugguugggaauucuagcuuggcacaggaauaagggcaagucacugaaacugcaaaacuaacauggcccaaacagauagaagugaacgggugagaaggcugugggugaaacaagccagccucuggaugcuuccugcccuuuuuuccuagaccccucuuagcagaaaauagugcuuccccucugcacuuaacuaccugugcugugcagaaaacgcacacauaaaagcagcauuuacaaagaaauuaaauauuaaaggcaacauuacaaucucauguugaaagaagcacuucgcugauagcacacagcagcauuugcugaugaaucacaaaauaagcaauuguuauguauguugaaaaaaaaucaaucacuuaccauuuuuauuucucucauagccuguuuggguuccauccuuuauuucaaauuuaaagggcaaaaggggcacacaauuauaacauacagagagcuuuauucugaauacuuauuaagugccaccaaacaucuuucagcugauggguggggaaagaaagccuccuaaaccacaaaauagguguuuucuaaguacuucuguauuugcauuuuuauuucuuuuuauguucguauuaaagagcaccuauuuccuaaaggaaauuccauuauuugaaauuacuguuuacacaaauccuuacucucauuggauaaagcauuuauuaguugaacucagaauuacugaauuauuugguuaacaaaagucaccgucccuucugauacaacuguacccugcuagagucacugauguguaugcucuccacccuauaaaaaucuacccagauucguuuaauuacuuauuacuuagaagaacuccuuaacucuauucaacuuacccaguuuuagaucucucugaauuaauguuggaaacuauaauauuuuaaugauugaauucacauuaguuaaauuaaaggacacauaauuuucccauauggcacaauuuaggaaggcuggcuuacaagcucucuauugcuccaagaacaagcaaaaaaaaaaaaagaucuuuguuuauuaugaauaucagguaugauuugcuauuggcauuauggaagcaaggacuaguacacauuuucuauucauuuuuggccuugggccugaaggccuaaagguaucugagaaaaaaaacaacaggauaaaucaaaaauaagaacuaauuauccuuagcaagauuuguucuugggcaguacaaauauccaacagcaugaaagguugcagcugugguuugcugacguuuuuucagagaguaguguauaguuccucaaaucucuguuucauguauguuuacugaaacacaugcauuuaugaggaccgggguggaacaguaaagguaucucugauucacggaugugcaaugaagaaauugugucccacaagugaguuucaagcaccucuauccuguccaacuucccccaggcauuuuuuaacaguuuagaugaaccuuuguagauauuccugcuauauauacuuaccuugguuagagugguugggaaacggaacaauaaaaagaucucaucauuuuccuuugauaacuacacaagcugcuacgcugggguagucuuccuuuucugaacaccagaagcuaucccaaggccccugagugcaucugacccuuauuagaaacugucacccaugaauuguucugucugugaccugccacaaccucuuugccucuugucuuucaauuaugcuagcagcagcccacauugaggaaauuuaugauugaguugaaauacccacacacugugucuccaaauaaaacugaggaaacagugaugaaaagcuauaaagucaaugcagugcagacaugucccgggugaccuuucagaggaagcaccuuuucaggggagacaacugcagcugugagaagaguuaacucaguauaggguuccuccgcauggacacuggcuguccaguccagagcccaucccuucuccuguagcccccaaccaccaccuuccccuacguaaguaucucagaugguugcuacaagagaaaaaucacgcagcagugaguuuguagauucgucuucuagaugagauaaauuugggguuuccaaucucaaguggcccuuaaggucacuuagaaauuccuuuuacccuuccuguguccauguguucucauuguugugcacauguacccuaaaacuuaaaguauaauaauaauaaaauaaaauaaaaaaaaagaaauuccuuuuaccuuucccaacuuaaggaauggacaaaagguaguaaaacaggcacuguuaaagccugaauccuaacccugccaccauguggcuuugcacuguauuacucaucaggauacugcuuccggauuauucaggccgacuuccuuugaggacaaguaaauggucaauauuucugcagugaucuauuugugauuagaacaaugggucacuucuccaagcuuaguugcuucacuggauagguaaagaugguaacagcaccuauuccucaugaagcugcccuuaaaaagauagcauacguaagagguuuagcacaguaccugauacacaguaaaagguaaauaaugcuacccuuauccuucaauaaaucuguuuuaaaacauuaccucucuucaaccagaaccaaaguccucacauucuaaagacagucgugccucuuccuucaccuagauaauaccagucacggggaaugaaauuccucaacuucccuccccucuaccuucagauccagagacaguuucaaaauauuuaugcuuauaauuacuuagacauuauacaacuaaguacuuaaugcauuaauagauugcuauaguacaaacugauguuuauaguauuuuaauaacuguacuuuaacaaaauugucuccucuguaauccuguauauuuuaaauacuaaaaaguauuuuucugacaagagguccauacgcuuuaccaaaaacugccaaaggaguccaggacacacacacaaaaaaacccagaugaagaacaaugaaaaaugcggaccauccaaugccaagugagaagccuggauuauaaguuacaugaauacaguaacaauaaccacgcacacaugugaacagagauaaaaugaauaagcaaaaaugaagaacaucaugguguaauuaggggaggcuugaguuuuccguuuucuuuuuucguguuguuauuuuauuauuuuuauaauaauaaugaaaaaagauggagcauaaacccugauuaucuuuagagcuauuuuauucgucguauuguuucagacucagaacuggcagauucacucucacaaugaaucaacaacaccaugcuccacccuucauuuuccuguguuuccuguuagccauuaacagguccucaaaagagggguggccacaacagaggaguaagguaaauucaaacaugcacauuuucuucauggaaguaacaccaccccaucuacauuaccuaaaauguucuuuuucugucaugaaaaauuggaugacugacuccaaacagauauuggacaagcccagcaauuaacucuuuagccaaagagugagaacguuaacuucuaaaaguucaauuaaaaguaaauauuuuguggaugcuaggccacacuuuaccuauucuuggcauggcuuuuauaaugcacuuuccauucucccucuauuucuuaauggaaucuucucaauauuuaaaaauuccauuucugugagaucucuucaaacagaacagucaguuacccaagcagaugugugcaagaacacguucauacucuaaaagacguguaccgcuuauguucuggcucacuggcaaucauacaacuaaaguguggucuucuaucaccuccaggacuuuugugaaagaugaagauuacccaguccauccuggaauuccugcaccuccauuucucuaugggugccuauguaucaauaagaagcccacagaagaagugcccagcaagcuucacggcaguaaaagacaaagugccucuaaguguagcuacauauauauuuuacugcuucaacugugaggccaaagugguaguuuucaaugauaaauuaugaagagaaacauauuucucuggaauccuauccaaacagcccuggucagauuaaugcaaaaugaggacagagaaagaagaguucaaggccucuaguuuuuuguaauaaagguaacacuugcgguucaugauacugccaucaaagcagauuuucaggcuaacucaauacccuuacccccaccuggcagaguaaaggagagugcauaggagucccagcucucccacuaagaugcagguuaccaugucccucugagccucagguuccacagcuguacuucagaggauuacuguggugauuaauggaauaauggauacagaagugcucuauaaacaaaaagaggcaucacaaacacggucauuccuacuauuuucuuucaaggaugaagaagaagaagaaaaaagaaacagcagaauguaauaauacaucaguucuuuucaguuugccaaugcaaaaggccaaagagcuuggguauaagauccacaugggacaaaaaaaucagaucaccccaguuaucagggguauauaugaaaaagagacaaaaaguaagggacguuaaacaaauaacacuucaggaaacagcgcagagaagcaugugcugagcccagggucugagaccugugucaggacaagcaucaccaacucuucuuccuucuucucaaucuaaucucuaccagguucccuggucaggccugccucagcaccaugugacuuuuccugcccaugucuucccagucgcaggcugaugugcucguucuucaacccuugcuucccauuuucauggcaagugugauggccaaggcuuaacucaauauucucagucuauguuucucagauuuauuuuuauggaaagaaaaaaaauccuugucagauucaggguuuucagccaggacuuugaaguauuuuguucuuguagccauguuuaguaaauuauuuuuuuauaaauacauucacuaaaaucacacaucugucuaacucucaacaaaagauaagaaacuagacaucugugcccaaauauauuucuuaaaguauaggggauguguauuucugccuuuuccuagagggaaaaacucuuucuuuaaaugauuuuaaguauaaaguguuuuagugaaaaaaaauucuauaguaguggaguggaaaaaguauuguacucuauuacuagacuugugugaaguuugccgaaaucuuuuuuuuuuucuuuuauugccuauguuuauccaguuugccaaaaucuuccacaguuuuuaccucucucccaagugaauucagaccuccacucuagacuuguacuggguuaaagccaaucucaugacagugacaaaagaaaguuuccauugaaaaccaucugagagccucgaaagaaagagucaccuggucagguucauuugaaauauucaugaacucaacagaagaucagauuaaaaauagagcccccaagcaauggagguuuuggggggguuuuccucaaauuuuaggcuuuauaaugguguuuucacaaccuggcccaccugcccauaaaaugcauccaugcuccacuaguauuaauaguuucacuuguaaacacauaauggacaugaauaggauguacaauucauucuuccccuugcaagaaaaguacaguucucaguagucacauaugagaaaucauaacaauggauugauauucuggugugugccuauuuuugaaagugacagcuggacacacuggacauaucacaggaaacauauauucuuacaacgugagucaaagauaaacaugccuagaaaacuauaccugcugagggaaggaggagacaccacacaucuaacagacauguagaaauaguguuacgguuuugacuauucugcaguucugaaccuucuauggggaggucauuuauaaacacaagcaguccauuccaaagucauuccuucauuugaccacaccaggcacuaaugcaaaggaagcuuaacccuucugaaaacauuuuaaaccugaccaaauuaaaaguagcaccagaggaauuauuuuuuuuuagcaagaacccacaagcaauuuacuugacuagaggaaaaagugcaaagaaauccuuuaucacaaaauagcuucuugaaucuuucuaccaauaaaccucccaucccuccaagaaugccuacccucccugcugauaacaagcuguggagauaaauauuuuauuuuuuucuacaaaaccccaaaugauguuuucaaauaaaauaaaaauaaaucuacuacaagcuacugucaaaaaugguccuagaagagguaaaugucauuuuaaaggcugugugucaaaauauuuaggagaaagaaucugcuugucaaguuccaacaggaagcucugaagagguuauaagugcaucuaucaaauuuucaucuaccuuaaggcugaccuacuggggaaaccacagaaagccuagcucuguguaaugagggagcuggaagggcuggggguuucaagcauuggacagcaacaaggucacaaucaaguacaaagaggaggcuugggggauucugcagugauuccccagggaagaugcacuggcaugggcaggcaggcagcugcauucugcuuuaagccacaguucaagcuuaggaauggaacccagcugacggccauucaaaaucccucaugagaacucugaccucucaugacucuagcaaagcagcacccaccaaaucugagcaaaggaaaggccgagccagcaaaauauggcaagguuuuguuuuucuggguuuuuuuaagucuaauuuaaagugcuuccauacccccacccuuugggaauuacaugcagugacuuuuuuuaagcaaggaaaauuugguuuuaaggaguuuaugggaacauguaacuuggacuggaaagguuauuugcucgguauuaggcuaaaagccaaaauccacuuuuaaccagagaugauuuucauauuauaccucacaagaguauugugucaugugagcaggcugcagcgauaagcagugaagugaaguuaugacuucccccaaagacucauuaaaauguauuauuaaguagaaaaauucagaaaauccaaaaggaacccgucuaacaguaaaaaugcuuuccaacuuauuauuuccuuugcucugccucccuacaaauaccacugagucaauacugugaagaacucgauccugcugcaaaagaugaaaaugccucaaaguugugugccacuauggugcucuguauauaauuuuucccuuacaugugcuauggaggaacauaugaugacuucaagugacugcaaaaaaaauaaaauaaaauacaccugugaggauucuacaauuugauuuuuuuacguuauucaacccacaaaauacauuaaaacaugguaaauuagaaacauuuaccuagaaaaaaauggcacuuuccaauuuugauuuuuauaauuccaaauuuuagcagcucuaauauuuuucuuuuuccuuccuguuuuguuuuuuaacucaucucgauuuuuuuucucaucaauucuugaaaauuuucccccaccacuucaauuuuuaaaaaguaaugauuucauuuaagucaggcaaaugugcuuuaagaaagcuggacaaaauaucggcuuucuuaccagauccuacaaaaaugugaaagcacacuugcaaaggaguuccaagcugcuauggaaacagcuuuuuuuuuucuuuuucuuuuuuuuccaaaauaacaguacuccuggcucaggacugcuggcaugcaagcuuccaauccaagcccauugacagcuuguggaguggacagaugaggcauggaaaauauuuuaaauuaguucauuuaucuuguugagacacaggaaauggcgacaaaucucucacauacggaauacaggaagacaaugcaccuccuguaauauguagcaaauguaauccauuaagacaaaccuuucagacgauugcauauuaucuaauaauagccaccccucauauguugaaggaauauuuuaucauuaaaagauccagaaagcuggcuacaaaucauggacuacuucugaauuuuaacagacucaaauuuuagaagucaaauaguuuugaaaucaauguuuuugagugauccuaagcagauugugggucaauacuaguauagaaaaauguaauaaagaacuguaauuucuuaaaggagaguuuaaaaaugccacauuuuaggauaagacaacaagagcuggauuaaagagagaaugugaugcucccuuaaaugugaaugaacaaaacagcauuucuccuaggucccauuccaggguucauaucaacgaguacuuuuggccccauggcuccugcccacuuuaaggguccuuccgaggcagacaaagcagggccuccaggccuggaggaagaagcaaguggauacgggggagccaaacacugcucucaggauugguugcaccaaaaucacgaggaaucagagaauccugcuaaagacacuguccaucucugccccgccaccagaaguucugauucauagaucuaagugggagcccagaaaucuguauuuuugauaaguaguaccucaaagcaauucuagugcaaagccacauuuaaaaaucacuguaagauuacaaaucggcguucuccauaaacuggauguagauagaauuuugaaaaacuacgugcccucucacacaauuuuaaguggacacaaaauuucucaucauaaguuuaaauaauuguagaagcuauacuucuuguggauuaaauauugacauuuagaaauaaaacauguaucucuaaauaccauugucauuugauaacuccaucauccauuuaacaaauaaaagaacaggcucuucuuucacguuuuguagcauuccuuauucccuuuaaauuuauauuacuccuauuccacuuucccuccagaauuuuaacugaauguaagauaauuuuaugccugaaacucuuuuaguuaucacuguaccauaauccucuuuaacaaaaauaugcauauuaauugaaguuuaauuuuuuuaaaaaauuuccuaugacaagacucuaaguuuuaaaaaaccucuaguuuggcuauuauacuuauuuucaguuuauaacugaucaaagcuacacauguacuauaacauugguaauuauuaaagaaaaaaguauauuuuuauuggaaauguaucucagauagaugaagccuuuaaaaauuauuuuaugaauguauguuacagacugcuggaguuaaggcauguuucugugucauuuuaauuauauuuuucuuuuuucaaaaaaaaaagccuucauauuaaaaacuaaaugggauuugagggguuuuguugcaguaaugucucuuucugaguuauaugcgaacucuuucugaguuauaugccuaaacgcacgcuggucagaacccaucacuguguaucagcugacaucauuuggguacuccuuuaauucugucaaaagugaaaaaaaaaaaaagagccacguaaguugcaauaaaaagucuuguuguccaccuacuugauucauucccuuuuccagcuuuaugagagccaguauuuugcaucuggcaugccagaggucuucaaccacagggcagaguacaacggugagcucagagacgcauggaggaucacagauagauggcagaaagaccaacugucugccccacucugugaaggagaggggacaggagacccugcagacugcaggcuggcucucaggcagaucaacuuuagaaaaaaguauguuugagaguugggauauagaaaagaacuguccuuguaacugucuuuauaaaggguacauggguguguguauguaucagcuggaagaccccggccagaugauccugcaugcauaguccaugaucucaggaaucugcugguaaccccguagcaguuaucugaggagaaaaucaaaggccagagaacacacucaaggcaauccagacaggaucaaaggcugaacaggguggugcccagcacagcacuuaccuaagggcagugugguaggaggagcagauggacuggaacugagaaugagggugggcgucucucuuagagcaagccuauuccaauguggacucacccauuucucacaagccucaccuuucuaaaaaagaucccauugagaaacacagcauaaaguguggaugauuacuugccucugugacagacggcauauuuacucaacagaguaauaacuauuccgaugcugguguugcggcaaucacuguauaugagaggggacacacaaaaaugcuguuuggccuaacucagaaauucauaauuagggccaguggaguuauaaaauacagaaauaucuaccaauuuuagaugauauuaaaaaauuccuguuugcucuaggaucaaauaugcuggaaaagaauaacuguuuuuguuuuuuuugagacggggucuggcucugucgcucaggcuggagugcaguggcaugaucucggcucacugcaaccuccgccuccuggguucaagcaauucuccugccucagccucccgaguagcugggacuacaggcgcaugccacuaugccuggcuaauguuuuugcauuuuuaguagacacgggauuuugccauguuggccaggcuggucucgaacuccugacuucaggcgauccaccugccucggccucccaaagugcugggauuacaggcaugagccaccgcaccuggcccaauaauuuuuuuuuuaaugaaaaauaaaaaagaaagaaaaagggaaaaaauaucuaaguuccucugagacugcaugcuccauucacuucaggagggguuaacgcauaggcccaguggggagcuccguuuucuauaaaugcucagauuaucccaccacgcagucugagaagauaaacauaacaacagaaaaaauaaauuaaaauauaaaaaaacccucucgcuccuaugagcagggaaggaguggcaggaaccauaaaccuaaacaccagccuuccucucacagguuucaauaugaugccauccucaagcaaaauuaaaugucauccuagaccagagcuguuccagggucagccaucaugaccccguauuuuacaguguaaaagucagguuaaccaacagaccugaaaaaagccuguuuuucucccucuuuguuguuccucauaguucucucuaaacaauuagauuuuauuagaaacaacuuuuggcacagcacacuggcucuuugaaacaaggaaaaagaaaaagcaagaaaaaucuuagaaugggaauucugcaacugaaaaaaaaucauuuguuuuagagaugaagaaacugagguccgaagaaguguuuacucacugccacacaacaauggcccugagccaaauaugccccuucaaagcccagugugcuccuccucugccacagggcuccaaugccccuuccugguuucauucugccuugccacucuggccaucucucaguacucugcugugcugagugccuuuccaccucaggguccucgaauacacccuuccuuuaccuggguaacuguuuucccaaccuuaccuucaucuuggccacaccuacugaucuuuuaguucuuaaaugucauuccuucagagccauccacucuugacccuccaaauuaggccaggcccccugaugggcacucucauggcacaacacuucuucauaacuaaucauuuguuuaacguaucucucuucauagaucuaugaggcccaagaacacuugaacccauauguucuuguucaucuuuauaaggaacugcucaggaacuggaacaugguaagugcccauucaauauuuguagauaaacuuaaugaaaauaaucaacuacaugucagauauugcuuugaggguauuacauguuccauucauugagguaagcaauaguauuauuacuguguuacagaugaagaaacugagccacagagcaguucaaaaacuacacuaagaucaugcagcuccuaaauggacggauuguuuaaaauauauacaauguagcacugggaaucauugaugauagcagccuuaugaauagucaugcagaccuacacaaagccauaaucaaugcuuugaaaguuauuaaggagaaggccuauuaacauaauggacccuauucuagggcacuaugugggcauuuucuaaaagcacuucauaauagacuaucuaucauucauguuccaguaacaaucaucucuaacaccacaguggcuaacaaaacguuugucuugcucauguugaaucuugguuguggcucugcuccaggucuugcuuaagcuaggacccaggcugagagagcagccccuauaugaacuaugccauucucacaaaugggaaaacaaagagagaugguggcaccauguaguggcuccgaaagcuucagcugaguaguggcacaggucgucaacaccuguguuaaguuagaagcccagagcucaugaucuuuucuuccuaagcuccccagcacaguuagaagcaagaaacuaacgccauuaaauuccuuauuuucacuaaaauguucuaagacagcaaacacuagguuacccagagccuugacugcccucagcauuugauuacaaggauccaaagaugauaauuugaguaacucugcccugcacacuauaauucuccauagcuuuuuuguccucucucuauauaauguuuuuacucauaggaucuuugcccaaaugaaaaauccccguugaggaauucaaaucaaauucucacagaguuacaguggacacaaccucuucuaucuuaccuuugaaagaagugaugauagggaaggaacauaaucuauccaacaauuuuacuguuuaaacaaugcaaucaccuugacacacacacacacacacacacacacacacacacacaucagucaugugcuacaugggacguuucagucaaugacaaauggcauaucccaugguggucccauaagauuguaauaccuaauuuuggcuauaucuuuucuauguuuagauauacaaguacuuagcauuguguuauaacugccuaccauacucaguacaauagcaugcuguagcagccccaugaaggcuaggagcaauaggcuauaccauauagccuagauguguaguagucuaugccaucaagguuugcauaggcacacucuauguuugcacacagacaaaacugcguaaugaugcacuucucagaaugcauccccauuguuaagcaaugcacacugaauauaucuaauccaaaaguucaaaguccaaaauguuccaaaguuugaaauuuuugaaugccaacaaaacacucaacagaaaugcccauuggaguauuucagaucuuagauuuacagauuaggaacaaucaaccaguaaguauauaaugcaaguauuacaaaauccaaaaucugaaacacuucugguaacaagaauuuuggauaagagauacucaaccucaauguguauaugggucuaugugugugacuugaaauacugacucagaauggggaggaaauguuccugaacuguugaguauauccaggcuuaugaacacagagaacucuacuuauucgauaaauaauuuaaaaaaugcaagcacuucauaaaaauagauaauagagaaacugcagguccaucccugcuggaggcugaacuauaaacaauggcuauuaauaucaauaguaaacaaagaaaaaguccuuaauguuugguacuauauuuuaucauuucuccuaaaucugacaauuuuuuuuugcauacaacuugauuauuaauucuacugaacaaaaggcauaagucccuuuugucagcucuguguuuugcuacugcaaaugcuugacaaaauugucugcuucauuguuuauucccuguagaucuuccugccuucaaggaagcagcucuaaagcagugugggauuuggagccacgcgugacaacacaguaggcuugagaugaagugucaagucagcagacaaaugccagcugagggaacaaagcaagacucucacaggaaaaggacugcccgcagccccaugaaggcacccugagacucacggaugggaagcaaucagagcucuguaucugcauaaggcuacugaaaaagccauaucccuuccaccaucagcccuggugaggacccaaacugaaaggcucuggaaaauccagugaugguuuguggcaucauucuuaacggggugccuucaccccuagugccuuaccuuggucacaguauuaugccugcuugggcucucuguguaacucccgcugaaucccacuugcuaaagauucugaaacgaaacucagguggaacacacauuauuccuaaugggccuucuggucugagucucucuguaccauucuggugggcuaagguggaaagaaaccuucuaaugcccauuccaggaggauucauucauaauuuaagccuuuccugaguauaaacucaggccccaugugaggcuguagugacacaaacaagucagagucuuuguccuggaggcacggcagaaucucuagagaaggugguuucagaagcauuuauuugaugccuuuguucucagggccaccaugaugcuuuucacaggggcaaaggccaggcuaaguggaaaacaccugauaucuagauaucgaccaccaaaacaccuuucuaaaaaguccauuagccggcaacuagcucucuggguuccugcucugauucaauuucuaaaggagcaagcacaagagauauauaauguucauccugucccuugaauuucggagguaauacaugccuuuccguaccagcaccuggucuaucuucuaccauuagccccucugaacucaucuccaaggcuuuagacacaugcuuugcaaauaguggaaaucccaaggauucaucaacacgaacauuuccucaugcagcguaauuaucguacuuccagauuuccccauuaucccuguaggcucugggcucgugagguguuuaauguuuuuccaaagaaaugccaggugugauucuggcauuuaugauugccaacaucuucaaaguggaaugccaggaacacacuacuggagacauuuucagucaauggggcagcacuaccugugagaucagaugauuuucacucauucaccugcaggacaacagcacaggcuucccucugcuguuccucacacacggugaguuugguaugcuggauggggcacugguaggaauacuucccuaaaguuauuuaaagcucugugcacgccagccuugccaaaucauaaaauuaggaaauugcauucagucagacuaaguucuucccuuagcgcuuuaggcaccuaguuauucuucaauuucuuucccacaaacacuuggcccagguccugaaguccaccccauaucuacgugucuacguggcacauaaaagagauucagggaagaagauggaacaauaaaacuucagguuuacugacaacauuaagugaaguaaucccccuccacauacuuuucuuacaggaagaucaguuacucagccuucccauucaccugccugaugugaaucuacaaauauuuuaagaggguaauuuguaaaaagacuuacaauagcagaaguuguucaagcuguagcauuagucucugucgugugccuuagguuugcccacacauuuagcucauuuacacaagugaaucacuaagggccuguuuauuaaucaggucaaccaagacuuauuuaaacuacuagcuaacagcccucuuuuauaaacuaguggucagugaacguuuuugcuuacaauuccccagaagaauucuggaagacuauaacgcgccuugaauguuaaaguugagauuuaugggguuguacuguuuuuaacuuuaaggugaaauagaugcaaaaggacauuauuucccagcauagaauuccagaauauaauuauaugugcgcuuaaauuauauuuuuugucaaauuuugagacagcagauuccaauuuauguaaaaugucugccccaaauauaaaacccaauagacaaaggcaguccucauuaucaaagcaaucugccaaaacagacuuguuuuuuaucugaaaaagucugaauuccuuuugcaauucaaauaaauuguauuaauacacauucccauaucaagcauuucacuucugaauucuaagagaaacaaucaacagugaguaaaagacagucccaacuauacaauggccuuaacacaacagaaccucacuucuugcucagauaacaguacugggcuggcaaauaguucagugggguagcucuccuccacagccauuuaggggccuaggcugacaaagugcugugaucucaacauuugggcucuagggucucuuugcaggucaacuccauuucagaaaacaguaaggaggagaauacauggggguuauuuaggagccaaaccugagaguaauauauuucacuucugcuccaauaccuguggcugugcuccuaccaguaagggaggcuggguuauguggacuaguuguggaccaagaagacaccauggguuugagggaaugccuaguggauaagguacauaaauucugcaauaaauccauggccuagaugaagugccauuuuuuuuuuucaguauuuauuaccuaaucuaucucuacuuugcucuuuugagacuugcccucaaagccuguaccuuuaucuguuuaccugggagugaugcauuuauucuguaaagcaaaagaaguugugggaaaggagaaccagcagccccuuccaagguucacucucaugcagaucaagcuugggaaagaguacauguuaaaaguugagggccagaaaauuaauucucuaagagauaucagugcauuguacuucuaggaaagucuucauuuaacccuggaauacacggaucccaguuuaggaaucucuauuauauaaaguauuacaaaacacauagaaucacagaauucgacuaugcagaguguaagugccauuuauagaggugaaaagugagguaaaggguaguuuguucaaagucacucucaggcugggugccguggcucacgccucuaaucccagcacuuugggaggcuuagaugggcagaucacuugaggucaggaguucaagaccagccuggccaacauggcgaaacacugucuccacuaaaaauaaaauauuagcugggagugguggcaugcaccuguaguacuagcuacuugggagguugaggcaggagaaucgcuugaaccaggaggcagggguuguagugagccaagaucguacuacuacauuccagccugggcaacacagcgagacuccaucucaaaacaaacaaacaaaaaacaaagucacucuuguagagauuaauguauauaauggggcuauucuuuacuucaacaaacucauuuuggccuuuggcacuaaagaauauuucuggcuuuuuauuacauguugaauagaagaguuaauacaacaggccugaaacuguuaugccuugaaaguucugcuuccaagguuggccccuggcagacauacaggaacuugaauuucaggaagcuugccaccauucauugauaagaauggcucacuguaccaaaaauguacuaacaauaugguuuaugcugaaucuguaaaccugcuuuucuucugggagucugaaauuuugguacaugcuaggcagagggugccuaugugaucagcccucaauaaaaaccugggcacugauguauaagcaaacuuugcuuuguauccuuucacugcaauaaaucuuagcugugaguacaacuacauguuacauccugugaauucucccagucaaucauccaaucaugggguugcucauggacaccuccaguguacauguaaguuacauccaacagauaaguauagauugauuucaagauauuuaagaacauuguaaauauagauauuucagcauauuuguauuuaaguuauuguuuuggcuaugggaccucuagaaaaggaugaagguaauuuauacucaagcuaauuaaacuauggaccuuuaaaaugcaagacaauaauggaaaacauguaaaauacagaccuugggcuuggcuagcaaguaaaacaaggauucucugaaaauuacuacuaaagauaucagaagagaaccuuccauguugaagagaaccauuaaggagaacaugaauauggaauugugaacauuaauaagaaaaauguguccagcauuuuaaagaaagaaaaagaaaagaaaacccagaggcucuguguugaagacaaaaaaaaaaaggaaaccuaggaacaauuucucugcuaaaagcuguguccauguccuuccuacuggggucacuaggcaaaguuauauaaaaaacuaugguguuuaaauaacauuuuaucugauuuaauauuuuacuuuuuucccauugauuuuacaagcuauaaaaaaguuccuacagaaaagcugcaaauuacaccacagcauguauaaauuauuuuuuuaaaaagcacccaauauccugucauccagagacaacgacaauauggcauauuccuugagucuucucccaaugcauuaaaaaauaaauaaauaaaugggaacauucuggauauaauuugucuuuaauuuuuuucucaucaaaacuugauuuuuaaagaaauauuagaaacauuaauuaaacagacauguugaucaacuuuccuuuaauugugcuggagauccucacauguggaaccuggaggucuuugaucccagagccuaaauaucugcuggccaaaacaccugagaaacccaagguaagagggugaccauguguuuccugccauggcucagacaugccauuauuugacaaauauacagaaauuagauagacaucuuucucuguagacugacuggucugcaaguugaaaauguggugcaugcacuguguugccuugaugggcugacuuacauugugaaguccaggcaaugaugaugagacucaggauugaugaggcagcuuaaagguguuccugggagucauagaccucccacuucucuugacuccaccauauuccagaggcaguacagccagcaaaaugguugagcaguucugucacuuaguggcuguaugagcucaaauuauugaacucuucuuagccccaguuuuacaaaauauaaaaugggaauaaagauaucaauaugaaagaguuguuggaagauuacuagacaaugucuggccuagugcagagcugccaaaaugaaaaagaauauucaacacaaaaacauuaguauagcuuacagauaaaugcuaaauagcaugcuauucuauuucauauuuacuuuuuuuucagccguaguugaggggaggggcauaggaugacaacuauauguccaaagcaauguaaauacgcaaaucaaauuacaagcacuaauccaagauccaugcaaauggcaucuuuaauucaccauauuguagguguugcaucuugaaugccaaugaccucucuucccacagcaugugugauaacaugagcuucagcaacagguccguucucaacaucugucagcccaguguccacaucuguuucgauagcauauaucacccagauagaacuuugaugaaugagugauaguuuucaccuaaacucaaaauacguucaguugcuuuguugugcagcaagaaggaaggauucaggcugacagacauagaguggauucucuuagauucaagccucugggccugugaugugcuguagaaaaaugguguaacuucugagacuccuauuauaaugccuccaugcuacaggagacaaccucaggaugcauccaaaucauuaaccugaugcaccuuggaaagcuuuugauuccaaugacaauuuuugaggcuguaguaggacacguuggacuaaaucacaaagggaaagggaaacucuaggauacagaaaguacauuaaucaaaggaagucauuuuaccccacauaggaagucaacaaaugaaauuuaaaaaaauuaaacacaaaggugugaggauccagaggaaaaugacagauacaaaagggaaaguccagggucugacucaaucaggagcucaggcuauuguauccccauccuaaacacgaugcuggcugcucccauggagaaugagaaacagcaucugaaacaguggcggaggggauguaacuuuccuaaugaauugauguuuucacagugagccuucauuguuauuguuguuguuguuacuguugcugugucuagauucccagccuucccugaaaaacacaaugcaaauuuuaaaaguccaauaugccagauuuuaauaaauuauagugaaaauagcaugggcuuuagcaugagacaaacuaauuuaaucccagcucagacacuucccauauguauuccuugaauaaacuguuuaccauuuauguuuccuuaaaaaucaucuaaguuuccaguaaaaaugguuugaaauuaugcuuagcauaaaguaucgcaagaggaagauuuuggguuuuuuuuucuucuguuguucuugcuguugguuuauuacaguaggauggccagaacugggccuggcaaagaagagacugaaauaccaaauauauacaguaguguggaggaucacaaagauaacacaugugauggcaccagguacagcacucagugcaaggcucacaugccauaaauguucguucuaucccauaagcuguguugcuguucuuuucuaugacugaggaaaagggaggguugaccuacuuugagaauaaacuaacaaauuaucacacccaagauuuaaauuuucacccaaauaaaaauccucagaauggaucacaccacugcacuccagccugggugacaggagugaaacucugucucaaaaaaagaaaaaaaaaaaauccucagaaugauuaaagaguaugcccaggagauggagucucccucuuuucuucaccagcuuguccuuccugauaagcaguguugcuguaacagaauaccugagauuggguaguuuauaaagaaaagagguuuauuuggcucaagauuuugcuggcuggaagguucaagauugggcaucugcauguggugaggaccucaggcugcuucaacucacuguggaaagcagaaguggggugggagugcaaagagaucacauggugaaagaggguaugagagagaaaccgaggaagccagacucuuuuuuacaacaaacucucucaggagcuaacuuauuccgucagugaggacuuaacccauacagaagggcauucauccauucaugagggaagcaccccagagacucaaaaaccuccacuaggucgcaccccccaacacugccacacugggaucgaguuucaacaugaauuuuggcagagacaaaacacaugugaugaaaccauagaagaugaaacaggacaguugaacuucaaaacacaaaaccaaaaacaaaccauuaaccgagcauagacagaauggauuaccagucauuuuacuacauguaaagagguauuaugcgcugggauccguucugggggaugcugaacaaaacaccugacugcagaauugucugacugacugcauaucaugcccaccaucacagcugggaugcuuucugcugggguccaguuggggagaaaguuguuucauaucccuacuuuuguucaagaaagaggagacucuguuuauugcucuucauauacaaauuaaugaguucaucauucucaaggaugaaaaucauccauucgcuggguauggcaggagaucuugucagacauccugagaccuuuguaaacuccuaaauucaugauguauucaaauagaauacauaccuuuucauguaaaaugugcauucagauauacagaaauaaaaacguaucagcauguccaugcuggauggguagguaggcucacucauuaucuuagugauacccuauacagcagccaaaaaggcucagcaaaacaacuaauucaaugaucuaguccuuuaggguuaauagcaaguaaugaaaacugcaaauaguauauagguaaauugcuaaaucugaauuuaauaagaugccuggaauauugcaaaaauauaugcauuccuuuauaauauaaagacagucacguggacuugaucaaaacuuacuuauaagcugaaaaauaacguggucaaacaucauuuauacgugacuuucuaaacaaaaguuuucauucugauugagauucaagaauagauuauauaaaaauugcucagcaaugcugggcacaguggcucauacccguaaucccaggacuuuggcagaccaagguggguggaucauuugaggucaggaguucgagaucacccuggccaacauggugaaaccucauuucuacuaaaauauacaaaaaaauuagccaugcaaguuggcacaugccuguaauccuagcuaccugggaagcugaggcaggagaauuguuugaacccaagagacagcgguugcagugagcugagaucgcgccacugcacuccagccugggugacagagcgaaacuccaacucagaaagaaaaaaaaaaaauuugcucagcacuuaaaagauucagauguuaggaaauaagcucaauacugacauccuuuuucucuauaaaguaagaugcacuacaaucuuuuuauuugaagggaagauuaguuugcuguucuuuagauagcaaauuccugucuagaacugucuuuuuuaaaagcugucaaugcuaaaauguuauuucugguuaacaaaacccaugugcccacaucacuaugaguuagguuuccgagacaccugccacaaguggaguuuauuagaugauagauguaugcgucucucugcaccucucugaggcuuuuagcugucucugacagaccaacuguuugucaaagcuuuccaacagaucugacaccaggcaagagugaacuacaauuugaugggcccugcaaggcuaaugguaccaugugaggauauguucaaacuuaauuuaagaauauuucucccauucaccugcagccuauaucucccaagggcugaaauaaugcagauauaguuuuaucacacugcacacauuuaaaguacucugaaaugaaaaguaaaacaaacaaaaaacagggaguauaacugaacugagauaaucguuuucuuggaaaauacuggaaacaauuaauuucugcaucuccauguuuguuuucagccucugagaauaucgggaagcuaccaccacaaaggugaguauagcuuagugggagagaacaugggaguugggucaggaguccaggauuuacacagcucuucaacuauuaucuauauaacauauaaaauaagaguugucauaauuacuucaugaguaaauuacugaaacuuacucagugccaaccauugugcuaacaucgcauauaucucauuuaaucugcaaugagaaaauuaucacaaugaaaaagcaauagaaacuguaauaucuaauuaaugauucuggcaguaggauuuuagcuacagaaauagcuauguuagaucggaacauucuaaauggagguagaucuaugccaaaagcauucuaagaagaagauuccaccccugagagucccaugucguccagaggagaguaaacacugagcaugggguggaauguugcugucauggacuguagcucucaucucccaaaacacuuccccuucucugaucaucuacauucuuuccucucacuacuucuccuacuacuuuucuucaccacuuuguccuucucccuacaucacugagcuaucauuaguaucagucauuuccacagucaaucuacuaacauuaaaaaugugguuuugaugauuacacaauguauacauguaucaaaagaucacauuguaccccauaaguauguacaaugauuguacaucaaauguaaaugaaaucuuuaaaaacauauaggguuuuauauuuaauuuucaaagugcaacguaaauaacauaaaguucauccuuuaguguguauacuucuguaaguuuccacaaaacaauacaguuguguaccuccaccacaaucaagauacaccacagugccaucagcacaaaaauucuuugugccccuuuguagucagugacuccacccaugcauaaggcccagcacuaauccauuuucuguccuuguguguuuugcuuuuacagaaugugacauaaauugaauucaacaguacggagccuuuugagucaggcaucuuucacuuaggguaaugaaucugagauucauccaugguugaugaaaucucuaguuuguuccuuuuuagugcugaguagcauuauauuguaugaagguaccauguuuugagaauucauuccccaguugaaaaacacugaguugcuuccauuuuuugggugauuaugauauauguaaacauaaauuuucauuucucuuaaguaaauuccuagaagugggauugcuggaugguaugcuaaauuguaaguuuaauuuuauaagaaacugccaggcuguuuuccaagauggcuauaccauuuugcauuaccacaagcaauuuauaagcauuccaguugcuaaacgucagcaucacuacuugacacugucaguuaucuuaacacugacuauuccauugauauguagugacauaucauugugguucuacuugcuuuaccuaacagauaaugacauuaagcauuuugucauguacuuaugugcugucuauguauguccucuagugaaguguaagauaaaauuuugcaguuuuuuauaagguucuuuuauuguugagugucaagaguucuuuauauauccuggagacaaguuccuuaucaaguguguguugugcaaauauucugucccagucuguggcuucucaaacagugucuuucagaugagaucagguguguucagggugguauggccguagacucaaaaaguguuuuucaaagagcagaaguguauuauuuuuauggggcucaauuuuucaauuguuuuaaugggucaaaauuuugaucuauuuaucuaagaaaucucauagggcuuuugugacguaaaacccaugaucacaaagauuuucuucuauaaguuuuauaguuucugguuugauguuuguuuaugauccaauuucaguucauuuuuguacauaaaaugaguauggaucaagauucaauuuuauguauuuauuuuccaaauuuuuccaacaucacuuaaauaacaaacuaauugccuuggaacuuuuacugaaaaacacaugaccauagguguaugugucuaguccugaaauuucuauucuuuucuauuguuacauaugucuaucccuucaccacauuaacuugcuaauuguagcuuuauaauaagcauugaaaucagguagugagauucauccaauuuuguuguucuuuuccaaauuauuuuggcuuucccuuuccacauaaauuuuagaauucgauuaucauuuucuauaguaaauccugcuggaaauuucauuagaauuacacugaaucuaugaucaauuugguggagaauuaauauuuuaacaacaaugugucuuccaaucagguguaacuuucuacuuauuuagcuauucuuugauuuccuuuauuagcguuuuauaguuuucaacauacagauuuugcauauaugcuuucauguuauaucuacgcauuucauuauuuuggcauuaauggaaauggauuuuuauuaacuuucaaauuuuucauugcuagcauacauaaauacaaugaaauuuuuuaaccuuguaccccugaaaacuugacacacucauucauagguuuuauuagcuuuuuuuguaaaccuuugggacuuuauggaaauaaucauguccuccuccaaucaguaugauuugaauucauuuuucuugccuuacagcaccagcuaggaucugcacucaguaugagguugaauaggagugaugggaacugaauucauuaccuuguucacagucacaggaaagaauucaguguaucaccauuaugucuaauguucgcaguagguuuuuuuguaaguaugcuuuauuagaaugaggaaguucuuucuguggauagucugcugugaguuuuuauugggaaucaauguuaaauccaguuaaauguuuuuuucuccaguauauuaaucauauggcuuuucuuuagucuguuacuauagcuaauuacauugauugauuuuaaaaaguuaaauaagccuuauguucucaggauaaacccaauuaaguuuuuuauauacugcugauucaguuuguuaauuauuaugaugggauuuuuugaaauguauauucaugaugaauaugggucuacaguuuuccuuugcaagaguugaguaucaggguuaugcuggcccuaugcaaugaauugggagguguucccuucacuucuaauuuuuuaaaaguguuuagguagaacugcuauaauuucuuccuuuaacauuuuacaucauaauacugaaauuuacaauacaccaaugacagcaucugggccugcaguuuuauucuagaaagauuuuuguuuacaaauucaacuccauuaauaaauaaaacacuauuucuuauuuagcuauuucuuguugggugaguuuugauguuuuguuucuuauaagaaauuuguccaugucaccuagguuuccaaacuguaacaacuacuuguuugauuuugucagucuguuuguuguucccuuuucccccuguucugccugcuuuugauuuagcuaaauuuauuuuuauuucauuuaucuccacuaaugacuuaaaucuguaccucucuuuuaaaaauauucuuagucacacuacacuuuauaauacccaauuacaaucuaucuucaaauaauauuguagcacuucaaaucuggugugagaaccuuaauauauucucaauuaguccaccucaugucucacauuguaauugucacacacuuuauuuucacauguccuauaaaccacaauacauuacuacuauuuugacuuuaccuucccuuuacccauuuagggagucacauuuccuugugaaaaaaaugacagccacauuuccaugugauaaaauuacauaaaacuauauacaccuguuguaucaauguuacuuuccugguuuuaauauuauacuauaauuacauaagaaguaaccaauagaggaaauugagagacaaaacuuuagaacugucacaacuucccacgaaucuguaauuauuuuaaaauuuaaaguuuuuuguuuuguuuuguuuugcuuuuagaaacagggucuugcucuguagccuaggguggagugcaguggugcaaucauggcucacuguaaccuagagcuccuaggcucaagcaauccucccacacaccuggccuaaaauuuaaaguuuguuuaaaaaguuaaauaaacauguauaaacuuuccuggcaauuaaauaugcguaauauucuauguaugagaaaauguguuccacgugauaaaaguuaacuuuaaaacaacccuaauaucauuuauuuuaaaauguagacuacauauucaucauuauuuuaacaucauuucacuguuguaaugguauuaguaguguaauacaucauaauaacaauaagaaggaauauuuauugagcacuuauacagccaggcccugguggaguacucuaugcugaaucuuacuugccacucagaacaauguuaaaagcuacuauuauggugauuuugauucuacgaaugcuccacugagaauguagagugagaagaaagguucggauagaaaguagggcaucauaggccaggcgcgguggcucacgccuguaaucccagcacuuugggaggcugaggcagguggaucaccugaggucaggaguucgagaccagucuggccaacacgaugaaacuccgucucuacuaaaaauacaaaaacuagcugggcgugguggugcacaccuguaaucccagcuacucagaaggcugaggcaggagacuugcuugaaccugggagaaggaggaugcagugagccaagauugcaccauugcacuccagccugggcgacaagagcaaaauucuguuucaaaaaaaaaaaaaaaaaaaaaaaaaaagaaagggcaucauaaacauguaugaaauagacagaagaaaaggagccagcaaagaaaccaaaaccagguagccaaagaaaaagaacacaacauggaacugucaggaaaaucagggacaaaguuucaaggcagcuggcacguucugaaauaauuagcauguggcagaguugacaggugaacccagguugucugacuccaaagcuuacaaccauuauuauuacauucauauuuucauacuuugcagcaaaucauacaccugagaaaccguuggcacuaccuuuaguaaaauugaggugaucaaauuguauacauaaaagcuuugaaaugcagccuggaaaacuucuaagugcggaaaauaagcaaauguauguaaaaugucaugaugcuaguggguuuauaguaagaccaaaggaggaaaaauacaacuacccuuaagaaaaaguugauuauuuuuauaaaacagauucacauauaugugucagcauaucagaccaauauaguaugcuauuuaaagacuccuaaaucuaacacagcaugguaaaaugcugcauccucccaaguuauuuucuccauagaaaaaagucaaaaaucagcugggugcgguggcucacgccuguaaucccagcacuuugggaggccgaggcggguggaucacgaggucaggagaucgagaccauccugacuaaaauggugaaaccccgucucuacuaaaaauacaaaaaaauuagccaugcguggugguggccgccuguagucccagcuacucgggaggcugaggcagcagaauggcaugaacccgggagacggagcuugcagugagccaagaucgcaccacugcacuccauccugggcaacagggcaagacuucaucucaaaaaaaaaagucaaaaaucauuacuccaauauguuaacaaugauuacuucugugaaguggcauggagcuaaagacgacuuucauuuuggauuuuauacacuucgguuuuuaaaaauauuuugaagauaagcauguuacuuuuguaacuaaaacaacaggccuuugaaaauaaaauauaaaaauaaagaccaagagucuuaacaugaucuauauauuugaauucuaaccucaaauaagcaagucacaguuaacagugcaacugagccuuaccuccuuuggaguugcccugcaccuuguaugucucaggcugauaaccuaaacucugagcuuggucugucauuuaaguggaacauuucucagagaaauagaauguaaucaaggacaaacacaucuugcuugcucguuugcuuuccccaaugcaggugggcugccacccgccacauguacagcaagcugaaguuacaaaaacuguugugcuuuaucuaugcagaacguacguugugguuauguuaugcaccacagcuauaggaagaaggggucccccauaucagccugaggcuaaaagcacaaaagugauacuacugucauacacaggaaaaagagagucaauaguucaaaggcuaucacuaagauaaauggaguuuugaaauuaaauggugauugcccagcuaaauugagaagccugaaaaugcacauauauucagugcuaggacugccaggaaaaggagugauuuuguguugcugguuccuucauuuucuaauuaugaaaaauaggauucuuagagaaauauauaaauuuccuuguuguuuccaaaaauaucugggccacugauucccucuuguuuuuaaguugaccugccaaauaaacagcucuguaauguucauauucuuauacaaaaaauauuuaugaauugcuuugagaaacguaagaagaggauaauaucaaaagauaauuaucucuggauggcuucuuccuagagaaacuuuaaagcaaauaucugcagcacuacucaguuuaugccuuuuacuguguacauuaaaacaaguaacaacaauauaaucccugcauuauuuacaaaaaacaacuccaagacaucauaguauuuggagcaguacuacaaugcauaguguuucaugacucacagauauuucauuuuccucugagcucugaauaauuuaaaauuuuauguuaacaaauaccacuauaaaaauuaaaauuuugauuuaacauguuuauugucauuucuaaaaugaucuuaaaauaauuccaucauaucugaaaaacauacacuauugcuauuuggaagaguauauuuguuuaaaugaucuauacuauguaaauauccugacauuaggaaacagaaaugcuuauuauaucucuguaaagaaauaccugagaaaaagggcuuuauucuagcccuucucuugugccuuccaaaacuaccaaaagaacaaaugacauccuugaaaguucuguaaaaucuucaucuaaauccuuugcgggguggagagggggauaccauacauccuucuggaauguaaaucccaugagagggaugaccuguccaucuuaugccccugucauugaaugcaagccaccaugaucagcucuguauguauuuauuaaauaaaaaacugauaaaugaaugaaagaaaaaagugaccuuuauucuauaauuuuucucaaaaccauuaaaaugaugacaagcuggaauccccaacugauguaaugaagaugauuuuauuauauuucaaauauaugcuuugugacagaaauauuuuuaugcggaucucaauuacaguuuuuuuuuuuuuuuuaaagcuguuaccccuccauuguccgcaaagcaacaggugucaaauauagaacugugacaucgugaaagcuaggaaaagaccugcggaucacaauuuuuugucuuuugcuuuuucaaacuacagucacugacuuauuacauuucacacuauuuagaguuuuuagaauuaaauaugggucaacaaucacuaaaugcaucaacaagugacacuuauuaaaauaaaucauaccaaauggccagcauauuauaagcugcucugacacuaccacugcuuucauaaauaaaaaaugagaauuaaacuuucauaguaaaauauuucacuggacuacacugcaaauuuugacacggucaauucaucauuguaaaaaucagaugaagcucagucagcucuggucagaaagcucauuagucuauuaaaauuauaccuuugccagaaugucaugauucuuuuugcggaaauaugucugcuauuuaguaaaaauauuucaugaccauacuuuuuugcuuuguccaaagcaaauaaauguuuaaaacugaugacuuucuaaauucaauuauaagcaacagauggcucuaggaaaaaaaauuugaaaguuuuaauuaaccuuaagcgcuauuccuguaaugaaaaguagucaauuuauuugacuacuuuuuccauuuauuuaaguaaaacauuuuauuauuaaagaaagauggaauauauuuuauauucccaacagaaaaaaaaaguccauaguuuaaaauuuuguuuuaaggaaguuucauuucagaaaacuauuagugaaaagaagacuucaauuuaaaacuaaaagggauuccgaaauaaacucauuuucauggguuugacaaaauucuguguaguucuuaaugcaaauucccuuugauagguggccacacaucuuggcaacaaaaucccgguguuagauuauguuuugauugacuguaggacacauuuaucuuucacuagaacacuggacuuccuucuggucuuguguuuguuuucaauuuauuuaagucucuuuauucuaagagagaauauacaagagacuucaagaacuuacgucgucucacuugauuauuauacuucaaaaggggaauggggugauagauacauuaucaucacuggccaaauggacaccuagaagaagacaguuguucacuguccccugauaauaauaacugaacaucacauaccuucagucacuauuaaccuaagagcacucuguuaaacaacuacauaccuaggagcaguaagauucuaacccccuagcauaucgcucuucugagccacacccagauggucuacaaggaccucaaauuaagaaaguccaauauauacuuccucccacuaaacccuaugccucucccaguauugaggagccuugcacguugcaggaccaaucacccagcuguuuaugccaggaccuuggcuuuauucugucgugcuccauaacgugacugaguauucaccaagccugaccaacccugccucguaucaauucauuucucuccaaccuagguucaugcuaaaaucaucuuucaccugacuauugaaacugaccuugcugccaacauggugagccaccauacuccacauuaugcaucuuuuaaaauuuuucuaggaggcucauuuuaaaacuuuaaagaaaagggcaaaauugauuuuaguaauacauuuuacuuuaaucuuauaaaucuaaaauaucauauugacaauauaaaaauaaucagugagauauuuuacauccuuuuucauacuaagucuuugaaaucugcuguguauuuacacuuauaacguaucucaguucggauacuaaauguuuaagggugguuacaugugaaagguaggccuaccaaaacuauaguuguaucuaaagugcuucaguuuuuaaauguagcugcuucagauuuuacacauagcaaauuuaaaguuaaauacaauuugaaauucaguucuucaguaacacugacacauuccaagcgcaggguagcuguaagcagccagcagucaccacacagacagcacagcuccaaaagacgggaggcuuccuagaaccuagaacuucuugagacucagagcucccucuucaugcuucacgcuccagcucuacugaaauuucaguuccuagaccuuacaguucucuccacugccaggccacagagcaugcuguucauucuucugaacccucccucccagcuagcucuccagggcucagauuaggcauuauuaggcacuguuucuuccagaaaguuuuucuacugucccacacugcuaagucucaugcccaaaucuaguaagguccuucacuacauuuugcauuuuuacaauaauaaaacuuuucacacugcugugcaauugucuguuuaaauuucaauaacuuccauuacccuguaauaucguuaagaccagaaagcaaguaacuuuaucaccuaacuacauauuaaguccucaauaaauauuuauugaauaaaugaauaaacaagugagagaccaccaggaauucugcucccuccuuaaaaacauuaaucugcucugauccugacagaccaaacaagagcuuauaggaauuuaugcugcaaagaacuguuggucauuagccaucggcaaugaauuuaccucuuuguucuuauggggaagugacagucacagucaagcugguaucuuccauaaauuguuagacaucaaaauguugagacagcaaaaauguucacucgcaagcaauauuuucaguuaauuuaauuuaaaauauuuaauuuacuaaauccagaacugaaagcaauuagaauuuuuuugucuacuuugguccccaaaacuaucucuuacauacgguaccaaaaucucaugguuaugauacauuauuuuacuaaagauauguggcaaauucuauuuuuugcuaaugcuauuucauuuccauaauuauuuauauccauaaacagaaacauuuucucuaguuuuaagaaauuaaaguguauuuauacaaaaauuuaauuaagaguuucauaaaguuugugcuucuuaggucuaguuuuccauaauuuucauauauauucuguaauuacuccuaaaauaagggaaaaauuaguuuauauuucuaauaguuucagaagucaauuccuccucaaaguggaaaaaaagaagucaauagcauuguguccccguaucaaaaacaucaauggucacuucauggaauuucuggguuaaaaggcaaaacuaaacacacaaaucuaauuucaccccuuccacagauucccuuaaaacaguaaagggaauaauucuguaaguucaaaugguggggaaaaaaaaaagggggcugggcacgguggcgcaugccuauaaucccagcacuuugggaggcuaagguaggaggaucacuucagcccaggaguuugagaccagcuuagacaagaaggaaagaccccacccugacaaaaaaaaaauuagcuggaaauaguagugcaaaccuguauucccagcuacucagaaggcugaagugggaagaucacuuaagcccaggaaguaaaggcugcagugagccaugacugcaccacugcacuccagccugggcaacagagcaaggcccugucucaaaaauaaacaaguaaaaagaaaggaaagaaaacacaaaguaaagaaaauuuuggaagcuagaaaguaagacaagugacaacuucagcaaaacugagaaagcugcauccuaagaaggcaaaauaaaaaagccaaaaguggccgggcacagugguucacaccuguaaucccagcacuuugggaggccaaggcaggcagaucacaaggucaggaggucgagaccauccuggcuaacacggugacaccccgucucuacuaaaaauacaaaaaauuggccagugugugguggcaggcaccuguagucccagcuacuugggacgcugagguaggagaauggcgugaaccugggaggcggagcuugcagugagccaagaucgcaacacugcacuccagccugggcaacagagacagacucugucucaagaaaagccagaaccagaccauucauacuccaggacuugccaaagauacuggugauaccaggugucucuggaagugcugaaauuagggugagggguaauguacggagaacuggcugaaagccgcugaacaagagguuaguuucccagacuccuucuucagucuaugaaauuaggcaacuccacugccacaaaauaagaaaaaaaccugaagguuuacucucagagccaguaaaagagggucucuggaacacuagccauugcugaggguagagucgauauugggaaaaaaguggacuuacugaccuuuucccuaaggagcacugagaccaccugcccuccugccucauugggcucugaggagcccacagccaggcuuuuacccuucagucuggagacuggacgagucuucucuagagaaccugaccaguaucucuucccaauaaaaugcccagccagaucauaauauuucaaguuaacuauccgacccaacccaccagcaccaggcuucugcucagcucccguuauuaaaaaugggcaagcaaccaaggauuaucagacauccaaggacagccucauggaagguaaacaccaaaucagguagaugacaggcagucaaaaacuguaacgggacagaagauuccgggacagguuucucaaaggacaugaaauugauaugcauccugguguaucugaauaucuugaggagauguaagcauggcucaacuaugaauaaauuguguuuacaaagcaauaauaacauaaacccucaauuaccuauccaaccacuguauguaaaauacauggaacacuacuggagggagaagaaggacacaucuguauagugcaacugaccgaagcaaauugagcuaaaucuuccccucuccaaaauaaggugucauaggucaugcuugagacuaaaaaacaaaguaaauacaggcauauuauuuagcucuuuagaggcaaaugacaauaaagagauggaugggcggacagauugagagauacagacagacaaagaugguugaauuugguuuccuuugaggaaagggaaguaaggacaguaggggaagaggaacagcugucuuucacauuauaaccugcagaaggacuugacaauguaaaccaucucuaaacaaucuaaaacaaauaugcaugcccacgcaacugcuacaucaaaagucuacuccuuuaagaaauaaaauccuggccaggcacaguggcucacaccuaugaucccagcacuuugggaggccgaggcaggcggaucacgaggucaggaguuugagaccauccuggccaacauggugaaacccugucucuacuaaaaacacaaaaauuagcugggcaugguggcaugcaccuguagucccagcuacucaggaggcugaggcaggagaaucacuugaacccgggacgcggagguugcagugaaccgagaucgcaccacugcacuccagccuggugacagaccaagacuccaucucaaaauaauaauaauaauaauaauaauaauaauaauaauaauaauaacaacaauacugcuaaaaagucaucccugauuuagaauuaguauuaacacuacuauccuaggagcuacugggucaagggagagggagaagaacaguuaacaguuucaaauuaaauucauaggaagcaguuagaaaucaauaaacucaaauauguaacaagguacacagacaguaugcaauagcugucccucuccucuguucuccacguucuugccaguaagaagaagaaaaaaaaaaaaacaugacaaugacauaaaauaaggaacaagagaaagcaaaggccaugugccuaaaaugguggaggacagaacuauucccuuccaccugauaaguuacaggauaucauaaauaauaaacaaacaaaaucauugcaaggaaugugagaacacuggauugaagaagaaaggauacuauauuaugaggggauccucucucuauuccagugguuuucaaacuuuuugguauccggacucuuuuauacucuuaaacguuauuaaggaucacaaaaaacuucuauuuauguggguuuuaucuaacaauauuuuuuacauuagaaauuaaaaauggaaauuuuuaaaaauauauauuuaugaauucauuuaaaaauaacaaacccauuacauaguaaaauauuuuuaugaaaauaaccauauuuucuaaaacaaaaagaaaacagcuugaagaguggcguuguuuuaaauuuuugccaaucucugcccaguuuaauaaaagagaguuagagucucauaucugcuuuagcauuuggucuguuguaauauguuguuugguugaaguauaugaagacuaugugguuugacacacauaaauacuuggaaaaggagauguauuuuaauaaccuuuccagauaaucauggacauucuucaugauacuucaccaaaacuucaaugguaguuccuaaagguaaugaacuuuucauaccauguacugcaguagcuuaaaauccacuagucuaucaggcauuuguaacagauaguuugcccaggcauaauuugguaacaucaugcauucaucauuucgaaaauacucucgagggcuaggcgcgguggcuuaguccuguaaucccagcuacucgggaggucgaggcgggaggacugcuugaacccagaagcccgagaccacccugggcaacacaaucagaccucaucuuuaccaaaaaaauuuaaaaaugaggugggaggaucgcuuaagcccaggagauacaggcugcaaugagccaugauggcgccacugcacucccaccugggugacagagcaagacccugcuccaaaaacaaacaaaaaauacaaaauacugucacugaguuacaccaaucuuccaaauguuggcacauuuuauuacaaaauaucaaagucuacauuaauuaauaucaccacuaaucucauuuaaaaagccuguaaguacugggaaauuaucacacugauggauacaaguuuucuaaaauuccaguuuucauguagaaagcucaaauucuuucacaggcaacaaaucuugucauucacuuuuuagaaaaugucugccaaauacacaaaucaaaguaaugauugcuuggcauucauuauagaaaaaaaaaaagguugcaugaaaaaacugguaguacagcaugcaacucaaacuaucacuaaaauguuuuaccucaaggccaugauguauuauagcaggcaguggaagugcuuucuaaguauuuccuaucguaucacacggaauguaaacaaggcacauguucaagaauccagacuuaauauaauuaaccauuuuaaauuucaaggaccuucuuaagugaaacuggcuuuuuuuuuaaugccagaugccuggcauuggagaauacaaugguuacuagugcaauuugaugccuugguuugauguaugguaagugccagccauuuucaacagugagcugcagcaagcuuguacaagcuccugagagcgacugcuagaucuucaagaauuuugagaguugguucacauuauauugguaguuugaaacuggacacggugagaauauuucaaccaaugaaaugugcaaacacaacaaaugaggggcuuuuuuccccuuuccuaggagagcugcuucuuauuuacugccacaucaguagcuuuaccagccguugcacuugcaucguuagucuaaaauucaaugccuuaggaugucugaaaaggguuggaaacaguaugcugaucacauuuugagaaccacagcucuguuccaaacagugauuuaucccccaaaggcaaaauggcucagccaaaagacaccauagcagagacugaacucuucugacugcuggccccugugcuuugaaagaaucccaaugccuucugagagauugucgaauucauuuccucuacaagaagguggagaaaaagccagaaauagaugagaggguauccugguaaauaacaguacucaugggucauagucauucucuaggccccaaacugcugaagacucccagcuguaccaugcaaggaaauggcauuuuuagcaaaaccguccugaacaagaucgcuuuucaacaugcgauguccgugcucaaaaugaagcaagagcuguaucucugaacuucuguuuuagagaacaucaaccuauucaucuuacgguuuucagcaauaacugcaggggaaguugguggaaucucagacguuugcagaagagcccuucuaugcccugcucccucggagaugacagaacacgccaguuuaacaggccuccauucaaagaaaauuccuguugcuuacaaauugcccagaggcuguuuaaaauacaguuauguucuuaacaguguuauaaaaauaaagggggaaaaaucacuuaagagaauaacagcuaauauugcuaacguucuuugagugcaaacucugugucagacuguuaacuuuuucauuucauccucacaaucaccauaauuuacagaugagcuucagaggguuaaucugcauagccaagguugcccaaguggaggauacagggcucaggcagucuuaacccagagccuguacucuccaucucaaccuaagggaggcuucuuauaauuaugugaucuaaagcaugauauagaugaaugcagagaaacuuugauauugagaucaauaaauccagcccauggcuggcuaaaacaguccuaguaucugugucuaaccaggagcucauguuagauaaagacuucacuuaauugugggaccacaccuaaaauauaccacagugaaauucuaacuccaaguaugaaaauguucucacuuuacacaaaaagcuuucuuuguggauuuuuaaaacccacccuucugaggaaaugaauaaccuaauuuauauuaaaauaugaaacaaagaaaaguaacuaauuccugacccccuucuucucagaaaaacaaagaauaaugaauucauuguuacacaauaaugaccguaccuuuccaaaacuauaaccucucuugcuuucaaucacuguugaccaagcaaaacccuacagauuguuuagagcugucuaacagcugccucgguuuggcauguguuuguugguauugacccaggcaguacuagagugaaaggaaugacccugucucugaaacuccaaccuggcucacucacucaauuaaaagaucugucaguaaucacuacucacacagacaagaucagaaaaaaauggagcauucgucaaugcaagcuagaaaauaagauuacuuuuucacaauacucuuuaaucaugaauuaucugaagucccaccugucuaauaauguuuuuaaaauuagcccucaggaaaaaaugacuucaaaacugaaaauuuaaaggcuccagucaauuuccuuuugucucacaguuuuucucucaacagauaaagaaaaauccauaguaacaagauaacauuucaugcauuuacacauuuucuccuauagacaucuacagccuucagaaaguauauuauuuguagccaugcccaucugacauuuuccauuuuacucaaaagauuuuaugguuugguauuacagcaauauacaaauuugacagcuugcaauaggaucuagucccuguagcaaaucauucugacaguuaaguacuauacagcuacuaauguacuuuuuuuuuuuugcacuacacuuauuuaaaaaccuuacaaagcuggagacauauguauguugaaauccugaagaacauuaucuuaaugauguuauauaauuuuauacuggccguguuaaauaauaagacaccacauaccauaccacaaccgugucaucuguaguauaguaccucuuacuccuccuuuagaauaguucacuauucaaagcacuuuuugugcacauuaacacuacugauuacuguuuaagcaauaaguuuucucaucauugucaauguuuauuauuuucuuagaacuucucugucuuuaaaaauaccugagccuaugaauaaaucgguacaugaguuaauguggaacauacugacuuuuucugauugccuuuacgacacuacuucuuuucuuuuagcaugaugaaagauaaucaauaugucuuuacauuuccuaaaaugcauuaacagaggcccugucaaauacaaccuugauucuuucagaaagaaagccaaguugcucacgaacauugcuguaacauuaacuaaauagaacucugagugaucuuacagcacaagaggcagacccuaucucuaccucucaauaauucuauuuuuaguauucaguauaucugauaacaugagucaguuggcaagagaacaugcgccuucgucuaagaaauaggaagugugauuguauuuucucccccuugauucaacucuugagauggaauaccacagugaaaccacucuauuuucagaauugauauaccuuucaaaacuauaaucuuuggcuugcagguucacuauuauuugccuucagguacaaauuuuaaaguguacagaggcuucuaagcagaauaguauggucucagccagacacggaaaggcuuguagcucagucaucauuguaguguaaauuccuuuucaaaauaauguucuucacucagagaacacuugugccugggcuuuguucacuugucaaacacaaaucagaggucaucgaaugcccaggggcaaauccugcuauuccaaaauucauuucucccucuauuugguugcagaaauaggauuucaaauguaaaaguccuagaaaggucuaaagacauagaaaccaaaggcacugugcuacaccacugugaggacggaugcauuugugacccaugaacaaugccaaauuuuuuguguuuguuuguuuuuugagacguagccuugcucugucgccaggauggagugcaguggcgccaucucgguucacugcaacuuccgccucccagguucaagcaauucuccugcgauaggcucccgagcagcugguacuacaagcaugcaccacccacacccggcuaauuuuuguauuuuuaguagagaugggguuucaccauguuggccaggauggucucaaugcuaaguuuguuaugcaaugacagcaaucagaacagacauccgcugcauugaaagaugugauuuaauauuuaaauauucauacaacaguccuauuugaaaacuuuaucuccaaauagaguauuuaaaacuaauaguugcauuuaggaucugcuacaacuuccuaagauuucuuaaaacccacaaaccugcucugcuggcuuauuuacaaaaauaccacagaucuuuaauuaauuuaagcugcaggaagugaucaauguauacaauaaacauucaugguaaacauacagcaacuaccagaaauccauacuucuuuuuaacuccuuuugcuagauuuuuaaaauguccuucucuuaaauuuuauaaucaaaucuaagauuuuuacagugaucugucuccaaacccuaccgccuucuuccuucugugugauaccauaaaaacaucauuuguuaucucuaaagucccauccuuaauccuucuuccugaucauuuuuauauuguaaaaacaaaauaggccauucugucuuaauguguguuuuauauaucucuauguucccuuguuuuugucugugcacaauuuuguucuucuuccagagauucacuuaugacuacggccaaucaaucauacuaguagagaaaauaagaaagaaagaagaaaaggaaaaaauucugaauaaauucuaaaucuauaccacuuggggucaauucuuuuucuuucaguccucaggcacaccaaucaccugugacuucacacaacccccuagaugggcuacggggagaaggaaacguccucaguagccuccuauuauccuacaaagugccaauccucacauauucuuuuggugaacagagaaggugcugcagggcacagggaagggguuugcaguaauaggacuugccacaaggauaacuuuucccauacaguaaagucauucagaagcaaagcaauuuauucuaauggacagguaauaaaaauacuacauaauauaaaaccugcauuaaauaucagaagaaugcugaagcugacagggaaacugguucucccuuuuggauaugaagucuuuagcccauucagcuaacuuuucauuucuuaagauuuguuagcauuuucauuucugcccuguaacaggaugacucuacuuaauaacccgguaguuuuggauagcaaccuguagcauuuuuuuagcuggggcagcaauuacuuuaauaauuacacaaaagugaaauauuguuaaagaaaacgaaagaaagaacaaauuuaacuggauggagaccacuacagccaaacuuauuuuucauuaaaauguuuuagguuuuuaaaaguuaauuauuaaaguauuuaaaauuggacacagaaauaaaagaaaauauaaugucuugaaaauaagucuaaugucaucauuguuguccauuuaauuguaugaugaacaaaggccacaccugugacauuaccaagcaagguggcuggaugagcuaaaggaucuccaugaagcacacaccauuuuaggaucaauaaauccacagaagagcaccaaaaggcuuguuuuccauuaguugucauuuuuuaaaaacuggccauuauacauaagaggaaaaaaucugcucaaguaaacaaauccuuuccuguauccgccacaaaauucuccuugcacgaauaauuuaccagaggagcuuuucaaaagcuguagguugaagcucugaauaaauaaacgacuaacaauaguguuaccaaaauauucaaauaccucugcauaaauuccaguauuucauauucuagaaagacugcuaauaaugagcauuuuaaaaauaaacagccuucauauaauggaagacauuuuaaacuuaugcuugcccaccagucauucuauuagccucuugcaguuacuagcuuuauacuaguguuguuuauuacuuauucagaaaaacucuaacuugccccaagggacagcagcucuuuuucuacaguuaaaugaaaaacuaaacuaaaaaacuguccuuuggaauucaacacuuugaaugcaucacgagcaguacuuucgaugcucuauugucaucccuugggcacucgcucgcucucucucucucucucucucucucucucucucucucugcagguguggccagagcucugguuaggcacuagagaagggaggugguaguuuaagagcaacauaagaaacuggugcagcagcaccaccucguggguacugaagagaugcagcccuugcugcugcuucagggaugaaccacuuguccacucauuuucaauccccagcugaccagaaguuccaagaucagaauuuucaaccaacaagaugaguacugcaugcauguuucauaggcucucuggaguacugcugggcucuacaauuuaaucauaugucuccugugaugcagauaaguaaaguaaugccuugcuuuagagcaauaugcagacaugugugugaauuagaucuguuacauuuaaaggagaaaccguggaaaggcaaaggccauuuguuauugucugaucgcacuccuccagccacagucauuauaagccugacgugcaaauaaugaauaaugauuugcugccuuuuauucauuucauaaauauuuacucagugacuacuaugugcauauacacauacaucacagaauuuuaaucuuaggugaaacuugauuaguauucaauuugguuguucaauuuccauaagaacagguaauguuaaauuguuaaaugagauuauauaauuaauaaguauauaguagcugauaugcacauguuaccagacuuuauugcuuugcuaacaaaaaagaaauuuggauuugaaaaaagaaaaaaauccagguuuguuuuuaaaaacauuuaacaauuucuguucugucagucuugaauucaguucuuccaaccaagauauucucuaaaaaugacaaauauugaaaauguucucuuucugucuauaucuucgcuguagacccguggauucuuaaaugagggugauuuugccucccaggggauagcuggcaaugccuguuuggugaaggcugcuggaauccuaugaugcacaugacaguccuccacaacgaagaauuaucugcucuaaaaugucaguaaugccaagguugacagaacaaaaacugugucugauucaaaaauguauacuacauggcaagacaagugauaauuguuuggugaaauaaauugauuaugacaucuaaauaauucuuauuauuuuccaguuguaugaagaggaaggcagaauggacagucuagaguucagaaaaggaaugcccacagcuccagaaaaaaauauugaaacugacacuggcagacacauauauauuuaugaaauaggcagaauaaaauagcuuaccuggacuuacuuuugccuggaugaaauaccacacaaaacuacucugcuuuccugccggccaugaacuuguuagguuaccauuuaaacuucagaagaaugccuaugucaggaaaguguacccuuaacacgacauacaggcagagcauccuauucccuggaaaggugcguuucauuccccacauaaguaaauuguauuauucaaagccauccucucugagucugaucaccauggaacaucaaugaagacuggggcacagacacuggacugcaguggacucacaagggugaugauuccuuccugaggacucuuggugaaaaagaauccagacuuucagucauugccccugucaaacuauuacaaacuuagacauucuuccccccaaaugaaguugcuccucguauuauuauuccacuaaagauaacuacuacaagcauuuugaugaggaucauucuaagaaacuuuccauaaauauaacauuauaugaaaaauaaucuggucaagaggcugcuauuuucauccaaaaauauuucacagaucucaguuuacaucuguaaccauagcucuauguuaucauuugaauagacuuuuggugauaaugacauucaguuaagacaugcucuuuuaaagguaccgacugcuuaaggaaggaaauguuccaugagaaaugugauaugcacuaucaagaugaagcacagcacugugaggaaagcgacaagcuucaccaucuuuacuugcaauuaugauauuucuagauauaacacccugaauguggaugaaauaauccugcugcccuucccugcuguucucucaaaaacccuuugggacugauguggguaacguuaaaucuuuaaggaagcacuuauggacuagagaagccaagacauaggccuguggaggcagccucaagagcagugacuacuccuucugaggggcacugcacugguaauaacacagaaacaaaggugauuuuaaaaggugguguagaauuuugacaaauaucuauuacuuuuauaaucagaaaaaaauauuaaaauguuaacauuuguuaauauuugucacaccaaacauuaaauuauuuaacaugugguaguucaacuuuuuuuuggauaucauaucuuauaguccuaauucuuacaaacguuuuguuuguuuuuuggugucuuuuuuuuuuuuugguaaucuggguauaagauuucaagcuuuccuauggaaguccaggagcugaagaauuauacucucuucuuacuucuucugacagucacugugaccuuuagagggccauuuaaauggcccacucauuuccaucuuagauuacaaaacuuccaacuaccacaugcugagcauccuaagcccaacacucacaucagccacaguaaucaucaguuccaugaaaggcccauauauuuccuagugaagugaaauucuugauggagguaugauggcaaauaacaguguucacuuucacuucuccgaaaacaaaauacaguaggcuagacugugaguuccuauaagagagccccagagacggcacacccagcucgccauuggggaaaagagcagugggaaaacaagcaacagucaagaaaaaagagucauagugaugaugccugaaaugcuguacaguggaaagaccuucaguggaaaauaacaacgacucaggaaauucuagaguuuuaaguccaccuguaagacgugcuccaauacauuaaggucaugcaguugaacuuuggggaaaguucuaauuagguaugcaauauaagggccuaaacuaaggaucugcuggcucauaauugaauaaaacuacaaaguuacuucaauguuaaagacaauaaaggccuauauuuucaaugaaaaaugcucuuaacagaaaccaaugggaagauuuuuacacaguuucugaacaagccagagaguuuggcauauuaagugacuuguaccuauucaagagugagaaaauaucuucguaaaaauaaaagcuucuuuauuucucugugugucucuucuuggugaagagauaaugaaauuagguuagauacauuuugcuagguuaagaccaaccaaagagagucaagagagaaaaaucuaaacaauuuaaauagaguuagauggcucagcuccaguacugacaaaucuuaccagauaaccuauaguuugaaaguucacauuaauucaggaaauguauuacuaucuuuuuccucauuucagacagaaauugaggaagguuauaugcaaacuuacaauauaacaggaaaagaauuuguaagaauaaauaaauuuaggcuaaaggaaaauaaggguagaaaaauaaaagaaagcuaggagaaaauauaccuugggaaugugugcauuaauggaaaaauucagaacuugaaauuaacacuaauuuaugagguaaaaaagaagcuuugccacucaccaauuuuaaccucuguaaagguauucugccuacaucuauuuguguccuuucugggacauuagugaaucgaacuucugggaccgcaacggcgcacaugacaugggcccaccuacaggaaaggagacauuaaacauaaacaaaaguucccuaaacuuacauacuucaacuuggugaugccaguucucacagaugggaaauacacagaugagcaagaaagccaaaagccuaaauccaucacaaacagauucugaacuguaaaccuccugaaugauaccuggacagacucaguaccacagcugcccaacaacauugugccaugaagagcugauaaaggcccacgacucuauccuauuaacgugcacauauuuuucuacacuugaucugcaaaauacugaaauguggguuucuuauuucauuugaugcuggaauaugcauguaugugcuuaaaguacuuaagcuaaucaauauguggcaaaagauuaguucaauuaauaaaagguaugaacuggguauagcacacaaccuuuuaaaauaauacaaaugucaugaagcaaacuuguuuaaguagcaaaaguuuuccaaaagaauuaaugcuaaucuuuaauuaaauuguuucuugcugcaaucuuacuauaaucaaugaaacccagagacaaaaagaaaugaaguuuaucucauacccuaguuuccuacuuuuuucacuuucugaaaaaugacaacuuucccguuaauacuauuaaaugucucauaaauguuauaucccaaaauaaauauaaagaaucaugagguuugaagagaucuugaaagaauugucaaauccaucaaccuauuuuuaagccaaagcauauuuacuucacucaaacaguaucagacucuauccugucuuucaagaccacaggaagagagaacaaguaucgaucccaccagggcauucuuccacaucgaaauaaauacuaucauuccacagaaaacacuauuucuuuuuguugugguccaagcauaggaagagaacgucuuaucacccguguuuuuacaggaaccaccuaaaccaucucacaguauggcauccagugcaauauccaagaacuagugaagacuuucaguauagugcgaaucauaucaaccaggacuguggaagaacaucuucuuucaaaaauuaagcaaacccuacaguuccuuacaacaaauuuuauuaauguaauaaugauaaauaccuucacuccuccuucccagcaaucagaaacaugugcacauguaaagaauuaugcuaaauccaccauuacauuacaccaggaguccuaacuccagugcccagggggccaggcggaauguaagcaaauacacauauacuaggaagucauggugaacugaggaguaccugccccacugacacuggguucuaucccaacuuguuauuacugccuuauagggauauacaaucauuuucaauuaaagaugaaaaucuggauuuuuauguaaaaaucucucaauuuuaaauuuuagaugcaauuuauaaaauggugccuggguccaacaaaacauaucuuagacaugaaucuggcccucaagugccagccugcaaaauccgcccagguuauuuugacaugucucuauuccagcggacccuguaauaugcuuuggccccauuuucaauauuaaaaccuggucaugaaaaaaaaauaaaauccaugcagaacagucauaaaaacuagacugccuuccuuuuauguucacuuaugacucucuuucaagacucucuucauauucuccaccugaucccuuuaaaucuuaacaucaauguuuucucccuaucuuuucuaauuuaguacacuuacauucucauaaauuugcuaauguaaaaaguaaaugguuuuguuuuauuaucauugcuaugacugauuuaucugaagaucacgguuucacuuucucagguaugcccuguuuuaacagaccaauagcauucaucauauuaaacaccaggauucuaauggcaccuggaugauaugggcuaacuccauuuucaaaacucugugaguaaaagagggguuauuuuucauggugucaaauacaaagaagagaagcauaacuuggacugcucuugcccugccgagaugagagugcaaacaguagaagucucugaagcacagaauuccaaccucagaucugagcagcaaaagcuuugaaaccacguguacaaugagagguaaagcgaacugucauccaaagguucuagaauggagaaagaaaaauaaugaaauucaacacaauuaauguauuacuuacuuauuguucuucguuugcuuaagagcaccuccucucaaauugcagagacagcauuccuggggggaaaagaaaauaccacaugaugaccagacccacauaacaaaagucauuaccauucaucuaaauauucucagagauccugauuuuucauucuaaaauuaaaaccaucaggaauuacaugaaggucuaucucugagaaguucaaaaagaaagacagcggagggggaaaugguagagguacaccccucaaauuucaggguauaaaauucucccagagggaaccaucaugaaaugaaccugguauaauuuuaaauugacacugucaucaaaggaaagcugugacacagagaaccuagcaguccagagaaccuaguccacacaccuaguauaugcaagaauucuagagcagagaaugcacacacgacgguguagccuugugcucugggaauucacuccuggauacaggguggcuaaugaauggagucugggcaggcuuuuuucuacuacaaggauaagcaagaggcuauuuuuaaacgauacucuuuucaccaaaguaacacuugcgccucacucuuucugugggcaaauaguguuauaaaaaguguccugaucaaccccagcuauccggcccgagaaaacagcaccaagaaacguuuugcuuuauccuucccacauaagcuuaaccuuucagcacucuuaugugucuuagcuuagaauguaauuuucuacuccaagaugacuccaauugcuacaaauauagauuuuauuaguuauuucucacuacacucucaugaaaaagaccaggaaaaggaggaccagagagcagugcacugccuucucuugaccuaaauuguuucaagcuuguccucucaauuuucugcauuaauacauuuuuuaaauugguagaaguuauuuggaguuuuuuccuccaaaguuuauauacgaaaccucuuuacccuguccacuaaagugauguuccuuaacaaauuuugacaauuuuuccuagcuuuacaaggaauccaucuaacugaucuacuauuaaugaggugugaaacuucauagcuuuuacuuuucugaggaaaacgauaccaaaacaacuggaaagaaucauguaucuguauaacuuuuguuaggcaguaauaaaugcaaacaacuagaaauguccaacagguuugugugucugaaaagucucuguaaaucuauaugaaaauuccuggauucagaguaguaaaagauacacuguguauauugauuugaauccauuauaaacccagcucaaggaguuaacaacucaaugaagaauuuucucuauccauaccacaaagccauauccuagaggccuuuggaauaacugguuuugaugaaucacaacaagcaaaauuucacaauccaaauacugaaaaugagaacucugguaguucauuuuauaaguucucaauuuuagguauuuuuccaguaauuuaacacacuuucuacagagaaagaggaggugagaaagaaaaugaaugaaugaaaaaggaaacaaaacuugaggucaaguacuuucguuguauacaugaagauguuaguuucaaagugggaaugcagcaaagaguuguggacugugaagcacucaggcucuaagagaauuagaugucugauuaaugaaaguagcagugagaagaagccuaaagggacaaguuaggaaagucaaauacagcgcagcagcauggaagcugcucaaaagcaccugauuaggaucauuaacagguacacauguucuagagcacuaaucuaacaagaggaaaaagucuucuaaaauacaauguguaggcucaagauuuuaaauggauuuuaagauucuccaccaucacaagaagauauucacucuuccuagccuccccuccaagucacaguaucuaauagacaauuccaaguccuugguucaccugaccucuuagcaccauacaacacuguugauccuuccugaaagauuuucucccugugguuuccaugacccuuagacuccucauuguccuccugcaccucuagcugacccucaguuuccuuuaacaggcuucucuuucacuauccucacacacuggaauuucuguaauaggcccuauuacuucucucuccacacaugccugcugagcaucugauccacuacccugauuccgaucacucucuauaggccaauggcucacaccuuaauucccugaggugucugacuaacagugccacagguaucucaaacacacaugcaaaacugaacucauaucuucuucucaagccuguacuccccgacuguuuuccaucauuggugccuaccauccauucuagcucauauuggaggacacauuuuuccucucauccuuuagauccaaucaacugaguucugucaaucccaccuccaaauccacccuguucucuccaucaucacugccaucacuuucgcugauagucccaguauccuucaccagaccuaaacuauugcaauagccacccagagcuacucugaaccccaugagagaagguuuuuaaugcuucucaguaccuaauauggccucagagggcuagaaucaucaggucuuggucuuggccagccucacuguguuuagacaccucaaggaccucccugagguuccuucuguccugaacacuuuagagccagccugcgccauucaucaauaauuaaacuaaacacauucuugaaaucucaaccuaaauguuacucccucaaacaagaauccccaauccccuggcucagguacuucuaucucaggcauucccacugacacuuucacugauacuccccuuuuauuagcuuuauuacucuugcaacuauuuguugcaugcuaucugcugcccucacuaaacuguaaacucacugagugcuauuggaauaucugucagguuaauugcucuuacucuauuaugauauccaauagagaguauacccuuaauaugaguuuguuaaauaaauaacaaaacauggcaaaacagggaagagugaaaaucuugaaaauuagcaaaggauuaauaaaaugcaaagaccauuuucacauacugggacuuucuaaguaaaguaugcugcaagcuuuagugaguugacaaaguuauuuuugccaugauuuacuuaagaaaucuuauuucuuugugaagaacaaaaauauucauggccagguacacucauaaguuauuuauaugauaucacaguuucuguucuauucucccaauuuugaaaaaaaaaaaguaggaaacaaccaaagucaugucaaguuacaucauuuguuugacucaauggcccucagagggucaaacuaguugaucugguaaaaacauaaagaugccaaccuguccauucauucauuuguaguuucauuacaugccuaugauuaaagcccaguagaaaacauaacagauaagacaauuuuuaaccuuucuuuccuuuuuuaaauaguacuuuacugucagagaacagaauugauaacucuaaaaauuaacagguuaacucucacucaaaaagcagcccaaguuuucuuaagaaucuacaaugucugauacauguaaggcacuacacaaaacaguaauuguaccuguaucauuuuccuccaaaucuuucaaugaaagaauuuaaggagaagguaggaaagugcuagaguauccaucaagacacugagucauuaaacuugauaucaagaauaaaaauuagaagaacagagacauguauugaaagccuaaugcauuccacguaccaugccaaaaauuucauauacuucaccucccuucuuuaucacaaacuuauuaaguaauuuauuauuucacuuaauagauaaagaaacucagauucaaaagauuaagugauauuccuaaaaucauccaacccaaugguuaucaaacuuuuucuguaaaugacuagauauuuacuaguuuagacuuugcacaacuauagaguaguuguaaucacucaacucugccucuggaggaaaauauuuaagcuacugguugugccuauaugccaacaacauuguuauuuacaaaauaggcagugggcuagaucaggaccauggguuaaagcauuccaaaaucugauccaaucagcaaggagaacaauugagauucaaacuuaugucugccuaauccaaauguccaugcaccuuuucucuaacaucuucugccccaaagcauaaggcaaggcauaagguaucaaaguagagugcaaaaauaaacaagaagcaaugccugcccugugaaguucacaacugacaagaagaaaguuccuguauguacuuaaacaaaccacgaagaugauacugguagaggcauuacuaagucuccauuugcucauuuccauaaauaaucaagaacuccuuuucaaaacacaaucccugcaaaagaacccauaucauaaaaaauuguguuacccgacagcauauaacaauuuguguuccuauuuguuucauuaaucuagcuaauaaaacaucucauugguauaacaucauuaaguuuucccuacuuuauccuucgaaguaaugauaccauuuaaaacaaaccaagauuuuaguuauguuacgcaauauaaccucaggcuaaaugaaucaaauuuaacugagaggaacaacagugaaacuggagagccaugacauaucacaauguuuaauauaaugcagauggccagguucaaauaaaaguucugccauuuauuacucuuaugacugugaucaguuacucaaccucugugccucagauacuuuaucuguagaggaaaaaauuaguacuucccuaaauuaauguauguaaaacauucccuaagcacauacuaaauacgaaagguacaguaguuaaacaugcacaagauuaacugugguucuagauaacauaaauauaacauugucaguccauaaucucaguguagcuguuuagcgggaaacaaaaaaauauggaucugugaugaauaauccucuugaggugcaaaaagcaagaaauagaaguggagagaaaagaaaacucuccaggaacucaaaguccaggcaacuguggucuaaacagcaaaagauauuccauaguucuuaaaagcugccagcucaacuaugaaaggcaggcagaucuucagaaucuccucagcgcccagauaacagacccugcagaagggaaaguccuaaucccacccucaaaacaccugaaaccugaguggacuuaaucaaacuaaagcugcaauaaagcacaugcccagcucaaauauaaaucagauugacuucaccccacuguaggaaccuaagagaaaaagcagcacacccuuucuggaaauaauaauacucauuucagucaucauagacaaaaugucuagcacacaaucaaaaaaguacaagauauaauaaaaagcaaaaaaaaaucauuuaugaucaagauaggaaaaaacaaaauguugauuucauucaacagauugagaagcaaacuggaauuggcagaguaaaaguuuaaugacuauagagacaaaugaauaggaaguacagucgacccucaguauccaagggagauugguuccaagaccccucacagauaccaaaauccagagaugcugaaguccuuuauauaaaacagcuuaguaucugcauauaaaccaugcauauccuccuguauacuuuaaaucaucucuagauuacuuauaauacuuaauacaauguaaaagauauguaaauuguuauacuguaucaauuagggaauaaugacaaggaaaaaaagucuguacauguugaguacagacacaaccauuauaggccuaaauguauuucugauccacaguugguugaauccacauauccacccauggauacagagggccauauguauagaauugaaagacaaaaagagaauuuuaaaaaccaauacagaucuagggaaaaaaaaaaacuacucaguuuauguauaauuggaguacuaaaaggugaaaaaagagaaaaggggugauaauauuggaagagauauugacagaaaauuuuccacaacugauaaaagauaucaaccuacagaucaaaaaauugcagcaaacucuaaacagauaaauauaaauaaaacauaccuggcuacauagcaaucaaaauucuggaaaccaaauaaaaagaacauaucuuaaaaucagagaaaaaaaaagccacauuuaguaaacaauuauaugaguuacaagugacaucuaaccugaaauugugaaggcaaauagguaauggaauaauaucuauuaaauacuacaagaaaaagcagccagccuaaaagucuaccucccaagaaaacaaccuuuuaaaaaaaaaggaaaaauagaaacacucucagugugauaaaaaucuaacagaauuuguccccaggagauccacaucauaacaaaugccaaaauaaaguucuucagaaugaggaaaaugaaaucacacguuaccaaggaucagcaggaaggaaugaagaacuccaaaaauaccuggguaaauauaaaaucauuuuuuaguaucuucaacaaacagacacacagacacauacacacgcacacacacacacacacacacacacacacacacacagagugggguagagagagagggaaagaggaagggagggagggagggaaagagagacagagggagggagggaaggaaagggaaagagagaaugaacaaauuucauuaaaagacaaaugcuuaaaacaaaaauaauaacacuguggaguauaguauaugaagaaguaaaauguaagauaagaccacaaaucaaagggaagugcuaaugaaguuauacuguuuuaagagucuuacacuguucaugaaguaggauauuauuugaaggcagagugugcucauucaaaaauguaaauuguaauuuuuggcaaccacuuauaacaaaggccucuaaaaauuucccaguauugaauucuaagaaacauaagcucacaaucaaaacucaauaaaacacaagaaacaugguucuaucagcaaaaauuaguaguggaauuagaugcaaaaugauaugagccacaaaaugcaaaauacauagagcuaacccaugaacaauguaagcuugaacugcauggggccauuuauauauagacucugccaccccugagucagcugggccaaccccucauccucuuccuuuucagccuacucaacaugaagauaacaaggaugaagaccuuuaugaugauccacucaaugaauaaauauauuuucucuuccuuaugauuuucuuaauaacauuuucuuuucccuagcauaaguuauuguaaaaauacagcauauaauaaauauaacauauaaacuguguguuaauuguguuauaucaauaaggcuuccaguaaacaguaagcuauuacuaguuagguauugggggaguccaaaguuauaugcagauuuuuagcugaacugggggucagcaccucugacuuccauguuggucaagggucagcuguauuuuaauaaguuuuuaaaaauaaguauauuaaaaauauaaaaaagagacucuaaaugacaaauuauauuuuuagaaaucaaccauacagaauucuacaaaaaaauugaaauuagacuuauaaauaauauguugaauagcagauuacuccuaagaacagaauuagagaggagaaagacagagcugaauaaauaaccaaaaccucacaccaaaaacuauucaguaacaguauucaaaauguccagauccaacugaauggaguguguguuuauguguuaugucccucacucauaaaaaauauacuccaauugauuuacagaccuaaacuuaaaaacagaacagaccuauaaaaguauuauaagaaaauauaggaaaauauacugaugaaguuaggacaaauacggcuccuuaagaagacauuuaaaagacaaaagauacauaucaaaauuuaaaaaucauaaagaauaaaauacaacauaauuaacauaaaauaacacaaaaauacucccaauacauauaucaaaaauuguuuucuggaaaauauuuuuuaaagcccacaguuacaaaaaauauguaaaaaguucaauggcucuucauugccaguaagcacaugaaaagaaaaccaaccucaagaauaaagaaaaugaaaaaggaaaagaaugagaucuaaccuuacauuuuaaaucagaauauaucuaguuugggggucauguaagcuguuaugaugguuacggagaagaauuuaacauuguccauuaaaauuuaaaugcacagaaauaaugacucagcaggcugacuucuuauaaucuaaccuaaauauuugaaucuauggagaaggacuauauaacgacuauaauuucauuucuguuuauaauggagaaaauaguuaccucuggugggaacuggaauuaucagaagccaaaauuuuauuuguaaugucaaaauuuuuauaacaaagcuuaaaauuucaaacaguaaugaaaacgacaugguaaauccacagccacugggauacuaagaauuaaaacaaguaguaugaagggaaaacacuaaggaaaguuaaauaaauugugauaucauuugggucccauacagcaagccauaacaccagauuauaauacauagaaaagagcugaaaggccaacugacaaaacagcuuaaguaguuuucuguaaaaaaugaaauuugagauuuugagaguguuggaaaugggagacuuucuugauaauaucuaguuccuuuguauuaaagaaagcaaacucacagacacacacauaaagaaauuaaaccuuuuuacaagaaacguacaauuuaaaauuaaugugacuguggguauuuauaucuuuuuucuauuuucuuuuaauuagaugaaaauuuaaaacggcaccuaugaucucuuccagacucuuucaguguacuauaacuucuuuccaaucuaaccuacggugauaucaaaacuguucauccuuacagaacaaaauaaauaaauaaaaucaaacagucugugcucauugccagccuuguuuuauguuuaaugagcauggcuuuuccaggaacaauaacacccagcauaaaaugauucacuauuacaaagaucuggcuauacugcuagucagccaauguuccccaaaacaaaacagaaaauauauauacuaaaaugccuguuguaacaugauuacucuauaaggcagcuguuauuucugucuccaaagaacagcauuuaaaaaaccauucugcuguauauuuuuuuccucagggugguuaaaagauaaaugaaaaaauauaaaaucugaucauauucugaacaguuuuguacuuuuccugaugaggucccuuucgcucaccuaauaccacugacaaaauccccuuuuaacaaugccagcuauuuuuaaaauuugguuucauaaaaaaucaccacugagaugaaaaguuagcauagcaauucauaacauggaaugauuucuuuaugccucaguuauuaaaccauggaaaagaguauuuauaaucaaaaugcugacacaacauugacaguggugagaacagcauuguuguaauauggcugucacaguuguucauuauuugcagccgagggaaaucauguuccaaugucucuucuauaaaacaucaguuaaagaaaugccaauaccaacauucucaagcugcauuguaggaagcucucauuuuaguagcauauccauaagugccacuaaagccaauuuucagugucauagaaaaauaauuagauugaaguacccccacaaacacacccucauuuaucugacacguucauaacagaaacacaaaaccguaaaauagggcucucugagcugggaaaacaaagaguaauuaaucacauuaacagaaaacccgugcugaucagcaagacaugggagaaccauuucuggauauguggcucauuaucagggcuggagagaagacaggaucucucaccgaaggacagagcugguaugaguucugagugauuauauaauugaaugacaaguguccugcaguaccuuuuaaauggaaauuccacaaauuugcaaauccaaaauucaccuguaaugaauucuguacuggcaaguaaguucucucacuuagugaaaacauucauucauuaauucaacaacuauuaaucaccaugaugugcucuagacccugagcaacacagugaaugacaaagauccugcccucacaguugacuuauaucgggggguggugcagacaaaucuuuuaagugaaguaggcuugaauucuaaccaacugaaaauauugagaaagucauaauauacaaacugaauuuucauucaguauuuuuugcauuacagaaauuuaguuuuucuucaucuaauuuacaacacuaaccaaguaaacuuacuauauuuuaucuauuuaaauaucagcagacgacaauuuacauaaaagagaacagaagaacagaaaaucauguucuguuuguuuacaaugcuaugaaaauuaauuugagguguucagagcaccgcucugguagcuauguuacaagccaggcacauauuaaguggcaagaaacauguaagacuggucagaaguacucuacauggagcuuacaacauuuacauaauaguauuuccaggguccugagcaaagacuccaagaugaacauacaucuuuacuuuguuaacguuauacaacauuugguuuucaaauaaaaacccagcuggcuuauucuuucuucccagcaugaccacugacaacaaacagcaaaguacuugauuucaaauaccuagaaauaaauuuaaccaagaaggugaaagaccacuauaagagaaacuauaaaaaaaugaagaaagaaacugaaggagauacaaauaaaugggaaaacaucccaagcucauagauuggaagaauuaacauuguuacaaugacaguauuacccaaggcaaucuacagauucaaugcaaucccuaucaaaacaccaaugacacucuucacagaaacagaaaaaaauaacccuaacauuuguauggaaccacaaaugaucccaaauagccaaagcaagcuuaagcaaauaucaaagcuagaggcaucacacuacuagacaucaaaauauacuacaaagcuguaguaaccaacaacagcauggaacuggcauaaaaacagacacauacaucaagggaacagaauagagagcccagaaauuaccccacauaucuacagucauacgauuuggacaaaggugccaugaacacucguuagggaauugacagucucuucaaugaacagugccggaaaaauuggauauccacaugcagaagaaugaaaguagacucccacuucucacccuauacaaaaaucaacuuaaaaugaaucaaagaccuaaaccuaagaucugaaacaauaaaacuaugagaagaaaacauaagggaaacacuucaggacauuggucugggaaaugauuuuaugaauaaaaccucaaaagcaagggcaacaaaagcaaaaauaaacaaaugggauauaucaagcgaaaaagcuucugcacagcaaaggaaauaauagagugaaaagaagaacuacagaaugggaaaaaauauuugcaaacuacucaucugaaaaagaggauuacuaucuggaauacacaaggaacucaaacaucucaacagaaaaaaaaaaaaucugauuuaagaaugggcaaauggccaggcaugguagcucaugccuauaauccuagcacuuugagaggccaaggcgggaggaucacuugagcccaagaguucaagaccagccugggcaacauggcaaaaccucaucucuacuaaaaauacaaaaacucagcugggugugguggcaugugccuguagucccagcuacuugggaggcaaaggugggaggaucacaugagcucaggaaguagagaauacagugagcugagagagcaccacuaaacuccagccugggcaauggaagugagacccugucucaaaaacaaacaaacaaaaagaaacaaagaaugggcaaaugaucugaacauacauuucacaaaauacauacaaauggaaaacaaauauacaaaaagaaaggguaaacaucaccagggaaauguaaaucaaaacuacaaugaguuauccuuucaccccagugagaauguguauuauuaaaugacaaaaaguaacaaauacugguaaggacguggagaaaaaggaacucuuaucacuguuggugggaauguaaacuaguaaagccaccauggagaacaauaugaaguuucuucaaaaaacuacaaauagaacuaccacaugauacagcaauaccacuacugggaauuuaugcaaaggaaaagaaaucauuauaucaaagagacauauaugcccccucuauguuuacuguagcacuguugaaaauagcuaagauauggaaucaaccuagguauccaaugaaagaugaauaaagaaaauguggcauguauacaccauggaaugaaaucuugucauuugcaacaacauggaaggaacuggaggacauuaagcgaaauaagccaggaacagaaaauuaaacacugcacauucucacucauauguggaugcugaaacaaguugaucccauagaaguaaaaaguaaaacgauacuagaggcugagaaggauagacagaaaggaggaauugggagagauguguuaaaagauaaaaaauuacagcuagauaggacuaaguucuauauuucuguggucuauaccaguguaggaugacuauagcuaacaauaacauacaauuucaaauagcuagaggagguauugcauguucccaacaucaagaaaugauaaauguuugagaugacggauauguuaauugcccugaucacuauacauuguauguacugaaacaccacuguguaccccaugaauauguacaauuaugucaauuuaaaaaacaauuuuuuaagaaaagcaacaaucagauugagagaccaacugaugccccaccaccaccaccaaaaaaaaaaaaaguacaugauuucuucaucaugucacugaauuaauuuuugccacucaagagaaaugccugcacugcaguuuuuccacacucuuccuggggaucucucuccucauugcaaaagagaugugccuugcagcccagugaccuccaggcaagcacagccugguguguaguacaguauguuaggcucccuguaaugucacucauuauucuucuugacuuuacuugugcuuucuaguugaagcacuaaagauuaaugaggcauuuguucucaaucaagaagcuauuuaugaauacaguuccacuuacaguaagcuaucuaaacuucuuuuuauuucucuccauuacagagcagaggugggggguguuauugagcaaaagaaagaggaaagaacagagaaaaaugauuugugacuuuuuagccacucagcaguucccuaacaggacggcuuccacaucauagcuaugcugucaggauaacugauauccucuuaugugcucuucuguuugguuaaagugaaauaauuauuaccaccauggccuuugcaggccaagguuuaagucugcagcaauucagaauaaucugccaccucaggaggcaagaggugauuuugaagccaaaucuauuaccucaaaugagagaggagaguccuguccaguguuuuaagagacaccacaguagggaagaauaagauagcaaaagcaaccacuuggcuacccgcccaauggugaauguccugccuuugacaagaaccgggccuuucuuuuuccacuaguuuuacuuuguauaaagaucaaagucggccuugcaggcugacagccucucaucaccuggucuugacaguaucccguggaauuaaaaaaaaaaaaaaaaauccagcauaaaacagaucagagggaacagcaaugccaccaugaacucucaaggccauaagccaaucugaucucaaaaucaaucgcucugaucuacaaagccgcuucagagcucuucgaaaaagaaaaaugccaaugcuguugucaguugggaaauugaauucaagacguuauccaguucugggaaagguccucuaggcagaaccuagaguacauaugaaagggaaaagaaccugcucauccaaccaauaaugcuaauuauucuacguuaaguagaaaaccaguaacgccagaaguuagugcuggcuuuauuuucaauguaaacaaacaaaaacuagucaaauacauuguucaggauuaggucaguggcuuggccuucuuuccccuccaaaaacaaaagcugagcagaggaggcaaggccugggaaugagauggucuggcauccugguucucuuaggacacacaagagugauccugggcaaaggaaucacaacucuaacacccuccgguucauuaguuguaaaacgaggcuucugagauagacgaagaauuccuuagccuuuaucgguaucaaguucuguggaaauaaagaaaagucuaucccugcuaguuauauuagcuuacaugaaaauccauaguuauucugaacacauagguccaaaguucgaaaaugaaacuacuuucucuaaagcagaagauuccaagagacaaaugcuugguaauuucuaacaucaauuaucagcaucauuauuuuuauuugggagguuggacagggguaauaaagguuguguucuggaauaaaaguaacauaauccucaaccauacaaauuuucuuuaauaaucucuacccuaagcuaacucuugcuguagacaggacagaaaguugccuucagauucaacugaauggaguuagguugcuucuuacgagaugugccuccaucuacaggaauuacgcucaauuuauuggacucagcuucaaacaguguugggagucaaagauucuaccuaacauucuuucaccaccugccuaauauuauggaaaaguaaauacagaguuacagggguuggagcuucgugguucacaaagaugucaagaguuaccaguuuucuaagacaugaauugucuuuaccugaaacuuaagguuggaaaguagacuaagguauacuccaaaguuccagaggucugauaaauauuuuucaacaagucacuuacaaucucuagcucacaaaauuuagcaguacuaggggagugggauuuaugaagaccauuacaccucagauaguucuggaaguuaauucuauaacuaugauuuaugcagacaaaugacuucacuuugguucagaagacaaauaaaauggccacgugcagcacugaagggcauuaguggcaaccauuacuuaauaugcagaugccacuuacuuauaaccaagcaauauuuuauacacacacacacacauacacacacacauauauauauaaaauauugguggcuguuuauauauacauauauauguaucuguguguguauauauguacacauaaacagccaccaaaauaguuuuuuuuaaaaucacuccaauuguauauuccauucuuuguaaguggaaaaggaaagcuaauuccaagugaucaucaagauauaguuugcuuauaucuaauuguuacuacaauuuuuaaaaaaacuggccaggugcaauggcucacgccuguaaucccagcacuuugggaggccaaggcaggcagaccaccagaggucaggaguuugacaccagccuggccaacacggugaaacccugucucuacuaaaaauacaaaaaaccugggcaugggggugugcaccuguaaucccagcuacucaggaggcugaggcaagagaaccacuugaacccaggaggcagagguugcagugaaccaagaucacaccacugcacuccagccugggcaacagagccagacuccaucucaaaacauacauaaauaaauaaauaaauaaauaaauaaauaaauaaauaaacaaguaaaauaaaggacacaaugaauacauguauggcuaaguuggaaacccauuucauguuuggguuuugauuucuuaaaaccauuuugggaaaaagaaaaagaauguuauguuuauuauauguacauaauaaauacaacuuucuuuaugauucugcagaguaaaauaaaugcuuuucaguaaauaauaaaugugcauaauuaccuaguuuaugcauuccauuauauggaaugagaauuccaaccuauaaagugcucuuacauuuuucauuacaaaaucuaguuuuugauagcauggcaauagucauccaaaacuauaaugguauaauggauagcugcuuuuuuuguuguacuauauuacuaucaagcauaaauauucaaauucuccugaauuaacuguaaggcauauauugaaauaaaauggaauuuaaaauacaauguacuuugcaucaaagcagacaggguuacaguaaggccuuaaaauaacuuuuuuauuagacuuuauuuuuuauagcaacuuuaaguucauagcauaauugaaggguacagaaacuucccaauuaucucuugccugcacacauacauagcuuccaucauuaucaacaucccccaccagagcagcacauuuguuacaacugaugaaccuacacugacacaucaucacccagaauccacaguuuaguuuaggauucacucuugguguuguacauucuauggguuggacaaaaguauaaugacauauauuuaccauuauacuaucaaacacagcauuuucauagaugaaugauguauaaugaugaaaauauauaaugacauguaauuagucaucuggucaguauuuaucagugucacauguuauucuucuauauuucucuuacccaccaccucuagguuaaaaaaugcaaugaguaaguaaauucaguuuuauuuaaggucccuaauuuuuaagacaaacuaauuaaagcaaaauggaaauacaaagcaagccagaauaaacaaauucuagggccaaaaagaaccuuggcugaagaucuuuaauaaagccaaaucuucucauuauauuacuuuuacaucuuccuucaauuuugauuuaauaucuagauuauagguauacuggcuacuguauuuacccugccugaccuccaagaauucuuuaagguaacaaaaaagcucccuagaaggacauagcacaacugauacuuuauuuggaguuuuucaaacuggcaauaaacaaugacaccauaggcuuaaugcugccauguacagauuccaggcaacucaugauuggucaaagucauaaaagggaguuggauguuacauucugugacuuucuaugauguuacauuaucaaucuucacaugcaguucucauucauauuuguggcacucuaacaaaaucccacagcccucaguccccgaaagguccuggaagaaacauccaaauuuccuggagagaaacaucuaccaaaugcuauacugucccccaaauuaaaaaauaaucuuacacacauuccuuuuuguuuauuaauuuauucuuauauuaauuuuauuuuuauauuuacucuuuagaauuuuauaauuuaaauucuucagaagaucacacaaaaaauucuccuauuacuuauuagcaauuaccuuguaauacucuacagaagauuaaggacuuggauuauaauuuauuggaauagagguaaacauuuagguuaucaacauauuccaggcauuuaacuaacauccuccuucauaauuaaaaguauaucccuaaaguaguguugauguauuucacagaaauacuuagccuuaacaauuuucaguauaggcaaaaaaaaaaaaaaaaaacgguggggggaaacccagaaagaaagcucuccaaauucuacauuuuuauggugagcauauuggcauuaaauuuuaaauuagcaauagccugcaggagaaacugaugcacagauuagacacaaacuguagaaacuuaagucaaaaguaaugagaggauuuuggagacagggcagaacaagauggccaaauagaaggcuccacgaaucauccccucuggaggaacaccaaauuuaacaaccaucuguauaaaaaaguaccuucauaagaaccaaaaaucaggugagcacccacaguaccugguuuuuaacuuccuaucacugaaagaggcacugaagacgguaggagaaacagucuugaaucaccaacgccgccccucccuuauccccuggcaacggucacauggcacaggagagcacagaaauuguaagagaaugcacugaauuccgugcugcccaguuacaagagaaagcaaaccuggcugagcugaccuggcgccugcccacagagggaauauuuaaccaguccacgucagagggagaucacacaucccaguuccagcaagccuugccaccacgggcuagaguacucuggggugcgaaauaaacaugaaaggcagucuaggccacaagaacugcaacuccuaggcgagucauggugcuggacugggcucagagccacuggacauucaacuuacugagacaccagucgaggcagcugaggaaguacuugugccaccuccgaccucaauuucaggcagcagagcucaauuaaagagaucccuuccuucugcuugaggagaggagaagagagaguaaaaaggacuuugccuugcaucuuggauaccagcucacccacuguaggacauggcacugggcagagucaugaaggcuccauugcagggccuagcuccuggacauuucuagacacacccuuggccggaagggaacucacugccuugaaacaauggacccaguauuggcaagacccaucaucugcugacuaaacagcccuugagcccugaauaaccagcagugauacccagaugguaccccgugagccuugggugagacuccgagacuugcuaacuuuaguugcaagucagcacauuccuagguaaugguggccacaaggagagauucuuucugauaagaaaaguaggggggaaaguaaaggugacuuucucuugcaccuuagguaccagcuuggccacaggaauuggaguaccaagcaggaucuugggguccucaauuccaggccuuggcucuuagcauuucuuuaccaguucugggccagcggggagcccagugucccgaagggugagucccaggcuggcacuauucaccacaaacugacuuaagagcccuagggccuuaacugaauauuggugguagcccagcaguauucuccaugagccuguaguaguggcggucaugggcugaggcuccucugccaguagaaaugggaaagaaaggugagaaguacugugucuucugguuugagugccagcacagcugcaggacagcagaacaccagaaagacuucuaagguuucucacuccagucccuagcuccuggaugguaccucaguacgcaccugggcccacaacaacucaccaucaugaagggcaggacacaagccuagcuagcuucaccaucugcugacuguagugucccaaggccugagcaaacauaguaucugguagccaaguagugguuacagugggccagcguuaggugagaucuaaugcugugcuugcuucaguucugaaccagcacaguccuagaggugguaacaacagagagucuucugucacacuaccuacagcuccacauggcucagaacaaacagagagacucccuuuguuuggaagaaaguaagggaagagaacaagagucccugccuaguaauccagaaaauuccucuggauuuuauccaagaacaugaagacaguaccucugcaagucugcaagaaccacaguguuacugagcuuggggugucugcuaaugcagauacagcuuagaucacaaugcucaaguccuuccaaauaccuggaaagccuucccaaggagaauggguaaaaaccagccuaggcuuggaagacuacaguaaauaccuaacucuuuaaugccuagacagaugaacauccauaagcaucaagacaauccaggaaaacaugaucucaccaaguaaacuaaauaaggcaccaggggccaguccuggagaaacacagauaugugaccucucaaagaauucaaaguaacugcucagaguaaacucaaagaaauucaacauaccacaaggaaggaauucaaaauuauaucagauaaacuuaacgaagagauugaaauaauuaaaaagaaucaaguagaaauucugaguugaaaaaugcuacugacauugaagaaugcaucaaagucuuguaaggacagaacugaucaagcagaagaaggaacuagugaacucgaagacagguuauuugaaaauacacaaugagaggagacaaaagaagaaagaauaaaaaccagugaagcacaccuacaggaucaagaaagccucaaaagggcaaaucugagagucacuagccuuaacgcagaggcagagaaacagaugaggguagaaaguuggucaagaggaagaauaauagagaauuucccaaaccuagggaaugauauuaaugucaaaguacaagaagauuacagaauaccaagcagaucuaacccaaagaagacuaucccaaggcauuuaauaaucaaacucccaaaggucaaggggaaaaaaaggauccuaaaagcagcaagagaaaagaaaaaaauaacauucaauggagcuccaaauaugucugucuggcagcagauuuuucagugaaaaccuaacaggccaggagagagugucaugacauauuuaaagugcugaaagaaaaaaaaacauuuacccuaaaauaguauaucuggugaaaauauccucugaacguaaaggagaaaaaaagacuuucccagacaaacaaaaccugagggauuucauaaacaucauaccuauccuacaauaaaugcuaaagggaguuuuucuguuucuuuuuuuuuuuuuucuugagauggcgucucgcucugucacccaggcuggaguacagcggugcgaucucggcucacugcaaccuucgucucccggguucaagcgaucuccugccucagccucacagguagcugggauuacaggugcucgccacaacacccaacuaauuuuuuauauuuuuaguacagauggagcuuugccacauuuuccaggauggucucgaacuccugaccucaagggaucagcccaccucagccucccagagugcugggauuacaggcaugggccaccguguccagccugggaguuuuucaaucagaaagaaaaggaaguugaugaguaauaagaaaucaacugaagguccaaaacucacugguaauaguaaguacacaaaaaaaugcagcauauuauaacacuguaaaugugauauauaaaauacucugaucuuaaggagaaagacuaaaagaugaaccaaccaaaacuaauaaugacaacuuuucaagacauagaaauuauaaugagauauaaacagagacaacaaaaaguuaaaaagcaagaggcuaaaguguagagcuuuuauugguuuucuuuuugccucuguguguuuuugccuaugcaauguuaagugguugucagcuuaaaauaauagguuguaagauaauauuugcaagacucaucauaaccucaaaucaaaaaccauauaacauauaccuaaaaaauaaaaaggaagaaauuaaaucauaccacaagacaaaaucaccuucaauaaaagaaaugaaggaaugaagaaaggaagagaagaccacaaaacaagcaaaagacaaacaauacaauggcagaacauauccuuacuucuuaauaacaauggaaacgcacuaaacucucaaaucaaaagacacagaguggcucugaauggauaaaaaaacaagacccaauuaucuguugucuacaagaaacacauuucacuuauaaagacacacauaggcugaaaauaagcagaugaaaaaaagauauuccauggcgacaaaagcaaaaaagagcuggaguagcuacacuuguaucagucaaaauagauuucaagacaaaaacuguaagaagagaaaaauaaggucacuauauaauaauaaagaggucaacugagcaagagaauauaacaaucauaaauauauaugcauucaacaguggagcaccuagauauaugaagaaaacauuaaaagucacgaaacaacaggugcuggagaggauguggagaaauaggaacacuuuuacacuguuggugggacuguaaacuaguucaaccacuguggaaguugguguggcgauuccucagggaucuagaacuacaaauaccauuugacccagccaucccauuacuggauauauacccaaaggauuauaaaucaugcugcuauaaagacacaugcacacguauguuuauugcagcacuauucacaauagcaaagacuuggaaucaacccaaauguccaacaaugguagacuggauuaagaaaauguggcacauauacaccauggaauacuaugcagccauaaaaaaugaugaguucaugcccuuugcagggacauggaugaagcuggaaaccaucauucucagcaaaguauugcaagaacagaaaaccaaacaccacauguucucacucacaggugggaauugaacaaugagaacacauggacacaggaaggggaacaucacacuccagggacuguugugggguggggggacgggggagggauagcauuaggugauauaccuaaugcuaaaugacagguuaaugggugcagcacaccaacauggcacauguauacauauguaacaaaccucacauugugcacauguacccuaaaacuuaaaguauaauaauaauuuuaaaaauucaaaaaaaaaacaccuugaaaagaaaauuaaaaaaaaaaaacgaaaacauuagagauaaaaagagagauagacuccaauacaauaacagcuggagacaucaacacaccacacucagcaauggacagauccuccagauagaaaaguaacaaagaaauaucacacguaaucuacacuacagaccaaaucgaccuaacagauauuuacagaacauuucauacgaaggucacaggauacacauucuuuuccucugcacacagaucauucucaaagauaggucauguuaggucacaaaacuugucuucaaacguucaaaaaaagugcaauaauaucaagcaucuucuuugaccacaauggaauaaaaauagaaaucaauaacaaaaagaauuuuggaagauguacaaacacauggaaaugaaacaauaugcuccugaaugaccaguggguccauguagaaacuaagaaggaaauugaaacauuucuugaaacaaaugauaacagaaacacaacacaccaaaaucuaugggauacagcaaaagcaauacuaagaggaauguuuacagcuguaagugcuuauauaaaaaaagaagaaaaacuucaaauaaacaaccuaacaaugcaucuuaaaaaacuacaaaagcaagagcaaacgaaacacaaaauuagacgaaaaacaauaaugaagaucagaguagaaauaagugaauuugaaaugagaacacaacagaucaauaaaacaaaaagauguuuuuuaaaaagaaagaaaaacaaaacugacaaaccucuacccagaguaagaaaaaaggagagaagaucaaaauaaauaaaaucagagaugaaaaaggagacauuauagcugauauuacagaaauucaaaggaucacuaguagcuacuaggagcaacuauaugccaauaaauaggaaaaucuaaaacaaauggguaaauuccuagaaauauucaaccuacuaagauugaaucauaaagaaauccaaaacccaaacagaccaauaacaaguaaugagaucaaagccauaauaaaaaggucucccaguaaagaaaagccuaggacccaauggcuucagugcugaauucuaccaaacauuuaaauaagaacaccaauccuacuuaaacucuuccaaaaaguagaggaugagggaacacuuccaagcucacuccgugaggccaguauuacccugauaccaaaaucaaaggaaacaucaaaaagaaaaccacagccaauagcccugaugaacacugaugcagaaaucuucaacaaaauacuagcaaaccaaauucaacaacacauuaaaaagaucauucaucaugaccaagugggauuuaucccaggaaugcaaggaugauucaacauaugcaaaucaaucaaugugauacaucauaucauuagaaugaagaacaaaaaccguaugaucacugcaauugaugcugaaaaagcauuugauaaaguccaacaucccuucaugaaaacccucaaaaaacuggguacagaagguacauaccacaacacaauaaaagccauauaugaccaacucacagcuaguauuauuuuaaguggugaaaaacugaaagccuuuucucuaagaccuguaacacaacaaggauuccuauuuucaacacuguucuucaacacaguacuggaaauccuagccagcguaaucagacaaaaaaaaaaaaaagaaauaaaggguuugcaaauuggaaaggaagaauucaaauuauuguuguuugcagaugauauaaucuuguacuugaaaaaacuggaagacuccaccaaaaaacuacuagaacugauaaauucaguaaaggugcagaaaaucaacacauaaaaaucagaagcauuucuauauaccaacagugaacaaucuaaaaaagaaaucaagaaaguaaucccauuuacaguagcuacaaagaaaaguaaauaccuaggauuuaacuuaccagagaagugaaagaucucuacaaugaaaacuauaaaacacugaugcaaaaaauugaagaggaaacaaaaaaauggaaagauaauccauguucaugaacuggaagaaucaauacuguugaaauguccacacuauccaaagcuaucuaaagauucaaugcaaucccuaucaaaauacuaaagacauucuucacagaaauagaaaaaaaauccuaaaauuuauauggaaucacaaaagacccagaacagccaaaacuauccuaagcaaaaagaacaaaauggaagaaucauauugccuaacuuaaaauuauaauacagagcuguaguaaccaaaaugacaugguaauggcauaaaaacagacacuuagaucaguggaagagaauagagaacccagagguaaauccauacaucuacaguaaacucauuuucaacaaagaugacaagaauauacauugggaacaggacagucucuucaauaaaugaugcugggaaaacuagauacuuaaauggaaaugaaugaaacuugaccccuaucucuucccauauacaaaaaucaaaucaaaauggacugcagacuuaaaucuaagaccugaaacuaugaaacuacuaacagaaaauauugggaaacucuccagaauacuggucugggcaaaaauuucuugaguaauaccccauaaacacaggcaacgaaguaaaaauggauaaaugggaucacaucaaguuuaaaagcuucugcacagcaaagaaaaacacagugaagagacaacccacagaaagggagaaaacauuugcaaacuacccaucugacaaaggaguaauaacuagaauauaaaaggaacucaaacacuauaggaaaaauaucuaauaaucugauuaaaaaaugggcaaaagaucugaauugaacuuccucaaaagaaaauaugcaaacgacaggccaggcccaguggcucacgccuguaaucccagcacuuugggaggccgacgaaggcagaucaccugaggucaggaguucgagaccagccuggccaacauggugaaaccccaucucuacuaaaaacacaaaaauuagccgggcaugguggcaugcgccuguaaucccagcuacccaggaggcugagaauugcuggaaccugggaggcagagguugcagugagccgagauugugccacugcacugcagccugggccacagagcaagaccccaucucaaaaaaaaaaaaauacauauauauauauacacacacacacacacacacauauauauauguauguacaaaugacaaacagguguaugaaaaggugcucaaccauugacacucuucacaaaaucagaaaaaacuaauugaacacaugaagccagagacuaggaggaugguuaccagaggcuaggagguaaccagaggcuaggaaggguggugggggugaggggaaugggaaugguuaauggguacaaaaaaaaaaaaaggaaaaugaauaaaacaguauuugcuacacagcaaggugacuacagucaaaaauaauuuaauuguacauuuuaaaguaacgcaaugaguauaacuggauuguuuguaacacaaagcauaaaugcuugaaaugacguacaccccauuuaaccugaugugguuauuauguacugcaugucuguaucaaaguaucucauguaacccauaaauauauacacuuacaacauaccaaaaaaauuacaaauaaaaauauuuuuuaaaaaguagugagauguacaugaagagucaacauaaugagacacagauacuaauaucaagaguauugacuuuugauaccuaaaaucuggauuugguaauguuuggaacgugcucuaaaaugauuauauaacaaaggaggaaaaauugcuccaaaaagaauuauauaaauugaccaaaaaggguuucaaucaaacagagcugaaaaugaaauaauaaagcugauuuauaagccauaagucaaacgcuauagcugucagauaguugugccuauuuauuuggguaauacugaaauaggguaaggcagggacucaaagcgaugauaucuaauuggaauuaugaaauauauaaacuguauccaaggauugacaguuauuuguggaguucuuuguaucauuucauuucaguugaaguugggcauagggccauaauucuagaauccaaauuaggguacaauaaaaaauuguaacuaaucucuccucaagcauaugcaauugaagcugcaauauauauuuugguuuuuauuuuaauggacgugaauggaaaaguaagaaaaugggaacacaaugaaucagagugacgucugaagcuaaucuuuagaaaugaugaggacacagaaagucacagauaaagauccagcccacaucacuaugaucucuaucuuccuaauuugagucuagagcgacaucuacucuuuagaauuggaaaauaaaaagagagcugaucuaugauuauugacuccagccaugcguacacccuccacuuucuguuuugcccaggcugaagccgaaaaaauuacuccauuuuaguaugaauuuauuuauuuaugucugggaaugggugaaauaauaagaugucuuugcuucuaaaauauuuuuauauauaaaaauauuauauuuuuauauauaaaaauauuauauuuuuauauauaaaaauauuauauuuuuauauauaaaaauauuauauuuuuauaauauagucucucuuuuuaaagagaaucuuuaaaaaauagaaccaccacauacaauucucauauaccucauaaaaaaugaacacgaggcguugaaaagcacuuaccaugaaaggaaacaccaacagaacaauuaaauuuguuguauaaucacgugucucaaacugaauaugcuauaggaauauuuuacguuccugaugaauaaccuuaccuucacaaggcagguuuuuuaaaaaaaaaauuccagggaauuaggaaugagaguuagugaacuacaagccaccaaugaaauaucaucugacuucagcugcacuauuugauuuccaugagcuccuuuagagcccuuuauuuacaaggaggcuagggcuccucuggaguguaaaacugaagauaugagauugauugcugaagaagucaguuuuaaggauacuuuaaaaaugcaaucauugcagccacaaaauuuaaagaaaucauacuuaaguguuuaguaaaaauuaauauuguaacacucaccacgacacuaaaucagaggguuaaagucagaauaucaauacugucaguuacuuuucuacaauauuuaaacuucauucaauuauuuuuucaacagaaauaggaagggagcuucauagaaaaaguacacucaaauggauacgcugaaaaaacaaguggaauccacugugaauucagaucacuuacagguagaaauaaauuauguaggucuaaaaaucauuguaauguuauauucaagaguucccaguucaacuguaaauugacagagauuuacauaguuucaauauuaaaauacaaauagcaagauuguauuuucugagggggcaaggaguuaaaauuaauagaaagaugcuuuaagucuauuccaaagagugauuaaucauagcauuuucuguaugaaacaugcuacaugaaaacagcauaaucaaucagaaccagcuuuagaaucagggugaguggccuaggccuggcccuagguugccaugcaaagacaaugguaccuuggacaacaggacugcucagugugugagcacaggagccaggcaguaacuguggauggaacagagaacucuuaaugccuuggugagcugaucagauaaucucuaacuucuaaauuuaugauucagggcgaaggagauaacaucacugaccaaacugauucugcaauacuuuauguuggcucauauacuaggaauaggaccuauauaauaaauaagagcuugauauauuuguauggucaagauuagaagcaggacuuccuggcuguguuaaauaugcuuuacauuuauuaacauaauaaucacaugaaaggaaauauggucaugugucacauaaagacauuuuggucaaagauggacugcacacaugacaguagucccauaagauuguaaggcuguuaugucuuuuguaccuuuucuauguuuagguacacgaacacuuaccauuguguuaaaauugccuacacuacucaggacauuaguagcaaugggcuacaucguacagccuagguguguagcaggcuauaccauccagguuugugucaguacacuguauuauguucacacaaugacaaaauugccuaacgaugcauuucucagaauguaucccugucauuaaguaaugcauaccuguaccaaaaugcuuucugggcccacugaugcagggacuucuuaaaugggagguaaaaccucuaacauuaaauauaccagauuauucagaccauaaagaguguccauauuuuuaucccuucuuucacuccccaaagugaaugccagcaauaaaaucauccagaaagacaccacucucagacuuacugagaacuaaauauacacagucaugacaaaaauuuucaucauauaaggcguauucuuuauauugucauucagguuuuuaacuucaguugcaaggaaguguaauucucugucauuagagaucauugaggaauaaaguaaaugcugcuauuacagcugaaaucaucgagcugagcaccugcucugagaucaugagugaggcauacacugcugaggucugauuguucgucacuuucaagaauguucugauuccucuugaaagacaauuuuuaagaaaaauuaagguaaaacuuaaucaaauggcaacaaaguugacauagauuguuagaauggaaaacaaagauuugaaguaagcuaaacuuuuauaacauuauuauuauuauuauuuucuucugcccccaaaaaaaucugcaggaaaguaguaagguaaauuuuuaacaaggucuuuagaaaaacaauuuaggucaagucaauucuuggucucuaaauaggggaucauuuguuauuaaauauucugccuaaaauucacagcaaugccuaguacagaccagaaacucuaaaauguauuaaaguauaaauguaaggaugaguaaguggggaaagaccucaugcuaguugaaaaguuagauaugaugucaggcacaggggcugauaccuauaaccccagcacuucaggaggccaaggugagaggaucacuugagcucaggaguuugagaacagccugggcaacauagugagaccuugucucuacaaaagaauuuaaaaauuacccaggcaugguggcgcaugccuguagucccagcuacccaggagggugaagugggaagaucacuugagcccaggaguucgagacuguggugagccaugauugcaccacugcacuccagucuggaugacagagugagacccugucucaaaaagagaaaaauaaacacuggauaugaacacaguuucuucaggggucacugaggaucccccaccuugacuguuacuugaaauacuuauuuucaaguauugcaaaauagggauggacaagaaaaugaagaaaaauucugaagccuugaaaauguaaauguggacacgauaaauugacagucccugcagcuuccuaaguagaggacugccaccagaaauuuaccuaauagucgggcacaguggcucacggcuguaauccuagcauuuugggaggccgaggcagguggaucaaaugaggucaggaguucaagaccagccugacuagcaaggugaaaccccgucucuacuaaaaauacaaaaaucagccaggcaugguggcaggcgcccguagucccagauacucaggaggcugagacuggagaauugcuuaaccugggaggcggagguugcaaugagcugagcucacgccacugcauuccagccugggcaauggagugagacuccaucucaaaaaaaaaaaaaaaaaaagccaggaacaguggcucccgccuguaaucccagcacuuugggaggccgaggcgagcagaucacaaggucaggagaucgagaccauccugguuaacacguugaaaccccgucucuacuaaaaauacaaaaaauuagccaggcgugguggcgggugccuguagucccagcuacuugggaggcugaggcaggagaauggugugaaccuggaagguggagcuugcagugagccaagaucuugccacugcacucuagccugggcgacagagagagacuccgucucaaaaaaaaaaaaagaaaauaaauuuaccuaauauuucuauaauggauauagaaccagcagguaagaugcuuuugagagggaagacuagaaacacaaggaagugcagaacugcacauauaagcaccugagcaaucuuaucuuuucccuagacuuaaauguguccacaguggguagggugggaagaaagguuaagcaauacuaaaauaagcuacuuacugcuguccacgcauuucuuuugcaccgggcacacagccauccaucacagaucucaugagaaggaauaccauaacaaccuauaaaauaauaguauguauccaugcguuaggucuuuuucaccuuuaaaauauugcagaucucaguacugaaauaaauaaaaaugggacacuagccuaccauacugucuugauucucacuguauagaacaaaacauaagcaaggugaaugugagucuuacugauaacuaacacaacaguuacagugaauacuuauggaacaucuugaauggguaauaaaauuuuaaacugucaagucuacuaauuuguucacacacagacaucuuaaaauaaguugcaauccauggggcaaaguuuaaggaaaugucaaaaauaauauaauaaauacauuuuaaccuaauauuuuuaaauuaauauaauuuaaaauugcuucaaaaauuaagucuaacuaccuuuaaccucaaugauagggcaaaugcugcaaauucagaguuagcaaugaaggaguauuuucaauucgauuugucuauucaguucacgccugacccaaaauaacuaucuaaggugauggcugaugaugcaaauauacauagcaauuauauggcaucaaggaacacaugucacucugacuucuugagauaagagaauucugaaauauuuaaaugaguaauuuuuaauauuuccaauauuaaaaaccccuccguauaagaggguuaagauuuaaugaguaauuuuugaaaauuucuguaacauuugagaugaaaacaaaauaacagaaauguaauuucccaaggaaaaaaccuaucacaguuaaccauguccaugaaauaaugaguuaaagcauauguguauaaaauaguauggcuacacugcauagcugcuacauucaggaaucagauuauaucccaauuauuuuguguccuggugcuuuaccuauuguauacacauaauaauguaagguguguguguguguguguguguguguguguguguguguuacaaauugccuucaauacaaaaagaagauggcuacgauuauauuucaagcagauagcauuuaaaucccuugaggaaguagguagucucuaauuaauuaauaaaugauagaugaggaagcuguuucaacccuaauacaaaggaauuauuacucugagguaaauacagaagauaauaucuauauuauaaaccauucaaacuacauugacaaaguacaggccauaccuaaguguguuacuagaaugugugauuugguaagaucuggaauauuaaaaugccuuaaaauagaguuguauuauaugagaucccuuuuacauaguucauaggauuuacauggcagaccaauaaauauuuaccacuuauccaauuguuaaaaauaauaaauugagauagguguggagacuaucccagugcagggguaaaacaacuguaaugacuguucuccccuggaauacaauagagauuccuauccucacgaaugaaaaaaaguuaacucaguacaacaauucucagaacaaccaaaggaacauucauuucucuuuuaaaagucacaaagaaaagcagucaucaaucaguaucagacuuucaaauuaaguuuuuauaaacuagaucuuaaaguaaguaaaauccaaacaugugaaaggaaccccaucaugacuccucaacuggaccccaaacaaacaaaccaacaaaaaaaaccagaccugcucuccacggauacuacaugaaaguggugaaaaaaggaugaauauaccaacucauacuuuuaccagcagaaauaugaaaaagaaugauauaaccauuaagaaugccaauaguccaugcaacagaucugacagguuccaaaaaagugagaaauaaagaugaugugaaaugcugaaaagccagugauugaugaauuauagauccauuuacuugcaugaacccguacgcagcacuuugcacaggaaauaaggagacuuguuccauccucuucaaggaaggcauuggguggagaauauucuauauuuucuucacuauaaauaaaacacaucucugguaugaggggcuuagucuuucccuccgauguaacgacuucaucuaauuuugucucccaucuagcaucauuuucuucauugcugcuaucuggcugaaaaacauaacguuuccacaugagugaaaaacauggaaaagagcucaucauucuagucacucaaauccacuaacuccuguuccagacacuaacuucuaacuuuuguucuuccuguuguucuccuugaccaaacuacuaguuuuuuuuaaaucaauauuccaccucagacucccacccaaauguuaaucugcaggaaaaggacaauauucuauaugucuguucauauaagaaagcaacuggcuacuaaaacugugucuuuccaaaauuaguucguggaaagcaucaauucuuuugcuucuucauaugcacuagaguuaacagaucuguuuucauuuacugaagaaucauaccuugcuacacuugaaggaguguacaaagaccccaguuuuaaucugugcagcaguauuaagagaggcuuuaagaauuuuugccucaucacuugcaguauuugaaagcaagugagagagaacuggcacaugucacuaaauaagaaaggauaauguaucaaacaaaauuaucaccucacaccaaaagauuuuaaaaaguuuaguacuuacuugaaaguauaaguaaugaauuaccuuacagauuuuauauuacuuuauguuuuauacuguauuacuuuauauuaaaucuccacaaaucuuauuauuuuaguuugaauuuuuuaauuauugagaaauauacagauuauaauauagaaauaagaaucaauaaguaguuaaaacccagaaauuuaaugacuaaaggaagagaaaaauaauguuugucacucaccagugccacauuaaaaaacaugaagggaauaaauuauuuccucuguuacaaaggucugaaaaugugagauaucacacauuuucuugcucugaaaugucugaacagaacaguuuauuuuuauaaggaacucuaagacagacauaaucuugaauaaaauauuuguuucuauaaauaaaaauauaacccaaaacacaauguucaugucaauauacuucauaauauauuguaccuuaaaaugaaccacauaguuccacccuuacgagauuccuaaaaauauuucaacuguuugagugcugaggacugugacccuccauuagcugaggugcuaucaguauaauaucuauggaaugacgcugaaaacaacaucacgcacagccagcugaugaggaugaacuggaaaauuuaguuuguagugagucuuggcugugucuuuugcauguuccacaugggaaggugaaaagagacacuuaaaauuuggaccuagggcugacauuucuauuauuugagaaugacguuuucaaacaaaaaaaaacagagauuaaguuuaaguucucucuuugaaagcuucuacuauuuguaagcuuuaaguucuguguuucuuaguaaaagagauagaaaaguugaaaguaacccacccaugaaauaaaauaagauacucaaaaaagauuugggagaccaaagcggaaggauugcuugaggccaggagcucaagacuagccuaggcaacauaguaagacccagucgcuacaaaaauuaaaaaauaaauuuaaaaaauuaggcagguaugguggcucacaccuauagucguagcuacuguggaagcugaggcagagggaucgccugagccagaguacaagccugcacggagucaugauugugccacugcacuucagccugggcaacagagcaugacccuaucucaaaaggaaaagauaaaguacuuucagaaaagugucucucaaggaucauguagaaacuguuugugguucuaugaaagccaucagcuaccuaaggacgucuuccuucuuaugugcaaaggaagcccacaacaauuuacagugaucuugugguauguggucacauggaaggcagagcagugaagggaacuaugauagcaggcuccuuuaccuugugguacggcaugagcagagugcagauggcacaguguggcuucauccuggccacuguugcauuauacucuugcucagcugcgaaguuaggggacuucgucugccaaagguggaugagagguuucgcccaagacucuguuucuuccacuuccuccucaauggacagaaccucaggcaauucuuaagggagaaggcaggaaaauaccaugagcaugggaaccagggaaaacaaucacccugaguacaaaagaaauaaacauuccacagaaucugugauauuaaggccggaaaccaaaccuacuuugucuuucaaauacauccugagagagccaggauaagggaaguugccuuauaauccuccucaagccucaaagacuagaucagaucccacggccagacaaccacccucauuuuguaacccucccuaucccuaccagaaauaauuacacuguucccuccuucccacauuacuucuuccgugucucuacugcuacgguaaaagcuccaauacuaaaacagguuuauguguaugagauuaucuucuaguuaugagaggaauucacaguccagaaacuacuuugccaauauuuuuacuuucuucaucuaacauaguacauggcucaauaaaaguuuaacugaacuucauugaauuaaauucuggguucaagaauuuauuacaauuaacauuuacagagcagcuauaaaguaccaagcaauauacuggcauuacauggauauaaaagaaaaucccuagucagaucuucucauaaaauaccccuagagagucaagucuuuaaaauguauauuucuuuuucuuucuuuuuuucuuuuuuaagauggaguuuugcucuucgugcccaggcuggaguacaauggugcaaucucagcucacugcaaccaccgccuccaggguucaagccauuguaccgccucagccuucugaguaguuaggauuacagccacccaccaccaugccuagcgaauuuuuuuuguauuuuuaguaguggaguuucaccaugauggccaggcuggucuagaacuccugaccucaggugauccacccaccucagccucccaaagugcuggaauuacaggcaugaaccacugagccuggucuaaaauguauauuucuuuacuccacaagaacagcacuuuauaaaaucuuacagagcaccagaaaaauacagaaagacaaacauguuagaaaaauacucuucaaugccuauagcagagggcaguacaucagagcaaguggccagaauaaaagcugcacccagugucuagggcugugacacauucuaaauaucugcauaaguagcuuucaaagucugaucaauaaauacuguagagcaaugugcuuaacuacaaaucacuggugaguaaguguguuccagcccuucccauguugacuuaccuguuuuagaaaaagucaaauuagauuugcacugauggcaaaaugggaaggacugaaugaggcugaaaauaacucaaaauaugucaaaugccaacuguagcacaaaggguggcauuauuaucauaauaaucacguuaucaugguuguuguuguuauuauuuuuacaauggaaaacacuugguauucacccauggguagaguauuugaaaacaaaagauaagagucuuugccuauauuugcaaugaaguaaucugacucuaaauguaaccuguuucucgcagcacuuggccucaccauaauagcaaaaggagauggcuaaaaaauuauuauagcauaggauauacuacagcuaauuuuaugcauuuaugauuuaauacugcaccuuuauauuugguuacauccauguuugugugcauauguugugacaaauuuuaacuuuuuauaauagauuuauguuuauaguaguaaaugauaaaagucuuguaucugcauauauuuuaugccuucaugacauaucuuuuucuuaauuuuuuaaauauuucuaggcuacaugauucauuugugaguuuuuucaaauuguucugagucuaugagaaauguucuaauguauuuauugaaaaaaauugcauguaaguagagucaaacaauucaaaccaaugauguucaaggagucaaguggaauugaaagauaaccacaguucucaaaauaugaucugugaacuccaggggauacacaacccuguugcauggcaucuacauagucaaaacuacuuucauaauaacacccaugauuugacuauuaaccauuugagauuuguaacggugauacgaaaguaguagagaguaaaauuguuggugucucagcaugaaucaaggcaguggcaccaaaggaaucauuauauugacuaccucauacuuacagagguaacaaaaaggcaguuucucuuaauaacaccuuugauggggggaaaaaagcaucaauuuuauuaaaucugugaaaaaaaaagaauguaugcauaaaauauuucuguacacacuaaaguucaagaguguucuuuaaaaaagcacuugagcaauuaauugaauugcagguugaauuaccugccauuuucauggaacgccacuuuuuccaugaaaaaaauuauuagcagacaaacuacagucauucagacuuggguggcuggcagaaaugugaagcccucuguggaacuuuucaguucaguuauuguguucuuuaccuccagaauauguuugguucucuuuuauggcuucuaucucuuuguugaaauucucaacuuguuugugcauugucuuccugauuucauuuaguugucuaucuguauucacuugcagcucauugagcuucuuuaagauuauuauuuugaauuacuuuuaggcaguuuguaaaucuauauuucuuuauuguugguuacugagguuuuauuuuguucccucaguggugucauguuucccugauuauucaugauucuugugaccaugaguugguauccaugcauuugaagaacuagugacuuauuccaaccuuuguagacuggcuuuggcuuggacaacccuucaccagucaguccauccaaauuuucuaggcaggccaucuggcaugguccaaggguaggcuugcuccuggaauccuccggccuugugucugcgucaguaugugagcuggccugguaccuggguucaugggguuggaucuggagccuaaguccaccauguaagaacugaagcuugggucuacugaguuaggccaggaucuuggguucacgggggccagcuuggcaccaacauuccacuggugugguccugucaacugcauccacagggauguuccuggauguuuggucugugggaguuggcccaaugccagggucuucuaugguagaccuguacccaggguucacuagggcaggcaugaaacccagguccacaagugcugcucuacauccuagaccaggggaccagcuuggagccugggucuguggggguugucuuggcucuggagugagccuggagucugggacugcaaaugcuggcuacuguugaggcagacuuggaggcuggcuccgugggugcuggucuggagucuaaggauguggguacugaccugacacuugagcuagucuugaggcugagagauggccugacacuggagcaauccuggaggcucagucugcagguaccagccaggaauccagggcggugggacuguguggugcuggguuucacugcaacggaccuuagauugggaucugaggcaaaaucuguuucucacaucacucuccuucccacacagguaucccuaucccucuccucacuguaccgccugggauuaggggagugguaauacagguaaugcaaaacuguccuuccuaucucuucaaugcaucuuuuuucaugucugugcuauacucaggugccaucaucucucaucugguuccuguaucucuuuugaaggcauuuuugagcauugauaguuguuaaaucgauguuucugccaggggacaagcgcugugaaguccuauuccacugucuugcugauguuucuaauuauuuuuuauggguugggaaaaucauuauuuuuuaugaaaauaaauguaacuuuauguaaauguuguuuuuauugcuauuuuuaaaugaauuaauauaauuuaaauuuucccuggugugauuuccaguaaguaaauaucaauaaaaugaacccacaaaaaaggaaauaaaagaaucuucuuucagguccucagaagagauaagaacauaaggcuuccugagaccaaaaagacugagaaccacugccauauacauguguacauuuuucuaaaaguguuaguaucaaagagucacugcuaaacaauacaggucuuaaaaacaccugauguaggcuucaaucuuaaagccaagcaguaacuucauaaucagcuugccuuaaucaacuugaaauacuuaagcaaaaagaaaacaagagucaacacagcaaaaaggccuccuuuucucccuagguucuuucaagaaugucugcaagguuugccagaaauugaagaaaacaaagauuuuaugccaagagcacuucauuuuuuucuuccucagucagugagccucuuacuucaugguggaaacccguacuccuagacuaagauuuuuacaaaaacauugucauuccuuguagcaaguaacaugcagucaagaaaaccaugagccuaaauacaaagcaguuccucaaaucuauguaagccuuucuaaauuuacagaagcccaguauaccaggcaccaagguauguggaacuuuguccuaaauaaggaaacauaagcaguggcuaaaagggccauccuauguaagagggcuagcgccuaaacaaacacuacugugagguggaaauggggaaaccagauacuaacuuggaucaauguacugaagaaaccuguugaaaauauugccaccuuggcaacaauaccuucaauagcuguuuucaaauuuuuuaaucgccaugucaauaaaaauaaaaauuuauuuuauaaacuguuucauuuuauaaacgaacuugccuauagaugaaacuccuggaucauauacacaauagacugaaauuuuuuuuauaguaguauuaaaaguauucauucucacuuagacccaggaaaccaaucaucaccucuuacucugaauauuucuggcagaauuaaaaacucgaggacaaagguaguagaaauagcuaugcaagcagggccuaaaaauaguccucaaaaagaaauaugaguuaaaacaaaaauaugugauuuauaugugugccagcuggguauuaagaaacugaccacaacuucugcuuguacaauuaccuauagguaaaaucacaguaauuagccauucacagccugcuuacaacccucccuucucagccuuuccaaggugucuuaaaugcaucuccaaagcuauucucccugcuugccauucaaaucacaccgcccacuccucaggaccauaaacaauucuguuuuucaaacaccucaaagggauagcuagauuucugucuugucauugaucauuaaauagacaaucaguaucaccucugaugcucaagcaaugauuccccaacagucagagaggucugccuggaagagacucaaccccacaggacauguuaugagaaggggaggccccauuaauuugaagcacaggaaauucuaaaaacuuucugguucuaauaagaaagucaggcuugcugaaauucacuuugaguaucuuaagacauucagagaaacuccaaaaguuuucuacuuauacuaauuugcaguauuccugcagauuaauaaaacuucccaaggugagggucacacugagauguuguuagcaacgguguaaacauacaguguuuauuucaaugauuauuuuucguugcuuuuuauacacauuaauuuguaucacuuuucauacaaaaguguaaacgacuuuuauguaaaguaaaaagucacacuagaaaauauauauuugaaaacauuaguccaagugacaccaaauuauucuaagauaagcauggcuuuaaguguagagcucugcuccaaccuaucagaauaaauuaaaauaaugcuucauucaugcagucuauacagucuugguugggugaugauucuaaaccuauuucucaaucuguaaaaugaguacaagauuaguuaaaugucaggguuuuccaacaaguuauaugagauagccauaaagcugcuauuugcugguaugcgcaaccuaguacuucaggacaugaugauccuuccccucuaggccuccaacauaaucucugcaaaggucuguggggguucagucaggcuggugggaaaaauuuuaguuauaauagccacaaacccucuuggaagccuugagaguuugcaaaauuucgguaauaaaucuggcugaaggcagccuaguccccuuaccuuuaguuaaauaaauuagaguagaaacaaaggaauguggggcguuuaucuaacucacuucuuuacucauguggucuuuuuuuuuuuuuuuuugagacagaguuucacuuuuguugcccaggcuggagugcaacggcuugaucucgacucacugaaaccuccgccuccuggguucaagcgauucuccugccucagccucccgaguagcugggauuacaggcaugcgccaccacgcccggcuaacuuuguauuuuuaguagagaugggguuucaccauguuggccaggcuggucuugaacuccugaccucagaugaucugcccaccucagccucccaaagugcugggauuacaggugugagccacugcacccagccuacucauggggucuuaaugcuaaccuuuguucuaccaugggugcuuaauugcuuucuacucaggaagcccacaaugucaacuaccuucuagugguguugacucaagccuuugucaauuaaucuuuacugaauaaaugugagucucgcuggcuggucggggccauggcugugacuaaguagcccggacacucaguagaacuggcaaagcagacuaucugugugucaguguacuuuauucaucagucauugggucagggucugcaggacagaaccccgcagcagccauccagaaaauuucugaaaauguaugcuguaaauguaugcuuaaacacuguaauguguuuaagaugacaacacagauuagaacagagccaaucuagacagacgccaaguuaucuccuauauauaaguauuuccaucaaaagguuuagccuuguagggaaaauaaaagccuuuauucucccauucacucaaaaacaucauugaauauaauugaugguaauaaagaaauuaaugucuuuuacaaaaguaucuaaaagaaucuuuuuuaaaauaugcaaauaaauuauggcauagcuauauaaugcauacauuagaagaaaugcuuuugaggauuaaugaaauauacaguaugacuauauauauuacacaacauauuaguugaauauaauauaaucaauaaaaaaugggagcacaaaaccauguauagggaacauugccaauucuauuuaaaagguuaaaugucuggaauaaagaggcuuuuuaaguuuucauaguuauaaaaauaugucaucuuaaaaguuuuuuaaaaacugcugucaaaauaauauuaggugagaacuaugaacugggggaaaccuugccuuaagaacagauuuuugccagauucguucacucacucaggacaguaucuuugaacaaauuuuguuacauguaagugacgucccuaaggaaaauuauucaggccauuugugaaagggcugcugccaggacuuguggauggaacucagcagaugagaaaagcuaucagcuccacuacaguauaauuucccuuugccagucaucacacucauucugcugcuuggggugaugcuccagugagguguuuuggcugguacagcaccauucucuacuaugaaaagcacagcagcaucuguuacguuucagguacuugagcaaaaucucaguccugggaggcauuuauauaugguuucaaacauccugcagggaaugggggguguaguggggugggauaagugcagaagugagauacucaaaaaggcaaagauucaaacuugggaacuuuauaauuucuguacugaauaauguaugaaacuauauuuaagugauuuuuuugaaaugcugaccuucaaacauuuauaaagcuguguucaaaaguacaaaagagaaaaaaauuacaggacuuuagguaugauuuuacuaagaagugaugacauugaggaaaaaucaaauucugcauuacaguucccccaaaaugcuaauguaauaauggauagcagagaauucuacaguuuaaagucuaaagcacuuaagaaauuaaauggauguauauaguuuuguucuuuauguaucaccucucaauaacacugauacaaaaguauuucagaaggauacauuccaaaugacucuauauacacuuuaaauaagaaacauuccaaaggacacaacuucaaaauuccuauuaccaaaaaaaaaaaaaacacccaugauaauuaugcuaccucugaggagauggguuucaccaggaacuauggcauuaccagcguggcugaaguuucuuacagaacauuagcucauauuuuauauauauuuuauaacacgcaugaacaaaaacaaggaaugcugggaaguuuaucuacacuauuaacaaagguaucuggcuauaaucagacauuuauauguguccacuucaacuucuuuuaccaguauucuagcuauuuugggagguuguuaguguugaaagaguaggcuggacacaguggcucacgucuguaauccuggcacuuugggagggcgaggcagauggaucacuugaggucaggaguucgagaccagccugacaaacauggugaaauccagucucuaccaaaaauacaauacaaacauuagccgagaaugguggcaggcgccugcagucccaguuacucgggaggcugagacaggagaaucacuugaaccugggagauggaggcugcagugagccgagaucgugccaccgcacuccagccuggcagacauagcaauagucuaucuaaaacacaagaguguagaguguaaacuuuggaauugaacagacaguauuuaaagccuguuaucuaccacuuacuagcuuugugaucuaggacaagugaauucaugucuaugagcuucgauugccuuaccaguaaaaaugaugcuagcaucaucuaaaauaauuauaaguaaugguuacuaguaauguguacaacaaauaggaggaaaccagcucagucaauucucacaucaugguaggaaugagaagaagaaaacuccuaaagaaagcuggcauauccuugggaaacuuagcugucaacauggcaccagaaggaacauauucugagcaucaaaucaaagauaggugaaaaaggagaaagagccacaugaucugaagagaaauaauaguauuaauacauuuuaaaauugcuaacacaguaaaagucucauguucucaccacaaaauauuauguauuuaaggugacacauaagucaacuaacuuauuccacauuguacuaauaaaacguaacaccauuuuguaccccauaaauuuauacaauuauaaauugucaauuuacaauuaaaaaacaaagauagguacuaagcauaugaaauucaccauaugcuagguaauauaaaagauucuggaaauaagaaauuaaaagcaacagcccuuucccuuuauggaguucaaaacuacccaugggaggcaagugcgguggcucaugccuguaaucccagcauuuugggaggccaaggcaggaggaucacuugaggccaggaguucgagaccagccuggccaacauggagaaacccugucucuacuaaaaauagaaaaacuagccagguguggugguacgugccuguaguccuagauacucgggaggcuaaggcaggagaaucacuugaacccaggaggcggaugcugcagugagccaagauugugccacugcacaccaguguaggcaacagaguaagacucugucucaaacaaacaaacaaaaaccacucaugggaaaaaccuccagauucauaagcuauuucauuaacagcauauacaauacaaagucaaaagauggcaaaacaagaucuccaagcaagaaacuauuaacacuagcaugaugcaaucuacaugaaaaagaagcuccccauaccaaaaaaaaaaagaugucagcuuuggucaucuauguaaaugacagcaggaaucacagauauuuugacccaacaacuaauaggaguuaucacguggcagaucacacaaaacagcugcuagggagagaacuucaaguaggguggccaucacaccaacuaaggaagauaaagacauggacuauucaggggagcauacagaaauaaggagagaacaaggcuauacaucuucuuccucucauuucccuucaaaauacauuacaugguccugucagcucuaccucaugaaagauucaaucuucuccuggggguccccaagaagauucuuaacccagauccaugguucacucacuugaaggcauuaucaaguuuacuccucaagaaaagacuucaucaacaacuauggaaauauuuauguaacacucaaacacauauacauaucauagccaaucauuccuccuuaaguuucuaguuuuuaaagcacaacaaaaaucucuguaaaacaaaacaaagaacauaaacacuaaaacaauggaauaucaauccagaauuuauagguucacuugacagguauaaagauauacucaucucaccauuucucugaagccugggaaccuaacaccuccaaaagggaaaaggacuaaaacaacucuaugaaaauuaaaaugcugauaaagagagccaccuucuaaccauucacuagcuggaagucuuggacauguuacuuaacuuccaugaccaacgugcacaaaugccaaccuguagaauguugccagccaggacuaaguuuucauuggccagcggcaaaacaaagaauaugaagacauaaagucaccacaauauuaaaauuugaaauauacauaaacuuuccaugcugauucuacaucuucagagcuaauuuuacaaccaaagaaaaggugaaaguaacaaugaaaacaaaguguaccaaaauaugugcuaauucgguggucuauaaggcugagacauucuaucuccaagaaaaagaaacuggcguucagguugaaaaaaauguaaaguaacacacuugaguuguaugaaauugcaguuuucauagaguaaaaaaaauuucaaauauugacaauuucauauauauuauaaccuaauacaaucauuauuuuucuaaagaauugaaugcaccaugaaacugugcuaucaaaaucuguuccuggguaguuuucuacaggacuuuaagaguaacaagguuaugguugaauuuauuuauaaguuaauuuuaaaaaaauaacaaggcauacaugaacccaaagacucaaacucuuucuuaucaucuuacaaucuccaugcuuuuagcacauucagaaaccugaucauaagauuucaugcuaaucauuguuuagaaaaguuucaaaauugaaaguaagaaauacagaaagcaacagcaucacauaaauuauaaagccagcauuuuugucucuaauuuaaucaaaaccugaccaagccacuagcauaauaaaagugaggugguuuugauuuuuuuauucaccauacuacaguaaaaaucaacgccacugggacuuccaguggaauuuacugacagaaauaaggcuaaacugagaacaccaaauuauuauuacaaaccuuaagcacuagauaaaauauccauuuuaucugaaugccaacaacaucuaauguuuuguguccacauaacgcaggaaaacacuggcugugaccuaucaacaaacauuccaagccaaucuacuuaguaaucugcugaauuugcuguuuuauugcuuaaacagacagaacuauaaaugugcuuauuaugaaaguauaguaauaccucaagcuaaaaagaauugauggaacaaagagaucauuauguaaaaauuaauaacauuuggagcaugacaugcagcagccaucacacagcauuuauuuuucaaaacuggcagggaaaagaacuuuuuacgcaggggaaagacuuucaaugggagauguaccuauucguaagccaagucgcagccugccuacccuaaagcagacagucauguacccaguagcaucuggaaaacaaaagauuguuuuuuuuuuuuuuuuuuuuuuuugagacggagucucgcucugucgcccaggcuggagugcaguggcgcgaccucggcucacugcaagcuccgccucccggguucacgccauucuccugccucagccucccgaguagccgggaccacaggcgcccgccaccacgcccggcuaauuuuuuguauuuuuaguagaggcgggguuucaccgcguuagccaggauggucucgaucuccugaccucaugauccgcccgccucugccucccaaagugcugggauuacaggcgugagccaccgcgcccggccuguuuuuaauauuuaaaauaacauuuauauuuaauacuuuaaaaaaauuuguaauuucugaaucaaaaagacaucaucauuauauuuggucaacauauucacuuaauaaauccuuaaaauaagagacacaaaauuaagacuggcaaaucuacaucaauacaguuaaaacagagaguaacagcuugccaggagcaggagggcauaauuuuccccaaacaccuaucuacaaaagguaaagggcaacagccaauucuaaauucuaacucuuugauuucuaguucuauuucuaaauuccacuucuaacuaauguccuuuuguuugagggacaauugcaaagugucugagagccagcuuguguaguaaaaguaccagcaggacaaugacuacaagacacggggugaaguacucagaaaauaccacgggaaaucccaggcgaugccagaaaaaaaaacaaccuagaaugaagugcaaucagugggcagcucuaguccugggaaaacacacauaggaccacuuuaguauucaauuguuauaaacaauuuuuuguuguuguuguuguuguuuguuuguugguugguuuguuuuuuuggaaccagaguccugcuguguugcccaggcuggagugcaauagcaugaucucagcgcacugcagccuccaccucccagguuccagcgauucucuugccucagccucccaaguagcugggauuacaggugugugccaccacacucagcuaauuuuuguauuuuuaguagaggcaggguuuugcgauguuaaccaggcuggucucgaacuccugaccucaggugauccgccugccucggccucccaaagugcugggauuacaggcgugagccaccaaacccagccuauaaacaauuguucuaauaaaagaaaugugaacuagagaaaaccauuuaaggaaguaaucaaauuuagucaaacgggacuuccugagauuucacuuacuuaaaagugaauaaauguauacauuuuauucuucaaaacaacagaaaaccuggguuagauggguuaaaugaugguuaaacaccaagaaagaucuccaauuccaccucuucugucuguauauuuaaacacucaauccauuacugaauaaaauauuauauauauacagacgucccaagaaauaaauuacuguaacauugccugaaauacacucuuaaucuaauccucaaggcaugcagacauuacagagauagggaucaggguguaagcugucuuuaauuucaaaaagaugcuuaacagcucauuacaguagugcacuugcugaacugaugacugaugaaaaguuauuuggaaaauucagauuagagaaaaucagacccaaaaccagggcuuuaaucugaauauugccaauauccaaacuuguauuaacagaugaggcugccucugcacuugacuaaacacaguacacuugguuaucugcaucuuuccaacuuucuguguugauuauucuagaaaacauaaaauuauaguugaagaguuauaaguaaaaguuuagauuaauggcaaucagcucuuuggaaaagcagccuucaaccugucaccacaugcuauuucaggggauucaaaaugcccaaaauccauauaugaacuuacagguuaggaacacuuaucauucaugaccaagccucacauuuuacacaggaggaaagaggccagagagagggcuuacccaaagucaaaaaacauauaaagcacaaagucaagacuccaaaaucuauugacuguuagucaaccagacuuuuauucaguggguguucaaagauuuugcaacugcuugugccagaugccccagaggcaugaaucgccagccuaaguugcauuuuaaauuucucacuuagaagaagagguauaaacuugaccacauggguaggaauucuuagaauaacuuucucuucuaucauauugcccuucaccauccaagccuaaguuucaggcaagcaagcucucuuguuuuuguuuguuucuggauuuuguuuuccacuuuuucuuuuucucaagugugcacuuaaguaaagguguaggcuuuuaaggcuccagcuccgcaugucugaggggcccuuuaguuuccuaguucugaucgcucugcgcccauucugguccuggaaaauuucuccucaacggccacaacuuggcucccccuuaccaaucagcugucacuuucccccucuccuuacaacagcaacaacaaacagucauuaugugccaaacacuuuuuuaacccucaaaacaauuccuccaugcggcaggugcugcuaccaucacuacuuuguaaacgcaggcaccgaggcaucacacaguagagugcuggagccgacugacccucauuuguaggcauggagagauauuauccuuugugcuauuuuugccucucuaugcaaguauaaaaguuguuuauuuuauauuagccauuauuucuaguuguuuuauaccuaggguauuaucagauaacccacuccaucauauugacacucuguaaaaaacacuuguuuggccaaauauaaaagaaauguuugucacagaaaauaugaaaaauuaucagcauaaaaaagaaaacuaaaaucaccuaauaacagucuugcaauuuucuuauaaauuuccaguuaacuuucacagacuccaacaaaacuucacugucagcacaaguauguuagcuauacucaccacuagcacauggugggaaucgcugagcagaggaguaucacugugucagcaaaugccaugcucacgacguccucuguacacuagcacggcuuguccuuaguuuacaauugcauuagaaacaucauuaaccucaucucuuaaccaaggggauuggaagcacaauaagcacaaaagcagugagcagacuagaaguaacaguaggaaaagcuggaaauuuuuuauugaaaacaauuuuuccauuuuuaauugaaaacaauauaguaaaauaagaaauguugggaaacaaaugcacacaugugcaggaugaaagcuucaaagaacaaacaaugcaccaugaggccagaagaagggggaagggggugugauaaagcacauguucagauacugaugucaaugcaggaugauuauuagcccaacgucacuucaagggaaguucuggaguuggcgucagcacgauuaaagugcugcugauaagaaugcuagugagaagaagcuugccauggcuuaaaacauuugugagugugaaucacaucaaaaugggcagcaaggcaacaaacagagauaccaaagugggugagggaugagaaauuaauuaccucauggguacaauguacacuauucaggugaugguuagacuaaaguccagacuucaccacuaugcaguauauccauguaauaaaucugaacuuguacccccuaaauauauuuuuaaaacuuaaaaccugcagggccgggcgcgguggcucacgccuguaaucccagcacuuugggaggccgaggugggcagaucacgaggucagaucgagaccauccuggcuaacacagugaaaccccaucucuaccaaaaauacaaaaaauuagccgggcgugguggcaggcgccuguagucccagcuacuugggaggcugagguaggagaauggugugaacccagcaggcagagcuugcagugagcugagacugcgccacugcacuccagccugggcgacagugcgagacgccaucucaaaaaaaaaaaauuuaaaaccugcaaagguguaaguacuuucugaaaccaucaaaagauaauuacuugccucaaaauauuuccaauguaaacaaaccuagcugaacuguauuuuaccacuuaaccuuauauuggaggcauuaucccaagagugcuaaagaugauacuuugaaaacauucuauauagcugcauaauguuucagugaauugcuacaccaugaccaugcuucccuugaacaauucccuuuuaugagacauuuaccuuauucaagguaggcuuucaucuccauggcaacuauucucuguguggaaauaccacauugugugugugugugugucugugccugugugucuguguguguccauacagguguauguacacacauuuauguuucaaagaaugguuuuauaaagcaacagaaauacaaacugcaaagaucaggaaauuuaaguucacuagugacuucuccugaacugacuuagucuugaucuuucuucuuuucuuccucacacaacacuccuuucucagcaauccaaaaaaaaaaaaaauccuaggaaaaaacccauucucuaauuaaugugcugaagacaacaguaugcaucauuccuuuguuguggguggggaaaaaaaaaaccacucucaggaccaccguagccuguacaaccaccauagccuaaauaagcuaguccuuaaaaaggagucacuuacugacccaacguaaugucacagcuccaaaagcccucaaacuccaaggcaccagccgcaucuacaaugggucagcugcauuuuaacuuugagguaauucuagaaguuggcacagugguagagagauuuucaauucugucaagauacaaaacugaaagagcugacauauuaaauauauaauuuaucacauuuauauugguaauuaaaacaacauguuuuucuauacacauauauagggagacuauuuccuggacaaggauuuacauuuuucuuuuaauaugacaguauguaacacguugagguacuuaacuuuuuaauggcugauuucaaguauuacugauugccuuauccagggcauucccacucuugaauccauaagugauuuaagcuaccaugauugcagggaaauguucacuaccaaaagcaugauaggggaagcaaaagagaggaaugagaguggggagacagauacacggacagacaaauaacaaaccacaguguaaggugaucaguggugcaagagaaccaagcacauauggagucuaugggcgguagagguggaagaggagaggugaguggugacaagggauugaaacauuccaagaaggaaaagagugccacacauaauguaacagccugggcaaauacauggaagaaaagcagcagggggaggguaaggagaaguugucuaaaucagggguccccaacucccaggauauagaauaguaccaguccguggccuguuaguaaacaggccacacagcaaggggugagcagaagccuaagcuccaccuccugucagaucagcaguggcauuauacucucauaggaacacaaauccuauugugaaccaugcauguaagggaucuagguugcacacucccuaugauaaucuaaugccugaugauccgagguggaacagcuuuaucccaaaaccauccccaccccuauaccccugccccauccauggaaaaacugucuucuacaaaaccagugccuggugcuaaaaaggcaggggaaugauggucugaacagaaaggaagacucacgucgcaaaguuaagggaaaugaagcuagagagagcaggcagcauugaaugacaacugguuucaaagccacacaaagaaauugagcauuuaaccuguacugaagcauuuuacaauuccaggaaaccugagagcuucugagcaggcauccucaccaaccaaaaacaaagaaagaaagaaauacugccgcagauuucuaagcuggccgcccuucaguggguucaucacaucuaguacguuccauggccagagacagagcauugcccucuccccuaagugcacgggugcaccagagcaugcauaguucacccaugcacuucauacacauccuccuucucuauggacagugaacucaggaaagagcaggaauaugccaauaauaucaacaaauggcaacagaagaauacguacauauccuggaugcuucgagaauaaaacaauccaaacagcuuugcuuaucagucuagguuucaacacaacauuugcguaauuuuuaaacaacugggcaauaaaaagaauuuuaauugaaguuucagucaccuuauccagcugccuaaccuuagaaaaacaugcaacugaaaaacauuucaguuaaaagaaaaaaagaggcaguuuaguauuuucauuuaaguuauaaaauauaaacauguaguauauauuuaacauuauuuuucaccaaaaaagaauaaguuagaugcuaauuuuuauguaaagauacauucuaaucauuauucuuuuauuacauagcccccucuucuccaccaccaccaacuuucauguuuugcuguucaacauggaaaaucuuuucccggaaaauaacaggcuaggagucacgaaguccuuccugauccuguaauuacaggaugugccaccagucagaaugaucuaugguguuucagguuauuuggguaucaaagagccacugcacuguccuaaagagaauagcaacguacaaguggcucaucucucagcugccaguggcauagcagcucccagagguccuggaccaagucacuuuccccugugcagccuuucuguuagggagaaacuuuccagcuucaauagagaaaugcucguucaccaacagaagacacugauuguuguuuaaagaugcaauucuccuaugcucuaauauaguuaugcuccuacguaugaggagugcaaaaggagcagaauaguuaggacagaaaaucccccaaaggaguuggauuuggaauuguaugcucccagugaguaaaacacucacugcacaucacaaucuaacaaugauaauguuuauucacuuucaacuuugcaagcaacauagacacagaggcaaauggcuaagguaacauucaaguucccaaugauguaaauaauuuacuucgggcaacagaauauucucuguugccaguuugaaagcuuguaaaaacuuuaagccaucacaaaacuucucugauuuuucuaaucaauucugaaaaauccccagaggucaccagggguccuuaacauauuagaaaggaaagaaagacuguugcaaaagcuacaaucaucguuucuacaaaauauguaaccucaaacccuugagacgacuucaucaaaccaauccauuuauaaaucuugcaagcuauacaaacugaaaucagaacugcuuuccaaaaagaaacucugggccaauuuaugauggcccacaucaaaauaaacuuccuaggcaaauaaggacacaggagaaagcagcuuucucuauguguugguacagccuuagcauagccuauucccuucacaaaaguuauacugaagagagucuaccaugggaaagggaaauuacaaucaugagcauuauacauuaaguauuaauuacuuuacacagaauugucauaugucuuaacacuaaagggaaaaugguuuguacuggguauaauaaaguagcaaaaaaaaaagaaaaagaacucaacauuaugauauauggaaaucaaugcaaauauguuucauuacuucuauuacuugaaucagaauucaacccuggauugguuucauacaaacuacuaugaucccuaaucccuacauucaugauauuuuuacuuuuuuaugauacagggucuccccaaguugcccaggcuggucuuaaacuccugagcucaagcaaugcucccaccucugcuucccaggcagcugggacugcaggagucagccacuaugcccugccaugaucuuguuuucuaacuaaacaugggacauaagugaaaagugagugaaagggggaaaaaaucugugaaagauaucuaccuacucugauaaauuuauuuaaacaagaaacuugagcuucuuguuacucacuuaacaguauucucacagacacaugaccuuagguaauaauuuccauaaguaaaacuggagaauacuucagagaaggacucuuaacagaaaaccugccugaauuaauccucuaaacacagaaaaaauaaggccuucaugaugcuaggagacauauacaagacacuuacgaaucagggaucugauuuuuaauuugaggcaacaaaaauuucuuuuuuauaaaagaaaggugagaaggguaaccaggcaugcaguggcuaaugcuuauaaucucagcacuuugcggggcugaggcaggagaaaugcuugagcucaggaguucaagacuagccugggcaauagcaaaacccaucucuacaaaaaaaaauuuuuuuuuuaaauuaaccaagcaugauggugcaugcuuguggucccagcugcuugggaggcugagguaggaggaucacuuaggccugggagguugaggcugcagugagccgugaucacccuccacugcacuccagcaugaauaacagagcgagacccugucuugaaaaaagaacaaaagggggaaaaagauaaauuuacaucuaggaaugguaaaugauuguaaaugaaacugcguuacauccagcugcaucacagcgaucuagugaaggaaaaaggauguuucaccccacaccaguuacaaaaggauauggaaaaggauauggcacauagacuuuuacugaaggugguuaaauuaauguaaagaguugaaguuaaaaguaaagacaauguaaagaaaccuacagcacguuaacucuaaaaucuaacaccuuuagagaaaugagucucagcuucuucuguagaacccuaaaacaugucaaggcugacugauuuuaccccaugacauaaaacuggaagacuuuuaccaguaauaaggcuagcuuauaugaaguacgucuuuaccucuaaguuccaaauuccuuuuaccuguaaauuauuuauuauguaugaucuccuaauaguacguauuugcuacuuguugaauuuuuuuucuauucagcaauuuuuuuuacaauaguuuguuuuacacaccaaaaaaaaaaaaaaaaaucccaaaaagggucaccaucucaccuucaucacuuggcgccugcugcuucacaagagucaucggagaucuugcuggaggccugcuaaguggauggcgccaacucuuagagguuuuguucucucccucugcuaucuaguuauagaacaaaaaugguggagaaauaccauuaucaaaaacaaacuacaaaaaaaaaaaacccuacaguucacaauuauuuaucacuuaauguugaagaaaucuugugguuguuuaccucuuggggaacuaguccuuuaagaaauuuaaacuuaaggucaaaagaaauaggaaucaauucuauuaguaauuuuagccagaggucaauuaauucuucuuccacuuuguauuaaaauacaagcuguagggcaggguaggcuuauuaaaccugcaauaagcucagcaguuaacaaguuuucuaaaguucuuacaacuaauguaaauuuaggauuauaggccaggcacaguggcucaugccuguaaucucagcauuuugggaggccaaggugaagggaucccuugagcccaggagcuugagacuagccugggcaacauagggagacucugugucaauaauuuaaaaaaaaaaaaauagccagguauagaggcauaugccuguggucccagguccucaggaggcuaaggugggaggaucccuugagcccaggagguggaggcugcaaugagccaagaucaagccacugcacaacagccugggugacagggcaagacccugucgccaaaaauaaauaaguaaaucuaagauugcauucucauaaaaauacaggacuguggcucuuggucaccucuaagauguucccauguuaacauuuagcaaggaauuuuauuuucuauccucacagagaagacaauacugcaacacuucuuuccauucagaaaugaaucaccacuucuagaucacauaaauaacaauuaaacaagaaaccaaaaguauucucuuuuuuuaaugauacauuaaugccauguugaaaccacuuaaauuuuaccaaugauuuuuuuguccugggauuuacagacuauauauuccuuucccggguagaaagucauguguauccuuacaccuuccagcuaggacccaccuuuuaagcucucuugcucgcacaacgcaaaauuuuuaaaggcagggggaagggaaagaggauaucagagagaguuugaacccagcaagcuuacaucaagaguugacuaugaaagaaaacaaucuuagucuucuucccgguaagcugaagaagcaguggccagauauagggaaacuacucuggccucugacuccaacacaugauucuaagaaaauguguaagaccauuguaaucaaagcuaggaauaagaaaagaaugacaaaugcaauauacgaugacagcuaucuauguuuauaauagcuaaaaaacaauaugggaaauuauaacacagccaagaagacauaucaacacacuacuaugcaccauaccguugucauagcuggagcuauagcaggaaaaauuacaucagguuucugcucucaagaaguguagauuauagagggguaagggaauacauaauaaaugaauaagucguauuuaucaaauacuacucgguaaauauguaacgaaggaaaauaaagaaggacaaaggaauagaaagugauggggagggggcaguuuuauaggguaaucagagaaggccuuucugauacagugauacuugaggggaacuuugagugcauacauaugauuaucugggggaggagcaucugggggagcaagaauagcacguaaagugagaacauacucgguguguuccagguacagcuuugagcccaagaugaauggauggauggauggauggauggauggauggauggauggauggauggauggcuuuaaaaaauaacauaauacuuauugaguagaucagcuaaugccagcagcuaucagcauacacauagcauuacacugaauacuaaaaaaaacugaccaaaacuacacaaaaauuaaguggggcuguauuacaucuaggaguuauccaacaccaugguguaagaaaaggaugucaugcaguuguucuuacaggcaagccaagccucucagccuucaauagcaauguugguuucucuacugucagucuuugcuuggggaaaugauaaagaugaagauaaacagcacuagaucuauaaucaccuuccuugagagcaaagaaaucugagaauuacuuucagcuccauucuacuuuaaagaaggucgcuaaaaauaacuaaagcaggcauuugacucagucaccuguccaaagaaugaauaucugcuuggcuacauuuaagccauucaugaaauuaaguugcaaauuuuuuuuccuuuuuuuuuuuuuuuuuuuuuuuuuuaagagacagggucucucacucugucacccaggcuagagugcaguggugggaucacagcucacugcagccuugaauuccugagcucgagugauccuccuaccuuagccucccuaguagcuaggaccacaggcacacaccacuaaauuuuuuuuuauuuuuuuuuuguagacacagggugugaccauguuguccaggcucaucucgaaccucugggcucgaggggauccucccaccacagucucucaaagugcagggauuacagaaauaagccaccacauuuggccaaaguuguaaauuuugcuuauuaguaugugaaugcuauuuucaaacuacucuuaggcaccuuuucaaagaaaccagaccauauuuuuuuuaucuuucauauuuuugauguguuuauaauucaaugagauauacaauucuacauaaaaagauaaacacuauugggucaaaucagaaaaguauauuuuaauuaacauuuuaagacugauaagacgcaagguauucaaagcugcuguccuuauacaaccucccuugcuccuacucagggacacaaggaucuauuuugaguugaaaccagcaggagcagugucuguucugcagccagcgcaaccuaucagcucaaacaauuacuccuuccugauccaccugaauucccuaaucaggcuggauacaucaaaaaaaaguacugaauucugacaaucgcuacagacaguccuagcuccccugauccacucuuauggcuacauggacaguuucuacugaauauggaauauuaauacuguacaaggacaauauuguacaauuuuccaaaaagucacaaugggaagcuaaauaauauagaggagucuuuucucagaggcaaagggccucuuucgaggagggggcaggacaagaaaggucacccugguccugagauucaggguccaugaggaaagaguaagaagaaagcaugaccacgugaguccugacacugaaauagaagcugugggaaggcugggaccaggagguauuaacuauuggcagaaagugaucagugcccagcagaugaauucuucugcaggugacagaacaauucuguaaucuuuacuguaucaaugucgauaugauugugacuuuguacuauaguuuucuaagaugguagcauugggagaaacugaguaaaggguacaaagaaucacugugcacuauuucccacaacugcauacgagucuacaauuaccucaaaguaaagaguuuaauuuuuuaacaaaaaaaagaaaaucaagcaucgacacguggccauaagcuccaugugcuaaauuaucacuaugugagccacagcucacaggaggcuuaccucccaguuauugaaugaauaugauuaagacccauaaauguaaaauguuauuuaucugugcccuaaaggaggauuucagugcacagcauguuguuuucaaaaugugcucucaccauauaaugaauaugguaaaaaauggauauugccacauacacuggggacuuugaagcuauuucucucuccacuggggaccgcugggauuuccccagguucaaggccauucccauggcucuccacaucacucucuucucccucuguuaacacaccauuacucucugccacugaugagcaugacucaggugacuuuggccaugaaagcucggaugggucugauuucucgggcuucucauagccacuagacaauggaauggaaucaucagccucacuggauauagaagguacacuucuauaugcauaagcuuugucauccucaguuuuuaugucuucuguuacagauguacuuaagcagcuguuuccugaggauaaaacagaagacuguuaauaaaucaugcacuguauuacuacuaaguagaauugguaaacuauucccaaaugauucuguaucuuacacacacauacacacgcaugcgcaugcacauacaugcacacacacaaaacaaaccucauuuguacccaucacauacuagcucugauacugaacaacccaguucuucuacucaaguauuaugccagggcucaaaaucuggagaucaaugugcaaagaaccauguagugacagaacuaaugaaauucagggcccuuaggcaaaaccauccagcaauucauaaacuggcuaauuaaacacaguguaagagaaagcaugaugaggagccgggcacgguggcucacguguguaaucccagcacuuugggaggccaaggcagguggaucacuugaggccagaaguucaagaucagccuggccaacacggcgaaaccccagcucuacuaaaaauauaaaaauuaguuaggcauaguggugcacaccuuuagucccagauacucaggaggcugaggcaaaaaaaucgcuugaaccugagaggcagagguugcagggagcuaugauugugccacggcacuccagccugggcgacagagagagacucugucucaaaaaaaauuuaaaaauuuuaaaaaaagggacuauagugaaauauccauauguauugccuaacucucuauucugcauuuguuguaauucccuucccuaccuucucugccuugcuaucuuauauccauucaucaaaacucaauucagauaucaccuuugccaagaaaccuuggcuauccagcucuuguguguuugaaguccuuccuugguaaaccagcaacauccuaugcaaucucuauaaugcuacuuaccacauuggauuguaauuaugugguuauuugccuagcucuccacuaaaacaugaacucauuuuuuaaaaguucugugguuuaaacucuauccacacagcuauuucaagagcaaaggcaaugaggcuggaguagcagcugaggaccaguuuaggacuaugugaagacuuuuucuuuuauuauagguggaauaauacuaagaagaagguagucacaagaccuaagcuuuuuuucuuuuaaaggaucacucuaauggccaccuggagaacugacuagcgggggugacuacagcugacauuccugaauaagaaggaagcaauugcugcagucauccaggcaacagcuauggugccaugagugaggaggaagcagcagagggagucggauucuggcggaggggggaaucccaugaggaaggauuuacaggaugagaaguaugagaggaacacaggaauuagcuuauuacaauacaaaaacuccaacaaauaugaaagaggcaaaucacuaaagcaguuucagaaaaauaugcuaccaaagggagaaaaggcaaaguagcugagauuuucagacaauggcuuuaguacaaaagagaagcaaggggacuauacaugucauuucacuagguugacuuuucauuauuguuguucuuaaaaccuugaucuuuauuuucuucuuaagucgaaagcuaagaaucuacaaagaauuaucuauaauugguuuucucuacucaugugaauucaaaagaagccuuccaaaaacguauauuguaaauugaguugcacgaaaaaaaaaaaacucauuuuagaaucuucuuuuuuauuaaaccaaauaggcacugcugacugcuugucucacaauucugcuacacauagcagugaggcuccugacuuuuacaauauucccugggacuauugguugaguuacccaugacuuugguagauuacugauuaagcuauguggacuagucagauacuugucauagugaacauccauuuaagacaucugaucaucaaccaccuacuacuuauaugugaaaccuaaucaaccaucuucucaccugagaguuugauaugaucugauaaauucugcuccaccugcauccugcuagcagaugacucuucuucugaagaugcuucuguguuccucagcuucacugcugcuucugacuuuucacugaccuugaggucaucugugacugagucgggguuagggaccucugccccaucgacuucaucugacacuuccucuuccucaucagccuuaggccuuuuagagguagaccuagcacacuggaagcugucaacaagagaagcaguggucagagcgggaugucugcaauggauaugaaaaacacaucccaauauaaaugucauuuucacuugcuuaaagaaggaaacaacugacauuguuaaucacuaugccaagucaauguucacaacugaaugauuaaauuugaaaucaaaaucuuaaacacaauuuucuuaucaaucaauaaaacuuuaaaauucacacaacuguaaauaauuauuaaacauuauuuugaaaaagggccauuccuaaaauuuugugacaacauuuuaaaagucugaaaauaaaaauaaaguaaaaaauguugaaaugagacagaaauaaaaucaauaaauaaaauauuuagaaaaugaagaaaauaaauaaaaaucagaauauccuguuaggcuagugcuaaaaguaaauuuuuuauauuucaagguaaacuacugacuacuuuucauugaguuuuguauaauugucagguauguaugaaaauaguucaaauuaaaugccaauucaucaauagcgaaaggauuuaaaacagacacaggcuaacuggugugugugugugugugugugugugugugugugugugugucauaaagacacugucucacuauauugucccggguggucuagaacuccuggccucaagugauccucccccacugccucccaaagugcugggauaacaggcaugagccaccacauucagccuaauuuuauguauuuaacaucguacaucaacauacuauuuucagagugaacacaauuuuuaucuucuuccugaguauuuuccagcaggucacuugauagcuuuggcauauaugcuuuuuacauaugaaacaaacauuccuaacaauuaggaacaauuacaaaucaacucaaagcaacaguguccaaaacacacccauauguauuauacacacacaagaaaccaccacaggacuaagcacuguaggaagucagggagggcagagaauaggguggccugcgauaaccuauauaaauuagcuuucacugcuacugauggcaguaacugcaguaguaugaucaucaccaucauugcuuuuguugcaaauccaugcauuggcugaugugggaaaaucucaacauuauaaacaguguaguauaugugaaaaaaagaaggcugacaugugcuugagacaucaaugaaucauucccuucaucagacuucccuaaaugggcuauuuccaaagggagaucaauaaucucuaaauaucaagccacaaggcugagcauauuaaacaagcccauagucaggcuuucuaaguaggugagcaaguuccauugauuauuugaaccuacugacaagcauuuugaucuguucaagugucauaaauccauguucucuaucaacccaaaaggcccacugugguuaauaccuggaaaccaagucauacaccuaaugaaaauauuguguuuuccauccaugacagaacaaugcucaagauguucuccugguguguauucugaacucaggauuggauacugccuccuuccagcgcuggcuucuuuagugcugugaauuaacacaguuaucaaagacacugacuguccaaauuaguauuucucaaacuuuucuugaauguaacccacagugaguuauauauuucagauagugacacuauauacacacauacacacauacucacacaugucaugagugaauauuugcccuuaccacagaggaagcacuauaauacuuuuuauucuauuuuaccaccucauuuuaaaauguugguccugaccuacuaacaaacacuuugacgaucauugcgguaaacuacagggggaaauaucaacaccugaguuaguucugcaccucaggucuaccucuuauaagaugccgaaguuugacuccauguuccuaagguucuuccacucacuaccacucuaaauaagcagaaaauaaauaucagggaaaaaaaaaagacagaaaauaagcaucauaagucugggcaaagauguaaaauuaugguguuacuuaguuaauaucaaaaaaguggacacaagcuacaggggauuaaauacaugcaggcauuaaaaaucauguugcagcaaaucaaucaguuacaugaaaaaaacacucaaaacugauugucagauuauuaacagagcauggccccaauuuuggaaagauauauaauauuauaaaauauauaauaaauauauagguaaaggauauauacaaaauguuaauacugguuaucucuggauagugagguuaugagugauaugggauuccuucauuauucuuuuccuuauuuuacaaauuuccuccaaugcacaaauauuacuuuuauaaucugaaagaaaaacaaugaguaauauugaagaggaaaauuuaacauaaaauuggaaaacauaagacccuuaaaagguagccuaaggaccugagcaacaccacacacacccuauucaauagguuuuaaaacaacaagaugcccacagcacaucuaaaagcuuuugaaaugauccuggccacaaagauggaauggagaauaaaguucacaaggauaagcauguuacagaaaugcuauaugcuguguuuuacaucuuacaaaagaauaaaaccaugugcauaaaauguaguaaaauauaagcauccagaagagagcaguagcucagauguuggacaaaugaagaagauaaccacuaaagccaaaaagcaaaaugguggcaaaaugaaaaaguggaaaaucaaguuauugauuaaaauauggaaaugcacagaaaggaauaauacaaccauaaaacacauucauguaaguggucuaacaaguucuauauuguucuauuugccaugucgagcaacuucaggaauauucucaaacaaaauaaauauacaucucuuccuauauuguauuuauuacacaccuaagaauuaaaaauaaugucucacauuuucagaaagguauuaaguuaugaugaauaaauagaaaaagcaaguaaauugccacauccaaugacccauuuuaacugagaaaacacgacaggcaaggcaggucaguggggugaggggucauuaccuucgggaugcuuuucuuacuuuccuccuccucugcagccaugcuuuuacuucagggguggaugcuggaguaggcuucgugugaucaaugguguauauauccuuuccuuguuuccaaagcugauaucugucuggcugaaauuuccucacaaagauauccauugaaaucuucaccaugucuuuccugcaagugcacugaaacacaaccggguuggagaguguuaaacguuucgcuaacuauacaguaacacagaguugguccuugaacacaucauccaugaauacuuagucacuacauaauggaggauaaugcauuacauuaucaaacauucaaugggugauaaacccaauuucuucugaauagagaugagaaucuauauauucacauuuauaaugugguuauaaugguuuguggaccucacagggaacuauguacuaagaaaaacuaaaaggaaagagugcucauuuggaagcacgccugcaauggaaagauuauuugcccaucacaaugaugugucaaugaacugagcgcuaaaaggucuguaaagcugaaaaccuggguugucaacaaauaaaauaacccaaugaaugugugauuagaauacuuuaaccagugaguugagauaaauuuacucuaagauauauuuuauuauauuuaugguuauuaacgaacucucauaagguaacccaaaauuaggagcaaaugaacagccuuuucuacaucacaucacauacaacauccaauaccaucaacaacaacaacaaacauauccacuaaaaugaagacaugggguaaaggugagaaguucaaagaaaaaauuauuuugaaucuacuaugccuuuaauucucaugaauacauaguuaucagucacaucuuauuaagcaaguuuucuauaaagacuucacacaaaguuuuaucaggucuaggccagcacuacgcaacagggaaguuaucauucaaaugguggugcauaaauaaucuccaagauuuaacugauagaccuugacaaucccuaacauacccgguaacagacugacugaacaguuuugacacaauaagacuuuagauaucuuggugauacaauuaucaccuccaugcaaauuaacuccaaagucuuaauauauccaaacccaaacucccaccacagaguucucauccuaauggccauuacauucaaaauaccuaaaauuaaugucuucaacuucaaaccacacucugucgcuaccaaaugauaccacaguucuucuauucuccuacauacauaguccacauuccuagacacucccuaugucuucaccccuaaaaauucagccuugucuccauuuacggcaucuccugucucaauuccuucugccagcauccuugcagcugcacugccaggccuugaauccuagcauaacaaggcuaauuucccugccuguagucucuccuaacaauaauccaucguuauagcuguuacuuucgucucccccaaaucucuuacaaucuuucauuccugaguucaauaagguguaaucacccugcuuuucuuagaccuagaauaaggucuaaauuuaugagccuggcauuaagggcuccaagacuuuacuccaccaaugagauuuucagguuucucucccacagcaagucaacauguauauuccucuucaacccaagucaugggagcccaaaugccccuuaugcuucauuuacuucaguauuuuccuccuaccacaccaccuuccugcauacuagccggcuauccagcaaaacuucauccucggcucugaauauaaauugucccaacuguuccucugaaccuaauacuauuuaucugcaccacugcuuucuauuauugguuacauauaaugagguuucuaaguuaccuugcauaauuaucuugccauuggaauaaagaaaaugaagauccugagaaauugaaagauauuuuggauuaagauguaaucuuuugacaaaagggggaaaaaagcuuggacuuacaaccagaaacuuucuuaaaguguuacuaauauugcuucacaaagaaaaauaaacagugaacaaaagugaugcuccccacuuuaaugagcugauuuaggccugaucaugauuacaauugcaacaucccuagggcagauaagcuggugagguacagaacacuauuucugaggaaagugucucagaaaaaaaaaccuuugaccuuauuaauauucaucuuguuugcucagaugaugcuaugaagccuaaacagaaacagcagauaagccauggucaaagaggagugugcuccgagacuggaggaugguacugcuggacaaacuugcuaaacagaugaaguaugugacucguggauccaaucaaccaugucagcagaagccaggaagagagaaugugguuauccaggagagagcugugcaggacugucuugcuugaugcuuggauguccaugaacuacacagaagacugacaaggauuuugagacuuuuauaccagcagaaaugcugccagccugaacugaaaggaacagagacagaaaaaaagaaaggaaugacuccaaggacaagccacagaugcagaacgacugaguggacagaaccucacugggcuauuacaacagcccuaacaaacuacccuucaggagguacagaaacaugccaccaugugucguaagauuuguuacuugaggauuaaaucaaccagaaaacccaccuauacuaaauuuuucuaaauaaccuaaacccaccaacaauuacaaucucaguaaugguauaaaagauaauauaaaaagauuacaccuuuaaaguuuauuuggaauuauuaugcaauggaagaugugaaaaagauuacaucauaucaauuugcugagaaacuguaagacccacaaugcaaauaguguuuaaaagacuaaauucaaaccccagcuucaacacugacaagcuaugaaaucuugaacagcuuguuuaaccucucugugccucaguuucuccaucugaaaaacugagaguaacagugguaacuauccucauggggcugacaauagaauuaaacuuuuuguucuuguagaauguugcugaaaaugcuagauaagugccuauuuuuaaaaggccgaauauggcuuauacaaauugcuuuuugguaaccugaccacaagaacauugagguuucuaguguuaucuuauuuugccuuacugaaaaaguggaagcaacaaaagaaauaagaaucagaauacugcaucuaacaaauggucuuaagggucaaggggaaguaagugcauagugguucugaagaaucaaacaggaggagcaaucccagacuugugggggauugaaaaaacccuagaggacugggccauugucacaggagaggugacagcaguguacaucaagcuccuguuuggaucauauguugcaaccagacucaacuccauggcuucacaucuagagcaaacaacugaaacuggaggcccagcagaugacaggcauuaaugaaaggaaauguccauaacaugaauuaauacugcccagguguccaagguaggaugcuguaaaguaaaauaagauggaggcagggguucgacuuaugugacuucuucauucuccacuguauuuaaaaaacaaaauaggccuccuuuuaacauaagagcuugguauuacauggcaacauguaugugguuuugggagacaugaaauaauauccacuugaaucucaggauugaagaauaacuuucagaacauacugggaaaaaguugauuucuugcuuacauaaaauaaaacucuagugaauuucgaacauaucauauuauaaccuaaagaggauaauauuuaaaauuuaaaaagaauuacugucuuucauagaaaauuacuaauuuuccaacaauuaugaaaagaacccaauguagaagaucaauuagauuuuugaacaggacaaucauaaagaagggaggagccgauggcaaacucuuauuuugaagauuuaaauauguccaaaugacacgaggcacauggcuauaaccuguagucccagaacuuugggaggccgaggcagguggauggcuugaucccaggaguucuagaccagccugggaaacaugucaaaaccccguuucuaccaaaaauacaaaaauuaaucucauaauccagucucaaaacaaauaagcccaaaugaaacacaaauuguugucuucuggugaugccugaguagauaucauaucucuagaccuaugcuguccuaucuuauccuuuagaucuaaaauacugcccuuuacaguagccaccaaaaauguauuuaccgauaaaaaugacuuaugccaaaaaaaaaaucaaacaacauauuuauugcuauuuccuuaagaaaugggaauggauaauuuaaaaagcaaaaguuaguuuuaaacacccuaaauuuuuaaaucaaacucuagccucuccuuucccaaaaauguuauugcucuugaaggcuaucagcuaauuaucuuugaggcacaaucaaaucacauuagaucagaacuacagcaugaaaaaggcaucuguucuauauucuauccaacacaaagcgaaagugccuaacaucccccaauauauaagguauaaaaacaugggacuguguauaaaacuuuaaaaugcaaaauguucaauggcuuuaagaacccaacaguuuauauguuauuaauacaaauugcccucugaauaguacuauauauauaauauuauggacaaauggaagacauucuauaucucauuguuuucuaauaacccuaauguuagugaagacaguaagaauuaagaaucuauuauuaacaguuauuucuaacuuguauuaugacuucauaauucauaauugcucauuauuucuauaguaagaaguaacaaagcacugcuaaguguuagcaucaaaguaaccucuuauuuaaccaagaauaugucugguggugguaacuaacagggccaaaaucauuaauuaggccugacacauaauuuuauucuaacuccucagacuacacucucauaaucacauagaucugugcaaguucagauacguuagucucaaaaacaaaaaacaaaaaagguauaauccccuaacugauuuuuuauuuuauuuuugagacaaggucucacuuugucacccaggcuggaguacaguggcgcaaucucggcucacugcaaccucucccucccugguugaagcgauucuccugccucagccucccgaguagcugggaucacaggcaugugccaccacgcucggcuaauuuuuguauuuuuaguagagacgggguuuugcuauguuagccaagcuggucucaaacuccugaccucgggugauccacccaccucgcccaaagcggugggauuacaggugugagccaccacacaggcccugaauuucuuauucuaauuuuaaugaaccauuagugaauuaucucagauacuuugccccaucugaccuuccuacaccacucuauacuuaaccaugagcuacacacagugucugucuuauagagaaguauauucuaggugccuagagaauaagagucccuuaaaaauguuuguuaaauaaccuuaaaaaaauauaugaagaaacagagacaggcgcagaggacucacauuaauuaguccaaggucacauaccuaauaaguaacagagacuuugcuagauucaaaucuagcacuucuacacucuuacccaaucuacuguggaaauuccaaaacaaaaccacauuuaauacauacaacaugcuuuaucauuuaaauggccacauuuuuccaucucaaucuucuuuaucuaugacccauaaccaaacugaaauuguagcugcaaauaaauguccgggacucauuauauuugcuuucuaugcaugauaucaugcuguguugauagaguuuaaccagccuagcuaacaauuuuccaaaauaaguuucuuucccuccucccacuucuaauagguucagauuaauuucucuggaauauuugcaggcuucacugugccaggauaugucucccuuauaaaguaaggcaauuauaaagcaauuuaagguaugggacuagaaacucaaucuuucugacccaugagagcacuguucaaauagacaaagaaaaacuaugcaaaaagaaggggaauggauucaaauaguuugcuccggggucuccaaaagauucaguagaaauuauuuuuagaauuucugcuucucagcacuuaccugaauaucugauagaaagguuguggaaguucagaguuagagauauuaaacaauccacuccugcugugccauguaaaacagcaugaaauugaacucuuuaguauucggggguagauaaaguuguuuuguucugaauucaugcacuccaugucacaguuuauauggaugauaaaucugaggaagaucagauaaaaauagggcucugcacacucuuagagaucuaaauuccuuguaaacauaaauauuuguaugagucuauaugaucacauaugaaaacagacaggcagggugcggugggucacgccuggaaucccagcacuuucagaggccgaagcgggcagagcaccugaggucaggaguuugagaccagccuggccaucauggugaaacuccgucucuacuaaaaauacaaaaauuacucaggcaugguggcacaugccuguaaucucagcuacucgggaaacaggcaggagaacugcuugaacccaagaggcguagguugcagugagccgcggucgcacaacugcacuccagccuggacgacagaguaagacuccgucucaaaagaaagacaaaaaagcagacagaaauagcauggaugcauauuguugaauauaacguuauauauaauccuucuccuaaaauguuuuuauuaaaauguucagguauacugauuuccuuguuagagagucuuucagguauuucuuuuucaaugacgaaguuaacacaauuagaacgcauccugaaccuuaggaaguaagucauccacuugaaucaucauauccuaauuuauggauaagaaacugaggcacaaaaaugcuaacugacuuguuggaugucacaaggauaguaacugggggaaaaggggguuuaagugaugugagauucaguauccugcccaccagccucuuuggguuuuucaauuucguaaccacugaguacacaggaacauaaugaguaauugaagggucugaauacagaacuagcugucucacagguuucacaaugcuggccacaguaaguaccaucugagcgauguugaagacauuuaccuuuuucuacuucugcugaauaugagauaaacacagcaucuccuguccuccuccaucuuuucugcacaagucaaacagcaguaugaauguagguaaauauuaaugaggaaauaauguuuuaaaagaagggaagggaugaggauugauuaacaaaucaauaaggagaaaaauuuuaaaacuagcuaugcaugcauaauaaaauucccagaauagaagcucuaaauaguauaucaagggugcucucacuugagagaaacaaaaauaacaauuuucaaauaaauucuagguuaccauauuuuuaaaugcuauaugucauacuaauuuugagugugagucucuggaaaaaaugaaaccuugauuuauuuagcagccaugucgaaaacaauaaccugcacuccauguacucugauuacaugucuccugccacgugaaaacucuuugacauuguuucuaaagugggaaaauaccuaaagaaagcuaacuagaccaagagaguaaugcuuuuagucuauuugauuuucuaauguuaacaauauggucaggggcugggugcaguggggcucacgccuguaauccuagcacuuuggaaggcugacacaggaagauugcuugaggccagaaguucaagagcagccugggcaacacagcaagaccccauaucuggggagaaaaaaagcagcagcagaaauuuaacacuaaauaagaaaaugaaaacaacucauguuuuugaaauaaaaguuugacaauucaaugacaaaacauacuuuuucagccaaacuucuccauaaaaacaguaguacuauaaguaaauaauucaccaucucagauucacuuuaccuagcaaucccugccuucccucucaaguaugagacuaugucuggccccacuauuauauuuucucuguuauuaguuucaugaaaugauuuaaaguggacaaaagacagauguauuaaacucgaaucagaaaaaaagcaaacagaagauagaaaaacacacaauggauuucaguguucuuacaauuucucucuagccaaauuuaaacauaaucaaucaggaagaauauggggaaacauuucuugaaagaagauucauuauuauucuaauaaaucaaaaugagaagaacuggauuuaaaucaguuuaaacccaacagguauccaacacgcagaacuaacucccaugacuguuaccauuagcugccuaacaugaaacucaugaauagcaaaacaaagcugcauuaaaccagucugugacaugguaagaauaaagcauggcaacaauuuggcaacacauaccagaauguuuaaaauauuuaacagucuuuuaaaauaugaauaaccuaugaccacaacugguggcauuuuccuaagcagauaauuuugaauuaauacaccaacuuaauuuuaacaacgcacagcucaucuguguuuaccaaauaucuuaaaauuagaaaaaaauuuucuaauacuccuuuaaaaaauuaugguauaaccauguaaacugauuuuaugggagaaaauauaaucauauggaaaugcauuaccauuagguagagaaaauagguguguguguguuuucuuuuucuauuuucacauacacagauauuuauauacauauguguguauauauauauacacacacacacacaccccuauuuucacaaaauaggaaauggcuccccccuaaauagauggagugaguaagagaucaaggucucucucuugaucucucacucucuugaucuuucuauauuuaucuuaaaccaaagguguuuuauuucguacccauuguuauuuucccuucaaaucacuugccacguguaaucauauuuuguguauuuuuuuaguucucaguuguuuucaacacuaaaaccuacacucggugaagacaggcaucaggucuguuuuaccacugaauaucugucaucauuacauaguauaugcuccauaaauauuaguugaaugauggcuagcccacuagaguaaugccagcaauguuagaaacaagucaaaaaugaaaauuaaaaucgaauguugacucaccauauuugaauuauucaauaacuucccucauuucuauuuauguaaguuauuuuaaaauuaaauuaccugaucauuguguagaacccuugauuagauaaccuuaaaguauugcauuacuacaugggggaagucugccuuaauuaauaugaaacaugucauaaauauuaaggagcuuucuuugcccaggaaaugacauucaucuacaaacuacaauacagauuucuaacuaugcauacacuuguuaagaaauugguuaauucaaauaaaauguagaaucaucauugauguaaugaaucauuaacaagcucuggacaaaagaauuccuugacuacccgaggggcacagaccgcugauaaaaucuagaaagugauuugguacgaucagguguauuuuuacucuacagagauucauugaucaguccaaauuuuaaaacaggcuacauaauaaaugcaguuuuaaugaucuacauuuccucauauucacaggcacuuuuaauauauuuaaauccaaacuggaauaaauccaaaaaggaaucauaaaugcagcugaaaucagccccauguucugccaagcaguaaagaccacuuuaaaacaauuccaacuauccauccauauuucuagagccaaaaaaaagcuccacauuuguauaacuuauauaauaaucacagcaaagauuacucaucuauauguguaauaagaaaucacuacauggcuauaguuucacuuauuucuucagauguggcugccuauuacaauccauccacuggcacaaaaauuuuuuuaaaucuuuucuuuuuaaaaaaaaggaaugcgcugucaucaccagugcauaaauauaagcugcagcagcuauccauuaaaucaaaaugcaaaacccuuuccucauggggucugaaagaccaaauuaaaagggagaagacgguagagccgagggaaugaugggguuaguguaugagugcaucauuucgguuuugguucauccuacauuccaugaguuguuccuaagaggagguacccugggggugagaccgggguggggguuaggggcggggggugggaauacuguuuuuuaaauagcaauaaacaauuaucacauaccaauucugcucauacuuucuccuucccuuuguccaagaacaggacauaaguugaaaauggcuucucaacuauucuaagucauuuuagccacaaaguuaucacaccugauccauauaaucucuggcccaagacuaaauuacaagccuuuccuucacagugcaaaaucaugaagccuaugccaccacaagcucuaauuuccccucucuaugaaauguauauuggaaagaaaacuaacaggaaguccagcacuuuaaucaaauauuaaauuacauccaucuuugguucaaauuuaauacuugugcuacagcaauauguccacaguaaccagcuaugaagcauucacucuacaaauauuuuggugccuaaugugucccaacagguacaauuacagugaccaagguucauaaguaaguaaacuacaagagggagggcagaaguauaaaaaguuuucaauguucaucacugguuaaguuuugggaaacuuaacagggcuauuuuauucauaagaaaccauuacucauuauuuaaucuuuuuaaaaaauuuuacuggaacugauguggcugaauuaaaugacaaaauugcaccgcaugauuuguuccuaagauuucucuucguuaggaugcuuucugacuaaaaagagcaccuugauugucccccaaacucaggcauguaauuuagggaagcuagacuggccaaacauuccaccccaauggcaacagugauugguucagagaugggcacauggcccaagcaacaccaaugagguacagugggaaugugucgguagcuuguuauccuacagaagcuaacagucaucucugccacaacaugggaaacaacugccugagaaagaaaucaacagagcagaaaguaugacaagaaaugucaaguagguaguccugcauccagagaauguuuacccauaggaccagcuuaggcagaaucgaugcacuuaauauuaaucucuaaguauauaacacucaaaagaaauguuaaaaucaccucugaacauagaaaaaaaauuuuaaauaaaaacgguccuccagacuggaaaugcaucuacgguugaaaccagagcguaacaauuuguauuugacauaugaaaaaaugauuugauagucagcaugggauggaaugcguuaucagguaagacagucaugugaugugauccaggcacggauguaaaaguuaaacgaauaagacaaucaguaauggaacaguauauauaaggaucugccaaaagagacuguuuacauuuccauuuuuacauguguucaaaacaauucaagucaguuaauaugcuuggaauaucaagccuaucagcagauaaaaaaaacccuauguucuuaauguggaggcuugauuuuuagauugcuguuuaaaccagccaagauuuuaaaugucaaucagaacauacaaaaaggccuuaauaugaaaaguuuauacauauaaaaaugcaauucuggcucuauagcauuaagaaauaaauaucaaaauaguaauuaacaacccaggccgagcacgguggcucaagccuauaaucccagcacuuugggaggcagacgcaggcagaucacuugaggucaggaguucgagaccagccuggccaauauggugaaaccccaucucugcuacaaauacaaaaauuagccagguguggugauccgugccuguggucccagguacucagaaagccgaggcacaagaaucauuugaaccaggaguuggagguugcagugagccaauaucaugccacugcacuccagcuugggugacagagcaagacucugucucaaaacacacacacacacaauuaacccaacagaaguuacauauuccaauaucccagaaccaauauaaaaauuuuaaacacucaaacuaaaacagauuauuguaaaagcccaauauaaaauaccaucucacuuuaauacauagauccaaacaguaauuuuaauaaaaugucaaaaauaugacauccaauaaccacagagauauaaaauuaugaaguaccugaaaaugaauaacauagguccaaagauaauguuaaguaacuggcauugaacuacaaagguuuuuggaagccuauuuucaacgaacccucacuuuggaauuauucuagcaguuccaacaaaguaaacuuauaacgcagaagggcagaauucaacuacuuuuucuuuuacauucuuuaugaaaccauaaaauauguggaaacaguuuaacuuaauuauuguuuaaccacagcaacaucagagagagcagacguccucucucugagaagaccugacuaagcagaacacaaaguuccuacaacagaggcugcauaaaaaacugcuucaccaagaacuacccagcauacacauaaaugguaaucuuggucuccuuuccucaauggcaaguaauugauggcauuucuucauuuauuaaaaauaacuuuuguagagacagggacugaacuauguuacccaggcuggucucaaaauccugaucucaagugaaucucccacuucagccucccaaaaugcuaggauuauaggcaugagugcacccagggcauuguucauucauguuuaguuuucuaaguucauaaggugaaggaggccuaucuuaguucuuacuuuugaaaaauuuuaaaacauaauuaauagaucauaauuuuuaaaaauucacgcugauagugauagcaaacaucuaccacuuacugugugcauacuaaguaccagguacaaugauaaauguaaagcauuuucucauucagucauuauagauauugucucaauuaaucuucguaucccaugagaaacuauuaauaucccuacuuuacuaauguuggaaucaaagaaccauuuacuuaugaaaagccauagaauaugcaagugguaaagacacagccucauaucuuuuuggcaucaguaucuguacugcuaaaaacucacaauauaaugagaauccaggauauggaguacuaauaauguguaucaucccggaucuucugaacucugaacucgaggauaauagggcucugguaugguucucauauugagaaaacuuacagagauuauaaggcagagaaaguaaaaagagauugcaacagaaggcauacaggugcaggugagcccccugccugucaugaucuccagauaacagcaucuucccuacaagcccguuucacuccuccaguccuuccaacaauuucacagccuaguuccuuuugcacccagacuuacuaggaacaacuguacauucaugugcaagucuuucugugaacguuuuaaucuugcauaucuuccuuucucaagagucuguacaauuuuuuuuuuuuuuuuuuuuaguggaagcuugcucugucacccaggcaggagugcagcggcacaaucuuggcucacugcaaccuccgccuccugggcucaagugaucuuccugcuucagccccccgaguagcugggauuacaggcgccugccaccaagcccggcuaauauuuguauuuuuaauagagacgagguuucaccauguuggcaagguuggucuugaacuccugaccucaagugauccgccugccuuggccuccccaagugcugggauuacaggugugagccaccaugcccggccaggagucuguauaauuuuuggcccauuuuucagggagaugcuuuagucacuucaugauugaguuuuucagguucuuuguaugucccaacuaccaguccuuaucagacacguuuugcaaauguuuuauccuccucugggucuugcuaauucaauuuuuuagugauauauuuggugagcagcaguuuuuaacuuuaacgagacccuaaaucaucaauuuuuuuaugauuauugcauucugugauuuaagcagucuuugccuauccucaaguuauaaagauagcucuguccccuauauuuucaucuaauagcuuccuauauuaauuuucucugucaggucuaagauaaaucuugaauuaguaguuguguauggugagguucaagguuuauuuuguccuaaauaaugaagacuuuuuuucccuacuggaugguuggaugccuuugacaaaaaacuaaauaccauauauaaauauggaucugauguggauuaacucuucuauuaaggaagaucuagacguaaaccaagaacuagaucuacauacagauuuauucuucauaaacaaucauaucuacaaacagagauauuuuuacuuauuuguuucugaucuucaugccuuggcuuacugcaguggcuguggccuucaguaaaauguuacauaaaaguauuaagagugaggcccggcgcgguggcucacgccuguaaucccagcacuuugggaggcagaggcgggcggaucacgaggucaggagaucaagaccacagugaaaccccgucucuacuaaaaauacaaaaaauuagcugggcgcaguggcgggcgccuguauucccagcuauucaggaggcugaggcaggagaauggcgugaaccuggaaggcggagcuugcagugagccgagaucccgccacugcacuccagccugggagacagagcgagacuccgucuaaaaaaaaaaaguauuaggaguggaaauucuuacuuuguuccaaaucuuaaucuuaaggugucuaaauuuucaccauuuaguaugguauuugcuuuagguuuuucagacuuacuuccaucuaaaugcaaaguuaacucugaaaguuuuuaauaaaaaaagcaugcugcuuucucugcauuuaauaaaauggucauaugcuuuuuauccuuuauucuguuaacaugguguaugaaacugauagacuuuuaaauguuaaaccaaacuuauugugaugguuaauuuuaugugucaauuugacuggaacaugagguacccagaaauguaguaagauauuauucugaguguuucuguaaggguguuucuagauacuuggauaauccgauuacugugaaucaguagagugaguaaagcagaugucucucccucaaguggguaggcuccaucuaacaagcugaaagggccuuggaaugagacccugccucucccuggaguaggaccuguuugucugacugcaugaacuggaacaucaguuugcuucugccuucagaccacaccugaaacacagguuuugcuugggucucaagaaugccagcucucagacagaaaaguacaucaucaguucugaguauucaacuuauugacugcagagucuugagguuucucagcuuccauaauuaaguaugcugacauauccauaaacagacacacauauauacacacacacauauccugcugguauuguuagucuggagaacccuaacaaacuuguguucuggagauaaaugucacauaauaucaauuagcacuacuguccucacuuuauauaauuuagucauauauaucucucuauauauaaauuuauaauuuagucauaaauauaccuaauauauccaaauauauauauauauaucauguauuagagaacauaaaauugauaugugguuuuagacuuuuuuuuucuuugcaauuugccuuguguuaagcucaaggcuuccuaugcuuacacagccagagccacguuucucuuuuauuuccuacauauaauuuuucucucauuaaaaauaaauaacaugcaagaaagaguaaugggaaacaaagccauuauaaagcacccuccuggaaauuuccauuuuucuaaacuuucgcauucaagaaagagaaguuuaagaauaaaaaauguaaauggguguaaaaagguuauguaggagaaaaaucuaggcauacguucacuuugcuuuuuuuuuuucccgacgaagucucacucuguagcccaggcuggagugcaauggcgcgaucucggcucacugcaaccuccgccuccugggcucaagugauucuccugccucagccucccgaguagcugggauuacaggcaugugcuacugcgcccagucugugguuuuuuuuuuuuuuuuuuuugagacggagucucacucugucccccaggcuggagugcaguggcgugaucucggcucacugcaagcuccaccucccggguucacgccauucuccugccucagccucacgaguagcugggacuacaggcgcccaccaccacacccggcuaauuuuuuguauuuuuuaguagagaugggguuucaccguguugcccaggcuggucuugaacucuauaaagacacaugcacauguauguuuacuguggcacuauucacaauagcaaagacuuggaaccaauccaaauguccaucaaugauagacuggauuaagaaaauguggcacauauacacuauggaauacuaugcagccauaaaaaaaggaugaguucauguccuuuguagcgacacggaugaagcuggaaaccaucauucucagcaaacuaucccaaggacagaaaaccaaaccccgcauguucucacucauaggugggaauugaacaaugagaacgcuuggacacaggauggggaauaucacacaccugggccuguuggggggucaggggaggggggagggauagcaauagaagauauaccuaauguaaaugaugaguuaaugggugcagcacaccaacguggcauauguauacauguguaacaaaccugcacguugugcacauguagccuagaacuuaaaguauaacugaaauaaauaaaauaaaaugacaauaaagaaagcaaagauuacagaaaaauaauaauaauaguaaaauauuaacaucagaguuauguucuuagcuuucuaacagucaaaauuauuagcuccaacagcuugcaaaugaagcugcuuucuaaccauuuuucaaacauucaaauacuccucugcacugaauaguuaaucuaggaauagcuaaaaaagugauagcaagaaacagaaggauuaaaaaugaaaugugagagggaacugucaggguggcggaaacaccaucaaguagaaaaacauauagguagcuguuaggggccuugagguagucuaagaagacugagaggcaggaaaaugaugcuucucuggaagaaugugcggaagacacaggacaggacacauugcaagagaaggaauggaucucauaaauuuaaacagcaaugaaaccaucaguaucaacucagauguccugucucuccacuguuaccccucugcuacauccugaaucuuucucuguauuguuaccuuguugcaccaacuguauuuaucuagcuaacaugcuucauauuucaccuuaaaugcccauagacuaggucagcuccccuaccacaaacaacucaaugccaugaauaugcggcacgauacuacuggucauaauuaguuguaucauuauuucauaaugucagccucugggcuuccuguaagaggacaaagauugugcuuauccugcaucacugcaacucccaaccagaguggucaauaaauauuuacugcaugaauuaauaacugaauaaaaaauguguccaugaauauauuuccaacaauuauuaauacuacuaaaagcauuugucuaguauuuuuuuauuugcuuacuaaaaacuacuugcuaagaaucacuuuuuuaaucacuuuacaguuuacuaaguacugagcaccauucuaaguacacugcauuuaacaacucaauccucagagguuggcauaauuauuauccccacauaacagaugagaaaaccaaugcacagaaagauuaaguaauuugcauaaaguucaugguggacacaagauucaaacccaagaagccugauuccacaagacauuacuggcucaaauuuuaauuuuaaaccaacuauaucauguccauaaacagcuuauauguaucuuguaaaauauuuauaggucugagauuuaacauuuuagcuagauaauucucacaugcauaaugaauuacagaaaacauuaguacuugauucuugauguugauuucuuuuuuuaguaauugaguaauuacaugagauuuuaaaaauaaauacacaauuuaaaguuuucauguuaccuaaaugcauuuaaguauuauaaucuaaaugcccagaagaacugcugaauuaagaagaaauaaaucugagucaggguugugacagucauuacagcugaugucuuuuuuuuucucuacuaauggaacaaagaaauguaucuuauuuuacagaaucuaucauguugacuauaaaaaauuuacuaugugaaaauguaaaugcugaaaacauuuauaggauuucuuguuccuuuaauaaaaucauacugauuaaaaagaucauugcucauacuuuguuuaaaaaugaaaccauaaaguguugacuucauacggucugauuaugugauuaucucagaagcugaaaauugcaauuauccuuaacucaucugaacauuaauggauucacuguccaaaggucaguuugcguuucugaacacuagaagacuggauaacuuaucuacauuucaucuucaaaugcauuuggauauaauuuuuucuugaauuacugcuagcuagauuaaacacugcuacaggaagggagcuuaagcuauaauguaugcuguguguucauccaggcuguugagcauacaaaguacaagauauauuuaaauguguacauacaugccuaaucaaauucacuccuauugcuuuuuucaaucaaucaauuuaauucauuuucuucaaaaucacagccaauagagcccccuggugcuccucuuguaucccacugugacucuaggguuccucacgacucugacauaaguacauaacgaaguuaauguuaccaagcauaaccgacccaguagcugauuuauaaaugaacuugugaaggccagcaggcauucccuacagucuuugauuuauacaugcacucauucaguaguacacagaaacugcauucacaacauccuuaaaacaccauaagcuagaagggaaaaaagcuuuaaaaugauggcaauuucuauugagaagaugcaauaauauggaaaaauaaucaugacaaugaacggaugacagaaaaguaauaaagcuaaauaccaucaaagaggucaccauguuuuuauuuuuguuuuuguuugacagggccacagacccuuaccuuguauauuacacucaccuauuugaauuuugauaacaaggauuacuaugauaaauaauuuugaauuuaguuaagucauaauuuaagacauuagauauuuaaaaagacaauuuauaccuuacuaaugaauuaugcuauguauaaauacuauauucugucugaugagaaauaguuacaauguuaccuucuuuacaaacagaaaguuuaugcacucauuuucugacaguuuauacaaccacgacuaucucuguucagaaaguagguggauaccuuucaguaccugcaucuaguaaggcaguaacauaaacacaaaacacuauauaugcaugcaagccaucuggauguaauaugguucuucuauucaccaccccacguuuagugcugcacacaucuaguaacaugaugacaagacuguccuccauaauuaccacuggauaauuaucaagccauccuuuucuauuucaugacuauuaggcuauagcaauauuuaacuuuuaaaauaaaggacaacuaauuuuagauauuaccuuuaguaaauaaauuuugucaaauguuugcaaacucacaaugcugacauaauauaaacaaacuuguguggcuauucaagaggcacuacaugguguuuaagugucagccuaagaaaaagaaagugaauuugagaguguccuagaagccaccucuugcuguucuccaucacugaaccccaugucgcucauaaguagucuacuguuucacaaugcguguauggaugucauuuuucugugugguuguccguuucccacacuagacuguagugcucacuagccuagugguucucaacugaggugauuuuugcuuccuaggggauauuugagaaugccugaaggcauuucuaaaggccaggaugcugcuaaaaaugacaauauugcugaagcugagaaugucugcacugggucuaagcaacuuggagaaagagacuguuuacugccuacaaagggugggcauucagauaugggacaaauggauacacauguacaugaaaauuugugucagugugaaaucaucuuuaaaccaucuuucucccuacgacacucuuuaaagaacuuccuuuuuuccuacuuucuaugacaaucuuuaaagagcuuccuuuuuauaggccacgcacagugacucaugccuguaauuccagcauuuuggaaggccgagguaggaggacugcuugagcccaggaguuuuagaccauccugggaaacaaagagagugaccccuagaugaguguggugaugcaagcuuauaguuccagcuacucaggagacugaggagagaggaucccuugagcccaggagguccaggcugcagugagcuaugauuaugccacuguacuucagccugggugacagagacccuguauuuaaaaaaaaaaaaaaaaaauuaaaaacauuuuaaaagagcuuccauuuauccuucuuucaacugcuucacagucuuuguggaaugaaacaguauaugcaucuguaauaaauaucaggacugcagcaguucugcccuggaguagagagggaauggggaaaggaauauuggccaagcuuuuucuccauugugacuuugggaaggucuugaccccuaaggaaucucucagggacuuggaucagauggccucucagacuucugcuugggaggauuacuuuaaucguuucuguaucuacaagcauucacuggauguaacagcuuuucauacgggcuacacaguuguuaguauggcagcagaggccccuacaguauuuuauaccacagcuguugucacuuucguaguaaccauaaucuuaggucaggcuuuuauuucauuuuaagaggcuuuaaauaagaacaugccuggugauaaauuaaguugacaggcauuuccuuuuauuacaacugaaaggaagacauauauauccgucauguuauuugguguaaacaacuuaugaguagucauaauucguguagccuaacuagacuacaauuucacagaauuaacaugccaugacuauauacuacaauucacauacucuucuugaaguugucuuauuaacuauaauauaaacucuuaaauugaaacaaaucuauagaaugacaguagauacaaacuuccucaguaaauuuuaccaguguaaaaaccuaccagcuggcucuugcaguugcucagaguaaauauguagcuucuguguaucagguggcacuaugcuaagauaacgacaagcaagacagagugaguacacuuaaaauacaauaggcagaccaaaguucagaaaucauucuucaaggcauauucuccaagagccucugacagguaccacagucuaguaucugaagaaaaggacagggaggcaaagaaacagaccaacacuuucaagagugaggggacucugacauccacuccucuaacuauggucaaauaaaaaguaacaucugggacuacauggugggaccagcauggggauuucaaacagacgauaaaaccaugaagaaaacugggcucucuagugcuccucuucucaccuacuucuuuuaaaaguaguguuuggggguaaaucuacaucaagcuaagucauuuguucacuggguuccuggauaucucugaaaaaggaagagaaaacuugggcaggacuauaaauguuuuauucuaggcuccaggcuuuaaaaaggaggcauaaaaggaacuuuaugauuuccuucuauugaaccuaucaucugugcucuaauaauauuaucauaacauuacacauaggcugggcaugguggcucacgccuguaaucccaacacuucgggaggccaaggcagguggaucgcuugagcccaggaguucgagaccagcuugcaucuaugaaaaacacaaaaauuagccagugugguggugcgcaccuguggucccaaccacaugggaggcggagguggaaggagauggagguugcagugagccaugaacaugccacugcacucuagccuggguaacagagugagacccugucccaaaaaaaaaaaaaaaucauauaaagaaaggcauaauguauuuuuaacauuauagccaaacuacuagggggaaaaaguaaauauuccuuacucagugugauacgauuuuuuuuuuuucagacagagucuugcucuguugcccaggcuggaaugcaauggcgcgaucucggcucaccacaaccucugccucccugguuggagcaauuauccugccucagccucccaaguagcugagauuacaggugcaugccaccaugcccagcuaauuuuuuuguauuuuuaguagagacaggguuucaccauguuggucaggcuggucucgaacuucuggucucagauaauccacucaucuuggccucccaaagugcugguauuacaagcgugagccaccgcaccggccucaaugugauauaauucuuauccuuagcugcugucacaguaguuaaauaauuucuaguaaaaauacuauuguauuauuauuaauuguuugacaagacugcagaguuaacaggugaaagacggcauugugagucacuuuuggaaacaccugguuggagaaaaacuuucugucccugcaauaaaaagaguaucuacaagcaauuauuaaaaaaaaaaaaaagcuacuuugcugaagcaaacccucaguuguuauaacuaauguuuauaugucuacaauuguucucucccucggagaagcaauauacuuggaggucacaccgucucaccacccaacuucuccauggcccucaaacacggauucuacaggcuuucgauaacacuguuuauuauuaccaucaucaauuaaaaauauauguacucgaauuguguuuuauuguccaugaacaugagguucaggaggguuaggcaguuugcacaaggguuucuagccaagaagcaagagggccaguaugcagacccagcucucugauucuggagcugagugcaugccauguuuucacccccuccccaccacccuggcuugacauggcuccugcuauaacaugaacacccagacccacuccugguuccauuucacaaacaacacaauugugcaaccaauagaaaauaucagucacaacacagagaaacagcagccuccacguuugaucucuuaugguggugguggugaccuaccaguauucuccgacaaugucgcugccacuaccacuguggcugcuauuacugcagaaaaaaaaaaauuaccuaauaucauggugguauuaacaagcucuaaaaguggccaaaaggcagguuucuuuucccuggaaagaacagggucccauaagagaguuucaauggaaagcgaaugccaaaaacccucauaaaaggcaggacacagcuuuccuucuugcaacuagucaucuuguaaagaaaauagaugguaggguuagugcacaauauuuauaaugaaacauagaaaaggacuugugauaaaaauaaguaucaaaagugacaacaggcagcauuaugcagaacauaaucuuccuaagcagcugugugccagggagaauuugcacauguguuugcaaggcauuacaaauaaaacagcuuaugccagagucauuauuuucuaccucuagauaaugcagcuugaaaaauaucacaaacagaagauaauggcucauauuaaucagccccacuaugaagugggucagcaaagccagcuggucccuuguccaucguaaccaaauguaagagcugcaacugugagaaagacugcaacuuaacacugccugaccaguaagacacuauuucagaaacagaaccaagccagaggauggcagagaaggcuucaguaccagagacacuaccagaaacuauagcgcuccagcugagcucugaagccaaagaaauggauacccuacuaugccuugauaaaagaaagauucugcuaccaaaaaacauaaagcaugccagcugguuaaucaccuaagcugcacagacaacaucuaaauacaugaggucccugggccuggucagaccucauaaagaagggauuggugauaucuuucuguaaaaauauuuuaggcucuguguauuauaugaucuuuugucacaaccacucaagucagccauuguaguacaaacgcaaccuuagauaauacauaaacaaaugagcauggcugugucccaaaauaauguuauuuacaaauacaggcagggggguauagugugccaacccaacuuagaaauggaguuucagaaaaacaggugaggugacauuugacccuuuuagugggcaacaaacaccaauuacaagauagccuucguccgcacccacauuacaauuuuuuuuaauuuuuuaaauuuuuauggguacuuaguagguguguauauuuguggaguacauaagguguuuugauacaagcaugcaaugugaaauaagcacaucauggggaauggaguauccauccccucaagcauuuauccuuugaguuacaaacaauccaauuacacucuugaaguagauuuuuaaauguacaauuaaguuauuaucgacuauagucaccacauugugguaucaacuaguagaucuuauuaaaucuauuuuuuuguacccauuaaccauccccaccuccccaucaccacccccaacuacccuccucagccucugguaaccauccuucuaccauguccaugaguucaauucuuuugauuuuuagaucucauaaauaagugagaacaugugcacacugcaguuucugaaggaacuaaaacacacucuggaaaugaggcagaggcagagguggcacaguucuguuguauuuccaacccuagcuaaagacaacugguuguauugugcucuuuuacuagcauuauaaagauugagaacaauuuuguacuagacaaagcgucacuguguuccaucugcgguuagugacuugcucuggaaauuaaaguuaauacaucaaauucugagacacuuugauacagaguguguauuuuucuccacaacugaguuaacugacuugguacugcucauaaggcaaauguggcaaggagccaaaagauuauaacuauuuuacauaagaagaaagggaaaagcugaaaaaauuucaagcgccaaacguuaaaagccaucaugccauuaaucagaggcuggucacguuuuccuuuucuagagucauacuucgauaaagcugcggcacagauuccaugcaaauaugcaggcaacacaauaagagggcugaaugauuaugugaauccagaucaaaggcauccuucucugcucuuggaaaaggggccucuauacucagcucugcagggccugagucaugguccacugcacugcaugaaaaacaaagggugaaccaaggacaagaaacaaaacagcaaacagcuuugucucuauucaaagguaaaaccaaaaccuacugacacaacugugcauugggcauuucaucucucugugccuuaccccaccuaaggaacugauuaccucuuucuccuaucacugaccaaaaacugauacuauuaaaacucuguccacuccuaccaccccacaguagaagaauuucugcuaaaauauagagaggcauucagaucuuggcucuagucuggaagcccaaaggcuuucaccauccaguaaccagcaauggaccuuuuaugcucccaggagaugcaccuguuccugaaggggaggaagaggggucuagccacaaaauuccuuuaguacaucauuguucacguuagcaaacuaauaaagaguucccacucuuccaacagaaagucccugaugccuccugcaguacuagagacugaagcaaaauaauuaguaucggauucuggccuuuaauucccaauuugcaauauucuguuccuggucaaauuacuuaacccuaaauggaacuaaacaagaauuuucugaauuugccaaauacuaaaacccaugaaauagggaguggguacaugaagucugcccauucagagauucucaacugaccugacaauaguuacuggcuuucacucuccauuguugggcuagguacuuuuaagaaguuacauagaaugcuaaaucauuuaaauuagaauaucuuagccuuguaaaagcugccuuucacaauuuccucaaagcuaugaauccaaacuccagaaaccugcacauuauuaacauauauaagaauuuuucauauaauuuuauagauagaucaauaaggccucuccuugguccccaggcuaacacaucgugaacagacaaauaaaaagaucaugucugagacuugucaagaguagcuaccagaauaguucauugucaauaaaauccuucauuuuauucaauauaacaaacaauuaugagcugaugggugcaggaauugugcagaguucuacgaaaauacagacauaauuaauuauaccauagccccacucuuccaggaacauaaaaacaaacauacuaugaagacauugacgugaccgaguacuaagcagacauuccaagagucucaggagaaaagaggagaaagucauauugcaugggaaaggcagcccugcuguuugaacuagacacugaaagauauauaggaucagaauccuauguaucuguguacgaagggacagaagacauggaggagacaauucaccugagaauguauacugccugacugguuugaugugagcauagaaugaggugaaguauccaugaaugcagugaaggaagagaaagcaaagaaguccuaugcgcaagguuugcugacccccgacagcuacuucugaaaccucagagaggcugaaaagguaaauucaagaugaagacuuuaauauaaaaacuagguauguggugacuuuggagagcaaauucagcuaaaugguuggaagaggaaccagauuuccaagggucaagaagugaauauguaaugaugaugaggcagcaggaagcagagaauaccauucaaguuugggagaagaaaauagggaugauaugguggcauauuaggaaaaucaguguauucacuauuacucauaacuaauucuauaguugacguuuuuaaaaauccuccguucucucaaaggucacaaaucauaucugaggaucagcaagaaaagguccacaugaauugguaaaauauuuguauaacaugguacacugagacuuuuauuugaaacaaaauauuacucccuuaaauacacauuauuuucaaaaugagcuaucaaaaucaauuuuauauuucauauucuaauaaaagaaagcuuuauagucuaggcagcuuagaacagccuccagagcaauuugaaagacaaagagauugaucagauuauugcauugcaaguauuaaauguuucuuuugaaaauaaaugcaaacagccaaguuaauucaaaccauaggucaaagcagaauaaauuauguuuaaaucucucaauuucaucuucaaaaaauaaaggcgggaaagccuuuacuccaugagaaucaaaacugcugaauaagcuggugauuaaauacacagaccacucuauauuucaagugagaacacucaggcugucuuguuugagugaaagggagaugucugaugcuuuucauaauaaauauccauucauaaaauaagcuaaaaugaacaaaaaagaucuacugccuacuccagcuauuuuacagagaaacguuggcaaggaauuuucuaacaucuaaaauaguaaaguaucaauuaaucaugaaaauggcucagauaaugcauuacauuuuaucauauucauucugcugccuuaaaccauuuuuaaaaugacaucacauaaaaaugcaaguaccagucauuuaaagaaguaaaaucuuuaaaaauauuagaucucccucccccgacugcaaaccgugcucacuguacaaauguugaguaacaaggacuaucauaaagaaaauaacaaccacuuauagagaaccacauuuaaccuauuuaucuuacguucaucuuucuaagagcacuuaugucacuggaacaaauacugcacaugaucuuucuuuuaaaacauacucuggggccgggcacaguggcucacaccuguaaucccaucaguuugggaggccaaggcaggugaaucaacugaggucaggaguuugagaucagccuggccaacauagugaaaccccgucucuacuaaaaacacaaaaaucagccaggcgugguugugggugccuguaaucccagcuacuugggagccugaggcaggagaauaacuugaacccaggaggcagagguugcagugagccgagaucgugccacugcacuccagccugggcaacaaagugagacuccaucucaaaaaaacauauaauaauaauuauuauuauauauauauauauauauacacacauacacacugugaacaauuucccauaucaguaaguauuggccuaacaacauuacugaaugguuucauacucuuuuccuauaaaacuguaccacgauugauuuauuuaucuaacccuuuacucuuggacauaggcguaccaucagguugcuuugcuuugcuguuuuaaauaacucuauguuaaacaucuuuacauauaccaauaacuauuucuaaauccuuagaucaacuuuucagaaauaaaaugucagguuguagggggugcauuuuguaauuuuucacacauuuuccucaaauuuccuuucauaaagauuaaaucaguuuacaguaucaucaacaauguauuuuuuaagcccauuuaaguucagccuuauaaacucugguuauuauauuuuuuaaauaugagcuaaguaacagcagggucaauuuucaaaaaucacacugccauaccccaauauuaaaggcauaaagagaaaaaaaaauuuaaaacuuaaaaugacaaaagaucaauuaucauaaucauauauuuauaacgugucauuuaaauaauauugcuauuguuuucaugacuucauacccaauucacauacaaaguacuaagugaaguaaaucauacaaauuuuucucuuuuaauuauaaaugaauuugggcaucucuaugcuacaugauuaaaugcaugaaauaggacaaugacagucaaauucucaauacaguuaaguguuuucccaaaguuaugucuaaacuguauaccauggguaauuguccuguuauaauuaucuguagauugcacagaguuuaacacucggcuuaaauggucaguucugguuacaagagauacucaauagcccccaccauaaauacacacucuuaacuccuguucccaagacauuccucuuuuucauagaaagccgacucccaacaaaaaacaaaaugcaacuaguggugcccauaaucucaugggauguaucagucuccauaagggcaccagaauguaaucagaucaugacuagaagaaacugauacugggcuucagaguccagaagacagaguuuauuaucagguuuuaauuuauaacucaaaagcauauaaggacagggagagauguguuaaaggauacaaaguuacagcuagauagaagcaauaaguucuaguguuccauaccacuguaggaugacuauaguuaauagaaauauauaauuucaaauagcuaagaaagaagacauugaauguucccaacaccaagaaaugauaaguguuugagaugauggguaugugaauuacccugacugaucacuauaaauuguauguauuaaaacaucacuauguacccaaugaauauguacaauuauugucaaguuaaaaaaaaauuaauaaaauaaaauuuaaaaauguuaaagaaugaauaaaugaaugccucccuucagagauggcaaagaauaaguacuguaaagcuauuccuccuccccccaaaauucaaguauuuucuguuaucugaaacauuuaaggaaagguucauggcaugacuacuaaggaucugagauuuuaacucagccacagcuuuuugguagagcagucaaagaaaagauacugaaccggaugaaccaugaaaaggcauaugcaccuccuuaaagguauuuauuaguuaguuaaccauaaaaaaguaugcuuucucucccugaaaacuucaacuuuuauguaaaugauaauaagcagcuacaauaaacguuaucaggagggaacauuggcuagcuagaagagcuaguuuugaguuuaaucaguauuaauaaacagaauacagagauaaucucacuuaaaccagcauuugaugaucaucuaauugcuaagggacaaugaggcagcuuaaauuugcuuugaauuuaguagggauccauauuaacaacuguccaguacagguuuucacauaaauacuuccccucaaaucuaucaacacucuaaaaucuguauggaugaauuuaccccauaccuagaggcugcacucucaaagacagggaaaaauaaaaccaaaaacaaaaaagccuagaucaguguaauuuucuucauucuaaacauagauuucuacuuaccaugauuauuuaaaaugccaacauuaacaaacacaagggaaaaaucauaaugaacuauagaaagaauaguucacaucaauaaaaccucuggaaaggagaauuuaagguucaagacaaccuucuauaauaaaauuugcuaaucauuucaaaauauuuaugcaucucaaaacaucacauuguaugcuguaaauacauaccauuuuuauuuguccacuauaucucaauaaagcuugaggaaaaaaaaaaacaagaaaagauacuccaccaaaaaaaaaaaaaaaaccagccacauggguggccagagaaguuucaaaaguuaacuaugaagaaaugugacuccuugggcuaaauaagcuaguuauacuugagccuuaaaucaauuaaugcagggaucucaaaaauccagaaagaacaucaauuuaucucugauucuuuggcuucauuaacaaaaaaaauggucccucucccucuccccacggucucccucucccuccacggucucccucugaugccgagccgaagcuggacuguacugcugccaucuccgcucacugcaaccucccugccugauucuccugccucagccugcugagugccugcgauugcaggcgcgcgccgccacgccugacugguuuucguauuuuuuuugguggagacgggguuucgcuguguuggccgggcuggucuccagcuccuaaccgcgagugaucugccagccucggccucccgaggugccgggauugcagauggagucucguucacucagugcucaauggugcccaggcuggagggcaguggcgugaucuuggcucgcuacaaccuccaccucccagccgccugccuuggccucccaaagugccgagauuacagccucugcccagccgccaccccgucugggaagugaggaacgucucugccuggccacucaucgucugggaugugaggagccccucugcccagucugggaagugaggagcgccucuucccggccgccaucccgucuaggaaaugaggagcgucucugcccggccacccaucaucugggaugugaggagcgccucugcccggccgcaaccccgucugggaggugaggagcgucucugcccggccgccccgucugagaagugaggagccccuccgcccggcagccaccccgucuaagaagugaggagccccuccgcccagcagccgccccgucugggaagugaggagcgucuccacccggccagccgccccguccgggagauggggggcgccucugcccagccgccccuucugggaagugaggagccccucugcccggccgccaccccgucugggagguguacccaacagcucaaugagaacgggccaugaugacgauggcgguuucgucgaauagagaagggggaaauguggggaaaagauagagaaaucagauuguugcugcaucuguguagaaagaaguagacauaggagacuccauuuuguucuguacuaagaaaaauucuucugccuugggauccuguugaucuaugaccuuacccccaacccggugcucucugaaacaugugcuguguccacucaggguuaaauggauuaagggcggugcaagaugugcuuuguuaaaaagaugcuugaaggcagcaugcucguuaagagucaucaccacucccuaaucucaaguacccagggacacaaacacugcggaaggccgcaggguccucugcauaggaaaaccagagaccuuuguucacuuguuuaucuacugaccuucccuccacuauuguccuaugacccugccaaaucccccucugcgagaaacacccaagaaugaucaauuaaaaaaaaaaaaaugcaaacagcacacuaaaaaaaaaaaaaaaaugaggaaagugucauaucaucaccaugucaauacuauuugccuuucuacaaggucacuuuuauaaguacguauauuuagaacgaaauccuacuguucagauaaauaucuacuauaagaaaagguacugcauuucugcuuaagaguuauuugaaacuaacaaaugccaccaaaggaauggcaggaugauucaaguaguuuugcaaauuuauucauauuaauaagaaauaacuguguaagucacaaaacaguuaauguucuuuaaugcaguuaguaaugcuucagauuauaaauuucaaagacugauucuacaguuaauaucaaauaggugauuaucucuucagauguaaccauaaaaauugggauucaauauacaaagcugaauucugauucaagugaauaaagugacacacacugcagcaucucaccuagaaaaaaacaggaaaucaaauuacacuuagaagaauaaggagaaguauaucuguuuugaauaagggacauauacgagacugacaaaccaauaaaaaagaaaugaaaacccagacaaaaaugcaaaugguuauaaaaguguacagcaaugguucucaguuuucauacacauuauaaucuccuaacaagcugguaaaaaaaaaauaucaaggaacaagccacacacccaagauucugacuuacaccaggaugggccccaauacugauuaaaaacucccuagaugauucuaaagcacagccauauuagaaaaugacaaauagauuagggauaaacuggauucagguuauuugaaacaauuucaaguaaacaauuugaaauucaaggaccuagaggaaaacuaaguuggucucggccucauaccauacaaugaaaacaauacuagauggguuuacaaaaaaauuauaaaauuuuuaaaaaucuaaaugaccaugacuauaacauuguaauauacaaagccuuucugagcauaaaacaaaaugcugaauaaagacaauaagaaagaagacugguaguuaugauuaaccuuaucuaaacaaacagcucuucuuauaggcauuaagaaagcauuaaugcuaacaggaaaaugaaauauaaaggacaaaaaggaaagaauuuuaaaaacauaaaaugacuacuaaagaugagaaauguucaguuucucauguaaauaaauguauugaaaaauuuccauucuuuaccaauaaaauuagaaaaaaauagcuuucacaucuagagcuauuuagaguacaaaaaaucagaacagaaguacgguuguagaaacucuaaggugacauucuucagagaaauuuggcgcaagugaauguaaacaccucccagagauuacacugggaaggaccuagaaauguauucacauggcuauauuuguuuuuguuaauuuacaaaaguacgacauuuucauuugauucuguuaaacacccccugaccucuuccauaauaauccuucccuucacuaugacuuagaccaguugggaucagaggagcugcuggaauauuugggaucuggccaagaagcaaaugaagugagaugcauuuauuuugaguuuagagauaaauuuuaauuuauaaauaauaaaaaggcaaaaacaaaagaaaaaaggaaacaaaaaauaauguuuuagaauuauuuaauaauucaauuaaagagugaaaaagacaaguuuucugcugauugaacauaaaauggcauuaaaaaauguaaaagaaaauucauaaugaacuauagaaagaacaugagugacauacugauuauaaacucagaguauauucaauauauucaaauauuauucacuguguaugcacacagacaacauaaacacacgcacauaaacaaacaccuugaaaagucucaaaauauuacaacucacauaucacagaaacuugguagagauuuacccuaaauguggauaacaauccuaaaaaucugcauggcauacaaauaccaaguugugacaauaaaagaaauguuuuaaaacuauaaguaaugcucuccaaaaauauguuaaauaaaucaaaaacugaaucaccuugccauauucucuucagaaauauuacaaaauuacugcgaugugaagaggagaucaauaauagguaggaacaaaaaguaaagaaaaaugucacggaggugugucagguacaucucuauauaauuaauaaaaaauaaaauuaaaauaugguauugauauauuagcagaaccccacuuuacauaucuuacuuucgaagucagaaaaugcaguaagcauaauuucuuuaaauauagauugucaaaaucucuccauguauaguaucaauugcaacuacuucaucuccaauccauaugauccacuaacccccuugauuacacaagcaauaccauaggaucauucucaucuaaugacaaaugaagugacuggacauaacucauucaauuuuucauaccaaggaauucaugcaaauuuacauucauuuaccacaacugaauucucauuugaaugguauaaauuuugccauaaaauaccaauagaaaagacaucuggaccaaauaaaauaucauaaaaucugugaguuccaacugugcugcuucugauuucuauggaauuaaguacagacagcccagucccuuccaugaccaggaaaaguuuaagcaaacauuaaaaacacauuuugcauaagauucaagaccuuaacauguuaagauuauuuccacuaucuugaaaaauauuaauaaguaccuuagauuaaaagccaagcucaaucaguuacuauugucuauauguaguaaaauccugguuuuaaaugauauuuaaaaucuaaaauauaguuaaauucacacaaauauuaucucuaaguaguaaauuccaucuauuuugauaaauucucagauuauaaauuuaguagccccaucuuuaauuuucucaaguagauccuacuuaaaagaugauuuugucaaaauuaauuaauuuaagcuuacaacacuuucucccuaaucaugaguucaagauacaaacauuuaggcaaauaaauaucaacaaaaaauacaucaaugcuacuacuaaaugcuuuauaauccacaaauugcucugaauuuaugcuacccaaaauaauauuuauauauacauuuucacaaccagggugacagguaaaauugguuuaguuaauuguuucaaaggaaggaugaaacuggugguaacagaaaaaagauaaauuauauucauguuauauuauuguuuaccuaagaucaauugacuaacaaggaaaaaaugagagagaaaacaagcuuccuuguguguaagcauuuuuaugagcaugugagcauuuucgugaguaugugugcggguccacggguucgugcagugaguaagagguggaagguaugucuguggcuguguagagcaagaaagagagugagaaggagaucacauaaggucccuggaugaucacaauguagagcaagacaaaaacaagaucacugcauaaucauugaaacacaugcaaaaauaagaacacuauacaaaccacaggaauaacccaacaccucuaguuccagcuaauuugaguaacucccauguuuuugcuaauuacacuuuuagcuugcuccaguccccuuguuguauagcuaaaaugaagauaccagaucauacaauugcccccacauucugccagcauccaauccaaaccaaaaccacucuucuuugaacccuuccccuaacaauaccuaagcaagccgaaaucuacuaacaagcucuuccuaagaucaaugguucccuaugcugugcuguuuccccuguugcacagaggcaaaaaaaaaaaaaaaaaaaaaaccucuaccuugacaaaaaguguguugcugguggauuuuagaggacauuuacagaaagaauauucaaguuaaauuuuuaucccuaaguaaccuauauauuuaacuuucacaaugaaaaugagugccaaaauacacagcaguuuucauguauuugaucauacccuaauuuaggugaugaaagcaaaaagaugugagccaaaaucuaaugagucaccaaaagacaugcugcagcucuuuugaacaauguacucaaacuauuaaaaggaagugccauuccagaacugaugugcaugaaauccugcaaaugaaaagcaauuuggagaacagaguuuaacaccccagcuuccagacaauuaaaggauaaacuaccacuguaauauuaagcacuuccugcacugccuaggccuucugaaucuggcauaaguucaaaugcaaggauguucaaucaauaaagauaauaaauucagaugccaauucaacagcacccucugcuugcagauaauuuaauuucauuuaagaggauuuccuaacccaacacauaauucgacaaaaucuaucuuuuaaauuaugaagcuaauguaacccauuuaagauauauaaauuuaagcuaaccagaaggaauacauuaugacauuuuuacauuuaaauaggcccgacaugacugaaaauuagcaaggauccagguaaaagucugucuggaguuugacacugaucuccuggcagcaaggcauagcaaagugaaucucagaauuuagcaagcaugagaaacaucuggggacccuguaaaaaaagauucuggcuuaaugauuauucaagugaggcccagaaaucugcauucuugacaaacauuucaguuguucugacacagaaggccuuccauucccacuucuacacaaugcaguaaaguauucuauagcagcagacuaaaguguuuccacuggggcagauaauuauuugugcaaccuuuuuuuuuuuuuuugagacaagauuucccuaugucgcccagacuggagugcaguggggcaauuauggcucacugcaguuuugaccuccugggcucaagcaaucuucccaccucagccucccaaguagccaggaccagaggcacacgccaccaugcucagcuaacguuacccaggcugaucuagaacuccugggcucaggcgauccuccccacuaggcguccugaagugccaggauuacaggcaagagccacuacaccuggcccuuauuugugcaauuuuaaagugguguuuuauccaaagagaaaugcgaaguuuguaaaauaauuuuccucaaaugauaaugacuucaaaagacuuacaaaucuuuacagaaaauaaauuaacuacuuaacaucuaugcucuaaaaaugacuauaaauauuuuuguaguuaacaggaaaucacauucaauuguuuccaacuugaauaacagagguaagaaaaaaaagaauaaaaaucaguuaaaauucaaucagaggccaggcucaguaccucacaaauccuuuacaaucccaaaacuuugggaggcugaggcaggaggauugcuugacuccaggaguuccagacagccagggaaccauggcaagaccucgucucuacaaaaaacuuaaaaaaaauuaugcgggcaagguggcacauggcuguagucguagcuacucaggaggcuaaggugggagggucauuugaaaccaggagguuggggcuacaaggggccgugaucaugccacugcacucagccgaggugacagaguaaagccgucucaaaaaauaauaauaauaaauuugaucacagagguaaccacugcucagcauuuaagacuauccuuuacucccccuaugcuuccuucuauauuccuugaguuuugcuucauuauauaaaacaucaagguaaaacugucaaaggaaaggcagaucacuacuacgugaaagccuuaauuuaaggaaguacacaauuguaauaauuacagaauccacagcccuaaaacaaagaaagacuugcaguuagcucacaaaccccacaggaagaaguuucauaacggagggaaagcacacauggaacagccuauauugcauucaagccauccugguagcagaagagcaguggcagcagugacaugccacuacacguaacaugcagaugagcccuaucucauaucaaagaggcugccaucuuccucgucaacacaguacuggaaagaaacaaaacacaaaauuaaaaaaaaaaaaauagaaaaaauagaaaaaagacaaagaggcagccauuggccucaguaccuuacaaccuagauuccaggaagcuugagugacuucuagcuuggaggauuaaacacacacacacacacacacacacacacacacacacacacuuugagggcuagaacaugagaaagaaauagauaaggcuaaaacagacauaauaaaauaaaagggaaaagggagccaaauacauggguaaguuuaauaaauuacaagaaaccaguuuuaucuuaaaguuauugcucugcuacuucacccaaacacaaugcggucaaacccauuauaacaaagaugaaaguauacgcucuaccaauaacugcucuaccaauuuauauuggaacccuuuuuaaaagagcccuuuuuaaaagaguuucaaaucaucugaaguuuucaagacaacauguaaauccauaugguuaugugaaaucuugugauacucaaacacuggcaauuaauguaauucaaauauuucuaagacacugugaggcaccacaggauacaaacacagacacauauacacacacacaagagagagagagacacagacacagaaacauacacacacacuugcucacaucugcaggcuggucaugcccuacagacuccuagguacagauuacucccaggcuuccgggugaaugugauguagauucagcugagaaugaccgugguaaggagcgcauggccaucucuggcuuggcugccacaacgucaagcaugagggcaguggcauagaucugacauuaagcaucucauccauuucccucucacucucaguucacauggcugcaugcaugcccugcccuccugguaacagucagaggaaaagcaaaauuagaucauuggcccugaaauguaauaugguuuuuuuuaguuguuaugcuucauuauucuaucauauguucugauaauuuguuuucauuuaauuuaggauaaugcacacuugauucuaaaauauaugcucucugauaaagucuaauauacagcaucuauaagaaacaaauuuacaagaaaagaacaaccccauuaaaagugggcaaauguaaacagacauuuuccaaaagacauacaugcagugaauaaacauaugaaaaaaagcccaacacccguaaucccagaacucugggaggcugaggccggcagaucacuugaggucaggaguuugagaccagcccagccaauguggugaaacccuaucucugccacaaauacaaaaauuagcugggcaugguggcuugggaggcugaggcacaagaaucgcuugaacccaagaggcagagguugcagugagcugagauugugccacugcacuccaaccuggaugacacggcaagacuuucuccaaaaaaaaaaaaaaggaagagaugccuuccucucucaagcaugagggaaucagucuaaacagggugaauauuuugagguugcauuauuaaguaaagaacaaauauuacacaaagcucacccaauguagagcagccaaaaagaaugauacguuuuuuucuuguaaauuuaaguuucuuauagaugcuguauauuagacuuuaucagagagcauauauuuuagaaucaaggguacauuauccuaaauuaaaugaaaaugauaaugaaauaaaguucugggaaaggaauaugguaguuacaugucuuaugauauauggauacuuacgugcuguaaaaaaugaauauucgguucaaauacaaugcuagugaaauguaacaaaaaugacaacuuacauauuuaaaugguggcuacguuuuuuuucccacuuucaauaaaauuaugacaucuuagagcuguaaugacuuucaagaauaucucugccuuguggaugauuuuaaauuuuuaauauucaaguagcaauuugcacuguuauuaauccuuuagcauauagaucuuauuuuuauagagguggauuaaaugaaaguugacacaauucccgcaaagauuuuaaaagcuauacucaucuuguucuccaagguagugacaacagcgggcaauaauuguucacauuuugaagcucuaauaacaugaaagucaggaaugauugucucagcuaggcacaguggcucacaccuguaaucaagaccagccugggcaacauggcaaaacucccucucuacaaaaaauacaaaaauuagcuggucaugauggcacaugccuguagucccagccaccagggaggcugaggcaggaggaucacuugagccugggaaguagagguugcaauagccaauacugcaccacugcacuccagccugggugacagagugggacccuguugaaagaagaaagaaagaaaagaaggaaagaaagagagagagagaaggagggaaggagggaaggagggaaggaaggaaagaaggaaggaaggaaggaaggaaggaaggaaggaaggaaggaaggaaggaaggaagguagguagguagguagguugguuauuggauuuaaagcacaugggguaaaaguaaaaauaaaaagugguuucuacccacaggauaaagccaacguuuuuuacuuagacuuucaguuauuuccucugccaagaguaauucaauauaaauaacauauauaaaugccaagagagggacggaaucacuugcugaccacccacgugauaaucuucaaauguauccuuaccaaaguguuuaacuuuuaaaacaaggaacccuaucauuaauuagaaacagacugcugccuauucuucaauuuuaaaauauccauucuaaaguaacuaugugauagcucuaaguaaccauaaccacuguaacaaaguauaaguaccuuuaacaucaacacccaacucuacauccaaucauaaucccagcaugcuuuaaggcagugguccccauucuuucuggcaccagggacugacaaaucugguguggggugguuuggggaugauuuaagcauguuacauuuauuguggacuuuauuucuauuauuauuacacuguaauauauaaugaaauaaucacacaacucaccauaauguagaaucaguggcggcccugagcuuguuuuccugcaacuaggccaugcccucacggggggaugggagacagugacagaucaucaggcauuagauucucaugaggagcaugcaaccuagaucccucccaugugcaguucacaacaggguucacacucuaugagaaucuaauaccaccgcugaucugacaggagguggagcucaggcaguaaugccagcgauggggagcagcuguaccugcugcccuugcuagcucaccuccuauggugcagcccaguuccuaacaggccacuggaaccuaaccacaagcagucuguggccuguuaggaacugggccacacagcaggagaucuguggcucagggguuggggaccccugcuuuaaggaauguuuacaaucuuuaacaucacugaacuuugucuaauaauguuagaaacuacagacagaacaacaaauauaauacaauguugcuuugaguaacaggucuaugcauuccucauaaaugaaacaugaguaaguuaaccucuaugaaagaacaauaauauuuuauuauuaguguaucugaaaaauaaauauuuauauaagaaaaaaauuaccaucuuucuacucuccucagacucuucucuuuccaaauauuccuaaaaccaugauuugcauagcagaaguaaaaaccauuugaaguuacacaacagaagacugacaaaccacuaagccacacacaacucuucaaaaggcucugcauugcuggagugauuuggaaucuugugguuucccaagggaagcuauaaaaaucagggagaaugaaaagagugcuggcugaaaaaccaaacagauggcuucaccgacuaaaaagccagcugagcuuagaagauuguucccauuuagaguaucuuccaaaaacagcuucauacggucgguuuucauuuucccauucuuugccacuguuauacuacuauuccagaguuuggacaguaggagcaaaauauuagcuuccuguagaggagaacaaaagacuauuucuuuucauccuccuaaaaaaguuuagaacugagcugcacucucugggucaucaugagccauccccuggaaauggggcuuauaccaugggaauaaguguacacaaauauauuuaacaaauacauauugcacauaacauauaaauauguuuuauguucauccuauaauauauaucuauauauuaaauauuauauacacauucauucacacaaacaugcaaacauuggcuggaggagggcagugcaggugaucuggagcauaccuugcaaaucuaauuaguacuaaauuauucugucccauuuaugugauauauguuagcaauuuguaaaauauugaaaguaacugacaaaaugauuaauuuuaaacauuuauucuggccggccacgguggcucaugucuguaaucccagcacuuugggaggccaaggagggcagaucaccugaggucaggaguucgagaccagccuggccaacauggugaauccccaucgcuaccaaaaauucaaaaauuagcuggccacaguggcgcacucauguagucccagcuacucaggaggcuggggcaggaaaauugcuugaacccgggaggcagagguugcaaugagccaagaucaugccacugcacuccagccucggcgacagagcaagacucugucugaaaaaauuaaauuaaauuaaauauaaagcauuuauuccacaggagagaagaaaaaaacaguguucccagaccucaggaagcaauguucuauuauguagcuaguguuguggugaagacucccagccugcuagagcagcaugugcacaacagguaagaauggcuuguuugcuaucaaagagguuaauauccaauaagauguaagauuacaauaaaaacuguuguuuaaacacaaaaauacccuacuauauuacacauaggaagaauaaauacuuggcauuaugcccaaaacaaaaccuaacugcaacaaguaacucugcaagagaaacaccuuccuuagaaguacccuacuauauauaacaagcagaaggcucugccaugcaccaaugaacuauuuaccuuucaccacuggcuauuuuuaaauuuuaauuugcuuuuucugucuucagaauuucaaacuuuaaaugugaaugacaauucugcaagaaaaacgaacaaggagaguaaauuuuuaauuacucgcugggugaggcggcucacaccuguaauccuagcacuucgggagguucuuauguuaaaaauaaauauuaaaauuuuaauuaucaucuauaaauuguuuuagucuuucugauugacuacaauaacuuacuuguuuccuuucuugucauuucucugauaaaaguggcaagaauguacauaaaaucuacacaauaaaauggccaaaauauuauauguaacuacagggauaugggucuagaaucuguaacuaaaaccaagucaauaaaagaacacauuuaaugaauauuuucucaaugcuaaguucuaggcacugugcuaaaaucuuuucauuccccuuccucuagcucuguaggggaggucuuauuaccuuagcuaaggaaacuaaagcacagaggagauaaguuacuuagcuaagggcacauaguuauuaggaagcaaaaaugggaguuaccaacaggucccuauuacucaaaagccugugcucuuaaccuacuacacuauguaccucccaaaauauuguuuucacaggaaccuuucuacaaacuggcuuccagagaacagaauagccaugggaaggcucauucucauucaucagaaugauauggcguucaaccuaaaccaggaaaagcaaaacugaaaaugggcugagugauuucucaugggaaauuuucacuuuaucuuaaaauaguauuaccuaauuuacuggaccaucaaaagugacuaagacuucacuauauuaaaaagugaaaaaaugaaauauucaauggcaauaauguuuuuguuaccuauaaauguauauaugcauucuuuuuuuagcaaaucaaauauauguaaaguaauacuguuuguauacauguauacccaugcccacaaaucuccaugauuuuagcauauauaauuuuuaaaaauagacaugcaguucugcaugggguaguaucuuucuaacauauguaaaaucacucauuuaguaagcagugaaguuuaaaaacgaaacauacaaacagcuggauauccugaaaucacaagauaucuuuuuuuauauuguuuguuuauggaauuuuuucccuucucucuaggauuugaauaaacuccauauauucaagcuaccuucuggcacuacauaauucuaguuuccauuugaaagccaaauaaguuacaaaaaauuguuuguaaaaauucaaagcaaaauaugugaaauauuaaacauaaguacacuuuucugacaauguaauucaauagcuuuuacuaaacaagaagaugacauuuuaaaacucuuacuguuuauuauucuuucaucuacuuuucaugucuucaaaaaauucaagcccuaaaucuggaauauaaguuucuuguugacaaaaaucaggacuuuuauuuucuaucaagaaaaauuccccgcaaaaacuuaaugcuguucaauaacaacacauaacacaaacuacaaagacauacauuaaagcaacauacucauggcucuuuuuguaaucucuauuuugaaguaucauacuuccuaauaaaaacgaaguuuuggaugauucuguuaagaaaagacauugguuaugaaauauuacaaugagaaauuagaaaggagaaauauaggcacaauauccaucucaaaaaaaaaaaaaauuagccgggcgugguggcgcgcaccuguaaucccagcuacuugggaggccaaggcaggagaaucucuugaacuugggagaugggagauugcagugaacugagaucaugccacugcacuccagccugggcaacagagcaagacuccaucucaaaaaaaaagaaaaaaaaauacacaugaaaaaucauguuuuacuguagcuaaaaaauaugugaacaggauauaaaaauugaauaaaaaucaaacauuugaaaauuacaggugagaugaguagggauuaaaaauaauaugauuauaauuauagaaugccuaauggaacaauuuuacgaacaugccaaggauaugccuaaauuauugagauuuuuguaaguaaugaugagagaggaaaaaauaauugagauauuaucuuuuauauucuaaaaaacaguaggaagaaaagcugguggugguugacaacuuuuucccugguuaaacaauacucauucuucuaagucaguaguuaaggaacuucguauuuaauaaauuucuggaaaauuuuccccaaaaccaguuuagccguuguaauauuuaaauuauacauaaaacuugugucauuguuauuaacaaaaagccaaaucacuacugaaagaaaaaaaucugaguguaugugcacacaugguugagaauaaagaaaucugguauaccuaauuuaaaaaaaaaaagaaauauuauuuuuuaauccugaauauuaacaacuuugccucaucuugguaauaaaaucuuauuuuuuuggaaaaagaaggaucaguucauauccaauuaaaguucucaaugaaaauuagagugggccgggcgcaguggcucacgccugcaaucucagcacuuugggaggccgaggugggcggaucacgaggucaagagauugagaccauccuggccaacauggugaaaccccaucucuacuaaaaauacaaaaauuagcuaggcaugguggcgcgugccuguaguccuagcuacucaggaggcugaggcagccuggugacagagcgagacuccaucucaaaaaaaaagagagaggauauaaguugguauuuaauuuuagauaaaauuauccaauuuuuuuuuuuuuuggcggggucuugcucugucacccagucucgagugcgguggcaugaucucagcucaccgcaagcuccgccucccggguucacgccauucuccugccucagccucccaaguagcugggacuacagggaccgccagcacaaacggcuaauuuuuuuauuuuuuaguggagacagguuuucaccauguuagccaggauagucucaaucuccugacuucaugaucagccugccuccgccucccaaagugauaggauuaccggcgugagaccccgcgcccagccccaacuuuaauuuuuacagugauuuuuuuuacaaucaggaagaccugggccaggcgcaauggcucacaccuguaaucccagcacuuugggaggcugaggcaggcggaucacuugagaucaggaguucaagaagaccagccuggccaacauggugaaaccccaucucuacaaaaaguacaaaaauuagccaggcuugguggggcacaccuauaauuccagcuacacaggaggcuauggcaggagaaucacuugaacccagcagguggagauugucaugagccaagaucacaccgcugcacuucagccugggugacaaagugagacuccaucucaaaaaaaaauaaauaaauaaaaauaaaaaaucaggaagaccuggaaaaaaaugcaauucaaaaaaaaccauuuacucuaaaaacagccauaccaaaaucuuugcccucacaguaucuuucauugccaaaccuccauguucuuaacuaaaauacuuacuccauuugugauuuacacacugucuuacauguguauuagaacuauacauaaguaaauacuuaucaaauuaccaacaaguuaaacuuuacuggaauggcuuuuauuuguccuuuuaaaguuaauuauuacacagcauucuuuuuuaaauuguaugucaaauucagccugaaaguaauuuugcagagccagauucccaggggaagaauacuguucaucaucagaaucacuauuuuccaaaaggaaaguugacccugaaugugguccaagccacugcuuuccuaaugcuguuuuauuucaaccacugaugguuaugcccccucaccaagcagugcauguaguagauagcuaaaaucuaucucagauaggcaaguaaugcugguauuuaucuuucccuuaggcauaauaugucaccuucagaauuuaaaaaaccaaggggcuuagaaccugaagauguaauuaccugucagauucuacuaaaggcuuuugaaaguuaacauccuauaccuauuguucccauagaaaaauuccagaauguccaauagaaaagcugauucaauuuaugcuauagucuauuuugugucauuuaaauauaguauuaucugauacaugcaauacauacuucuuacggaauuaaaauucuuugagaugguauuucaccacugaugaaguacaaaugaacucccuacacuugcuuguacaaccuaaaaagcagcaauaagauaaacagcuuuuucuuaaauuagcucuacaccaaagaggaaaacuuaaugcaugaaagaugguuacaaagugcaguagugcagaguuccucaaucucuacaugauugauauuuuggggccauauaauccuuuguaguggaggcugcccuguguauuguacgauguuuugcaguacccuuggcagaggccgcugaugccauuggcaccucccccaucaugcaaucaaaaaaaugccccuaaacguggucaaauguccuuuaugagacaaaaucaucccaggggucagaaccaaugaaggaguagaaauggccacacacggguugcaguuuggcucugcugcuuuggcugugcaccagggggagacacuuaaccucuuugccucaguuuccuccuuccccaaauaacagcuguaaggacuaaauuagaaaagguuugaauaguggcugcugcuacugcuacugcuaugauugcuucaauuguauacacuguagcaucucucuaaacuucagucucccuaugacccaaauguaugguuuuucaacaaaaguuuucucaagggcccacaacaaggugggagggggcauuacuaagcuuauggauuacagauucuuccucaaaguccauuucaaggcccuaagaauaugauccaaacccuaauugaaacuaauaaucccugugccgcagaaacaggagagucggcuuggucacuggaaugcuacacacaguccucccucugcacuccggcuuccacucuguucugaaggggaacaugaccacagcucauguggagcuacacaccuguuggaauccagcaccaaaugccacuuucucuuucaugaaguacaugccugaugacauucuaaucaucucccucuggccccaccccaaacaccaaggccucucauagcauuuguacucugcagauaacaagugacucacaauagucacggcccaaaugagcucacuucucugaugaaucacugacacuuuuucuguccucacuccucucuuuacccugcagggcacagccagggcacugaccauauuauugcuuaggauaucuuuucaacuggacagcuaccuuuagacaauuaauuacaauucucuaauagguugauauaguuuuuauauauagcuccacaguaaauauuuuucucauauaagacugccaaauguauaugacuauugcuggcugaggaugguggcucaugccuguaaucccaacacuuugggagacuaaggcggguggaucacuugaguccagcaguucaagaccagccuaggcaacauggugaaaccccaacucuacaaaaacuacaaaaauuagcugggugugguggcacaugccuguagucccagcuacucaggaggcugagguggaaggacugauugagcuugggugauggaggcuacagugagccaagauugcaccacuguucuccagccugggugaaagaacaagacccuuucuuaugaaaaaaaaauauauauauauaugacuauugcuuacugacauccacagacccaacaaaacuaaugacuaauuuucaugcaugcguguuuaguugauggccauucuuuaaguacauaaaauguccuuguuaucuaaaugaagagguaauaagcaaauuacugugaccuaaaaaaaauuaacucuagcaaguuuauuuauuguguaucacuguuaaccaauuuauuuauuacuaaaauuauauuguucaguauacacuccuuuagcugauaagucaggcgaugguaguuucacacuggggggcuccagauagaaaaacaaggggaguauccagcaaugcaugcugcccuuguuacugagggaauucaagacauaaaguguguuuguguggggggggugagaagagagaggguuccaagugccuauggaggcaacaaguuaggcaacucuguguaaaugccaggguucuccugaugaauccugguaaaagaagacaucagucacaggcaaagaagcauaagaaugcaguugcauauuucagcauguacucagaggaucccauacaucagaauucucugaggugcuuacugcaaacugcagaugcaaaggagugggaccaagccccugcauuuuugcaaauuccccagguauuucucaugugcacuaaauugaaaggaacuaauagauuaggggguguuacucuuuuacaacaaaagaacauucauugcugaaaagguaugaaagaaugauacaugaauaucauauauaugauacauaauaauauaauuauuauauuauaauaauaguauaaucauaugauauguuaauaauuaauauauuauauauuaauuguacuauuauauguaguauguauucauauuacauaugaauauguuauauauuauaacauguuuuauuauauacauaugaauauauaacauguuauagauaacauauauaacauacuguuguuauauauaacacauauauucauauuauauauguacauauuuaugauacauauguuauauauuuuguauauuauguauaagguaugcagauuuuuucaaaagacauuuuuaaauaacugccacuaaauucaacgcgugcuuuauuuuccacauauucacuguauuaggugcucauuacaaaauaaguggaguucuauaaaaagauucuagagaaacuuacagaaacaacucauguugacaagucagugaaauagugucagaauggggcagcguuauucugagaaugugaaaauucaacauacauauccaaaaaaccuaccuguggccacccuggaguaguucccaucaguggcugaaucugaccucuaguagaucuugagaacugcugacugcuaauaauuuaauuucugcagggaaucuuaggcgauagagacacuuagcauagcaccaaggagugugucuuucuccucugccaaacuaaaaccaauuaaaucaaaugcaucacauucauccaauuacaccaguaagaguuaaaaugagacuaauaucccaaagacccucaggacucaucaacagugaguaacauccuuaagggaucaauaaaauuaaugacauuuuaguaaugagacuucuuaugagccauaaaagaaagaauuggcagaggguuguagaaaucgucuauuuugauccucaaaaacuagagaaaacauuugaaagaagccuucaaacuuuuuucaaaacagggaagaugaacuuuuuaauauucuauuuuggcacccacaaaaguauccuuucugcuugcacauaccaagaaguuggggucaaauacacccggauugcaauccugacugggacuccagcagagugaccucaaccagacaauucaugaguuucaguuuccuccucaauaaaacugggcugcuaaaaagagucuacccauuaggacagaccagugacuggggaagaguagcacuuaccuaaccaaccagccucugcaccacaauuucuaccuuauuuuaucauuuacauacacuguccuuccuuacugaauuguugccaaaaaaaaaaaaaaaaaaagaaaaagucaaacaggauaaaguguacacugcuuugugaaaaguaaagcauuacucucaaauguuagcugauauuaauuuggaaauggaagaauaaacacaauuaaaagaggaaugacacccaggauaguugaguaaauaguaaaagggcacucaguuucuuuaaaugacuucaagucucuuucauuccuucaagauuuauugaacaaaaggcuauagcuaaacaugugucuucaaugaccuauaacagauauuagacauaagcaaauacaagaaagaaaggucuaagcccuaaaauuaagguaaagauaacuaagaauuucacuguagagagagauuacuucuagcugagggugaggagauaaaucuucacaaaagaggaagcaguugggauagccuugaaguguaguguuuggauaaagaagauauuccuggcaacagcauaaggaaagcaggaagaugaagcagcacagguacgaggugcaagguaacuugguuuuacuaaagcacaaggguguggguagugcuggggccauaaacaagaaaacaggcuacagauaagcuguagagggucccaaacaugcagccggcagcugggauucccugcucacacuacuuccauagggaaaccucagaguucugcauuagcagaauaaucugacacuaaagaggaagacagagccaagggguagccaucaaccuccaagguaguuaaaaagugaaggcuugaacaaaaacgaguggguaagaaugcagcaagcaaagugacuaaucauaggcgauaaaaaauaacgggcacgacaauaacaaagcaaagaccacagcuuucauccgccacaaacaggugaugccauuauuauuaaaaaaaaaaaagaggacauaggugauauacuauaguccaggauaccgacguaacauuugaagugauaauagaacuacccucuacaaucuuggugaaaccacgaggaaguaggauacacagauccgaguaauaaggggaaugacaaagggucuaaccaggcaagcagcaccuacuauaucucagcccuguucuggacaagagauacaugcacaaacaagacagacuuaaagccugcuggcaagagacuuacauucugguauaaggaagacaaacgaccacauaaagaagguaaagaaagaggggcgaguucaggacagagcucuuuggcucucuaacacuggaaggccugguaaaggaggcugugaaauaacggcuggaaagcuggaagaaaacaaggugaguauaguguuaugagaagaauguguugcaaggauggagagggugagggguugaguaacaugaggaugaagaacugacuccugguuuuggccuagagacgaccuugauaaaagcuguuugauagcccaacuggagugggcuaaaaaaggaauaaguggugagaaaauagagauggugaguacagcaacucuuuccaacaguguaaaggugugggagccaagauaagaauguucucaagaaggacaaagugguaggaugauaccaaaaguucaaaugaaaugagaacagacugguugguuguuuugggaaauguauaggucaaugauuacagcaguuucaguggaacagccagaucaaaauagugauuagaaugccuugagaagaaugggaagugggaaggggcaaggaaauuggugagacacaaugcuaaaagucuaagaacuuaaucuucuuacaaggcuaacagggugggaacugagagacauguucacuuguguggaggguugauacguagaugaaaaaacaaaguggcauauugugauuucucccaagagcagaacugagaccagcaguuucguguggucccuggaagccucuacguagaugagggaugaucuccucaaaggaaagggucuucuuuuggggagcaaguccuacacaucucauauucuaauuaacaucacuuauuaucaauuccauuaucaccacaggucaacaugaucagaagcauuauaaaauauagaagcuacaguuacuauauggaauaaauguuagaaaaaagaggcugggcgcaguagcucacaccuauaaucccagcacuuugggaagccaaggcaggcggaugacuugaggcccgaaguucgagacuagccuggccaacacggcaaaacaccaucucuacuaaaaacacaaaaauuagcuaggcuugguggcaugcgccuguaaucccaacuacucaggaggcugaggcauaagaaucacuugagccugggaagaggagguugcagugagccaagaccaugccacugcacuacagccagggcaacaaagagagacucugucucaaaaaacagauagauagauagauagauagauagauagauagauagauagauagauagaaaauuuuuuuugaaaggauagaaucuaagggguuaauuuucuucuguuaacaaugauuaaaaucugugcuggcuuuaccaaaaagcuauagucacccaaucaauauauuuucccuccaucuaauaaauaauaauuaagauaaaugaacauguauacauuuaauugcaucuaccaauagcuucgacauguuuaugaauaagaaaauaagcaacaauuaaaggacaguaaugcagucaagaauugccagauuuccacugcugaacuacaagccauaaguccccauaauauggagccucacagaucaaugaaaacaucaagaguuucuuuuaacaaucuguaaacuacuaaacacaccccaauguugcuggauuucugaauguccguuucucuaaaccauagcugugauaagcagugccuggaggcauuuguuuguuuucccaccauguguucuuagcacccggccuuccuuacucgugcuagagugaagaaugaggcagaaauaagagucugagguuaagacuagaaagagcggauucucacugaggaggaaauaaucauuuuuauucuguaacugcuugcugcuauaagccaaucauauaauuuuaauuaugcaaaaagaaacugaauauggccacaaaauauuuucagagcaaaaaaaugaaaaccagcucucacagaacaaagauuccacuuuucaccucaugugucccuuucauucauuuuuauuuugguccuuuuuuuuuuuuuuacaaauuaucucucuacaacugcuucuccacuuguuucuauucacaaacgccuuauauuaccucaguuaauucuuacauuauuuuuccuccuucacaacugccucucacaguugaguccuacagccucaggaaauguuuuccuggaagaaggaaugccuaacagccccuugacgccaaacuggguaaucugcucacaaagagaaggcacccgguccacgaaagaaccaccaucuaaaggggcuugacuuucaccaucgccagcacuuucuuaacugaguucacugaccacaagcuuuuacaguucgcagcggcuaugcucggaagccgcucucuaguaauccagggaagaggaauccaggguacuuuacggaagccacuggaaacguuccacuccagugacugcuaauccuaauaucccaagcuaagcugcggcucaagauaaaaaacagaauuuuuucacgucccaaugcccuuucauaaaauacaaacuuuaaacuucacaagagguaguaccacaucauaucaagcuaccacaaaaccaaaaacaaaauuaaaacaugauuuugaacacaugaaucucaauuaaaaaguuuauguaacucacaugucagcugagagggcuaaugaaaaaaagaaagaaaaacagaacuaauuggaaaauucccuuacaguucuccgaacagcaucuuucugaaacggugaagggcugaugguaaacaagccaagacgguuuuagaacugagggucugcccaggcaugguggcucccacuuguaccagaacuucgggaggccaaggugggaggacugcuugaugccaggagauugaaagcagcaugagcaagauggugagaauauguccuuauuugaaaagaggggaggagagggggaagggggaagaggaaaaggggaaaggaggaaggggaaagggaaagggaaggaaagaaaaaaagcuuuuaauuuacaaagagaacugagcuucucuucgccaaaagaaaaugaagacgcccaacugaugaaagcuugugucuccuuuauuugaccuccauuauuauauuuucccauaguaacuaccuccuacaaugcuguucauaauuauuccgucugaagcucugccacagcucucacaugagcuguaucgccaacagugacagcccuggauguuuacgcacgaugauaaggacuuccagugaggcacugcuuggcauccaugaaagaguucaaagaggaaaaaugcauggucuguacuagaaagcuaaauuuuaaaaaggaugcauguuucguugaauguucauucuuauacaccugguucauuucagaacuucagaaguaggaagccuaagauucacuaauacaaaacaucaacacuucuaccaaaacguguuuuaaaauaaccacugucagaacacauuauuauuagaacuaaaggcuguacucugaccaacaaaaugcuccaccaccccaaauauucauugaaaaaaauauauaguggacagccugucuuauuuucauguuaauagcaaaguggaaugcagaaaccaaaaaaaagaauauacagggaaaauaacuuuaaacauuuuaaguuuuuguguuuaauaaaaacuccucagacaaaauccacaggaguuucccaggaugacacauuaugcaucgguaccccagcagaacacaaguguaacauucaacguuggaauaaucagagaagaucuaauuaagggacugaauuggcgugggcaagguacagaaaaaccagaggauagacagaguggugccccaggccagcuaacaacugaggugucaauaaucuaguccuaaaaggacuagagaagaguguaauuccccaaacuaaggacagagcaacagaggauggugugaggcaaguccaacagagcgcugcagcccugggcccucacucuccuccucuuguaauuuccugccugggcucuaccagaagccagagggaaagggggccugugguggcggcccauacagaucugcaacccugggcagacagguaagagacuagggcaaaguggacuuggaggcacaaacugcaacuaacaagcacaaacacuguucaguauauuaaacuaguccacaccaucugucacgauggauuaaacaaacaaaaaagcacaugcaaccaguaaccacuuucucucuccaguauguucuuauucuguauuaaaauauaaaaccacagcuaacuuuuuuuaaaaaaagaaaaagccagcagcuauuagaaaaaggauucuggauuaccauaucugagcuuuauaagaaguaaacauugucucgccuaaggcaccugaggaagacaugcugagaacuguucaaaaaacuuaccaagaaauuucuaaauaucugaggagggaaagaagaaucccaugccccaccugaaaggcugcagcagccauaagcaucggucucuucucagauuccugcuuuuuucucuuacagauaaagaugaaauccaaugugcugaagacacaguggucccccuugguucucugcccccaaaaagagaagacuggauucugcagucauugacacaggaagcauuugaaacaaucaaacaaacaauaaugacaacacacauacauacaaaacaagauaaagagccauuugauggaauuauauuaaugacuuauuuuuuggucauuaauuacaagccauuaguucagaugucaaaccccacaagacucugaagaacuugccuguaauguauggguauucuauguucugucucuugaugaucccucggcaaauaagaauacaauucuuggaauucauggaaaguaaaaguuugcaccuucauucugucauuguaaucauucagucauucacucauucaaauaaauccaagaauacaauucacuagugaugcacauucauauuaaucuuaaaauucaagcugcgcucauaagauagccacucagaaaaaaagucaguauaaaugaaguaucucaaaggaaaaaaaaacauuuaaacggaaacugcaacuacaaaccauacuugugcaauuauuagucacaauagccagaaaagagggucacaugcagcaacagugcaacauucuuugcagaauuuuuuuaagauuaaaaaaaaaaaaaucugucugauuccaaugcuuugcauauguaacaaacgagcuauuguauaaccauaaucucggcccccaggugaaguggggaggaggcagugcuuuacaaacccguaaagaguaaaaacauuaaaucaaacaggcuuuaccaaauaaauacccauaaaauagauuuagaggggagaaaauucauaccugaggagaaucuaaagcauaugacaaaacaagaaaugagaggauuuauugagacaucacccugugacacugccuuuuaaguuaauuuggaaacaucacuuuggaaacaaaucuaaugugcauccauuucuguagcuaacgcacaguuuaaguggcuugagucagagagggagagauaagcaucucuuccugaauuucuggcugaaguucaauuauuagugacagugaaagaaacuuagugacauuugucaguuaacugcuugaggauauguuggaaggcuguuuauuucucuguuuugagacagggucuggcuccgccacccaggcuggaguacaguggugcaaucaugguucacugcaaccucaaucucccaggcucaggugauucucccaccucagucucccagguagaugagacuacaggcacgggccaccacauucaacuaauuuuuguauuuuugguagagaugggcucucccuguguugcccagacugaucucaaacuucuggacucaagcaauccuccaaccucagccucccaaagggcugggauuacaggcgugagccaacaugcacagccuggaagauugcugaagauguuacccaacuauuuccaggaauucuacuucuuuuaaugggggggaaaaaaacaguaaauguaaucagaaaccugugauaggaaaucuugcaacaggguggcuuuccuuaugacuauaaccaugauaguacuaugcacaugcccugcauaagggcaaagguaaaagaaauuagaaauguucaguguuauaacauugcauaaaacaaaaaauuaagauaggaauuagauagaaauucacaaaaacauagcagcagcagcuaagauugggcuaaacuguguaaguuaaaagucugcaugcuucauucugucaucauacauucauucauucaugcagcaaauauuugcugaacguguacuauguacaaguuauggugcuaggcacugggcauacaggugugaauaaggcaaaauccccuucacagagcuugggauugugaagaggguuccaauucaaauugagaaaugauaucagugagaagaugacauuugaacaauacuucagagaagggagggaccgagccaugcagauuggggagggguauucugggaaaaggaucauggaaccugggggaccuagggcauuaaugugccuuacuguguugguacagagugggcaagggucauggagguaaaacucgaagucaaagaugggggguagggguuggggcagggagugaucacguagcauuugcucaccaugguaagcauauuaaauuuuaauggaagcgagaugggaagcuaggaaggggagauucugagcagaaguauacacaaucugacaaaugguuuuaaagcugucaugcuggcugccgaauaaagaauagagagaaauaguaagacugugaaacccacuggcauagccaggccaaugacuuauagugguuggaccagaguaauaguggugaguguggugagcagugggcaucccagagauucuagagccaacagaauugauugggugugugauuaaacagaaagcgagugagcagugaugacucccagaguguuuggccugagcaacuggagaaacagaguugccacuaaaugagguggagaagucuuuugacagcacuuucugggcuuguuaacguuugugaagcccaucaacauccaagcggacgugugaaguaaucagccuugauuucauggcaggaguuuguggguuccaaggaaaaguccaggcuaaagauacaaauuuuaguagucauuaguaaucagcauacagauaauauuuaaaguugcaagacugaauuugaucauaagguaauucguguagacaagaaaaugaaaccugaggacuaagcccuaaagcucucgaagguaucaaagaaaaaggaaccaacaaaacugaccgagaagggaagaccauguaaggcagacggaaacaagaaauguguaccaucucagaaagcaaggagaaaagccgauuuaaaaaaauaauaaaggaacaacuuuaucaagugcugccaggaggucauguaagaugagaauuuuuaaauaauauaauuugguguuggggcucagaaaacugauaccucaaaacaugccauuuugacauacugcaggggaagaaaccucaaggccucucugacuuccuccuggccccagucccuuucaaagaaggugaaguaguuccuuuaccugccuaagauccagacccaccaagcagaacaaauguuuuucuuucccucugugcaagaccaagaauguaagcacaccuucagacccuuucacaagauaauguacaaauuaaucuguucccugauuucauucacucucccugguaauuuccucaaaagaauuccgcuuucaccccuccaccuccaauaaccuauuuugucaggaugauauacaaguuucuauuucuuuauauugauuaauuaauuuuuuuuuucuuguucuguugcugaggcuggagugcaguggaacgaucucggcucacugcaaccugcaccuccccgguucaagugauucuccugccucagucuccugaguagcugggauuacaggugcccaccaccaagcccagcuaauuuuuuuguaguuuaguagagauggggucuuaccauguuggccaggcuggucuugaaccuucccaauugcuucuacagauaacaucacuauuauaaaaccuaagacuguuuuuuuauuuucuuuuuugaacuguuuuucagacugaccccaugggacucaugagucauggcacaacugauccugaguggacucagcacaugaggacugcuuuccacaccccuaugauuucauccccaaacaaucaccagcacccauucccuagcccccugcccaccaaauuguccauaaaaacccuaaccuccaaggcuuuggagugacaacuccaguucuucugcaugggcuggccucacaucaauuaaacucuuucuuuacugcaaugccacagacuuagugaacagauuuugccuuuguagcaggcaggaagaacuugucaggcaauuccacaaugaaugaccacugacuuugacaaaagcaguucugauagcauggaguagguaaaaggcuaugguauuuaaagagagaauagaaaaauaaauauggccaggugcaguggcucacaccuauaauccuagcacuuuggggggccaaggcagguggaucaccugaggccaggaguucaagaccagucuggccaacaugguuaaaccccaucucuacuaaaaauacaaaauuagccaggcaugguggugcacgccuguagucccagcuacuccggaggcugaagcaagagaaucacuugaacccgggaggcggagauugcagggagccaagaucgcgccauugcacuccagccugggcaacaagagugaaacuccauccuagauagauagauagauagauagauagauagauagauagauagauagacagacagacagacagaugaaauugaaagaugaaauauaggcaauucuucuuucaaaguauuguuaaauagaaaaacaaagaaaagggauagcagguaagauggaaagagggauuaagauuuuuuuuucaagcuucugcacagcaaaaggaacuaucaacaaaguaaacagacaccuuacauaaugggagauaauauuugcacacuauacaucugacaaaggucuaauauccaaaaucucaaugaaagaaagaaagaaagagagagagagagacagaaagaaagaaagaaagaaagaaaagaaagaaagaaagaaagaaagaaggaaaaagaaaauucagaaucuguaagaaacuuaaaacaacaagcaaaaaacaaccccaaugaaaagugaguaggcugggcgugguggcucacaccuguaaucccagcacuuugggaggccaaggcagguggaucacaaggucaagaguucaagaccagucuggccaagauggugaaaccccaucucuacuaaaaacuacaaaaauuagccaggcaugguggccguugccuguaaucccagcuacucggaaggcugaggcaggagaaucgcuugaacccaggcagcagagguugcagugagcuaagacugugccacugcgcuccagucugggcaacagagugagacucugucucaaaaaaaaaaagugagcaaaggacaugaacagagccuucucaaaagaagacauacauacaagcggccaacaaagauaugaaaaaaugcuaaacaucacuaaucauuagagaaaugcaaaucaaaaccacaaugagcuaccaucucaaaccagucagaauuccuauuauuacuaaaaagucaaaaaauaauacaugcuagugaggcuguagagaagggggaacacauacacugcugguagggauguaaauuaauucaaccacuauggaaagcuguuuggagauuucucuaagaacuuaaaacagaccuaccaacugacccagcaauccuauugauggguauauacccaaaagaaaagaaaugauucuaccaaaaagacacaugcacucuauauucaucacagugcuauucacaauagcaaaaacauggacuaaaccuaagugcccauccacaguagacuggaugaagaaaauaugguacauacacgucauggaauacuaugcagccauaaaaagaauaaaaucauguccuuugcagcaacacagaugcagguggaggccguuauccuaagaaaauuaaccuaagaacaaaaaaccaaauaccacauguucucacuuguaaguagaagcuaaacauuggauacacauugacacaaagaugggaacuguagacacuggggacuaccagaaugagagagggaguacggcaaaggcuaaaaaaagcuaccuuuuggguacuauguucacugccugggugaugagaucaauuguaccccaaaccucagcaucacacaauauaccaauguaacaaaccugcacaucuacccucugaaccuaaaauaaaaguuuauauuuuuuaaaaagagaagauauuuuucaaaugggagaaauaacagcuuguaugcugaugagacugaucuaguggagaaggaaaacgugaugaugcagugaaugaagaauugagaugccuggacaauggucuucaaguugcaagaggggcuggggucaagugcacaaguggccucacuuagacccauaaacaauucaaucagguaaaagaaugggaguucaaguguaugggcaccgggacugauagguaggaaaaugugcugugugcagucugcagaaguucucuauuuucucaaugagaugagaagcaagacaaucagcaaagaaugaggauggagacaggaggagagagggagagccaacgaacucggcaacauggcuggacugcugggcaucgugaacaacucauuggaguccuagaauuuagggauaggaaaugggauggcugcaugcuuaucuccagccauggucagauacacagggacaagcaagagaaauagcuaaguugaacaagauggggauuuuugccagaugaguauaacaaagugaaagaaaggcaaggugugaaaccaaagguaucuuuacaaugauggaucaugcaauagaaaccagugaaagggggaaguaagaaguugaggugagugagcaaccaugaaaaguaggaucaauggauuuuaaacccuacugggguccaagugcaugcuacaguuuggguaguggagaaaaagagcuugagagacaggugguguagaucagaggaaggcaugccugaaacugagaauauggauaccuauauggugcucauauuaagaccagaagacugaguaagggaggcaggggcugcccaacagccauuuuccuuccugagcaucucucccacagcccugcaauucaugccuaacuucccacauucuccaauucacuccugccaaugaaaauaauucauaccuauauaaacgauauuuuaacucuugaacaacaacaacaaaaaaaacagaaugaccucaacaaucuucguggguggaauaugaauaggcagauucccucauucaacuuuguaucauuuccccaaaaccagagagaaaaauuaaugaaacugggauguuucuacucuaaucuacaaacauuuguccauccaccaagcacagaaaaauacagugcuguugcuuugaaaguugcuuagccaaaauagaaccuauucaaaggugaucaaaauuucuaaaaacaagaagguccauuuuagaagacauaauccucuuaguaaguaugcaacauucaaugcuuaaaacagaaauaaaauaaaacauccugcuaaaaucucuuuguaaguuagaacuggcuuuauucauauuuuauucacacauauaaauuaucuugccuguaacuaaagcuuaauauauauuugcuggauaaagaaaaagaauuucaucuggucaaacgaauuagccaauaaagaaaaauaucagccaggcacaguggcucacuccuauaaucccagcacuuugggaggccaaugcaggaggaucacuugagaccagccagggcaacacagugaggccugucucuauaaaaaaacaaauuaagaagucccagcugcucggaaggcuguggcaggaggaucauuugagcccuugugauaaagcaagacccuguuucaaaaaaaaaaaaacucucauuaaaauugcaaacacauuauauuuuuaccacuguccuucagaaguuuauauugaaccucuucuuuaaaaugcucauaggcuccccaucacucagaauaaaaaagguccggauaacucuguaaaacuuucaagacacuucauagcccagcuccacccacccuucuaaacacacuacaccucaaaucacucagaagugacugucaaaaacaccuuaccacaucuagcccccaucuuuacucagguugcugacucucuccuuccaaauauauacuuccaaaacaccauccaaucuucaccaggucaaauaugaugucucucacaaagcuguccaaauucaugccauguuggaauuaaauuccccccauccuauaacccugauuaccuuguacuauuuuacagcaucugucagugauaaaagcccagccugucauuaauucaagugcuggaaaggagucuuugcgagcuucucaugccccagcauagguccuuccaugauggcaaacugcaaccugacacuugauaacgucaucacuauuaacaggcagcuuccaaaggaagcuggaaguguaaaacuagcccuuuccuuguucuucgaaggcuauaccuuggauacagggcauagccaccaagacuaaggcuccaauaagguccaaggaauauacaaauuguuguagcauucgaggaaagaaaaacaaaagcagucucuuuauucuugagacagucaaguggauuauuucccguauuuuuguuaucucucuuaaggguuaaaaauaaucaaauuuugccaguagaauagcauaauaugugucaaauacaauuaggaaaaugacuucuuaaugacuagacaguaacaaucauuuuaucucuuuugaauuaaaauggaauguaaccccgaaccucaaaguggcaggcaucuccaaguguucaucacaguaguagugagaagacaauacagcaaaaaugauugcuucagaggaaggucauuuucuuuuguuaccuaaugcuuuacuaugcaacccccuaaaccccucacaggaaaucugaagcaccuaaaacaaacucucuuagguagaugcaugaacaccuguuuuguaaaaccuaaacaguagaaagagaucacgugcuucuugcauauuuuuaccaauaagacaauauagggugagcugcauucuagcaaauuaauaaaguaucuuugaaguaguaaaggaaguuuaaaauuuuuccaaacuaaaaaagcaccccacagaaaauucuaugauuuagaacguuuuaucauguuaauuucaguaagacuaacucgagaauuucaaauugugccccuuuuuauaaguccaacacuuaauucuuaaaauagagaaagauagguagacagcaaaaucaaaaagacucugucuuaguacauuugggcagcuuuaacaaagcaaauuacagauaauucacaaauaauagaaauuuacuguucacaguuuuagaggcuggcaaguaaguccaagaccaaggugccagcagauuuggugucuggcgagggcccaugcucugcuucaaagauggugccuuguuucuguauccucacauggcagaagagauagaaggaauggggaaggcgaauuugcuuccucaagcccuuuuguuagaacacaaaucccauucaugggcguggagcccucaaugccuaaucauuuacuacaggccccacugcuuaauacuaguguauugggguuuaaguuucaucacuaauuguggagggacaccaauacucaaaccauagcagacauaauaauaaauacaaacaaugcuaauguuuuuuaaugucaaaaggcacucaugaauugguccaauaccucugcaccccucauuauaagcacugaucuuaccaaaagcauguggcauaucauaacgguauuacaaguagccaggaaaugauguacucaucuguuacugucuuagacaaugcuuuauuaaaaugggaaaauaugggccaggcacaguggcucaugccuguaagcccagccuguaaucccagcacuuugggagucagaggcaggcagaucaccugaggucgggaguucaagaccagccugaccaacacggagaaacccugucucuacaaaaaauacaauauuaacugaacaugguggcgcauggcuguaaucccagcuacucgggaggcugaggcaggagaaucgcuugaaccugggaagcagagguugcggugagccgagauuacgccauugcacuccagccuggacaauaagcgcaaaacuccgucucaaaaaaaagggaaaauacaaaauguacuauguuguaaacaaauaacagucucaggcuuucaacugcaaacaaggaugauggaacagaauugaaaaagaaacgcagaaagugcaguugcuccuaaaggagugcuuaaacccugacuguuagcucauucccugcucucaacucucauacuaucccuuccaucuacauuaacaguaauauguguccauuaaaaccgcauaaacuaucagaaacucugacauuaguguggccucaaaggaugucaaauacaccuuauuacuuuuuauaguaacuguuugaauugucaucugggaauuuugugauucugcuuauauggauuaucauaauagaguagaaacuguccaauuuuucccaugugcuagcuuuccugauaagaaggaaggaaaggcagccagguuggcugucacugaaaugacuccccuugggcucugccacacccaccaacagggcaggaggacaagugaaguccacugacccacccuucagagaagagguauagguaacagcccuuugccugccucucacaaaucccaauggagaagcgcacuguacaugaaacguauucuucaccagcuggcgcaagguaugagcuaaagaaggaaacacaugauaaaagcccauuuugcaaacuagagccuaagacagugcauuagauucuuuaaauguugcacuacaucacaacaaauggguuuguuucaccauauccuucaagauuaccuaauuacuuguuuuaaaucaacuugcuugcauuuaaauuuuaauacuaggaaacauuuuaaugaaaggguuuuuuauuuuucauuucauaucccuggguagcuaauuuuuugaaaaauauaaucaaguuauauuaucuagaaagaaaauggacaauuccuuaucccagaauaaguacuagugcuuuauuuguuuagcugcaaacacagaacuaaaaccaucguuacuuaaccaagguuaugucucaaguaugucauaguuuucacuuccacugauuccagggaggacugauacgaccaguauuuucuuugcuuuuuauuuuuuauuuuuuguuaaauuccucaacauacugaaaaugcccacugauuuggaacaauauagaaaagguaccauacgaaaaacuccaagaauaucacaauucuugaaauaucaacaauagaaauagugaaaaaaaauauucuuuuccuuauuucuuuaucaaaaguaguuaaaaaaaggauuaaaaaacacacaugguaacacauagggaauaccaacacaucuccgggagcaaccaucaguucagcagacacuaauaccugcuauccucauuagaauccaguuacuggggaaagaaacaaccuuacaaacauuucuaagcagaaaugccuuuggacuauagcaaaaccaaaauuaguuaaagcugcaaauauauaaauucucucucucccaguauauuuauuacccuucagauagaacaaugaacaauuuguacauggguuuucuuuacuuucaaucuacuccauucacauacauuaaugaucauuucuguuuuuauccacuguguuuggcagaggcauuuguauucauucauucuacaaugaaugccaggacuaugagcuuccuggaacccugccucagagaacagcgccuaugugaagcaugucaaggaaugccagcaugguguguacaucuucuccagcagucuucagaauaacccuaggagacaguacuuuaucacacaggggagagguuaaggguccugacugcaagaagugacagcaaagcugagcugcaugguaucaaguauucguuagucuggggaggagcagcucaacuugcugcuaaaggagaaugcagagaagcauagaauggcaggaaaggaggaaggggcaggugggcaggaaauaaggcuggccagaaacagcaaggcaccaugaaggccccucccuggcucugccugcaccuugagaaaaccucuuuccuaaggucaccugccaucuucccguucugugccaaccuccugggagaaaccuucacagauggucuggcuaccaucuaguuuuggcacuggguuuccaccuuccucacaaaccucacaaacugccccaaguccugggcaaaaguaggggagcaacccugcagaagggccucaugaccuaagaagccagaaccaggauccaaaggacaugggguguuuacccccucaggcaacagugcccagucccugccaccuccccgagccccagcaccagccuccucccauguucuuaugcagagccagaaacauucagcugggucacacacguucacaaacauguccuuugcaauacgucaacaaaagcuucaugaccacaauaauuuaauuaaguuuuuagauauaauaacuuauuuuagagaucaaggagauuagucaaauuucucccuuuugaacuaaauaugaacauuuuauacaagugcuaacauuguuaaacaggucugacuuaucuagcagagguaggaagugaaauguaucaugaaggacaggcaugaauuucaacuauuuaacacuauucauucuaaaauucacuaauguacuagcuuauuuucuuaaucgggauauguaauucaucaaaaucauuaacuagcuugacagcccacagucaucauuacaaauaucagaugcaauuacgcacacugaagaauuauugauauuuauacuccuguuugaagcuagaaacagguaauuuauccaaagccucaaaucuagcaaauuauggaaacucuaaucuuucagauuccucaucgcugaucauuuucuaccuucuugucuuuuuacuuccauauuaaaaguuggagguuuuuuucccucauccucuaagugauggcauaaaaguuuuuuauuaauagagcuauacauaauuuuaaguaaauuaaguaauuuaagccagcccuuuuaaaaaaauaaucuguuauuuuuuucacugcacaugugauaacugguugcuauagaaauauuuuaaaauaaagauaagcaaauuaaaacccugcaaagaugacgcuaaaauuuaauaaacaucuuucuauaauuuguaauacaaguaagcauucaaacuaagaaaagauccuauucuauaaccuuucuuuaauccaugaccguguauuacaaacaucuaucuacacauaucaauaaacguaccuccacaucauuuuuaaugcuaauuagcauaucaugacuggauguaccaucaucuauucaacuaucccgcagcguucaacauuuacuugcuaucaauuuuuucaguuucacaaucaacacugugaagacuauccaaauaaauacauucuugggcaacuacugauuauuuccauaggacaaauucccagguguggaugcagggucacagggcacacauuucuaaggcuggugccuuggcaugcucugggguguacuaauuugcauaguuuaaaacugcacugaguauuuccauuugucuucugcaccaaucugagaggugagaaauggcacuaaccucuuugcauuucuaugacuacuaaugagauuauauuuacguuuuguaguuauuugcugacuauauuucugcuuuagugaacugccugucuuuugcccaguuuuucuaauuuugguguggagggacccacaauugugccucucagugcuuuaauuuucucuaauaagauggggguaauaacauuaucuauucuauaggacaguuguaaaaauuaaacaaguuaauguaaguucagccuuaugccugacacaaaguaaggacucaaugaaguuuagccauuuaaagauuaaugaauuacaaaugggaauuucuuuauauauuaauguagugcugcuucucaaacuugcccaaaaacgaccccuaauggcaaaaaagaguaacucauaaccucauggcaucugaagguaaaaaccaugcagcauaccagauguaucaaauuuccuuaaaacaugguuuuauuuuaaaauauucaaguacauuuuauauucagcuucaaaauauuucaauuuuaccauauuuuccuucucacgaacuugcuauuaagugacauccagggauuacuuggacaugcaccuuauuaaggauauuaacccacuaccuaucauauacuuuucuauucagcuugcaauuuucaaagauauacgugaaaucuucuuucaugguguccaccaaugaugugccgcuucaaaagucuugcuccacucaaggaucaaauaaauacuccccuauauuuucuucuaauauauuuaacauuaaauauuuuuuuaagaauuuuuuagcgggacagaaauccaaauuuguuuuuccucacccucuuuugcugucaaauauacucuaaaauacuaaagacuucaaaauaaguguauauauuuacuuguuucauuaaauguuuuuacaaagucugccauguuaaaaauacgagugaaagcuuauuuuuauuuuuuuuuuacauaaauacaaacuggagaguauucuauaauuuuggacacagcauuuaauacaagaaaucuuugaaacaucagacaguggcaaagacccaccuacccuucuggugauuuuucaugggcccugcugaauagcuugaguucacaaaaucaaauuccuaucccaauaugcacaaugccacuggaugugcuagaucagauggucaucacacacccagauuaaugaucuacagcacuacagaaagguguuacacuugagagccuuuuggguccaguaagaggggcaagugcagcacuuugcagcucucugucccaccuccauugccuaacuacaucuguucucuuggccacaucgugaacuccaggacaugcuuccacuagcacagagcuacagcuggacaagaagcagaccccucucucugccuauccauauguagcugauuauagaauuacauucuuuacuuucuaauacucucauguagguuuuagcauuuucaguauguuucacauauuuguuuuauuuucaaaagaaagaaaucaauuuuuuaaaaaguuccuggggcagaucugguaaacaaaaaugggagaaugcacucaugguaacugucacaggacaauaagagacaaagggaguccaaauugcuuuuaagagguuaauaaauaucaauaccucguagaaagaaaaauguuuauuacaugccaugugucagucacuacuccaggaguuuacucucauuauuugauuuaaucauuacaacuaaccuaucauuauuguuccaauuugguauuauuaucccaauuuauagaugaauugcccaagaugauauuaccuguaaaugacaaugcuaggauucaaacccaggcagacuaaauguccucucuuuaccacuaaaaucuacuuaauguccccaauuaagcuagguaccuccccaccccccaccucagaaacuuagcaaaaagaggccucuuugcuaagucagugcuacaaagacuacauccuccccccaagaagaucuugucacaccuggucccacagggauguguucugcccugauucuccguggcuaaauggagcauguugggccaggugggguccuuccguggacgcccguucccaccugugccccacucaagccucauucucucagugaaagaaugaguggugggggaccugcacacacugcuacuugucagcuuguaaggcccucccaauacauucuauuucauuuuuguacugugugugccugucuguacccacuucgcacagcagcuacacuaaguaacauguagagauuaaacacauuaacaguuugcaauagauuuggaagaaaauuauaaccucauuucacaaaagacagcacuucaacuugaugguauuuuagguuaaaugcacaaacuuccuacacauaaaaugggcacuucauuuaagaaacaacuaauguaaagggaauauaaacaauaguauaaauagcccuuacuacauuaaguuacauccauuuuuaucaucuucucuucaauauaaaacauaccgauuacaaauguguaaccaauaaauaucuucuaagacucuaggucaagguuauaaggaaaauccauuccuuacaaaggacuuugcaggaaaaaaaauguaugaagcgacacuguccucugcuggugaauuuuccacacugucuaugaaucuuugaguagaaaauuuaauauguuaauauuuaaguaccauaguccaugauacaauuuacagucuaauagugacuuuuaauuguaugaaaauguuaaacaaauacauagccaaagccaauacaaaauuucaggcuguuuuuacaacaaggaauaaagaacgccauuuuaucugaauauaguuucaacacagaauuccacuuuacuucuuucaacagcauuuugaguuaguaauuguauuagugcuguuuacuuccauuuuagaaucaacgugaaaugucccuuaauuagauaucaauuauuaauuauagaguaaugcuuuaaaugcugaaaaaguccuaugaguaaagacacauauuuauacuacccucuuccccuaaaguuuuggcuacaaguuaaauauucuggaggaaacaaauuuuaaaacaucucugcuaugugucuauaagaugcauuuagacauugguccagagcucuacauguacagauacuacugaaaacuuuaacaauaauuuuacugaauuuuaaauaauacaugaaaauagacuugcaaaaaaaauaaauaaaugaaugucaaccucacagaaguagaccgcauaaaagaugaggguuugccugucuguaucucaaguucauuccucuggccauagcauuaaccauguuuaucuuucauuuauuuuucauucaauuuacauauuuuuaagauugcuuuuuaaaaauacagcuucaugcuaaagaaguauuccuuaacuacucuuugucacauaacaauauauuuugaagaucauuaucacaucaauacauacacccugcuguuuuuaacagcuguauagcagagauuuuucuaaaaaucuauugagucaauccuuuaaugcuuguaagcauauuuucacaauaguaaaauugggcagagguguuauaaaugaccuuguuuaaaacugguuacgagaauaguuucuagaauccuugauccauaucauaaaucuuagauuguucccaugaaauaaaauaccuaucuacgucacccauauaaauaaacaauacuaugcaaugcuguuuucauuuuugccauacuaauauuuaaaggcaauuucauuuuaaaauucacuugagucuacaacugugcacaaauaacuacaaaaaucauguaaugccaaacacuuuuaguaacccaaagagaaauuuuuaaaaaccaaaccugccuggcacaguggcugacaccuauaauuccagcacuuggggaggcugaaacgagaggaucacuugagcccaggaguucgagaccagcccgggcaaaaaagcaagacuucaucucuacaaaaaauguaaaaauuagccagucauggcggcaugugccuguaguuguccuagcaacucaggaggcugaggugggagcaccuguagucccagcuacuagggaggcugaggugggaggcucuggucaguguaccagcccuuugccucagagacaaaaccauugaggcagaagacuuggagucacuaaucucccaauucgcccauagacucuauugagacaacaacagguacuuaggaacgguauaccacgaugcugagaauuccuuccauaguguugccuggagagguuuacccuguggaguuuccacaaacgagaaguaccauuuacuucaaugcuuaauaauaauuacuucuaagaaaacaaaucugacaccaucugcaaucauguccaucaguuccagaaagcaaacggagaaaaaaaacaagggaaaagugcucucucaucaugaaaucaacacacacagcaucauguuaaucuacaacuaaacuugacaugugcccuuugaaauucuaugucuguauacuuuccaaccucaaaauguuucuuugaaaacagaguguguugcaucuucccaauuuucucgguaaguagcuaugcgucacuuacucagucauuugaaucugggcuccagauucuccacaacucaaagccuggauacuuucagaaauauggaucugaacuccaaaucauuuucuucguuuacacagaggccacucuaacuggcaggauccucaaugugaacauaaaauaaaggguaauaggaauugaaggagaaucugugcucagcacauuuuucagucugaggggcugaaugaagucacaggcugauuuagcuuugccccagacaccuuccaucucaauaacaccagcaaacaugucuguauaguaacuggaucaaaaagcaacauaaauugaucacaaggacccuacacuauagaaaugccauuuaagauacccugcuauaguuaaacccaccuacaaaucugagaacggcaguuaucuguuacgaagucuuggucaugcuuucucaaaagaaucauuuuagggcuuaggauucagcauuaauucugaaggucauaaguguauacagcacccaaauucagaagaaccucucugauauucuaaacaaaugucaaagacuaaaggaggaaaccauguuuucugaaaauuaugaccauauaccuaaguauguucccccaaacuaauggcuguaguuguaaggcaaucuagacauuucaggacaaucaacacuugguagagucaguuugaggggaaauuauacaaccgagaagaguuucauacaagggcuaaucaggguuuagaaguguuucuucauagucuuuucccucaucuaucccucaaucuccugccaagacggccuccaauguguaucccuguuggcauacugauguuacauuuguuccucguuaacuauauauacuauggcauccucaaaaauagaaaagcuugcauuuaauuuuuuaauauagaugauauauacucuuuggcuguuugcucuuuuaagaagcacaucaaauuaaaggauauuuuaagcaccaucugcucucugcaacaauggacaauaauguuuuaaaucuauaguauccuuuaugguuauugcaguuagcauuuuguugugcugaggauuuuuuuguuuguuuguuuuuuguuuaauguagcccuccuugccuaggcucguacuuagaaaccaagcuagguuuuuuuuucuuuuguguuauucccaguuuaauuucccauugccacaaaacuguugacuaacgccguuuaguuacuuuuuccucucguaucuuccaaauucacuggaauacuccuuuaugaugccagagaaaggcauuacuaaaggaauuuauuaaaguuuuucuuaaaaauacauuccuucaaauauacagacccaguuauaaaugcugucauucaguaaaacagaaacugcaaaggcauuauaaaucucuuccaguauuaacuguaguggaauaagccgaggugacagguguggacacagcccaucaacaaagacaagacuggacccgugcaccaagcacaagcccaccuaccaucugcucugcacccagggaaugcaaacagagccaugagcuaagguguucauuuucaacauucugauuuguuaacaagaucugugcaaugaacucuuauguacuacugugguucugugaugccccucaaaaaaaaaaaaaaaauccacugcaaaccaccugucacauucuuuugggauacgcuacaacaauuuucuuguaguaaguaucuauaacccagaaauguuuuacuugcuguaaaugaaagacauauauagauauagguauaaauauauagauagacauagauacagauuuuuuuuucuuuuuuuugagauggagucucacucuguugcccaggcuggagugcaguggcacaaugucagcucaccacaaccucugccucccaaauucaagcaauucuccugccucagccucccaaguagcugggauuacauguacccaccaccaugccagcuaauuuuuguauuuuucgcagacaugagguuucuccaugucagccaggcugguccugaacuccugaucucaagugaucugcccaccucagccucucaaagugcugggauuacagacgugagccaccgcgcccggcuaaugaaagauauauugaacagaaugauauauuaaagacauggcaaaauaaucuauaggaucuugaauaacauuguguagauuuucgaaaagauacagauauaugcugauauuuuaagagauauacaaugaacuguuaacaguuuuuuaccuuuaauaaacuagaaagggugccauuaaauauuuuuauuuuuacaaauuucaacaauggauauuuggguaguaauauuauuagccauagugauuuccuuuccaaugcuuuucuguaaaauuuuuaaaaauuacaguguauggacacaauugguuauucaaugauuccuauaucauuggacauuuuaguuacaauucuauuuucacugauaaaacuggcacuacaacaaucaccuuuugccuacauuucugcucauuuccuaagagugugagaaaaugguaaaagcgcaagaagauguuuaccaagacugaugcacacugcccaccuucucuucaggaugcuuacuccaaucauauuccugccaagagaacacagugcccacucuaccaacuacauucuccuggggacugggcauuuucuuauuaucuuuacuaauaugauuuaaaaaaagaaaagaaaucauuauauaaguuugaaaacuguuucaauuuuauuuaccuucaaagaaacaaguuuucaugcuauuucaauaaucaacaaaacagucaucuuuuuaaaaaauuaacacucaaaaucaaaggacaacccugaauaugcauuccuaagaacugggaauaugcugccaaaaaucaaugaaaaugauuaucaggccuuacaaaaauaccuuuuacgaaaauuuuaaacaguuaauagaaacuaauuggguuuuuuuaaucgaaucaaaaaaccugaaguauaugaaacugaugugggaaauacagucaaagcuuagcaguaaucucuaccauccaggaugguguuuuuuccaagggauuacaaaacacggccuuucaaauucaacaaggggcacaagagcuacacuguguuucugaagauauaagcaacagcuccuucaaauuccuucucucagcaaucugguccacaaaaacccacuguuaguuauuggcacuucuuuucauacugccuucauuuuagcaaaaaaguacaccugaaugcgagugagaagucaguaaaacuaucuaauauccaucugcccagccugcuguugacacuuacccugcaaacacuguccccacagacacuguuucucagcaccucaggccugaacuccaccagucuucccccaaauuaauauucagggaguucccugacauaaaaaugacccacaaugagucacuuccuaaauauguacuuggggagagggacauggugccaggcgaguucucccaucaccacccgcauccucacaaccugugaggcacaagugaacgcccucuuuacagguaggaaaacuaagccucacagaaacaugucauuugccccaggucacacaacuauuccacacagaacgacaauuccaacacagucccaggugauuauguuggguuuuuuacgugcacuccugacagccaucaggacauuuacuaagcucuucagaaagagguauauacagugcauuccuaucuuuaacaucuacucuauuucuuuuccaacacucucccuuccuccccuuaaaaguacuacugggcauguuuacuugaucaugaaauaugugggcacaauucuauauguguucacaacaccuauuaauucuuggagaaaagagacuguaaaugauauauguacaaaacauuacacaucuccaauuuauaaauagauauuaaguuaauguuuuggaacucaaaauucauacugguggaaaaaaauagaagaugcagaagaaccccaacccaaacaacaaaggccuaauuuaacucccuaaaaacccauggcucucaacccacagcauccaccagagucacaggaagauuucagaaaugcaaauguuugucccuuauccucagauauucuaauccuacugauuuugguggggccagggguccauacuuauaauguuccacagagcugagaacauagacugaagucuguaagcgccacuauacagaaacuacaugucuuacuuaguuuuuuagccacagcacagggcccaccaaauaauaggugcuaaaaguaaauaugugucacgaaaugagguaucagaagcacauauuguggcagauucugucaaugaaucuuuuuccuucuuucuuccaucuuuuucuuucuucuccacaggcagagccccuuucccuaaaaacaccaguuacucgccaguuaccuuuccagccuuucuaacaguuggccacaggacauaaaaggauguuuucaaguguguuucaaggaaagauuuuccucgcaaauggggguagaugagccuaguucucacacugucucgcuuccugcccuuggcagcaagaugucugaaguaagcacagcuaucaagacaagccugcccagagacagugaaucugaaggacaggaacugcaugagaccucaugagguugcugagcugcuacaccaacccuaggagcacauaucugacaaucccuuaugugagguaagagcccuuuugagauaaaccacugugugucaccucagcagaaccugcagggguggaagugcaggaaagccugcauggaugagaagcugugggaagccagggcaucugacuauggcaaacucuggggggugcccagggcccugcugacucucccaccagucccuccuucccuccagggguuggccagccugcuucucucaaacgucaccucauguucugcccacugcuuucucuucuggguaaucaugagccagaaaacacacuaccaacuuuugccuucuucugcagucaccaugucuagaauagagccuuuaguaaaaauuuuuccuauguguuuacuauuauaaacacugaaaaaauauggaaaaguccaaacuaaggcauuaaaaaaaaaaagaauccuaaagcuucaaaagugcuacacuaaaauuuggccccugauaaucauacaaacauacauugagauagguggcccuuaacuuugaccucauucucuauacacaaguccuuuuauccagacagaugccucagaacuuccccacacacacuugauaaaaugaaagagaagguagaaaaccuuugcucucaccccuaccgccuuaaucaaagagcaaagucaaagccucagaguuaacgacgguugcacuacagacuaaaaaggaauucacauguagguuuaucgacagagaagacgaauccaaaauaacauguccauuggcuucucuuuguguuuugagacaggucuugcauuguugcccaggcuggagugcaguggugugaucacggcucacuguaaccuugaacuccugggcucaagcaguccucccaccucacccucccaaagugcugggaugacaggcguaugccaccaugccccuggcuccacugacuuuaggaauccaaacucaaccaauugugagauagaguccaaagccacuugguggugacaucagcuacagcuuucaugggacaagaccauucugaaucuucaagaaucuugagagugaucccacaaaucacacacguggcuggcgcuuauuuaagccauuacaccuagaaaaaugaguccagaaggguacaggacauugggggcaaaccuacaucuaagccgggccucacugcccuauuuucuucuucaucccaaacucccuccaauucaacguaagauauaggaccacccugaaaaugacacauuguaaaaagggggccaguauaggacagaaagcaauuaucucugaaugugcaucaucacugaucaagaaaaauaagaugugucuagugcccagagcucgaucugacauauuggagacaaugucaaauauuauuacuauuguauuuaacuacaagaaacuagacugaauuaaaaacaaacuaauucucaauagaguauagaaguuauucaaaaggcaaauuuacuuucuuuuaagguacugacaaacuauagacucaaaagcagauaaugccuugauuucagguuaagaacuaaacaucagcaucaugaggcuuaucacuuccuuucaaaucccauaaugcagcaaaugcaaguuaacaacaaaugaaaucaggcucccuagcuccagacuucagcaauauauacuaaccaacugguuugauaccaucauaccugaagucucagacuucuugaaguuucagauauccugaaucccacaacucaauauuuuuucaguauaaaaagaggacauaaugugacuauguucuucauaucucuuaauacuucuuccagaugugugaacacucucuccagagguagagguuucucaugagcuagcaaguuaaacacacacacacacacacacacacacacccccauggaaaaggcacagaggacucauagggcagugaaaccacucuguaugauacuacaaugucagaugccugucauuguauauuuguucaaacccacugaauguacaacacccagagugagcccuaauguaaacuacggacuuuggucugguugccuggguuuccuuaaaaaauaaaaguuuaaaaaaaacuauggacauugggggauaaugaugcaucauuguagguucuuuauuuguaacaaaugcaccucucugguuaaggauauugauaauguggggggcuaugcacauguggggagaaggggaauauggggaaucucuauacuuuccucugaauuuugcugugaaccuauagaugcucuuaaaaguaaagcaaaaaaauaaaagagcgcagcaaaacuacucaucagcucuguuacacuguaccaucagaaccuaggaaucagaaacagcaaaaaguagagguaaaaaaaaaaaaaaugcagaacauaaaauccccauacucacuaaguucauauuauauaugucaugucagacacuuaaaauugaaaugccaagaacuguuaaaaugaacaauacucaaagcagucuacauuuucuuuccuucacaugucacaggaacagagaaauaucacuauacuaguauuuugugaucaaaagcauauuaaaauauaaccuagagacucaccacaaaaaugaucccugauuguuuuaauaaagacugcccaagauuaaagauuuucuggaaggaugcuaccagauuuaagaaauaucuaacuuaauuuuagagaauugaaauauaaaauagaaugaacccacaucauggcacuuacaugcuagacaauuuaauaguugaaaccccugccagauuaaagggaaaucaguuuuaaaauucuaucaucucuuuuuaaacuuguucaaacauuugaggauucaaguaucaaaaugucuuaaaauuagauaguaagguaguacuccuggaguuuauaagagaacauucccagcucugcaguacaguuuuucaacuuucugacauaucauguuaauaugaucacuuaaaauuaaaauaaaagauaucauuuuugugucaccaacuauuaccuuuccuuccaauaagauaauauuuauucugacacaguaagucucuuucacugcacacacuguaauaaauacacugcuucagacgguauaaacgagauaugacuguccccaagacaaugauucuuuuuuacucaagaaaaucaguacaguaaauaacuuuucuucccuucgagacaaucauagugcuugaggcugcugaaacacaaacacaaaauaucuucacaaaugucuccaaacagucaagcugaaaaucuaagccaaaguuucauuuaacagccugucaguuuuuugaugugaagcuaaugaaugcaguggcaaacaaauccaucaaaccuaacaucaaacaacugcacuucaucccagcaaacggaaaaaugaaauacaaccugccggccggcgcuuugauccaaccuggccaggaagcagaccugugagugucacggcagcagcugcacagaguaaucacggacuucauuccaccacagaaggaaagaaugcuccagaaacagaaaacagucagcucaaauaugcacaaaugucuuauuucaacugcuaaacgagcuguugaaguauuuuuaaaucucuaucaagaaaaaauaauugcauuucacucuguuaugccaacauucaaagcuacaaagauuccuaaaacaaagaacuagauguuacguuccauuaauacuacaacuuugcaaguggaguuuuauuaaaagccccucuguucuuucugaaagcuccuugaagacaauauauauguuuuucuucuuuguacacacauguagcacaggaggaacucacugggcacucaccaaaucugaccucugcccaucagcagcaaaugaacaugugacuaccugaaacaucacucucaauuuuuuucaguaaugaucuugucuuugauuagagaaaugggggaaaauuacacaacugccuucuuaggucaguuguuccugcuaaaugcaaggcccuuuuguucuggagcaucuuacaggauuuggcuaugcuauauuuugcaaguuaagacaagagagcagaaugauccucauugagggaaaacacaagcaaagacagaaaugagaggagaaugguaaggccugggccauuaucagagaauauuagaaacagggauggucaaacuaagcagcuaccaaaacuaaaagguaaaugucccuucacucucuccucugccuauuuuccccagaucuucuacacaauccauacacacacaaaaaaagucuguuugagagaugaggcaguuuggauggauacugugaaaaaagaccaucuggacugaaggacugaaaaaacagagaauuuacgcacagggacagacaccucuccuaaauacaauaauucagcugagaauaucaaacauccaggaauuugcuaaaauuuggaaguguaucugagcuuuacacaaauaaugaaauuucuaaucaaauguacccaaaucuuaagagccaggaagauuuauugaacaacuaucacauaucaauaggucaguaacagauuccgaugaaagccacaggagcccccucuccaguccugcuccagggacaccagaagaagucaaguagccaacagcaaaggaagcagaccuugaaccccucccagugucaacucuacucucaccccuguucucauagaacaaugacucacgagugaugaauucauagaaacauacaugaugccuggcacacagcagauaagccuagucuccauaaguagaacuucucccccuucuaccagccaucugagacaucugaaaaggucccuaaugacaaagccuguugacuuaugaucaaaaggucccuacuggggaacaugagguuaucuuuucaaaaccuacuuuuuuuuuuuaauuaaaaaacaaauugccuucucuaacagcucuuuucugagucaccuaauuaaaaauacugguuuguauuacacaaaauuauauuuuuauauauauauauauauuucauaguguuugugauuacauauaugcacauauaauguaugcagaccccacacucugcacuauuuugcuuauuuaaugcuguacaacaaauaauuuaucagauacuuauacacauucaauaaaccccaugugacagguaaagcagguggcaucaccaccaaugccucauuaugaaaaagugcucauauuuucauaguaauuauaaaaguauuguucauaaucacuuaugaacaaugacuuuuuuauaguuaccauuuagaacaaacugaugaagacaaagaauuaagacaaauaugggcauccucaaugcuaaaagucuuuuuagugcaauucacuacacaucaguuuccaggaaaacacauaaauguaugcccagugcacaaauuugccagggauuagaaacuacauauacaugcaacacaguaaauucauaagguuaccuaaagaaucagacuuggagaucaaaaauaugugucaaauaacugauuaaagauaccaaaaucuggguaaaaaaaaugcuaacucagcuuacuauaauguaagguaauuuauuauccaagaauagacaugaaaauauuaguauugaugguauaaauuaagaaagcacaugauauuuuagugaaacauucgaaacuaucucuuuauaaaguuauuuuccuguuuuuaugcaaaauaacuaaaauugguuacauaacucaaaauauucuuuuuucuuaauuuuuguuuuuauuuuuuguagagacaagaucucacucuguugcuaagacuagucuugaauuccuggccucuagcaauccuccugccucagccucccaaagugcuaguuauaggcaugagcuacugccccagcccaaagcagauucuaaauaugucaaugauaaauugguacccccuguaguaguaggcagaugcuuccccuccugcacccccaacaaagauguccucauccuaaucccagagaucuuugaaugcgcuaucuugcaugacacgugggauuuugcggauugccugcucugaaaugcaggaacuacacaggaggacuagagagaggcuucuaggagaaaaguccagccucugguucacagucagcaacaaauaugaacguuuagucuuacaacugugaggaagugaauucagccaacaacccaaaggagcaaggaaaugaauucuuccccagagucucaguaagaaaugcaauccugcaaacaucuugacauuuaacuggugagaccaaugcuaggccuauuaccuacagaaccaugagauaauaaauggcuauuguucuaaacacaaaguuugugguaauuugcuacagcagcaagagacaacuaauauauucucagaugacaucaccuggccaaaggaaguaagggguggccauaacacugaaaaaaucucaaauacauucaguuagagcaauuuuuaauuagcuggccaaaacugcauuguagcacugaauauuuuguacccagaaccaaacaaaacagucauagcccuuacuaaacugaauaaacagauagucacauaccuaaguucuuuucucuaacccauaggguagagagguauuucuaauuuauauaugaagaauaaaugacuuuccuaauguuacauggcuagccagagaagaaaacuugguugucagauccagccuccuccaccacagugcaacacuucacauucccacaacugugaugggcucugucagcugggauuucagagaggagcacuaccagccucucuuccuuccacuccacacccacucuacuuccacauggaaauguggaaaugcaacuccaauguacaugguaguuuagcuucuccccaaggcuggaauguccuauucuggccaauaucauaggcuacuucugagaccuguauuaaacaagaaucaauauuuguggugacucugaacagcuguaauagcugacuuauaucuguaaguaaaggugcaaacuauaaaauaacagaccuuguuauaaccucguggccaagacacugcuucaaggcagaugcaagcauuacauuuccacaaaagcaaugcagugguuggccaaaguacacacacugaguucuuagaauacacaggauguacaaugugaaguaguaguacaguucuguuccuuucugaauuacucagcauaaacagaaauuacuuagaacagaaaaagucuucuaauaccaggggcuuuccuuuaugucaagaauguauucgaaugacuccugggcugccaaagggcuauauuuuauuuaucuuuuaauauauuaugcaauuuucuaaauacacagguaaauuaaacuaagaguugucuccccuaaauauacuucugucuacguucaccugauggcuccacauguaaguuuuaucaguguagaaugaaugauauucaguugagccaugcaauggccaaaauaagaccacauacgcuuuauuuaucauuuucugcuaaaucuacgucaacuuuacauccucuguaaaacacacaguuuuauuuagaagcugcccucugccagccugcaccuuucccuuaaaagccacaggaaaggaagcaaaccuaauagaaaccaccaucacuuugaagaugucuucuauuuaacaccacagggggaaaguaauuaaauuuaauagaaguuauugccugugaaagaaaauacccacuaugugagcuaaauuaaauacacugggcaggagaugcaaaauuuuauaccaaauuuaacaugaauauguauuuccuguuaaaauguguucuacaugauuacuuucaagaauuucauuucugcacuaagggcaguuuuaaucauuuccuccuaccaaccucccuccaucucuugcuacaauuuuaucagacacucccuucuguaaagugcuguuuucuaagccacaaacugaucgcaaacagggagagaucugagucuaccuaacauggagccacaugaugccacuggaaaaucuugcaaaacaccaacuggaggccucaagauaaaaagcaaacacacgucgcaucaaauuaccuaucaggguaaauugcuccacauuaaucucaaaacagacaaauucagcuaaaauugguaauauuggcuauguaaaauaaauguaucgagccugaagugaauugcuguggugagaggcacauggcgccagugaggaagaauaaauaaaugcugcacaggaucguaggguuccuacuaaaauaaccagaauacacauuuaauuuuugcuuuauuuuugaggcauagcuuaccaauuuggcaacuuuuccauagucaauccaucugacaguagcaaaauuuguagauucugcacaguugaaaccaugauuaaaaccagcaugguagccauaugggaaagugaucaugaauucuccagccuccuggguuaucugcaagguaggaaacauauaauauuuuguaaaaauaagacuuccuaaauuaugaauacaauuaaaauauauuucccauuaaaaaacaaagaaaaaaagucuugauaucagagcacuaccaaaaagaguuccaccagauucauuacuuaauccuuuaauagugcuuuuucaggaaacguuuaaaagacuuuccuaaauaggauguggcuugcuggcacuugaauuaaaucaaacaauccauacucaaagcuauuacauuuuaauugaagguaucuucagguuauucaaguaaauuuguucauauuagcuaucaagcuauauauucuuauauuuuaauaacuugcauuacuggaguuacauauaaaaaucauauaauaacugacauuguuaaagcuacagcuacagaaacuuugauaauacaugcuuggcaggcuauaucaugaauucuuguugguaaagaguuggugauauucaucaaauuauuuuuuccuagcaccuagaaaacauucaauuaagcacaguccauuucacaguaaaacuucuguuaaaagaauuauucaaauauauguauguuagagugagugcauuuuuaaguauaauuaaaauaacucgcauaaauaagccugagccuuuaaaaaagaauuuuaaauguauuuacccuguuucuauuuuuuagauuaaagacuuuuuuuuuacaaucaccaaagcaacacaaaauaucccauggucuacagaaaaagugaagaaaaauguaguguuguuucuuuuuuaaaaaaguaucuauccgauacaaaaauuauaaaacuuauugcucacuccuucaaauggaauaauauaauauauuuguuuuggauuaucugaucuuaaaauguuucuaacccagcagcacccaauaggauagaccccuuauaucuuuaaauucuuucaguugcugcaaaguaauauaaaaauacucauaggauuuggccacugaagcaauguuucuccuugacacauauugccaaaguauuuagcaaaugcuguauguucacauucagagccuguauucucugcuagcucugauaauaaaaguuguaaaaccacauuuuuaauuauccuacugacccuaauacaacuuauauuuucuuugagauauaauguacauauaauaaaaugcucagauaauaaauguacaguuugaucuguuuugacaaaugcauauaccuguauaucccaugccccuauuuucuuuuuuuaugauaaaaaucuaaggaagaaauauauuuauuaaauauaucaaccucagaaaauuacuuaucucugggagggagaagagacugaaacaguaauagcuacauuuguaguauuuuguuucuuuggacaaauaucuguauauacauauaguguuuuuuaaaguauuuuauuuucaguaacaacuuuauugaaauguaauucacauaccauaaaauucacucauuuaaaguguacaauuuguugguuuuuaguauaucacaaaguuaugcaacuaucacaauuaauuuuagaacauuuuaucaccucaaaaagaaacccccucacccuuuagcugucauccccaagccccucauucaucccagcccuaagaaaaccccugauuuaucuucugucucuacagauuuguuauaauggauauuuaauauuaauagaaucauauaaaguaugaucuuuuguuacugaauucuuccacuuagcauaaacuuuucaaaguucacccagguuguagcaugugccaguacuucacuuccuuuuauggcugaauaaucuuccauuacauaaaauauaucacacuugcuuauuuauucaucagccaacagacauuuggucauuuccaauuugggcacuaggaauaauggugcuauggauaauuguccaugccccuauuauuucaucacccaagagcgcucccucaucccuaaccuagaccauccccugcccauccccuacucccaccucaguaauaaucacucuucugauaccuuucaccacugauuagcuuugccauguuauggaugcuaaaaugguauuggagauggggaaaguauuauuuuucccaacaauucugaaauguaacucauaacaccacugucccgugccaaagaaaccccagaagauguucugcugcaaugagcucaguugucaccuggcagcagagacaggcuuaccagugcccagcacgguucaagcuccauuaucugagccacgugagaacauagcccaacucucuccuuuccuggucucacugaaucuaauuaauuaucuaggugcuucuuucuuauccuacguaaugaaacaaaacucacccugcucccacauaaaggugagaggagagggaggacugcugccacuggaacaagaaaacuacuuuucccgcuccauggaauccuaccuacaaaccuucucuacccuaccuagaaaauccagcucaugccaugauuuaaaaaaaaaaaagagcaccuguuacacagaaugcaacucugaauuuuaggccccugucauuuccaaaaacaggucagucccaaucucauaccauaaaagaagcuagagaagagaguggauauaaucuaaaugcagacaucagcuguuuauuacacuuauguuuucauacauauguaugaauauggcaaauacaaugaaagaaggaaaaaauguauuccaacugagacauuauuaccuacaggaagagggcugaguugaagaggaagaguacguuacuaugcaacauauacuauucaaaacucugucuauagauuaucuuucucgucacaguaacccuauuaaguagucacuauuuuuaucccauuuuacagucgaagaaacuaaagcucggaaagauuaugcgacugaaucaggaaugaacucaggagguuuaauccugcagccugugcuaccauugugcugcccuaucauauguuacgcuaucaucaccagguaaaugugguucuugaggaauacagugucaugacaggcccuguguugagguggaaaggggaagugacaguauuaaauaugaggaagugccacugccaaucaacccucaaagucacugguguuucaccauuucaggacuuaaauucaucucgccacuuuccacagaagccauccacaaaacaccagaugagagcccaaugccuccagcgaucuaccauguaguacugguagagagcugcagccuagaaagagggugccaggcaccucuagaaaagagcuccaagcuccagaggccucccuccuggggaaagggagccaaucccacagcccugcugccucacauaacuucucuucacguaucagccuuaagcuaccaccaacaccuaacaccagccccaaaggaacagagaaggauuuugugucuuggggauacuguugcauuccuucacgucuaccuuguaacaguccaacuuaaguaaaaguaccuaaugaagcugaugccaacuacuuaaaagaagcacuggaugaugaugugucugagacucacaaaagccuggugcccagaggugucugcagaugggacaaagccccacagccacagcagccccucugaguggcacagccugugcccucuguacccagcaguucugcagcccauccauagugccucccuacacccgcaggcagcccccacggugcacaucucggaggcacgauuuuuucaugguaaaaacgugcgaguaaaccagugaugagggcacauucacaaaagcaagcauaucuugugcgugacugcugcauagacaguuuaugagggagcagggaaucaccucaagcugaagaaugaacccuggcacuugaaaaacuucuacuuugaacaaaucccccccacccucccacacacacacacacacacacacacacacacacacacacaaaaagaaggccacaguaagaaccuaaagugaagaaaauguaaagauuuagucacaagcaaaaagcuuccaagauggaaagcagcaaggauuaugagaagaaaagucaaauaaaaaacacagaagggccgggcgcgguggcucacgccuguaaucccagcacuuugggaggccgaggcgggcggaucacgaggucgggagaucgaggccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaacacagaagaaggaagagcuauuuuuuaauguuucugcaagcagcuaaguacuuaauccuccugagacugagagggagauuuuauuuaucuggucaaaaccuuuuuucauaucagcugcuucacauaaaaauguuugagcucugcaauaauucugacccaauaaccacccacagacacaaagaaugugggauccagcaucuacugaguuuuauagaaccuaaucuucagaaaacucgcagaagcaauaucagauuauuaaaucaucaggcaauuuuauccauaaugaaaucucgauuguauuaugucuaaauguguuuacaagcaacauagugcuaccauaaucauugauucuaagcaacccauugcuaauaauugcucugaaauuuuuagaaaauagaucacauauacauaaauuauguuacucauaaaaaagauuuuaauauagaagugcuuccucuuauuuuauagaaugugcuacauuuuauuuucaguacaauuauaagugaacuauagcaacaugaaaucucuaguaaauauauuugaaauaaaauuaauuucuaauuaggauuuagauaaauaauugauaugcuauaaaacauaaauuugaauuucucuacccacauccuaaaaauucuacuggaaguuaaagauacauuacuucuuaaauacaaauccuacacaaacaaaauuaauuuguguaagaugaauacuaacauaccuugucaaagggaauaccauauuucuucaauacugauggagaaaucaaugucaucuuguggcgaagaaaugcaucacacccuugggagcugcuugggaaaaaaccuaaaaagaaacaauaaauguaaguggcacugugucgauuaagagaaaauaucaaauagguuuuuuaauguguaaguucuaguguucuuacuguuugacuuaugcaaguauggaccucuucugccaaaaagcccuuguacuaaaacucagagucagaguuagaauucuuaaaaauuaaaggauacaucaccaaagguugaucuucuuuacaaacagauuuaccauaaguuguuuuuguaaccuguaaaauuacucaacuuuaggaauaaauuucaauuugaaacaaauguggauucaaucuauuaucugauaaauggagaaaauauuuagggaaguuaggaaagauaaauacgugggaugcuggaucuauagcuaaaaauacaggggaaaaaaaggaaagauaaguaugcauuccugaagcacucaucccaauccucggcauacagcagacagaguaguucccccaccuuucuguuucuuuucugauuaaucugaaacuaauugcuacuaaucuccugaaugaacuucccagccaucacccaucaacugucugagaaccugccugaacagccugaaugggagaaguguuuugaggaggcuuuuaaaugaggaaguuaaacauacaacaacccuuucauucaacaguauauuauacgccaagacagagucaguuuucuccaucgcugacuucaaaccugcaguucugucugaggcagacucucauuaacucagugaugcaagcuggaagaaaaugaacaugucugauguacugcuccacaccuuccucacucagagggaaggcagccaugcugaagggauuggaaaaacaagaaacaaggaaaagacagagaaucauggagggagaacacaaaaggaagagagaaggcaccaggaaggcacaugcaaugcauaugugugacaggaugaggcguagaugcugucugacuccuccaccaccagaaugaggggggaaacugcuggaaaugugacaucuaacucuguggaucucucuaugcagauaacucaagaacgugaccaauuuggccagguacggugacucacgccuguaaucccaccacuuugggaagccaaggcagguggaucacuugaggccaggaguuugggacaagccuaacacagcaaaacccggguucuacuaaaaaauacaggccaagugcggugguucacgccuguaaucccaacacuuugggaggcugaggcgggugguccacaaggucaggaguucgagaccagccuggccaacaugguaaaaccccgucucuacuacaaauacaaaaaaauuagcgaggcauggugacgcacaccuguggucccagcuacucaggacacugaggcaggagaauugcuugaacccgggagguagagguugcagugagccaagaucgugccacuguacuccagccuggaugacagaguaagacuccucaaaaaaaaaaaaaggaaaaaagaaaaaaaaaaauuaggcgggcaugguggugcgugccuguaguccuagcugcucaggaggcuaaggcaugagauucacuugaacccaggaggcaaggguugcagugaacugagauugcaccacuguacuccagccugggcaacgagagagacuccaaaaaaaaaaaaaagauaggaaggaaggaaguucaauaaaacaugagaaauguuaauucuuuacaaugucucuuaauaaugcagcccucugcuuaugguuaauauucauaauacauaaacacaaaauaaaacacuggugaguggagggaaaguaagacacuaauauaauggccauguccacacaacaagauguccuaaguccuacacacagagaagggcaccaaggggcaguccccaaaugcacaauccaugggaacguuuuuauaaacaauucaaauggauccaucaaacuucucaaaucuguaacuuucugcaacacugaugaauuaaguuuuaaauuaaaaucagugaagaaagaagagucuauuccauuuucuuucaauauagauuuguaaucaggaccugaacaauguggugacuggucauaaguuaaccuaaauuggaaaaccacugaaggaagguaauuugcaguauauuaagaauuucacauugguucagaauuuauauuuacaauaugcuaucagaauuauauuuuacauaguccugaaaaacacuucauaaacaacgcaucuuauguacaaaguaugugccuuaaaaugaauuuuaccucaaaauaccugcagggcuacaugguucauacucacucucacuccauagucuauaaaacacagucaauuccuugccauacuaaagucaacugccuuuuuuuuuuuuuugucuuuuuuaagauauuauacaggaucaagcaagcaaagauggucuuuggaaucauucuuccaauccaaauaauaaguuagagggauggaaggcuaggauaauaaaaagcuuguauuccagagaccccaacagagcccuaaaacccuaaaagcaauccacaauaaccuuuccuaagaacaccaaagugcugcugagaguuuugcaacacagagaaguguguaggaucucauaagcucucucaaggaucacgugcuauacccauccaaaggauguuucacauacaauguaaaagugagcaugugugaaaagcauuauucuaagugaaaaaagcaaaaaacaagucuacacauaguaugauuccacuuauaugacacuuuagaaaagguaaaacgauagggacagaaaccagauuagugggugacagggaaggggagagugguuaaguacaaagaggugugagggaacuuuuuugggguauuggaaauguguuacauguugauaacaguggcuuaucaugugguuuauuaauuacaccacuguaaacauuugucaaaacucaaugagcucuauucuuaaaauaagugaauuuuacuguagauuuuaccugaauaaaacugacucaaaaaaaucauuaaaucuuuugaaacuauuuuugaaauagaguggaugugucuaaaaauauggaacagguguguuccuuccuucaaaugagaaguucucuauacugucaacugguuuauaguuuauaauauauuagcuauugcuaagaaauuauuuuuaaaucccaaucuuuuaugauucaaauacaaacacacgcuauaguauuaaaucaccaaaaauuucagccuugagaaaagaguuuaagaucaaagcuuagugacauuuuuauggguauacaaacacuaauuuggugaagauaaugauagccauuaacuuuuuaggaaaggggagagaaagacaagaaacaaaggagggaggaaggaaagaaaaucaaacauguagaucuauuuccaaacuaguaaaaaauuuuucuuuacaauuuuacuugauaauugaaauuugcccaaguaugcuuugaugaaguuuuaucgugguuuuauaugacugguaugaggcuugaaaaauauagcaaccauauaaacaaaagcuaaggaaaagaauacaagaaaaagguauagaaaauugguucagugaaaaaugcuuucagaaacagauguacuguauuugauuuacacaugaaauuucuuggcaagcuuauuuaugaaaagaaccaaugaccuacauuguaugcagagaaaccuaguaacauuuacccacagcucuacuugagagguugacaugagaggcacauauuacauuuggccucuuggugcuugcuaacguucacggagugguuacucaggaauggauagaaaauuauccuuucgcaggccucacuugacccuaacgucccauaauccaucaacaucucuaccagcagagcgcuccaggaggagugccaggagaacuucauacugauccuggaauggagaauggcgcuucuccuaaacaaguggcuuguuuuaaucuccuagacauggugcgcguuguguaaugggcaaguuuuuuccauuucaagauaauuagcagaaaaccgagauuuaaaauuuccacccaguuuaacuggugugugugucauuacacgcaugggguuuuuuuuacugcauuccugagaccacuuaauuucagcucucacuucccacccccuugaaauauccauggauaaucuacgcacaagucaccaaggacuccccaagccaagaacauugggaucaaacuggucagaguuaaacuaaccaggauucuucuggcucugccucugcccagccccauuggcacccucaaaucaaagaaaucuucacuuccccauaauuccucccuacuaguugacauucauuuccugaauucuuccucuccauucucgguuaagagaagggaacuaaaagucuuucacucacaaaugaauuauguuauuuggguguauuucauguauuauugcccgaugucuaaaaucccacuaggaacauggcuggauauaaaauauccaauuacauuuaaauacagacagugauaucacugacaucaaauuguuaagaaauuaaguuuaccaaccguuucuucacucuuagugaaauccagcugauagacgaaaauaaacauacccugacgcaccacacauugaucuccaugccuaaggcaugaguuaggcaugaaggcagaggauauaucacuggucuuuugcauuuuuuauggcuuacaggguacuuuaaaauugauuauuuauaaucagagguauuuuauuuauaagccuuucaaaacuagacauuucaauauaauauuucagacuaucagcuaagugaaugcuuaagggaauaauauuuaccauuuugagagcuaauaaaaguacauuucccuaauuuccaagagagagguaugagagcagguuaauuuagaaucuguucauaaaauuaaaaugauuuauuuauugcugcucuucuauucucuugacagcaguggcucauaauccuuuucggaccaaacgaucucaggggauuugaugauggcguucccagaaaucuacguauaugcccaacuuugaauauaauuucaaagaguccacugaaugccugucugcaucccacccauugaccuuuaucuacccccuggcacagggaucucugcaaaucgggcuaugaccucuuacuccacaggauuaaaaucaagauuacuagccauuaaaaaaauuccacaaugugcgugcacgugcacacgcgcacacacacacacacacacacacacacacacacaaaugcuuaaaagcaugaacuaaacuaacccuugguagcaauguuucuucuauucccuuuugcuaaauacugcuuuuuuaauaagguaacaaaaccaacauuuguuucaaguaaauauaaggaucuaaaagaauugacucacuuccacuacacuguccuuugaaauaaguuuccuccuaauuguucacacuuucaaaacuggcugcacaaaguccuaaaucacauauuuuggacgaguaaccaaaauuuucaaaguaaauccuuuucaguuuuuuaaaauaauagcauuuuauucccaauaaaggacaaaugaaauaugaaauacuacuuuucacaaaaaucuguacacuuucucaauuuaccuaacuuaauauaacagcaauauuaucuuuuuucuaaaauaggugagauuuagacauuuuaaaaacugaaaaucuuccaaacugucauucaugauuuaacauuauaacucucuucuccuccauauuugcaauccaauuguaucaaaccaaaaauuagaaagaaugcaauggcauuacagacgaauauaacaaguauaaaaauuguaacaauucacuugagauuuuuauuacauuuaugucuauauaauauggggaaaaccuguauaaauaagaaagcagcugaagggcgaaaucaaacuccuggcuuuauuagaugcaggccuaaugucuuuuggauaaaauauuuguaggugccacagucaaucaagauuucaauagaaaccaaagaugaaagcauucaugcauaaaaggcaagugugauaauuaugaugcgcagacaagauaauggaaaauaucugagccuacuuuucauuuuaugaaucaaguguugcuaucagcuagacauucuaaaaugcuccaucauucgcacugcauuauuuuaucauuuuaauuauuuagcagaauucaauuauuuuggcuggcaucuggucaucagauacaaauccuucacuaucuugcagggucuuuucccugcuuuauuccucaaaauauugcugcaaaagaguuuugaauaaacaggcaacugauuucaaguucuuguucauccuucaaguucauuaaccucuuacugauuaaacaaacgguaaccauuuucuggaaugucauuuucagacaguuuacgucaaagcauuagaaguuuauaucagaaauuuuagucugugacucaauauuguaagguuuacaucggcuucauuuuaaaaguucucugguagcaagauuaauagaaaaugguggaaaaauuuuauuacagagaagaagacaguugagaauauagucuuaacacaaaguucacuuccuacguaguuaaguguuacaguaaucaucuuauaagcucuacucuaaucuauuauccaaaacuuauucaugaaaacagucccuaacaaaguucaagauuacaauuacaucaaucgcuauuauuacuauuauguauuacauuuuuaaaaagacacuuuauaguuauuagccugacaaaauuauaauaaugcuucuuaaaauguaauacuauaacuguuccuucuaauacucuucuguaauuuagggaaaaguaaccuuuaggugccauuaacaguuucuguuaaaaacugucaagucaagcaaugagguuucucaguguccccauuucauuauuaauugaaagcacauauaaggcaggaacaaaauucuuuuccuaauagaaggcaaaccuaacacaccaaugaaacuuagaucugcacuggacuaaaagagcacugcucacugaggacucaauccuggauaaaggcagaaggccuugcuccucaguugucacucaaauggaacuccacuuuucccuggaaauaagucacuaccagccuacaucuucuuucuggaaggguggcuagcaaaacagaagauaaggauggcagggggugaaugugacucugcuucccauacguaaguagaugagggcaaggccgccuggcuuaucuuuaaaaaaaaggaggaaggaggaagguggcugcuugcauuggcauugucuacacacacaaaagcaggcacaggaucaucaauagagguccagaaaaguucuuuauucuggcccuaaagaagaagcagcaggccaugaaaaauaaaaaugcaaccugcaguaaaguaaguuuaauuuugccaguccaagaaggcccaaaaucucauguguauuguuacucagagccauucaccuucacacuucccuaagggcacaccuccagucccagugggccacagaagaacugggcgucggcagugacauaacccuugggggaaacagcagaucaacagaaaaaguagucaugaaaaaaccauaccccaagaugcagcaacaauaccgucuggaagaauguaacuuaauuuaaaaaaaaauuauuggcacaaugacguugaaugcauuacauuaaaaacaauuuuuuuagaaacuaccaaaacagauuaagggcaaucacuugaugaaauacuaaacagucaacuaaaauaaccaugacgauuaugcaauagggaaaaaauaauauucacaaacuaaggugaaaaaauuuaaaauuguucaauuaaaaaaacauguaaaagucaauaacuugaauagaauaaaaccaacagaguaacggucuauauuguaaaaaguaccucaaaaacaaagaaccuacaaaacacagaaacauauaaaacacagaaaacaaauuuaaaaagcaaguuuuaccuugagcuagucuuucaagucguuuuccaugcuccggagguauagcauaccuaaaauuuuaaacauaaguaaaaauuuuagguuuauaauuuuucagcuaguagccuaaggacaucuauuccuaaauaaugucacauaaaagaaauucaacaccaaacuccacuuagaugaacugaguagagauuagaaagccaaucacagagucauauuccuuagacaaugaacagaaaaaaaauaugccuauaaauuaccaauuucaaugucacaacucaucaugccaaccacauuuuacaaauuagggaacaaaggcccaaggcagguaaacugcucagcaacaagacagcuagucacagccuagagacccucugugccagcucucauagcaccccagcacucuaggguuguuuugguuguauguuuuucguuuugugguugguugauuuuggcuuuuguuuuuaagaaaaucuggguugcucucuuucuaaauuuuaaaauauuuuuauugacaagcagaacagaacacaaaauuauuacaccaacauuuauauuuccaccaaaucuuacuaagaacaccguaauuuucaaacagacuuuaauaagcaaaagauuaucagccuuaaaaaaaguuuuauuuauuucauaauuaugugacuuucaaaaucuugauuacagcaaaaaauuuucacccuuaaagaacagaaauacucauuucuaguuccauaguuauuuuuacuauggacuugcuaagaaauuuuaaaacaacaaucucauaauauccuauacaaauacuaaauuguaaaggcauuuuaaugaggaaauuuaaugaggauauuaacaauaaauuugaauaaucauuccauguuuuacauauaaacuauacuuuugaagaccucuauuugcuguacuuacuagcucaauauauacuuaguacaaguuacuucuuacuaaaguaacuuaacuaauuuuacuuaacaccacacuugguuucauuuaaugcuacugauaacauaugcaaaacuuaauuggauccaauauaacuaugcaauucacuaaaagaaaauucaaucauauauccuguugcuuaaggcacugcuaaugaaauuguuccaaccgaaaugggaagacaaaauuuuagcauaacuaaaugacuaucacccaauguauauuuauggccacuucuuaccaguucuuaauuccuggcuuacaucacaaauauacccagaaaagggguguggguguggguguggguguggguguggguguggggguaugucccuuccaaacaagagggucagccuuccucaucacacacauacauacacacacacacauacauguaauaugaauaugccugccaacaaaaagguaggauauggagauauuuauauaugcagauucauuuuucugaaaaauugguaaaguuaaagcuccucaaucuaaaguucaaccauaugcucacagaaaauuuagcuauccuuaucugcagaaaggaggaaaaaguaaggcaagauggcucuacuccuacucugauccucaguuuacuccuaggaucugaaucauaccaauucaaucuccucauuccucuccuccuagguaggcuuacuggccuauuauuuucuacaaguauuucccaggugcagcuauuccuaucuuagccaaaugauuuaauuaguucuacuuuucuucuuuuagauggaagacagugucucaauuucuuuucaaauucuauaaauaucaaguucauuuuaaaaucauaacuaauuauuaauaaaauucuuaugguuaaccaacuauugcuauaguuuaauagcuucagaaauaaucaaaggaugaaaacuuccuuccaaucacagccccguacacggaagacauguaauauuucccaaguagaacuaaauccucaaacugaaagccauacugugguaauauccagugaagcacaacugggcaaaaaugccuucaagcagaggucacucuccuucccugccuuagucauuaucuugcucaaagugaacccacucaucuccaugcuuaucccugugaaauauuuuacaugcuucucucuucuguuaucaaugcuaugcuuuguuacacaguauuuaaauaaugacaaagcuauguaauguuuccuauacaaauaacuuugaaaguucccugaaugagcccaaaacccugcccgagggucugacaaaggacagucugaagauaaguaauaaugcuaauaaaacuggaaugucaccaucagauuuuucuguuuuuaauguuuccacauaacaaaggaacuaggaaagacuaauuuuaauguuuuagaaauucaaccaagagccaaaucauuguucuugccaugaacaauaaaaucagagcacuaccccacucagcagucaagaagcaauaugccuccauguaccaucuugacaaccccaaaaucuugcucaaaagauacuacuauucuuuuaaucaauuaucucacucugucaauaaagcccuaggggaucaaagaacaauucuguucucuaaauacaaguugcagggcuggaagggcccuuaaaaauaaucuuguuaggccaggugugguggcucacgccuguaaucccagcacuuugggaggucgaggcgggcagaucaugaggucaggagaccgagaccacccuggcuaacaaggugaaaccccauuucuacuaaaaauacaaaaaauuauccgggugugguggcgggcgccuguagucucagcuacuugggaggcugacgcagaagaauggcgugaagccaggagguggagcuugcagugagcugagauggcgccacugcacuccagccugggugacagagcaagacuccaucucaaaaaaaaucuugcuuagcacuuucuaagccuuuuuccuguuuccauaccauuacagaggcagaaucacuaacaccucuaauuaccagcaauaacuggcaccugggagaaugaaggacagcagaaacauacaucccucagggaugaaguacccagcauacccugaaaaaagcucccuagcugauucugacaggguaguacauuauaaugaaugaacgaaagaauggggugauuucuaauuaccauaucuaagaaccucugcuugguccugacuccccacaaccucccugaugucggaugauagauuuguguaugcgaagcuuuuuuauguuuuuccuucagauuuuuuuuuccgguaauaccacaauggcccaagucagaaugcuaaacaaaagcuucacauagcacuuucaaaccugcagucuauguguguaggcugacagacagcccuugccuguaagaaggugagcaccuggcuucaggggcacucagucacauugcauuugaacacuagacucacugacuucucugcaacagcaccccugcuaacccuacaccacggcacuacuuugaugggcaacugcagcaauuugaagccaaacacaacucuaaucuguuucaaagcaugccaugagaagagagagaaagaaagaaaagacaacaaaacagcaaggugcauauauuuucauguguuuuccagcaaccagcuuccucgguagaggggaacgcacguuaaacaagaacuggaaagcaccaucuaagagacauugcacaagccacuucaccacggucagaccuagucuaccucacagaacaacacggaacagaucgacugagucauauuuaggagcucauuauacacugucagaccucaucuaccucacagaacaacacggaaugcagcaacugagucauauuuaggagcucauuauuaaaagauggcuaaaucacuucucggccuuuuggcuaagaucaaggguaaaugauggcuacaaggcaaugaggugagccugacuugcugccccccacauccaguaaacuugagaaaauguucaaaaaguaucaguucaaacaauccuaacaucaagggucagacaggcacauaaaaggcugauuacaauuugaaagaacccaggaaagcacaguaccuuuuugcaacccaucggaauauccaaaacucaacucuccagcagccugaugaucaggcccuauguucucuuucucuacugcaccaucacaggcccgagcaaacgcaggauacucaaaucaccaggugguugagucauuuggguuacugucccaaaauuuuccuuuauaauagaugugcugcuaguaagaaucacuuuaaaacaaucuaauucaauucaggagauaggugcugagcaccugccacauauaaagcacugcaggaagaacucaaggcauuuuccauguaaguagcggggguagaaauacauacagauauugcuaagaccuaucagaaugaagccuagauucugacacauggaucucagcaacaucaagugcucaggcacaucuacuaucauauggcaguuagugugaauaagaagaggauaaaagagaagggaagaccucugacuucucaaaacacccaaaguuaucgccacuagagaugaacucuaaugccucaacucugggauacuuaucuuacaucugaaauaaguaucauuacccacuuacauuucuaagauuacuucauaguucuaccuaccaggcaccaggacaaaauuagucuuccuguccuaaacaggaauaagauacaacaaaacacccacuccucuuucaaaucucagcucaagacccgcccaggagaacucccacucccucucuuguuguaucaacaaucucacaugcagguguccacccuggcacucagaauacauguguauuucuaccuuccugccucccuacuauccuaucucagcucccuaagaggaagggucuauggcuuucucccggaauacagcaccagaagaacagauauucuguauuugcugacuuauaucacucucaaaugauaaaccauauuccugcuccuccaagauggaaguccuggagaagaggaaggaaacgggaagaugaaaaaaucacgaaagcagaaaaugggaaggaaggcuaugucagcaaaccucauuuccugacuuuagggucagucuggugugcucaggaccagcaacugcauccucaaucaaacgucuacuucagucaaacucccaagaccuaaaugucucccaggacucccuagcaacuuuuuuuuuuuuuuuuuuaacuguagagaugaggguuucacuauguugcccaagcuggucucaaacuccugggcucaagugauccucccaccucugccucccaaagugcugggauuacaggccaccacaggccacugugccaguccacauuuucauuauagcauggucuccccaugcuucauccuugccuucucuucauuccuccugggucuuacccagagcuauguugccuacgaaguccacaggcugugacagacaacaugugcucaagauagauugggcagacuuggggcuccgaaauuccacauaaaccacuuucccagaagaacugcccuaaaaauuuagcuccaugaauuguagcagcugccacaaaaaaagucaucuaauuccguuauaaaaugaaaaaugaguaauaaaguuaaacagcaacauguuuguacuuuauuaaaauaugcuaauagucuuuaucuaaacaaguuuugaaaaucaguaaaagucacugucagacaauagcugaaacagaaugcccugaaugagagcaaaugauaggagguaaaaagcccuuuaaaaaaacccggggcuuuuaagaaguuuuaaauccugcugcucugauaacauccaaguguuuacuaauuguuguuuaacauaguacuauggacauaccucauuuuauugcacuuuguugugcuuuaaagaugcugcauuuuuacaaacugaaggucuauggcaaugcagugcuaaccaagccuaucuguggcauuuuuccaacagcaugugcucgcuuugaaugugugugucacauuuugguaauucucacauuucaaucuuuuucauuauuauaucuguuauggugaugugucaucagugaccuuugauguugccacugcuauuguuugggggcaccacaaaccaugcccacauaagagcgugaacauaauaaauguguguguucugacugcuccgucggcuagcugauccucucucucucucucucucucucucucucucgcucucucucacucucucucucucucgcucucucucucgccucuaaguguucaagaaaaagaagagcuccaugccucucauuuuaaaucaaaagcuagaaaugauuuagcuuaguaaggagggcauuuugaaagcuaagauaagcugaaacuuaggaaugcaaagaaaaaguuacugaaggaaauuaaaagugcuacaacaaugaacacaaugaugauaagaaaacaaaaaacauugcugauauggagaauguuggcaugucuggacauaagaucaaaccagcaacauuuccuuaaaccaaauccuaauccagagcaaggcuucaauucucuucaauucuaugaagacugagagaggugaagaagcugcagaauaaaagcuggacucuagcaccaugacguuucaggaaagccauuguauccauaagagagaaguacaaggugaaacagcaagugcugcugauguauuaauagacauugcagcaaauuaugaaaaucuagcuaagaucauuaaugaagguggcuacauuaaacaacagauuuucaauguggaggaaaccuccuuauaccuacuagaagaugaugccaucuaggacuuucacagauagaggagucaaugccuggcuucaaagcuucaaagggacgggcaugguagcucacuccuguaaucccagcacaccuguaaucccaggccgaggcggguggaucaccugaggucaggaguucaagaccagccuggccaacauggugaaaccccgucucuacuaaaaauacaaaaauuagccaggcaugguggugcaugccuauaaucucagcuaaucgggagucugggcaggggaaucacuugaacccaagagguggaguggugcgcgccuguaaucccaacuacucagaaggcugaggcaggacaauugcuugaacccaggaggcggagguugcaaugagacgagauugcaccauugcacuccagccugggccacaagagcgaaacucugucuuaaagaaaaaauaaaaagcuucaaaggacagguagaacucuauuguuaaaggcgaauauggcuggugacuuuaaauuacauccaauguucauuuaccauucuaaaaaucauaggacccuuaagaauuauacuaaaccuacuuugccugugcuguauucaggagacucaucucacgugcaaagacccacacaggcucaaaauaaagggauggaggaauauuuuaccaagcaaauggaaagcaaaagaaaagccagggauugccauccuagucucugguaaaacagacuuuaaaccaacaaagaccaaaaaagacaaagaaggcauuacauaaugguaaagggaucaaugcaacaagaagagcgaacuccuaaauauauaugcacccaauacaggagcaccuggauucauaaggcaaguucuuagagaccuacaaagagacuuagacuuccacacaauaauagugggagacuuuaacaccccacuauuaauauuagacagauaaacgagacagaaaauuaacaaggauauucaggacuuaaacucagcucuggaccaaguggaccuaauagacauuuacagaacucuccaccccaaaucaauaccucuuuauuucucaucuucuccgccaauaacaaguccuaaccacucuaccaccucaaaaccuugugucuaucucccagcaguaucacuccaauuucaaccuuuaucagccuucagcuagacuauugucacuauuacaguuuaaaaaccuucauaccucacugccuggcuuucaagaccuccacaauuuaacuccaaccuucuuaaauaugaacauuccacucccuauaggcuggacuaagaauuauucuaucacucacauaggugucaaccucacuccuccccucaaaauaccccucuccguguuucaauucaccucucaaaccccacccagauuccaccacuuugaagccuucuuugaccauuauaaauuucagccaucucaucccuuuucuuccucccagagcccuucaauuguauauuauguaguauuauauacuacuucccaaagcaagaugcugcucaaugugcacacaucauuuuugucuugauaggucuugaguucuaugagguagaaaaagccuaccaccacccagacauuuuaacauaaacuauccauuuucaucuaccuuguagagugccugcuccacagccaggcccuaaauuaugggacacaauugcucaguuauguagcuaauuccaaauucuuugaggauaagaauguacuuugcaccuuuuuuguauacuuugaaaaccaucaaauaaaaugccuaccauuguauauccucaaguacauacugguuuguuaaaauuaauaauuauucauuuaagcuuugggacaguaggguuuuucuugagcuauucugcauauugcucaaguacugcuaacacuaaaaaacugagucacuaaugaacuaugaacacacuaauuagauauuuacaggauuauguugcauuuaaaacugaagucuuuuauaaauuuuuuuuaagauuuauuuugaaggccaaggaaaacaaaauuccuuuaaacauaucuucaggugauuuacucaaaaauuaaacauaaacagauauagcccugcaguugugaaacaaacacuaccuugaacugaaugagauuaggccaacauuucacaauaauaguaaguaaaucuauacuuaugaaaaucuacuuucucuaguucaaguuuucucuaggaacugcccucuucguacuucuuucaaaauaugcucaguccacuuacuuguuuaccaguacuucucaaagacuaacuccuacuucucagaucacucccucaaaauucccuauuguuuuuugggagcccuggggcuguguguuuaggaacaaaugguuucuguugucccacugcccagacgucugucacagggcugucacaggcagcugccauaggucccucugucacugucaccaacaggggcugcagcaccuacagaugucccagcuuccacucaccuugugacauccaggaccacagaggggagaauuccuuccaggcccacgucaugcucaggcaggucaguccuaaaacaagccugcccuauacucccugcgccuaacuaaggccgugugaaguagucauuuccucccuuauuuauguuucugcuuguuguugcuguuuugcucacaaucauccccugugaagaagaaagcccaguaccucaaggacaauuuuuuaacagauaacaaccccaaaaugaucccccggccccauuccucgcauaagcuuguaugccugacuugcccucuaccuucacuaaaguguucaaaaacacagugaaaaagaagaacugaccaauaauaugauuacagcucaucacagccaucauuuauugagcacugauaacacaccagagcuuaugcuaagauguuauaauacaaguucuacuacuaccuccauuuaacuaaugaggaagccaaagcuuccuuacaggcaucucuucacucaagcaaagugaugacagagcuggcaccuaaccccagaccuaucuuaacuccaaaguacaagaucuacucuccaaacccauuuuccaacacuguuuccccaacaaucacuaugaagaugucaaaaggaaagaagugacagggcccaucuguccuccaagggaaaaaccccccuuacaaugaacaagcaaaagacaauggcauuuuaaauaaaccgcagauacaaagaacaagaccagcaaaccacuaccugaagugguuguuuuuuucaggggggaugcaagggaguucuuguuacaaaaacacuuuaugaaucaaaaaguaaaguauauuucacaaaacucaaaauuccugaaguaguuaauuuauaauacacuuuuuaaucaaagcauacucauaaccaauugucaaaaagauugaaccacuauggauuuuauagaugcgacuauguuacauuuucacauuacuuauggugcuaacaaguuuuaauacuugugcauuuauuaaagauuaagcauuaaguuuuaaauuaugaagucuuguuaguuaacuguggaaaguagaacauugcauacuuaauuuucaguucuuaaaaacagaugaacgugaggaacagaaagcauggcuauaggggaugcugcaggcaggcugccaagucccacuccuggcaaggcccuugcugccuucaugaguucagguucccucccccaagaacauaccccuugaagagggagggaauggcggcccacaugcaagggaugguccaggcuugaguauaaaggcuuggccaucuugccugaauuuggggcaauucugaagggcaaugucagcuccagcacugcccuuaggaucugccaggacucugcuggaguucaccuuccccuucugcccaguucugccucccccacugugagcaguauuauuccuggagcacuauacaagaaagcccuggcacacaaucucagagugaacuccccaaguaaucuaagcuaaaacaguaacaauaaacauguuuguaaagaggugucacuuaaaugccaguccucuugccuuguaagcuaggcaucuaagaguacggccuggagaaugaggugccugaaaugaggcccuacagaaccugagauuaaaagccccugagaaaaggaacucagcuagagcucagccgcacccuuaaugccauucauggcccauuuccugacauaacauucagaugaaaaccagaaacccuagcaaccauaugugcaggcagucauaacuguggaagccacagugagaaaaaauccuuacaagaagggaauaacuaagcuuuggaaaguugggcaguucuuuuuaaucuggaauuucaaauacaauucgauaaccauauacauguaaauuaauuccccgagcgaucagaaaaauuaguaaguuaccauuaccuaacaucauuguuauaaaaucuaguaagacaauggcacaaaacuugacuuucaagaaauaauauauuuuauauuaccuagucuacugaauauuuucuaaguagaaaauaauuuaguguuuuacacacuauuuuucgugagaaaaaagguauucuaaauuaguugauaucaacucugaacaacuuuuaaaaagcuuuccugaccucuccaaaauacucaacauauaauacaugcaguaguaaagcgacuuuucuaguacagucagcccuccacaccgagagucccacauccauggagucaaccaaucacagaucaaaaauacguggaggggaaacggucgugucuguacugaacauguacaaacuguuucucuggucaguauucccuaaacaauucgggauaacaacuauuuacauagcauuaacauuguauuagggcuuacaaguaaucuagaaaugauguaaaguauaggggaggaugugcauggguaacuaccacgcacuuuauaucagggacgugagcagccacagguuuugguauugugaauggaaccuggaaccaacaguucauggauacugagggguggcucaaaucggugauccaguuaaccgauuuucaaacugcuuuuuauggcacaccucaaaguucccaggguuuccugggaugaaugcuauguuaccuacggaaacucucuucacgugaggauauuuuccucaaguuuccucacguaggacugccugcacguaugguugcuagagugucucuaguucaccuaaacguucugucaggaaaugggccaccaguggcguaagggagaggcaaagcucgagcugaguucuuucucucggggggcuuuuuaucuggugucuucauagggccucagcucuacaaggugccuccagggaggguuuggugcgagaaagcuucucaccacacauuucauccauaucagcucugccuuauguuuucugcuuuaaauauugagauucugcagaaacuuucauguauagaaaguuuugaaaaucucuguguuaaagcuuuuccaaaguagggaccuaucacagaaaacauucuuucugguugauacauaaggguucuguguaagauuuggauuccauguaagauuuuaauuccacugaaauuuugcccacaagcguucugcuacugcaauaaaagacaguggggaagugcaggggaggggcuaaaagcuuugugugucaacuguuaguaaguuucauaaguagaagccauucugucaaguucacauguucaugguauuauugacaccuagcucaauaccugacacaggugugugcucaguaaguaaugaagaaauuggaaaaacauauaaaaucauaaauuaccaaacauagaugcaauguuuuguaacagcaucaagcauuaauaaaacagggaaagaugccauuucgagaagauucuaaaauguaagaacacaagaaguugacgauaaaugaaaaacaugcccauauaaagcugucugcccauaucaaaaauuuucugaagcaaacuuuucccaacaaaaaauaaucuuaccuuauauaggaaucuucugagaacauuacucuuuccaaaugaucauuuauucaaauaucaauugugguuucugauaccaaaauggugcuauagaagcaagcuggauucacuccucccacaaccuucacagaaaaccaaaaacaaauaugcagcacuggccgggcgcagcggcucacgccuguaaucccagcacuuucagaggccgaggugggcggaucacgaggucaggagaucaagaccaucuuagccaacauggugaaaccccgucucuacuaaaauacaaaaaauuagcuggguguguaggugugugccuguaaucccagcuacuugggagguugaggcaggggaauugcuugaacccggcaggcggagguugcagugagcugagaucacaccacugcacuccagccuggugacagagcaagauuccaucuuccaaaaaaaaaaaaaaauauauauauauauauauacacacacacacacacacacacacacacaaacauauauuuuuauauacacauauauacauuuuuacauacauuuuucuauauauauauauauauauguauauauauauacagcaccaagucaucaccagcaauuuccuagaacucaaauaugaggaggagucagaucccagagaaguaaaaaacuuccaagcaaauaguaagagaauaagagacuucuauauccucagcaccccuuccuuugaucugccugaagucaagugugcagaaaauaaaccccccacucacgguuucuacacuagaauagagaucaggguggacaaccagcuuucccaccauuguggguuuccuaggaggacacugucccuucuucaaucuguaggaagcacugggaguaccugaagaaagaaauaucccucaagacagccagacacaaagagcgauggcaggaauaccauucccagcccuggaaacucagcaauucagccaacggagaugccaaaucagaguggcagcucagcagugcuacacuguaggaggucugucccacaggucuccugggaaugaaccccuagcuagcccucucacacccuuuggaaaauaccccauucaggacagggggcacucugauccuuuacuagagcuaaggaaaaccugggcugaaggcaccaucuggaaccaaaaaggaaacaguaaccuagcagaaaaagaaaagaaaagaaagaaagaagggucaagaauauccuugguaaauaaauccaagguaaauuauaagaaucucuaaguagacauauuuaauaguaaccaaaaaaaaaaaaggaugggugcaguggcucaugccuguagucccagcacguugggaggccaaggcagguggaucaccugaggucaggaguccgagaccagccuguucaacauggugaaacccugucucuaacuaaaaauacaaaaauuagcuggguggccaggcacggugaaucccagcacucugggaggccgaggcgggcggaucacaaggucaggagaucgagaccauccuggcuaacacggggaaacccugucucuacuaaaaauacaaaaaauuagccaggcauggugguggcgggcgccuguagucccagcuacucgggaggcugaggcaggagaauggcgugaacccgggaagcagagcuugcagugagcagagauugcgccacugcacuccagccugggcgacagagcgagacuccgucgcacaaaaaaaaaaauaaauaaaauaaauuaaaaaaaaauuagcuaggcaugguggcacaugccuguaaucccagcuacggagggcugaggcagcagaauugcuugaaacugggaggcggagguuacagugagcugagaucacgccacugaacuccagcccaggugauagaccaagacucugucucaaaaagaaagaaaaaagaagagagaagacugagauaaauaacuaagccuacaauaacgcaaagucauagacauacauccacaagaaacaauagcaaacagggaaccaugaccuucucaaauggacaaagcaagaaaccugugacugacuggcccuaauaacauagcuauauguaagcucucugaucaggaauucaagauagcacuuucaaggaaaccaguaaucuccaagauaacacagaaaaggaguucaagaauuuaucaaagaaauuuaacaaagacggggcacuuuggcucacgcuuguaaucccaaaacuuugggaggccaaggcggucggaucacgaggucaggagaucgagaccauccuggcaaacacggugaaaccccgucucuacuaaaaauacaaaaaauuagccaggugugguggcgggcaccugcagucccagcuacucgggaggcugaagcaggagaauugcuugaacccgggaggcagagcuugcagugagccgagaucgcgucacugcacuccagcuugggcaauagagcaagacucuaucucacaaaaaaaaaaaaaaaagaaagaaauuuaacaaagagauugaaauaauuuuuaaaaaaucaaacagaaaucuugggacuaagaaauacauuugcugaacuaaaaaauuaaucagaggcucucaacagcagaauugaucaagcagaggaaagaaacaguaagcuugaagacaggcacauacauagacacaggagaaaaaaaauaaauuaaaaaaaaagauugccaacaagauauagaaaauuaccacuaaagaccaaaucuaagaauuacuucuguucaagggggaacugagcaagagcaaggaguagaaagcuuacucaaagaaauaacaacagaaaacuuuccaaaacuagaaaaagauaaauaaauaaaauaaauuuaaaaaaaaaaauuagcugggcauguuggcacaugccuguaaucccagcuauggagggcugaggcagcagaauugcuugaaacugggaggcagagguuacugugagccgagaucacaccagguauagaaaaguuagagaucaccaaacagauaugacccaaauaagauuaccccaaggcauauaauaaauuucucaaaggucaaagauaaagaaaggaucuuaaaaacaggaagagaaaagaagcaaugacauauaaaggaacucuaucuaacuggccuggcaacagaucucucaaugaaaucauauaggccaagaaguagugagauggcauuuucaaagugcugaaaaauggggauugucauccaagaauacugaaaccagcaaagcuguccuucaaacauaaaggagugauaaaguccuucccagauaaaugaaagcugagagaauuugccaucaccagacccaucuuacaagaaaucuuaaagggaauucuucaauacgaagcagggaggggaaaaaacccacuaacaugcaagaagaaaacauuuaaagaugcaaaacccacuaaaauuaaguacaugaacaaauucagaauacucuauuacuguaauagugguauugauaugguuugauauuugaccccucuaaaccucacguugaaagcugauccucaauguuggagguggggccuaaugggagguguuuccaucauggggguggaucacucaugaauagcuuggugccaucuucacgguaaugggugaguucucacuccauuaguucccaugagcuggcuguuaaaaagagccuggcccucccuuccuucucucucucuuuuuuuuuuuuuuuuuuugagauggagucucgcugugucgcccaggcuggaggcaguggcaagaucucggcucacugcaagcucugccucccagguucacgccauucuccugccucagccucugaguagcuggaacuacaggcgcccgccaccacgccuggcuaauuuuuuguauuuuuaguagagacaagguuucaccguguuagccaggauggucucgaucuccugaccucgugauccgcccaccuccgccucccaaagugcugggauuacagccgugagccauggugcccagccccuucucucucuuaccaugugaucucuguacaugcuggcuucccuucaacuuccaccaugaauggaagcaacaugugacccucaccagaugcagaagccuaauccagaacuuuucuaaacaucagaauugugagccaaauaaaucuuuuuucuuuauaaauuacccugccucagguauuccuucauagcuacacaaggaaagucagauggaauccacacauaacuccaguaugaagccccaaagaaaaacaucucaaaaacaauaacuacagcaaccuacuaaaaagcaggcaauauuaaaacauguaaauuaagaaaacaaaaaaucaaaacauggggugggggggaguuaaagcacaggguuuuuuuguuuuuauuuuguuucuauucuuuucuguauacguugucaccucuuuaaauauuuaagguaacagauaucccaguuacccugauuugaucuuuauauauuauauaaauguguaccccaaaauagguauaacuauuauguaucaaugaaaacaaauaaauaaaugauaauuacaccauccaugaauaagauaaaguggcuuaaagggguccauaaaaauuggcuuauaaaguuccaccacaaugaacuccaacaaaguacugaagcauuuucaagauuuccuaugauugaauuuuuuuuuguuuuuuguuuguuuguuuguuuguuuguuuguuuguuuugagacaaagucucgcucugucacccaugcuggaguacaguggcgugaucucggcucacugcauccuccuccucccgggaucaagcaauucucccaccucagccuccugaguagcugggauuacaggcacgugccuccacaccuggcuaauguguuuuuguauuuuuaguagagaugggguuucaccauguuggccaggcuggucucgaacuccugaccuccggugauccaccaaccucaaccuccuaaagugcugggauuacagcugugagccaccacacccagccugaaguuuagccuuuaagggaaaacuaccuguacagcuucuuuacaguuggaaaucuccuugagaauuaagaggcuuucaaaagugcacuuuauucaaagcaaccaaacuacaaguaacaugcaaacugaaaaaaauacacaaagccugaaauauuaaaauaaaaauaaacaguaaauggucaaauguuucuguuaaaaucaaacauuucauaaguaauguuaaucuucauuagguaggcacaguaagauaacuuaucagacaugaagacaacaaaggcaacccaacuaauucaaguccuuucucaaguauaauaucuucccaaaaaccacucaguuuuuuaaccacacuuaaaggaaaauuguuaaauaaguuuucugucucugauuagaaaauuauauuagagaucauacaauugacugcuauguccucucagaaauacauauuguaggucaggcgcguuggcucacaccuguaaucccagcacuuugggaggccaaagcaggugaaucaccugaggucaggaguucaagaccagccuggccaacgcggcaaaaccccaucucuacuaaaaauacaaaaauuagccaggcaugguggcacaugccuguagucccagcuacucggaaggcugaggcaggagaaucgcuuggaccugggaggcagcaguuacagccgagaucacaccauugcacugcagccugggcaacagagcaagacuccaucucgagaaaaaaaaaaaagaaagaaagaaauauauauuguaaaguaacuuuaugcaugaguucaagaaacuuuaugcaugauuccucaaauaaguaaauccucuaugaagcccacacaaauaauaagucacugggaggaagagaggaggggauagauucaugacaauuggcuauauuaaguuugagguauguugucuguagauuucucuuaugcaacaaauauaaaucugugauuaucacugacaaucaaaauaugguagaguggcugaacauuucuaauaagcaguuuucuauaauucuaaaauuuccuauauaucagacuaguucuaaucaaggcaucacacaggaugcaugacuguacuauucuauaggcugacuuuguaauauuuaucccuaagaagcuaaaaguauguuagauuaacaacagcugaaagaagcaugaaacugcacauaucuaugacauacaaguugugauaccuggucaacacacaaaaauaggauacauguaccacugcucucaggaaguugaauaucucaugggagagacaagaccaaaauacacaaauuaaugaagaguucuaugagaacagaacauaauaaaguaguaaaacugaccauuagagcuauauaaaucacaagaaaaaagaccaauguugguucaaguagugaccaaaaaaacuuacaaauuauagauguguuaguuucaaguccagugcagggauuuauuuccaccuacugccugugccuuggguaaaaguuaucaaucacuugcuggaaaugcuuuuacaauaacuuaagcaaacauacauuuuuaauaacuguaauauuauauauagauauauuccaucuuaaauauccucaguuuuucauuuuugacacuuuuacaaaaaaggaguuaguugggguaaguuaaucaaccuucauaagauuuuaagcaaggagcccagacaaucucaaaaaaguauucucaaucuagagaaacacaauguugagaucauuuuaacaugaauuaaaauacauuccaaguaacacauggaaaaacacacuaacuuuaauguaaaaacuauuugcucuguacuacugcaagacuaaagaggacuguguuacagccuucagaagcugggcucagacucuaugucucuucucacaguccuagcaaaucuuuuuuuguuuguuuacuuuuauuuuaggauugcaggcauaugugaagguuuguuauacagguaaacucaugucauggggguugguuguagggauaauuucaucacccagguauuaagccuaguacccaguaguuauuuaucugauagguuagacagauaaaguacacuuaacuccugacaaggacugacuagcuucugucaauguacuuugccaaaggggucagaaucuaaguauagucuaauuaaaaaucaccaacuauucccuagagagaaacaaaacccuccgucaagacauaacucaauccuucaaaugugggguuuucuuucugacuucaagaauguuuccaaguaacacaucuaaagaaagaaccuuagguggcaaacaaacgguguugguucagacauuucuccuaccuacaccuccaaacgcccccccauccccaucaccugucaauuaucacaagauuagaaucuagccacauuacagcccucugaaaaucuuucuuaugccacagucuggccccccaaaaugaggagcacguuucucuuuuaguucugcauaaaaucuaauuaaaagaaaguugaugguguaaaaagaaacacagggaggcuuucuucuugccuacuccuucaucuuuacucuuuucuuuucuccuuaaagcuauaggaaaaaucaguuaauagucugaaucccaacugcaagacuuauuaauaacuagauaaaccuuuaagacucuaaauaauucugagucuuuuuuuuuuuuuuuuugagacggagucucgcugugucgcccaggcuggagugcaguggcacgaucucggcuugcuacaagcuccgcaucucagguucacgccauucucuugccccaccucccgaguagcuaggacuacaggcgccugcaaccacgcccggcuaaauuuuuuuuauuauucuuaguagagacgggguuucaccauguuacccaggaugguuucgaucuccggaucucgcgaucugcccgccugggccucccaaagugcuggauuacaggcgugagccaccgcgcccagccaguccucaguuuuaaaauggggcaaaaaaaaaaaaaauccaccuacuugagacaucugucgucuguguuaccagagacgauuucuuuuuuuuuuuuuuuuuuuuuuuugagacagagucccgcucugucgccaggcuggagugcaguggcgugauaucagcucacuguaaccuccaccuuccugguucaagugauucuccugccucagccucccgaguagcugggacuacaggcgugggccacuacgucgaacuaauuuuuguguuuuagcagagacaggguuucaccacguuggccaggauggucuugaucucuugaccucgugaucugccugccucggccucccaaagugcugggauuauaggcaugaaccaccguacccggccaccagagaugauuucuaacagugauuaguaugguuccuggcaaacaucaaaggacuucacuaaaugaaauggagucaccaaagacaacacacuuuacaaccuuguucaaacccuacuaacuaaaaagcaagcuuauaaaaaaugaacacaugugcaguaacaacggaacauuuauaaaucuauuuguaauccuagcuuuagaaaugcaaucaugaaaaaagccacuuuccuauauacuaugggcaaauaacaauuuuugcauaacaaauauuaaauugcaugcauuuucuaccaacuccaaucuaaacaaugacauuaaguagugugugaaaacaaaaaaaaaaagagauaccaaaaaaaugauaaagcuggguaaaauaacuuguuaacuacuaacauaguaauuuuuuuuuuuugccggggggggagacaaaaucacucugucacccaggcuggagugcagugacacgauguuggcucacugaaaccuccaccucccaggugaagcgauucucaugcuacagccucuugaguagcugggauuacaggcgcacgucaccacacccggcuaacuuuucauauuuaguagacagaggguuuugcuauguuggccaagauggucuugaacuccuggucucaaaugauccgcccaccuaggccucccaaccaugcccagcccuaacacaguaauuugcgaggugaacagcauuaaugcuugcuuuccaugaaguacacaauaaagaaaguuggguaaacauucugguuuuucccuagaguuauggauuuaacaauuucuuuucauuugaagggaugucaauguuguagguggugguggucgugguggugguggugguguaacuaaaagaguagcaaaaaagauucagcaagcauccuaaggggaauuuacacgcccuuacugagcaguaauucauuaauaugcaaauuuggaacauugcuaauaacaaaauaagcaaaagcagguagaaaagggauucucacaauggguaagauuuugcccugagucuucuguuucuucaauucauuccuuuaaaucuaccaucaauauagcagguuacugccaggcauaguggcucaaaccuguaauccaggacuuugggaagccaaggcaggaagagugcuugagcuuaggaguuugaggcuacaaugagcuaugacugacugcguggguagacugccuuagcucaggaguuccaggccagccugggcaacauagcaaaaccccaucucuaaaaaaaaaaaaaaaaaaaaaaaacuuagccagauguguuaacaugcaccuguaguccuagcuacucaggaggcugaggugggaggaucgcuugagcccgggaggcagagguugcagugagccaagauugcaccacugcacuccaaucugagcaacagagcgagacccugucuuaaaaaaaaaaaaaaaaaguacagcuggcuacucuggaaaacuauuugcuuugcacguugacugacauuauuaggauuaguuccaguucauaauuucaucaucaaaguaccaacguuaaacuugaucgguaacaauccaguuaccaaucaauuaauuaguaaaaucucaacacuucaggaaaaaagagugagacuuuccaacucacaaacacuagauauccuggaugguuccuuuagggaauucugugcugagcagugguccacagagaucaauguuuuggggcugcaagcaagugggugugugcuagagugguaugugauccacuugaucaauaaauauuuuacuaccaguuagcacuguauucucuucuucuuacaaauauagcuagcagcuauguacaaagcuaauaccauacuuuuugguauauuuccaacacuuuuuaaauuuuauuagcaauauuaucuuuucuguuuugggguuuguuuuuguuuguuuuguuuuugguagauacagggugucccuauguuaaccagguugguuucgaaccccugggcuugagcaauccuucugccuuggccucccaaaguaacaauacuaucuuugaaacauacaauggccaggcaugguggcucaugccuauaaucccaggacuucggggggccaaggcaggaggauugauugagcccuggaguguaaaaccagccuaggaaggcucaacauaggaagaucccaucucuacaaaaauacaaaaauuaugggaggccgaggcggauggaucaugaggucaggagaucgagaccauccuggcuaacacggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaauacaaaaauuagccuggcauaguggcacacaccuguagucccagcuaccugggaggcugaagugggaggaucacuugagcccaggagguuguggcugcaguuagccaucaucgcaacaccgcauucagcccgggaaacagagugagacucugucucaaaaaaaaauacacacacacacacacacacacacacacacacacacacacacgcacacagagagagauaugccuaaaacuaaucaauaaccuaugcgguuaauuuuauuacuucaacuuaagaguauuucuaaaaguauuuucuuauguaaagggcaaauuucucuagaaaaagcaauuaaaaccaaaaugaaccaugguuaauucuaagugcauuuuuucuagacaaaauagcaaaauaaugcagcuuuacaccauccaguaagucuuaacauuugaaauuagaacauauuacugggucuaaaguuacuaaauagaaaaauuaacaaguaugaguuauuaccaugggcugcuaauucaauggaucacuaaauacuaucaagcugccuaaucccuaauguucuuagauuuuuuuuuuuuugaucuucaaauaaagaguuccuucaguaagacuguucacugagcaaauguuuacugaguaccuaccaagugccaggcucaugccaaaugcugugccaggcacuagaggcaugcuaguuaaaagacugguggggccaggaauggugacucacgccuauaaucccagcacuuugggaggcagacacaauaggaccacuugaacccaggaguucauggccagccugggcaacccagcgagaccccaucucuauaaaaaagaaaauuuaaaccacauaauaaaugaaugaacgaaugaaugaaugaauaguggggcuccccaacucccagagcucacauuuuaauggagauguacauuaaacaagcuuagaucaauuuggcaccauauaacuugcucauucuuuuaaaaaguaagacuugaauuauauaauucaacaauaaucaaguaauuaguuguaaguaagcagcuucucucuucuagaccaaagggagaaagaaggaauggagaggagaaaggacaggaagagauagggguaaggugaauagaagagaguggagggagggagaaauaaagggaaaggcugagacagacauccaaugggagcaucugauuuccuagacugagccaugccucugguuuaucccaacuacaaacacugggaaaaauccguuauacuuaaauuggguuccuuuuuuuuuuuuuuuuuuuuuuuuuuugagacggagucucacuguguuccccaggcuggagugcagugacgcaaucucggcucaccacaaccucugccuccuggguucaagugauucuccugccucagccucccgaguagcugggacuacagucaugcaccaccaugcccagcuaauuuuuguauuuuuaguacagaugcgguuucacuauguuggccaggcuagucucgaacuccugaccucgugaucugcccgccucagccucccaaagugcugggauuacaggcaugagccucagcgccuggcugucauuuauaaccaagaacacuuauuaauacaaauuuaugaaguucauguuuaaaacacuucaugccauguauacauacaacauauauuugcuaaaugaauguaugaaacguuaacaucuauugagcacuguguuacaucuccagcugugauauguacuuuguacauagcauguuauuuaauccacacaauugccuuacaaggugggugccaaaaccaucugaguauuuuaggagagaaaauugaggcauggagguuauuuaauaauugcccaaggucacaugcucaguaaagaguaaagaguuuugcaaaacucaagacugacacaaaaaccugugcugguaaguacuacacaacacugaucaaaaguucuaaugagaaagcauugaacuaauguguaucuauccugaauaauuggauacuucuuaacugcuacacaguauuuuaacaaaaucucaguuuacugaaugaaauuuaacaauguccaaaaugcuacaacccauucuuaauuuucuaaaaaccuucaggaaaaccuuuccugauuuuagaccuuuucacagcuuaaaacacauccucuuacaccuuaucucccuuguucucuacagaguaaauuugaaaguuaguuuuuuuuuuguuuuuuuuuuuuuuuuuuuugagacggaguuucgcucuuguugcccaggcuggagugcaauggcgcgaucucagcucaccucaaccuccgccucccagauucaagcaauucuccuuccucagucucccgaguagcugggauuacaggcauguaccaccacacccggcuaauuuuguauuuuuaguagagacgggguuucuucauguugaggcuggucucgagcuccugaccucaggugauccgcccgccucggccucccaaagugcugggauuacaggcgugagccaccgcacccagucgaaaguuucuuauucauuuuguuuguacccagucugggaaagaaagacucaagauaccaucugaauucuauauccucuagcaguuaagcacucacacaagaggcuuggaagggagaaucacauuuuuuuuuaaucacugaaacuccuauucuauuauaaauacauacauuauggccaaguucagacuuuaaguaacuacuaugacuaaaaaaaaauuauuuucaugguuauuaaaauaauaguaauuaugaguauuuguauaauacuuuacaguuuacaaagcauuuauacacaguauauaccuggacccuccuagauaucccuuaaguagacagagaauaaaucaugccuccauuuggcagugaaagaaacucaugaugaaaggaguguagugauuugcccuaagucauucccaguaagugacagauugggguuuuaaaacaggacuucuggcuccaaagucaauauucauuccaagaaaauaauacuuuaccacugacugucaaagcaguuuucuaucugcuuacucuaaggauacuuuucccccuaaaccuucaaccagaaauguucaaauaaaucaucagcugcuuugaagucucuucaguacaaaccuguguucaugaacacuuacuccgcaaaccugccacacacgguagcuagaaauguaugucuccuauguauagcaacucaggaaacuuaguauucuuaauaguuaccuuuuaggcuuuuauuuuuauuuauuuuuuuauucuuugagacagugucucccuccguuguccaggcuggaaugcaguggcaccaccucggaucacugcagccuugaccuccccgggcucaggucauccucucaccucagccuuccgaucagcuggggcuacaggcgugagccacuaugaccggcuaauuuucuuauuuuuuuuuuuuguagaaacaguuuugccauguugcccaggcuggucuugaacuccugggcucaagugauccgccuaccuuggccucccaaagugcugggauuauaggcaugagcaaccgcaccugggcuagaaaagaaucuuuuuuauuaaaaguuuccaugccugcccuuaaagagauggaucuaaaauaauuuaacacucuucuaauucaauacaacaauucuuuacagggcaucgcuccuauagccaggcccuguguguuaagugcugaugauucaaaggugaaaaaaaaacacacacaaaaaaaacaaaaccauggaccuuaacuucaaggcacacacaggcaagcuggaggauggucggggagaaaggaggugggaaaaugagggagauggcaggagggguggccacaaccaguuguaagaugccaaaacaaugucuaaaguaggggcagcacauaguccagagagucuuuaagcaaacccuaagugaaacauggacagaugagagcagcaugggcccguaaguaaggagggaaucguaggcagucuuugcaauaaucccauccagagccugguaccuggagguagaauucaagaggaaggaguagacuugaaaugccaaccuauaaggucagagacagaagagaaaacaauauagugacagauaugucaagcacaggagaggccacccacuagagaaaaguaaaggcaaccaucccauacugaaggggagauacagcucaacaaggagaggacaggcagaagaggacgcuggugcacacgcacccacaugugcauacagaaccuugcagcccuucauccucucguuuugucaacucaauaaaaauauuccugugacucugaucaugagucacagaaucagaaugacuggaggucauucuggcuaaccuugugacuugggggagugaaggaacuggaguccagacaagcagaguuauuugcccaaagccacaugcacuagugcauaauaaagacuacagcccugauuacugggcccucguguccuaagcucugccaaaccgccugccuccaaauacuuccaugaauuuguguugcuucuaacaucuuucaaagcucaccucaaauauauuauaaggauugcuaaaaugaauuuuaauaaugacaaaguuuaccucaaaauuauuuaugcugaggaaauguaauauuucauacaucuacuagaaaauaucuguaggggcauuuauaacacucucuuccuacaguaguuaucuuaggaaauaguauguagaaucaguguuacaacucacuacuacauuuuauuauuuuaucauuauaaacaauggccaagguuaaggauaauagugacaguauaaaucuacucuuaaugcgucugauggaggcuguauacuuaauaacuaauagaguaauuaacuacugcacauauacaagcugcaagaaagaaauacuuugaaaaugggcauaauuauucucacucaugauuagugaugcucuuucccaaagacacaagacaccagaauccaucuuagcccugaccagaauauucuuccugaagugaucauuaggagacaacaucaaccuguucccaggagaagacaagacagccaucuuucuuaauuagaaagcagacacuucauuuaaacuuuccuaauacugaaaacucaaauuaacgucccaggcauccucauuuauuaauuccuuaacaaauccccagaaaaguuuugcuacuaacuuuucagauuucuuaagcaagacauaguauguaguugccuacauacuagauuuuauuaacauguugaauucacccauuucauucaauuuuauccacacuuuaagugaaugucagaaagagcaucaagauaacaaagcagcugagaaacuguccaggagccuaaccauuguugaaaauauuucuccuagucucuccaagcuaaguucugaaaaaacuaaaagaugacauuccaacaaacuuuacaguaaugcuguacaaacacaacagagaucccuguccuuaagcaugugcucaaaccaggcccacaaauaacaccugagugcugggugcaguggcucacaccuguaaucccagcacuuugggagguugaggcagcaggaucacuugagcccaggaggucagcaccggccuggacaacacacuaagacuccaucucuacaaaaaguaauaacaaauaaacaucugaguaaugaauaauccgaucacauucucuugucacuggagccuguaugaguccuagaccaccuauuaaaaaguuucauuuggccaggcgugguggcucacgccuguaauuucagcacuuugggaggccaaggaggguggcucaccugaggucaagaguucgagaccagccuggccaacauggugaaaccccaucucuacuaaaaauacaaaaauuagccaggcgugguggcacacgccugucaucccagcuacucgggaggcugaggcaggagaaucgcuugaaccuaggagguggagguugcagugagccgagaucgcaccacugcacuccagccugggcaacagagugagacccugucucgaaaaaauaaauaaauagaaauaaaaaauaaaaaauacauuggcugggugugguggcucaugccuguaauccuaccacuuugagaggccaaggugggcagacugccugagcucaggaguucaagaccagccugggcaacauggugaaacccugucucuacuaaaauacaaaaaauuagcugggccucuaaucccagauacuuggguggcuaaggcagcagaauugcuugaacccaggaagcggagguugcagugagccaagaucgcgccacugcacuccagcuugggcgacagagcaagacuucaucucaaaaaaaaauaaaauaaaauaaaaauaauuagaggaggaugaaccagaagaucaugaagaugguuugaaacuacacccaggaagucagcucuucacuccuaacuaccuccuacauaccauccaacaaaugcucaaaguaaagaugcccaauaaauucuugaagccuaaaauauuuaucaauucaugguucacaaaauggacuacaggcaacuuuacauauacagucaugcaucacuuaauaacagugauaguuucugagaaauauguuguuaggcaauuucgccauugugugaacaucauggaguggacuuacacaaaucuagauaguggaucuacuacagaccuaggcuauauggcauagcuuauugcuucuaggcuacaaaccuguacugaacuaaauauuguaggcaauuuuaacacaaaguauuuagcuacaaaguauucauuuagcuaaacauaucuaaacauggaaaaagaauuuuucaauugcauuauaaacucaggaugaccguuguaucugugguccaucauugaucuaaacauuguuauacagugcaugacuguacgaguuaccaugggguuuaugguuuccaagcacaaucccagacagaauagaagacaauuaacuauuacagucaaaaacuuccuuacagcucacauaaaucugaauccaccaaaucaaagaacaaaauccucuucaauaugugccugaugcccaaauuucaaaacuccaaaguaaaugaauauuaaacaaguaacuugccaagacuugggcucuccaaaguggagauaauuaaugcuauagagguccaugucuucggugugccaugcaaacguggucuuccacaugccaaaauagagauaugggguauuuacacccucaauagaaaugccacacucuucuucaaccacauccaagacuguauugaggcgagcuauguuccauucauccacacccuggaaugagagagaaaaaaagagagagaaaucaaaucuuacuaaaccaugaaagauagcauuuacuaaucaaaccacuauccaccaaaauuauuacauuguauauucuaacuaacugaaaacugaaaaauaaaacaacucuuauucaagagccacauacauauguccauuauuauuggucaaagauuacuaccagcauaaugugguuccauacaacuaucugguagaaauuuauaccaaauagcuuccugaugccaaauggaaaugaaaguuacagacccacucccaacuuggcugucagcaaaaaauuacugauucaaaguagaugauccggcaugugcucucccuccuuggcacaccuuuuuguuuuugggguuuugagauuuggguuuucuugggauuuuuuugcacauuaguuuagagguaauauucaccaucacauaucacaucaagaaaccaacagcaaaauauaucuucugcuaucucucucccaucccuauccauucaaucuuagcauguaauacauuguuuccuuaaaguuccacucuaauuauuggaaaaacucuuggcaguauccacugaucacugugcuucuacugaugcuucaaauaaauauuuaccucuuauguuaauggaaaaauuuaaacacauaaugccuauuaaaaauacuuaucccaacuuugguaaaacugcuggaauaauguaguuuuauaacaguauaacaauauggauggugauggcagagcgagggaagguuagagucacuacuauaagaguuaaggugauaggaaaagauucugguuugauuagaacuuaacaaucauuuuuuuuuuuuccccugagacagucucacucugucgcccaggcuggagugcaguggugcaaucucagcucaccgcaaccucuaccucccagguucgagcaauucuuaugccucagccuuccacacagcuggaccuacaggcguaggccaccgcacccaccuaauguuucguauuuugaguagagacaggaguuucgccauguugccuaggcuggucucgaacuccuggccucaagugaccugcccaccucggccucccaaagugcugagauuacaagcgugagccaccacacccggccaaucacucaugaauugacuacaguucacaacugcuuagaaauuuuuacaaacuaugcauuuuuaccauauauuuuuaucaaauucuaaauaucagagacuaggcauguuccuguguaaucauggggaaacugaaaugccuuuaaagccauuccaaccuuuucgugcuaaugcacuauuagagaagcgcauuggccaggugcaguggcucacgccuguaaucccagcacuuugggaggcugaggaaagcagaucacuugagcccaggagcucaagaccagccugggaaacauggcaagaccccaugucuauuuuaaaaauaaaaaauugaggguauuaaauucaucuaugucuaccaaaauuguccucuccaauaacuauaccaauggcuucacauacaaccacuucuaacauuuccugaacacacuaaaagcuuuuagaguuguucuguuuucauuuuggucuuuaaaugauuuucuaaucaguguguuaaucuuacugucuaaagcuuugggguuaaaaaacuauugaugaagcagcuaaugaaacucugacucagguaacauaacugaacaugccaaaggacauaauuuaauucccaaauucucuuaaguagccacucuaucuacaacuuaggccacacgcugagaagcuuguuauuuggaaacuggucaaaguauccguuuagagaagauccggccgggcgcggagacucacgccuguaaucccagcacuuugggaggccgaggcggguggaucaugaggucaggagaucgagaccauccuggcuaacacggugaaacccugucucuacuaaaaauacaaaaaauuagccaggccugguggcgggcgucuguagucccagccacucgggaggcugaggcaggagaacggccccgggagguguuugcagugagccgagaucgugccacugcacuccagccugggcgacagagcaagacuccgucucaaaaaaaaaacaaaaaaagagaagauccuagguuccaacuuuucagaccucauagaaguucaaucacauuauguaaaauauuuuaucucauucuauuuauagcgaugcaaucucuuaacucuaguccaaucagacuucaguccaaucacucuaauaauagaguccuauuuaaaagucauuagugaagcaaugaaucugaaguaauaaaugagcaccauauuauaggaaccauuuuuaaacugaaugagcuugcaaauuuagacacaaacuauuucucuaaaauuccuacauauggagacaucuaaguuuuauuucugacugacacuaucuuuuaaaaauaaccaggguugaaucccuugacauccuagacccaugguaugaggggaagaggguagagaucaaauagugcuggacaaaaagaccuagauuauaaccccagcucugcaggucacugaggggaaaaucacggagcuuuucugagcgucaagucuuucuucauggaaacacaaggguucuuguacccuccuagaguugcucggagcacuaaauaagcuaaugaaaauaaacuuuaauaaaauaaaauuuaauuauuagaacugauauaauaaauaucaccacuauucucuagcaaaucuuacuggaaagccucccaaaaaacaagucaagcaugugagaagugauuauuuaauaaaauguguuuaaauucacuacugaauuucuccccguuaaugggcaaauaacauauuugcagcaguuucuucucagcaaggcaagguugcuaaaaaguaauuuauuuugcuaaaauaaaaagucauauaauuucaauuaagcaguugugcaaauauuaagaauaaccaacagagauaaaucuuauuguuucaaaauucuuucuccaauuuuuguucucuacuauuaaacuagcuaucugacuccaaaaacaggcuccacaaaggcucuucugaacaguaccaggucugucucauauacuuagaccaaaaaugcaccuaguuaucauuaaagugaaguguuauacaauauacuaccucauuacacuauacacacuuguaucuuacauuuauucuaaacaauccuauaaaauagguaauguuauucccaaaugaacaaaugaaaaaauuaacacuccuagcuagaaguagaugguaaugauuaaccuaaaucuaucugacuccuggaccuucccuuuuaaagguuuaugcuucuaguccugauccuuucaaaacacaacauaucauccucuucucucagcaucauugucaacaaagaucugagguucaggagcagcaaacacgugaagcugcugcauucuucccaccagaggcagugccacucuacacaaauaccagcaaggcuuacacugcagacugcuucacuugagagcaggugacaggaaugauuuaguguaaaagcagucuccaaaccccagcuacacacaagccccacaaugacaaguuagaaucugccgaacuguuuaaaacuuaauuccaucagguuucagcagaaaggcugcacaccagcccaaguucacagacaaaagucuccuccuggauucugucucccucgaacaaaacucucccacacauguucagcaggcacaugagcaauauucauaacucaccugacuuccaauggacuaacuggaguccuaagccugggagucuacgugccccggccccuuucuccuuucaugccaauuacccaguuggagccuguccugccccauuccuuuacguauccugcaucuguuuucugaaacaacucacaauuggaccacgauuuuugcacacagguguaacugagaacuuuauuagggauauucccuuucaaucagugauaguaucuuccuccuaucaggaaucagacagcaguuuaaaagcacucguaggccaggcacaguggcucaugccuguaaucccaauacuuucagaggccaaggaaggagaaucacuugaggccaggaguucaagaucacccugggcaacacagugagaccccgucucuacaaaaaauuuuaaaauuagccagguguggugccucacgccuguaaucccugcuacauggaaggcugagaugggaggaucaauugagcccagaaggucaaggcuagagugagccagugauugcgccacugcacuccugccugcaugacagagcaagacccugucucaaucagucaaucaaucaaugcauuccuaaaucuucaaugucucaacuaggccauccuggacucucuccacaguaacugcacucagucucugcaaaacugaagggaacaacacagcaacaugccauguuagaaaccuugagaaauaaugagccauuuccaccuacagaaagaaauaaugugaaaaucauaguagcucaauuuuucccaaaauauuuccaaugcaacauuagaaauauggguccuaggcugggcgcaguggcacacgccuguaaucccagcacuuugggaggccgaggcaggcggaucaccugaggucaggaguucaagaccaggcugaccaacauggugaaaccccaucucuacuaaaaauacaaaaauuagccgggugugguggcacacaccuguaaucccagcuauucaggaggcugagguaggagaaucacuugaacccgggaggcagagguuguggugagcagagaucaugccacugcacuucagccugggcaacaaagcgagacuccaucucaaaaaaaaagaaauaucaguccuaucagaugccaaggucgaaaaacuuuguccucuuuaacucuagcucuuaagacagucacagugcugacaggcacccccaaaagcacucauaaggaaaccuguguaacuucguuuaacucugcauuucccaaaaaucauuugaccacggaagcuuguuuguauaacacauuuacaucauguaaaacagugcugugugggacaacauauuaaaggaagccuuaugauaggcgguucccuaaacacuguagugcaaauguuuaagucaguaaaacaaaaaauuacugugaccacaucagagaugcacuucagaacccggggugugugaagggguggcuagagaauggucacauuuauugucaaaauacacauauuuaauuugauuaugucacuaaaaauaaaauaguguaaauuagaaaaacuuaaaacaaaagauauuuguaaaugaagauaguccaaaggauuaaaacuaggaaaagagaagacucaauccaacguuauaaaacuauaaaauguacugaaaaacagagaaaaagcuuuuuuaaaaguacguaaaaaugaugguuuaugccuguaauaccagcacuuuaggaggcugaggcaggaugaacacuugagcccaggaguuugagacgauccugggcaauaaagagagagaccucaucucuaccaaaaauuuuaaaaaauagccggguauggugacacaugccacaggucccagcuacucaggaggcggcugaggagggaguugagguugcagugagucaugauugugccacugcacuccagccuaggcaacagagugagaugucucaaaaagaaaaagauggcauguccaucaaauauuacaaaaaagauuuuuuuagacaaaaaauagauuauuaguaaacuuuugaaaacugugucacugcugcacucacccagcaaacaguaaaauggaaugaagaauuucaaucugaaagaguaaccgaguaucagaauagcaccaugcugcacuggaaucaaaaguucuccaaccaaaugcuggcuccaccacucaccaauuauaggaucugaugguuucucaaucgccuuucauggcagagcuacgcccaggguucagugcugcaaauugggccacaagaagacuguggcuaccuugaaaggaccacaggaaaaguccagucuuucacugaaacuguuuucaagaaaauacauuauuccuagcagaaguggagaaagcccuaaggcuucccaauaguacauaaauccacacaugccuaccuuauaggacaguuguaaagaaaggauuacaaaacacaagugaaaauauuuugaaaaauugcuuaaauuuuucauuuucaaagauggggagaggguucagaccacagcuuuuuagaggggcaccucgacggauucacagcccauuccacuucaaagagggcugucagcauccuguuccaaacagcauggcagcaggccgggcacaguggcucaugccuguaaucccagcacuuugggaggcagagaugggaggaucaccugaggucaggaguucaaggccagccuggccaauauggugaaaccccaucucuauaaaaauauaaaaauuagccaggcaugguggcacaugccuauaaucccagcuacucgggaggcugaggcacgagaaucacuugaacccuggcgguggaaguuacaguaagccaagacugcaccacuauacuccagcccgggcaacagagcgagacucugucucagaaaaaagaaaacaaaaaacaaagaguacaagaacacagcaggaaguggagagcugaguaauaaagcaggacuuacaaacucaggugcccaaagagccaggcagguaacagcaauuagugaaggcagccagguauaugucaaaaaacguggguauugggggugauguguauuuggagacaaccuacuauccugucuaaaggagacagccauuacucagucacugggaaugcugccagauuuucugauuuuuuuuaagccacaaaucccaauuuuaugugacauuaaccaacuuuuaaaaacauguggaucaguccuggugcaguagcucacguccguaaucccagcacuuugggagcccaaggcagacggaucaccuggggucaguucuagacuacccuggucaacauggugaaacuccaucucuacuaaaaauacaaaaaaaaauuagccaggcgugguggugugggccuguaaucccagcuacucaagagacugagacaagagaaucacgugaacccaggaggcggagguugcagugagccgagguugcagugagccaugaucgcaugccacugcauuccagccuaggugacagagcaagacuccgucucaaaaaaaaaaaaaaaaaaaaaagaaauguggauaaaagaaaauaaaucuguggccaaaucugcaaaaaauguagcaggcauuaaagaguccauacuuauuacaguaauuuuaaaagaauaaaggaaggaggaguuuuggagacaggcuauaaauaugaaguuagugguugugagcuuacugcuuuaaaaugaaucauauauuuguccaacacuaaauagcucuaucaguuacuccauaaauguguccaguaacuggagugagacuauacaagugguaggaaccuaacaggaauccacucuaugagcauguuuuaucucucuguuccaugaucaauaugcaaauggccaaagaaaaacaaaguaaaauggcaaaacacaaagccugagcaauuaagaaaacugauaaccagcuccaggauaaguaggaucuagcacagcccugaacaaaacuguguaacuucuuaagagaagucucugugaggcagcagaauggcagggaaggucugcuagaacuuagccauuugccaggcacaggugaugauucugugaacugcaccaaagacggccugaucaugcauucugcuuuguccaccaaguggaauagcuauagucacuugcccacaaaccugagaaacugcuacaauaucaacacggagacuguggaagcagcccuggaugauuacugaaacacuuccaacugaacacacaaaacgugaagauguucuucacucuggcauauuuuaggggcugcuuucucauuuguuguacauaaaagcagaguuggcuacagaaaaauugauaaacugauacacacgauuauuacuaaucauauuuuuaugguacuuuccauauaauagaagaggaaaagucuauaugaaccuuguuccccaaaauuaggucaaaaccacuaaccugucacucucucgcuaagucuuuccauaucuucacaguuaucacucuauauuccauccucaacaacauccuucccauuuccugcugucacccucagcaccuucaauauuauccucauguggcugauuuccaaacaaagcuaugagcccccaucuuucuccugaguuucagugccacagagccaacuccaaacugggccaauaaugaccaauaaaaauuuuugaaauucaagaauucacagggggaacuaccacuucauuagaaaauccaauuauuaaaaaaagaucugccaccuagauucuguaagaaucugagaaaauacugaaagaaccuguuaaagauucucaaguuuccaggucuaccccguaacuuaacgaagucaucaaaaagaauauacagaugggcaggacuacagucuuucuuccaccacaaaaaugccaucaccaaguuacauuuagaugugcucuuggucuuuccaagggcugacauagcuagcacccauuuaaauugccucucucaaagcuugcuaacuguagagcuggggacaugucuucuaccuaacaacauggcaugcaccaccaucucacauagaauuggaaagaaacaagaggugggauaacccccaugcuaggaaaacaaaagcaaaacaucauuucauuuuacagaugaaaggaaggugcccagucaguaacuuacaggacuccuuauuugaaaauuagaacagagggcuggaugcgguggcucaugccuguaaucccaaugcuuugggaggccgaagugggggcggaucacaaggucagaaguuugagaccagccuggccaauauggugaaaccccgccucuacuaaaaauacaaaaauuagccaggcgugguggcagacgccuguagucccagcuacucgggaggcugaggcaggagaaucacuggaaccugggaggcagagguuacagugagccaagaucccaccacugcacuccagccugggcgacagagugagacucugucucaaaaaaaagacaaaaaaaagaaaaagagaaaauuagaacaaaggccagguucaguggcucgugccuguaauccuagcauuucaggaggccaaggcaggcagauagcuugagcccaggaguucaagacuagccaggacaacauagcaaaaccccauuucuauaaaauacacaauaauuagcugggcaugguggcacccgccuguagcccuagcuacucaggaggcugagguagaaagagcaccuuagccugggaggucaaggcugcagugagccaugauuguggcacugcacuccagccugggugacagagugagaccugucuccaaaaaaaaagaggaaauuauaacagaacaguuagucuccucaacagcaaauguaucaucuguccaguauaucauagcucuuuguaaacaauccccucauaaauacuggaauuggucucauuuuuauauuucagcauugugacaugguguuucucauuaacccauuaaugugaagcuuuuuauuuuuuugagauggagucucacucugucacccaggcugcagugcagugacgcgaucucugcucacugcaaccuccaccucccagguucaagcgauucuccugaccucagucuccugaguagcugggauuacaggcacaugccaccacacccagcuaauuuuuauuuguuuuaguagagacaggguuucaccauguuggccaggcuggucuccugaccucaagugauccuccugccucggccuccaaaagugcugagauuauaggcacgagccaccaugcccagccacaugucuuaauuuuuaaguguaaaaacacuuuaaaauuuuaaguaaaaaacacucauuuuuaagaauuuuaaaaagacaaauuuggccaggcgugguggcucacaccuguaaucccagcauuuugggaggccgaggcgggaggauugcuugagucugagacuuuaaaaccagccuggguaacacagugggacccuaucucuaccagaaaaaaaaaaaaaaaaaaaaacuggccaggugugguggcaagcgccuguagucccagcuacuaggaaaguugacgugggggaaugguuugagcccaggaggucacggcugcagggagcaaugauggcgcuacugcacucuagccuggguaaccgagugagacccugugucaaagggaaaacaacagacaaauuuaugccuuuccucauuugacuuguaucaucccguuuuaggacucuuauccaagcccacauuagaagacuuugucuuuaaagaaaagaccauccaccaaacuccacuacugugcuggcaacuuaaagcuaggcuaauguaaaauacugccacaaauucauacagcuggaacaagcccuugaaguuucaaagguaacacgcauggagaaaaaauaacauaaaauuugguuaguucuuuaaagauuucaaaauucaauccauuucacaccauaguguauagucuuuucuccauaaaagaaaacagugccuucuaauaacuaaauugaaaguucuggucuacacuuuaauauagacugaggauuucccuggaucuuuacacaaugagaauagauccguaugcaguacauuuugcuuauaguuaaucauaauguuugacaugauagcuuuuuugcugcuucuuucuaaaaauguacuccuuaaaucuuuauuuuaaaacaaaacuauuuucccuuuugcauuuuuauacaccaaauaccuacgauuuuacagcacugcuuucuguuuuagaauucucaacaacaaccaucauauagcaaguuuugaaagaaaaauaauucugcagugaaagugccacauaaaaagauaaaggcaaauaugaguacaaaaaggacagagaaaaaauggggaaaacguccagucaaauaaaagacugcagugagcuugagacucccaccuugagucuagacuacugauagugugaaguuaauggaguuuccugguuccaggcagaaauaacuccaauccucuugggagaaaagaaucauacauuuagauccagaauuauuccacaaauuaacaucaagucuacgcauacaagcaaagaucacugugcauaccgggaagaaagccaacacugcagagagauagcgcaaauaaugaacaaauuguucagaccagccccucaagcaggaccacuaauauugaguugucuuauucugucgucaaggaauaagaaauguuuaaagaaauaaaagacggaauugcuaagacaagcaaagaaaaauaaaauauuuggaauguccaguccaaccugaaggagaggugaacuccuagaaaagaaauauaucauuauuaaacuaaaaacucagugaaagaguuaaauaagagaaacaguuaaccaguauuaacaagcaaaaaaaguaguuaaccagaauauaauauuuaggacauuaacauaguacaguacagaaauacaaugagauugaaagucugaaagguaaguuaagcaauacugaggauagaauaugcaacauuauaagacagaaucuaaucaguccaggaacaaugagaaauacaaaaaaacuaaauaaaauaguaaaaaucuauuaaaauuaaaauuaagacauuuguucauuaaaagacauuguaaauaagacaaacaaaauagugaaaagaauagccacaacuagagcaaauaauucaacaaauauaacugggauaguuuugguauccagaauaaagaauuccaaauaaagaaaaagccaaaagaucuaauagaaaaauagaggacaguucauaaagacaggaauaugaauggccgauaaagacaugaaaagauauucuaagccauuuuuaaucagagaggugcaaauucacauaacauauuuuacaggcacaagaaugacaucaaguaguaagauauuaagcgugaagacuggaucagcaugaagaagcuuuuaaagcugauggaaauguucugcgacuagacuggugauggcugcacgaaaaucacugaaguauacacuuaaaaugggugaauuuuguauuguauaaauuauagcucaauaaagcugucuuaauaaugauuauaagcugggcagaguagcacacgccuguaaucguaauacuuuggaaggcugaggcaggcgaucacuugaguccaggaguuugggauaagccugggcaccauggcgaaaccccaucucgacaaaaaauacaaaaauuaguuggguaugauggugcaagcuuguggucccugcuacucaggaggcugaggugggacgaucacuugagcccaagaaucugagguuacagucagccaagaucguaccacugcacuccagccugguugacagggcaagacccugucuuaaaaaaacaaaaaugauauacagugcuaaaggaauauaaagugauacaaacucuuagaaaagcaauucaacaguaucugguaaaguuaaauacucuaugagccagcauuuccauuccuacguaaauaccuuugagaaacuuuuacacauguacaucagguaccauguaugggauguguucacagcaacaauauuuauuuuuaaaaaaaaagaaagaaaauguucacuggcagcagaauaaaaaaaaaguuguaaauucacaaaguagaauauuauacagcaaagaaaaugaaugaacauuacaauagcuuacaaaauaauauggaucaacugggaaauacuguuaggugaaaaauaucaaagacccagaaaacuacacaaagugauacuauuuuuaauaaggucaaaaauaagccaaacuaaacauauuguguuaaaauacgugcaugcaugagaaaacuauuuuuuacaaggcaagaaaucaaacacaaaauucaggccaccccagagugauggggguggcauagcaggaaaggacuaaaaaagagugguuggucccugagcagugcuguuaauguuguaguuguugacugcauggugaguuugggauauucaaaaucauuaugcuuuaaaacuuaaauauauuguacauauauaaaucaaauauuaagauuucaacaagcugauuuauuuauuuauuuuuuugagacagagucuugcucugucccccaggcuggagugcaauggcaugaucuuggcgcaccgcaaccuccgccucccauuuuuuuguagagaugagcuuucaccguguuggccaggcuggucuugaacuccugaccucaggugauccgcccgccucagccucccaaaguguugggauuacaggcgugagccaccacacccagugauuuuuuuaaguugugcacuuuuauucaacuggucucaagucaguguacagguaagcccuggcugccuguacccacucccagggagaccaaaagccuucauacaucucaagcugggggacaaaagaggggggccacgaaggcugaucauucaaaauaaaacaaacuuaaaaaguauuaaggcaaaaauuuaaaaaaauuugcauuaccuaauuuacaagaaaccuccccuauguggacucggaggaggacuaggccauucuccuuagacacaagucggguggcuuuuaggagggcaaacaacuuccuguaacaaugcaucucacgauauuuggaaugacuauuaaaaaaaagaacaauguacaaacaagaaauagaguccucagccacacugcagaaauuugggggauguucacuccaaccgacugcugucaccuucaccguuccaguuuuuaaauccugagucaagccaaaacaaaaacaaaaacaaaaacaaaacaaaacaaaaaauaaagccaugccaaucucaucuuguuuucugcacaagucagguuuugucaagaaaggguguaacacaacuaagucacaguccgccuagaagcauuugaaggauggaugauggagccggacucaucauacuccugcuugcugauccacaucugcuggaagguggacagcgaggccaggauggagccgccaauccacacagagugcuugagcucaggaggagcaaugaucuugaucuucaucgugcugggcgccagggcggugaucuccuucugcauccuguuggcaacgcuaggguacaugguggugccgccagacagcaauguguuggcguaaaggucuuuguggauguccacaucacacuucauaauggaguucaagguaguuucauggaugccacaggauuccaugcccaggaaggaaagcuggaagagugccucagggcagcagaacugcucguugccgauggugaugaccuggccgucagucagcucauagcucuucuccagggaggagcuggaagccgccauggccaucuccugcucgaaggccagagcaacauagcacagcuucuccuugaugucacgcacgauaucccacucagccgugguggugaagcuguagccacgcucgguaaggaucuucaugagguagucaggucccggccagccagguccagaugcaggauggugugggggagggcauaucccucgcagaugggcacacugugggugaccccgucaccggaguccaucacgguaccagugguacagccaaagaaguacagggacagcacgggcuggauggccauguacauggcuggggugaugaaggucucaaacaugaucugggucaucuucucgcggcuggccuugggguucaggggggccucggucagcagcaugggaugcuccucgggaaccacaugcagcucccuuuagaagguguggugccagaucuucuccauguugucccaguugguaaugaugccaugcucgaugaggcacuucagggucaggaugccucucuugcucuaggccucgucgcccacaugggaguccuuccgacccaugcccaccaucaugcccuggugcuuggggugccacacgaugaaggggaagacggccgggggucaucgucaccugcgaagccagccuuccacaugccggagccguugucgacgacgggcguagcaauaucaucaucuauggugagcugguagcggguguggacaggcagcagagcagugagggccagggucugugcucacggggcggacguggucuuggccaacaagaugauuuuuaaaaucaugacaaagagacuaucggccagaugggguggcucaugcuguaaucucagcacuuugggaggccaaggcgagcagauugcuugagcucaggaguuccgaaaucagccugggcaacauggcaaaacccugccucuacuaaaaauacaauuaacugggcaugguggcgcacgccuguagucccagcuuuuugggagacuggggcaccagaaccgcuugaacccagaagacggagguugcagugagccaagauugcaucacugcaccccagccuaggugacagagcaagacuaucuuaaaaaaaaaaaaaaagacuaucucuugagucauaucccaugaggccacuucuguccuggcaccacacacggcaggaucuuacugacaagaagauagugguauauuucucaaaaacgacagaggcauuuucuuaagcagugacuccuaaacaaacauucuucacggcucugacagaugucaaaaaguauaaaucacugggcugcggauuggacaaacuuaaaauggcaaccgcagaacagaacucuucacaauucucuuggucagaaucagcuagugaauaacuaucucguuaaggccuggagacuucugucuugcuuugcuuuaguacugccaccugcagcagcuaacacugauucaguacauaccagggagcaggcccuguacgagguguuuuauuuaugucaccucauuuuguccugccagcuaaacacuaccaucaacuauuaucaacacuguuuuauaaaugaggggacugcagcaaagacagauaacuugccaagaccucacaguucauaaucacagggccgggguucaagggugagaaugaaaauucuaacccaugcuggcucuauuguuucugaagccacguggccaaacgauaaaccaguaagucaacucugacuacacacuuuuuauaucaucagggagggagaaacuucccucuaucucccaauaucuaggaaagucaguacuuugguaacuacauuuucuauuuuuuuuaaaagacucccugucaagaagauguuuuuaaaaauacuggcauagaggaagugcaggauauacucacagauaugcauucuguuuuuuaaaaaaaauaggcuaaauagaaauauuaauuuuauuuuacauaucuacagauggcucuuguagaaaauccuaaaggggcccaaaccauaugaagccccccuuuaaaggagaucaauuaucucaacauauacuaaaacagccauaucccaugcucagaaccaucaagguaccuuuacauaugaaaaauuuaaaacacaauaaucuauacuacuuuacgaccaggcacaguggcucacaccuauaaugcuagcacuuugggaggccgaggcaagcagaucaccuaaggucaggaguucaagaccagccuggccaacauggugaaaccccaucucuacuaaaaaaaaaaaaauacaaaaauuagccaggcaagguggugggugccuauaaucccagcuacuacagagucugaggcaggagaaucccuugaacucaggaggcagagguugcagugagcugagauugcaccauugcacucuagcuugggcaacaagagcaaaacuccaucuccguaaaaaaaaaaaaaaaaaggccgggcacaguggcucacgccuauaaucccagcacuuugggaggccgaggcggguggauuacguggucaggagaucgagaccauccuggcuaacauggugaaaccccaucucuacuaaaaauacaaaaaauuagcugggcaugguggcgggcgccuguagucccagcuacucgggaggcugaggcaggagaauggcgugaacccaggaggcggagcuugcagugagcugagauugcaccacugcacuccagccugggugacagagcgagacuccaccucaaaaaaaaaaaaaaagaaaaaaaagaaaaagaauaaucuauacuacuuuauucauauuuucuagacuauuaagccccuugacaaauucaacuuuuuuuuuuuuugagacggagucucacucugucgcccaggcuggagugcaguggcgcaaucucagcucacugcaagcuccgccucccggguucacaccauucuccugccucagccucccgaguagcugggacuacaggcucccaccaccacgcccggcuaauuuuuuguauuuuuuuaggagagacgggguuucaccguguuagccaggaugcucucgaucuccugaccuugugauccacccgccucagacucccagagugcugggauuacaggcaugaccaccgcacccagccgacaaauucaacuauuuaaacuguauauaauacaguauaacacagcaucucaaagucaucaugucuuauaauaagcuuuuauggcagagacugccuaaguacucaggaucuaguuucaccuuccuuacuaauggaccucauuuaauugaaagagcaauauagcugaaugaaaacugcauuuccagcuucucuugcagcuaaggauggucacaguacaggguucuuucuggccaacgaaaggucagcggucaucacugaguagagcuuccagaauagagcuuugaaggacuaccucagcaggcacaagcccuuugugcccuucacucuuccucccucuuccuuccaugagacauucagacaugauuauuaggcucaggcaucuaccaggaaaacaugaggguaaagaucucaucauaggccgggugcgcuggcuuacaccuguaaucccagcacuuuagaggccgaguuggcuggauuaccugaggucagcaguucgagaccagccuggccaacauggugaaaccccaucucuacuaaaaauacaaaaauuagcugggcgugguggcacacaccuguaaucccaguuacugggaaggcuauggcaggagaauuacuugauccagggagacggagguugcagugagccuggccgacagagugaggcucugucucaaaaaaaauaaauaaaaauaaaaaagaucucaucauaaagaaagcagaagaauugggaggaguaugggucuauaaugacaucauggaaccaacacacuggccccaggcuacuuaccucaaauuuuuacaugaaagaaaacuaaaugcccaauuuguuucagccacugauucugaggucuuuauuacuggcagcagaauauugucugacugauauauuucuucgauaguaaaauccacagauccccgcuucccccacugacuaguggauuaaaauaagaaaaaaaauaacagagucuaugacacuaacgugaucuaacaaaaggaaaagugaguaccacuuaauucuugaaugguagcaaaguaugggcuguacuugagccuuuucuuaaccacuaauaccuggaaaaucccaguuuaaauaaagaauauaccuguucuucccaauuccucuauaccacucugugauuuuuccuucaguuucucccaguuguugguuuuuuccaccuugcuucauuuucucuacagcugcuauuucuuaaagcaaugucagauuuaacacacucucauaacacauggcagagggcuggugcuacugaguuucccuuuuauucuucauaaagaaaaacagccuaagguacuuccaguggccucauuuucauucuucauucuucacagaauaaaauucuggaucauacacauaggcacauuauuccuucaauggaaaaggaaaacuaacaauaauucuccuaaauauuaaacuauacuucaucauuauaggacauuuggaaaguaaacuuuaaaauaucaaauauauaaaucugcaaagaagagaaaaccauuuuaucauuuuagugacaucuuucucuuaaaaacuuguuguaacuagcauauauuuagaaucagacuccuggcauucaugacucuaacucugcaccagugaccccccaaaagcccacugacagcuggugacuuauuuugaagaaaccauacuaggaugcuggggugugggaagcagcuccacgaccucccucaucucagccagaccugcugcucucuacccuugggcaagugaaugaauuaugagggagauuguaagcaauacuggaaauccagagugggcauuccaaaaucuuggagauauaucuauacacgguuauccugguuuccucacauaccacuguguuacaaacauuuucuuaacauuuuauuguacauauuacuucauggcuuuaacaauuuguauccguauuucuccuuuguaacauguaaguuguuuuacauuuuuugcuguaauaaggaaaacacuaaaaaaaauuuugguacagaaacacugccccauauuuuugaucaucuguaaaacagauucuaggagaaguuguagaugaaugguuccuuucugacaagaauuacuugaaucuuucuacucuauuuauaaauucaccccagaaaaaaaacacaggcuuuuauaucuuacaaaauuauaauaaagaugaaaucuagauuaucuuuauauuccuuuuugugaaauggaaaacagcaggcccaaagcaggaacugggcuuccaauagauauaccuuaucaaagcccuucuguaaaccugcaggcaaggcuggguugcaggggaaaugcccuucugaccagcagaggccucaacagacaccaauccaagacaagaagagcuccagaguauacacaguguucaagcucuaaccauccuuccuggugacugucugaaagaguagagacagaauaggaaaggggggucucccagcucugccacuaaguaggagucaucuaggauaaacccuaacauucagucugagcuuccuuaucuaucaauguguugacuauuauaccagaugaucuccaaaguuuuuuccagcugaaauugucaaugacuuuauguucaccagccaaauucagcacuaaaacucucacuuuucaccucugaguuucauguucuuucuccuuuaguaauucucacugaauucucacugcugugucccuaauacuuucccacagaaaucugccccucuaggcaugccaaucauccagaacucacaaaacaggcucagcuuccucaucccucacauugcucaccaugccuaauguccauaaugcccuggauucucaguacagucuuguggacuuugccagugcccaguaaucuucaccucuuuacacuccuacuguguguaguauucaugccauccaccaggcuucugccuguauaguguguguuguuuaucccucagggaaaccauucaugacucucaagcuaaccaguaagcuccuugcacuggccaacacccaccauugcugacacgucucacaaucaucgaucacucagagugauucuccacacauauuuguugauuuaucaauuuaccagguuauuaaacauuuaaguauguuucaacugugaaguuuaacaguugagagguaaagagaagagugaaaagagaaacggccaauucuacucacauccuauccaacccaauuuuuuuuuucuugagacggaguuucgaucuuguugcccaggcuggagugcaauggcgccaucucggcucaugccaaccucuaccucccagguucaaacaauucuccugccucagccuccugaguagcugggauuacaggcaugugucaccacgcccggcuaauuuuauauuuuuuaguagagacgagguuucuccacuuuggccagguuggucucgaacucccaaccucaggugauccacccaccucagccucccaaaguacugggauuacaggcgugagccaccgcaccuggccccaccccaaauuuuuaaacuaugucugacagaagaucagacggucucuacgugaacauuccaaggucaguauuuccuuaccucaaguggcagcccaaccugcucuggggcagauguauuccuuagaaacuuauuccagagauggccgggcacgguggcucacaccuguaaucccagcacuuugggaggccgaggcaggcagaucacaaggucaggagauugagaccagccugucugacauggugaaaccccgucucuacuaaaaauacaaaaaauuagccgggcguuguggugggcuccuguagucccagcuauucgggaggcugagacaggagaauggccugaaccugggaggcggagcuugcagugagcugagaucacgccacugcacuccagccugggcgacagugcgaggcuccgucucaaaaaaaaaaagaaacuuauuccagagacagacugaauuuucccacagugaucccaccuaaccuuccuacuugcaccauucucaggggcaacaaccacaugggcuuuaacugcucuuccaacaauuccugcaccaucccagcugugcugcucuggcaacaccccucugaaaacacagcuucuagaacuaacggaaacauucuggaugcaaugugaccaauaaagcuguccaucaccuccccugucuggaugauaacuuuuggggucaugcaagcugaccugcuucacuaaagagcagccauaacaugcuagcagauaaaugagcugugauuaccuagaagccuuauuucacagaacuaaaaccugaaagucacaauccuacaagccaauagcucucucucugcgucaaaaccugucuaggaugacaucuuugccuuggaugugaaauuuaggcaguuaguguucuggcuuugaacgauuuguuauuucaaaguaaaugauauccugacaugauaaaaauaaaaaauggaaaggaacucuccuggugacucaaaccguuuaaacuguuuuaccucauuuggaaacccacagccucaaauaaauuugcuguccaagagcaccaucugcuggaugaagguauuuaagcuaccccauugagggagagggaaaaaaagucuauagguuaaaugccacuaugucuaacaccuuggugugaaaagauucccaugccucaccaacagguuucuuauaaaggagcucuugauuugacaaaauucuaauacaagagaaaucuggaacugacaaaaauucacuaucauugaauuuaguucaucuuaaauauugcuuaucauaaaguaaacauuucugagcuggaaggaacgagagagagcaguuaauucaauuucuuccccuuguagaugaagacucugagaaaaacacagagcuuuccugaaagucacagcuaggaauggcagacauugauuauaaacgaaaacaggucaaauauucugugauguuuaauaaagucuucaaucucaagaagcugcagaagaauggcagaaaauggggcagugggugucugugcaaggugccacucucucagguuagcagcgaucuggccacccacuguggacugugcccugccccacacugaccaacacaagaucaggagcugucauacucucccgccuccacccacccacauccuucauauuagauuuaucugcuuuccucuaccugugaaaaccauccugccaauaaaaacaauaaaaauaagauacauuuucuuuuuuuuuuuuuugagauggaguuucacucugucgcccaggcuggagugcaguggcgcgaucucagcucauugcaaccucuaccucccagguucaagcgauucuccugccucagcuuccccaauagcuggcacuacaggucccugccaccaugccuggcuaauuuuuuguauuuuuaguagagacaggguuucacaauguugaccaggcuggucuugaacugcugaccucaggugauccacccaccuuggccucccaaagugcugggaucacaggcauaagccaccgcgcccggccaaauaagauaaauuuucaaucaucuuguugaagaacaucuaucaucaugggaaagcauucacaaugggucaaacagaagggggauaaaacuauguucauuguaccacaaaaauuuuuuuuauaugcaauuauggagcauucauagagaaaaaauggaaggaaauauacaaaacaguuuugacagcuguuuucucugaaugccaggauuaugaaugauuuucauuuucucuauguaauaccuucccauauuuuucauauguaauguuuauauuaacaaaaagguaacuuuuaccuuaaagugguguaauuuauacuuauagauuaucaagaaaacuaaaaacaaaauggaaagaauaggacaccaaccacccauccaccuaguacgagcauagcaaaaaaaaaaaaacuuuuccccagcucaagaagaaauauauaaaacauuuauauuuuuuuguauuaagauucuccacaaggccaggcacaguagcucaugccaguaaucccguaacuuugagaggcggaggcaggaagaucacuugaagccaggaguuugagaucagccugggcaauauagugaaaucccgucucuacaaaaacuacaaaaaauuagcugggcaugguggcgcacacacguagucccagcuacucaguaggcugagguggaaggaucaccugagccugggagguggaggcugcugugagcugugauugugacacugcacugcaggcugugcaauggagugagaccuugucuuaagagagacagagaaauaaauaaaaaaaagauuugccacaauauuuuucaaacuguuuuaaauuuucuaucacuuuuccauuaauaaauaccugaagauaacaaaagcaauaggccagcaaauuaauauugaagaaaaaucuuggagguacaauuuaaaauauuuucuauauuuugagaugcagagacaugaguucacaugcuguccacuuguaaaauuuugccugguuuauaagacaaaacacaggacaugauguaccccaaagaacuccauggcuuccaguuugagaaucacugucucugaaggugauucguucuuucagaaacauaucaggaaugcaguuaccugaaggccaauaaauaaagauagaacacaguuaccuugcccuaagaucucugcaucaucuaugugcaauagauaagucaucuuuugcuauguaucuuaccgaagcaguugucaagguguuuuccgaggaccacaggaagacacgcagaccuugucagagggucugugacaucaaaacuauuuucaaaauuauaccagaacauuaauuaguauuugccuuuuucacucucaugaguauagaguuuuccagaagcuauaggacauaugacuuuauaacagauuaaauguagaagcugauauaaaaauccagcuaucuuuuuuuuuuuuuuuuuuuuuugagaccgaguuucacucugguugcccaggcuggagugcaauggcacuaucucagcucacugcaaccucugccucuuggguuugagcaauucucuugacucugccucucggguagcugggacuacaggugcaugucaccacacccggcuaauuuuuuuguauuuuuaguagagaugggguuucaccauguuggccaggcuggucucgaacucuugaccucaggugauccacccgccucggccuccccaagugcugggauuaugggugugagccaccguaccuggccacaaucuucuauugagcuagacauaagagauuugaaaaauguaaaauaaugugacucuuccuacuaauuuuuuaauuggggaaauacagucaccuuuucuuuuucugucugcuccucucuacccuauggucaccuuguauaaaauaauguauguugauauauaauggacuguuuuaaugaauuaaauauuuuuuaaauauucucuuaauuuuuuuuuuuuuuugagacggagucuugcgugagccaccacgcccggccuuaauuucuaauacaauaaaaaacaauagauauaaccuccuuaaaugaaaguuauuugagguucacaauaauuauuacaauuguaacagggccuuaagaugaaaguuugagaacuacugucuuggaguaaaagaguucagaaaaaugcacacuggggaagcucaccugaacccucuucacccuucucauccgaagcccuccccaagccucuugcuguaacuagaccaucuugcugcagucuguuaucagaucacaauauuuuucacagcuauuuuuccaaugccaugcacucaucagacccuaugcuagagacuggagcuagagaauacaugagaaaugacaccugucaccaaugaacucagagucuacugcagaagaaauagccacgaaaagaaauaccacaaaaacaaauacaaguaaccuucauccucuguuaucauuuuccaacuauuugcuacaauaauuuuuuuacccaauauucacuguccaaaucaaagacucucuaugaugguguccaccaacagaacuguuucaguuguauacaaaucuaggucagagaauauagucugcagcuaaguuguaucucagauguuuucccaaaaggauuauuucuagcgcccacauuaaguguauuggcauuacugcugucaucuucccaucaguaugagugaaaaugucuccugaaaaaguagaaaaacccgaggagaaaguaagugagcauaugagaccuacagaagccuacgaagaguuggaagugauggugcguacugaaggaaggaggcccaucagauauuaacuugacaugucccaaucucuucaacauagcagaguugcuccugaagagcuucaccaugugacucaagauuuugaaaaacuagagaaauuccuuuugcaguggacucauagccauucucaggguaggagaccaaugauuaucuggcugguacaggagaggguaggggacaccuuuggagaucuggaggcagcagcaacgaaggagcaacgugauucagugaaggagcuaaguuucaaagcaagugcaaaauggucugaaacauccaacaacagugugagauagcagaaguugaaggugacagguagggcaccauccccucacagugaaguguggcuaccuuccuccagugaccugcagaaaacuaucaucaaagaugguuacacacacaggaaauucucagucuuuaugaaaugcuaucccauagguuuauuacagaauccaaaggcuaaauugcuccauggguacucugacagugaggauaagcuacccccuuuuggugcaaaacauugguuccaaggggccacugaagacugaccugcauguuaugcuaugaggcauuuaaacuggaaagccagcacgauggagaauagagaugaggaugagaggaggagcuaugugucaccgcucagcaaagggaaaaucuugcaaagacgacuugaauacacacaauacacuggaagguccaucuaggguuauagauuaugaagguaauagcaugagcaaaacauguagaacuucauuuuauaccucuauuuaaugaagcauuaccacgagaagaaucaucauuaugcuacacaauagguauugcuagaaaugcagcccaaaauaggacagaacacaaaccugaugauccuuugucacuguacuaacauagguaaugcugaugucuauucuuagcucucacacacagaaaaaaagagauguagcuuugccuucaaaggucgaugcagguguacauggcuacuggccaucucagcaauguuauaccuucugucuuuucuacagacaucugcugacuugcagguccuuuagccaaaucuuauuuucucucagucccucuuuuaucuuuaucuuuguguguuuguuuuguuucccgaagaaacuccugugcugcgucuaacagaaggcugaguauuuuaauguaaaggcuuguuaacaaaggcuaauuaaaacuucaucggcagaccagcccuuagugaaacauaacaaaaaaaaauccagaucuuaaguuccuuauguguauguacuguuuccaaagaaucaucuaggacuuacucaggaccaaagauggcucuauuucuaagaucuuguuuuaacuacagaagguuccugaaauuaccaaacacuccaauuucuuucuugcaaugaaucaauguagucaauuauauuaaucucauccuccugagaacauuccaauuuuauuuauaucccaucuaucucaaaaaggauuuguacagucuuccccaagaacaaauaauuauccuccauauaaggggcugacaaacauuuucugcaaagaaacaguaaauauauuaggcuuugaaggccauauaaucugucacaacuaaagcaccucugccacgguagugcacaaauauauaauaugcaaaugaaaaagacugggcuccaagaaagcuuuauuacaaaaaccagcaaaaggcagaacuugacagccaaacccugcucuucaauauauacccaaaggcuggauucgccccaugccuuugagagucuugguuuuuugguuuuaaaaauaauaacuugcuuaaguuguguuacuguugccauagguuacuguccaugguguucagauuuuuuaguauaaccuaaggaaaucaagcucugaaagcagcagcagaauaaaagaggggccagccgggcacagcagcucacgccuauaaucccagcacuuugggaggccaagacaggcagaucacuugaggccaggaguuagaaaccagucuggccaacauggcgaaucacggucucugcuaaaaauacaaaaauuagacaggugugguggcaugcaccuguaaucccagcuacucgggaggcuaaggcaggagaacugcuugaacccgggggugaagguugagaccgcgccacugcacuccacccuguaugacagagcauacuccaucucaaaaaaaaaaagaaugaaagagaggcuaagaccugacaaagggcuaauauccagaaucuacaaagaacucaaacaaauuuacaaggaaaaaacaaacaaccccaucaaaaagugggcaaaggauaugaacaggcgcuucucaaaagaagacaucuaugcagccaacagacacaagaaaaaaugcucaucaucacuggucaucagaaaaaugcaaaucaaaaccacaaugagauaccaucucacaccaguuagaauggugaucauuaaaaagucaggaaacaacagaugcuggagaggauguggaaaaauaggaacgcuuuuacacuguuggugggagcguaaauuaguucaaccacuguggaagacaguguggugauuccucaaggaucuagaacuagaauuaucauuugacccagccaucucauuacuggguauauacccaaaggauuauaaaucaugcuacuauaaagacacaugcacacauauguuuacugcugcacuauucacaacagcaaagacuuggaaccaacccaaauguccaucaaugauagacuggauuaagaaaauguggcacauauacaccauggaauacuauguagccauaaaaaaggaugaguucauguccuuugcagggacauggauggagcuauaaaccaucauuaccagcaaacuaucacaaggacagaaaaccaaacaaugcauguucuuacucauaggugggaauugaacaaugagaucacuuggacacagggcagggaacaucacacacuggggccugucggggguuggggggcugggggagggauagcauuaggagaaauaucuacugugaaugaugaguugaugggugcagcaaaccaacauggcacauguauaccuauguaucaaaccugcacguugcacauguauccuagaacuugaaguauuaucaaaaaaaaaaaaaaaaaaaagagagagagagagagaucaagacacaagccaggggauuuccaggcccucucccucuucugucgaggaugacuauucugaucuaguccuuuaaaaacacccucaccccuaauuccuaugcuauaucccagcuggaugaaaacuaccauggcaccuucucugcuccuuaaaagauuugccuggggcuaagagacaaaauucagacucuggaacaaagcagguggggcugcuguggggccaugggucagauccacgacccaggaccacagcccugucucaggccccucucccauaucccacagcugcuauucgaguuuuuccucacccuccuaugcuccugcucagcaaacaaccugcaauuucagcaaaaauacugacacuguuagguguggucucacccuucaauuuaccuagcucuggucccaccuuucacucucucuccuuucacuggaacuuagucaucaaagccaaguucagaugucguccccacuccagaaagucuuacuugaaugcaggccugcucauacugccucucccgcaggcugcaaagagucaagcccacugcaccaacugucccuccaccccacaaagucuaugaacuacuugagaagcaggauucguauccaucuuugcaccuugcacaaauuacuucucuuaucuccccauacccucuccaagaacucccacccccaccaaaaaacggcuacgauuuucuuaccauucuuuuaagauuaagguaaauagcuaccacuagaaauucaaggaaaaaggaaacugcaauuugaugacucuauaauucguuucaaaauaaugccaugaaccacgagaaaccaguucuugguacaauuuaaauacugaacuaaagaauuaaacaauauaaagauaagacagucaacagcaaaacaauccaugggcuuuuuaaaugcacauucauuacaaugaauucaaacauuccugacaguaagcaauuauuacacucacucuacaucaugcccuuuaaugcacucuuuucuuuuguuauucuuugucuaccucaaggcggguaaauacaaguuauuucucauuuguugaauuuaggugucuugagugugauugguuuuguuuaccagaagcaguuuacaacacuccucucaugucuuuccuuaugcuacaaaagcaugaaaaugucaguccaacucaggagcugcuaaaugcuuccacacagccugcagaaauucuauaaaauacugccuuguagguccuaccaaaaugauacauucccagcucuaaaaccuguaaacgaugaggauguuuuaaaacugcguguuuacaaaccaguggauuuuguucauuggauuuuaauaacaaaaguuacacaaaucugaagucuaaagucaauguucccuugaagaaaugccaaugaguaaauggcuuucaaacacaagcaguaaauugauaagcacugcaaaccaaaguccaucaaccucaucuuuacagucaaugcuuaugcuauuucacuaccaaauacauacagcuaauucaggacauuuuuguaucaauuuuucugaaaauguucccaaacaugcugcuucuaacucuuaaucauauauacaaaaauaagggaacaaaaagguuaauuaucuuaaaagaaaaaaaacuuaagauugaguuuuauuuuauuuucaagcacucagacaugcaacuuucaggccaggaucuggaugacccaucagcucaaccuucuucucagaagccugaacauuugccagguuacaacgcacaggaagaaacuauggagaaaguacaaaauauacccaucagcucaggggcaauaucuaguugacaaagaccuaguuuuacauauuuccacaacuaugagacugacuaugcauaaugacuucucuaauacuggugugggggauaagagcgugucauggcccuuuuacuagccucccaacuuuggaaaagcacuugacccucucugggccccauguuuuguuaaguguaaaaggccaacaguacuuaagcugccucacccauuccaauggaaaucgcacagaagcugguuuaacaaggcaagaugccacauuccuuaaggaagccuacugguaagagcauaaagauacgggacccacacaaauguuuucaauaugcccacucccaucugcccacaucccucaccaucaauuuccuacauguccuacuugcugccacacccuucccagacaauugcucuaagcacuagaaccugcucuuggccucucucugagcccucaccuuuaucacacaugugcauaacuugccccugccuaugggcaacaucuaaugacuugcccacaacagcuaaacuuacauuuagcucauaagaaauuuauuauugcuaaagaauaaaucagcaaacaauacacuugaaacugaaacgaacaaaaauccaccauguaauacaagguacgauuugaaauugguagucuagauguggcuugugcuaaaagaaacugaaaugauccuucuggaaagcaauauuggaaauguuucaaaagucaaaaaacuguaaaaaccuucucaacucuuuggugguaaacaugaacacgcaugcaaucacaggcaugcauauauacauacacucacauaaaacagaaagaccaaaaggaaaucauaaaaaggauauuccugggcagggugcgguggcucacaccuguaaucccagcacuuuggaaggcugagguaggcagaucacaaggucaggagauugagaccaaccuggccaagauggugaaaccccgucucuacuaaaaauacaaaaauucgcugggcauggugucacgugccuguaaucccagcuacuugggaggcuguggcaggagaauagcuuaaaccaaggagucacagguugcagugagccaagauagcgccacugcacuccagccugggcuacagagugagacucugucucaaaaaaaaaaaaaaaaaaaaagguuauuccuguuugauaaccuuaugagcaauuuuuuauucucuucuucacguuuuucuguauuuuuccauuuuccuacauguacauauacuacuuuaauaaacaauacauucucaacauagagauuacuuauacuaguaaaaauucagaugcagaaugaggaaaggcuauuuuuuuaacuuuuauuuuuacuauuucaaacauauacguauuuaaaacaccagucugucaacuagcuucaauuauaaauauuuugcugggcugggcacaguggcucacaccuguaaucccaacacuuugggaagcugaagagggaggaucgcuugagcccaggaguuugagaccagcgugggcaacauaggaagacccugucuuuacaaaaaacauuuuaaaaauuagcuaggcaugguggcgccugcagguagucccagcuacauaggagguggaggcaggaagacugcuugaacccaggaggucaaggcugcagugagccgugaucaugccauugcaugccaaccugggugacagaacaagacugucucaaaaaaaaaaaaagugggggggggggcagggggaggggccaaucuucuuucaucuauauccauucaacuuuauuuucuuaaguaacugaaaaacaaaucccaacccucguguuauuucaaucauauauccuucaauaugcaucuuuaauugauaaauuaagaaaauuacauagccaucauuccauccaauaugacaauucuacaauaucauauaucuucaaaaauaagaaucgucuuugaaauaaguguucagcaauuaaaaauucauauuugaaauugugcuacuaccucauacgcaggauauauaaagaaguauaaaccaguaagaaucacuaaaaccacagaaaagggaacuuaagccaaaaaaaaaagaaaaagaaaagcaugacaaaaaagaaguguauaagagacuucacuaaaggggaaauccaaacauucagugaacauaaggggaaaaaaucauaaugcaacuuaaaaccaaaagauacgacuacacacaccaacagaguggcuaaaauuaaagaaaugacaauaucgaguguuagggaggauguggggcaaaggaaacuugaaaacauugcuauaggaaguguaagcuggaaaaaauguuuucuucuaaagcuaaccauguauauauaagguauauaagaagguauaagguaugaaguauaagaagccagacauaaaagaaugcacacugaaugauucuaguuauauaaaauucagaaacaggccacacugagcuguacuguuaaacaaaagaagaaaaugauuaccuucaagucagaagaucuaguuaccuuuggaggaaaaggggagccuauaguagguaauagggcagguaagggaauucuacggugcugguaauguuuuccucagugucagaaaugguacacagguguucacuuuacaauaauucauaaagcucuagguuuauguucuaugcacuuucuagcuuguuuuauauuucaaaauaaaaaagguuuuaaaauaauauaauaauggaauuaaggcaaggauuaugaaugaaugccauagaugccaaauccacugaaugaaaggcuguuggggacagauagucagcuaauauuugaguauaccccauagaucacuuauuaguuacaaaggggaauccuugacugaauccuuaaaggagggcggggggacaguuauaacauuacugggaaaauuugaauauggucuauacacuagauaauauuauauaaauguuaaacucucuugucauuaaaagauacaugcuuauauaauucagggugaacuaucgugaugccugcaucauacaucaaagacagaaagacagacagauagaaacagagauaaagagacacaaagaaacauuaagcaaauguggcaaaauauuaacuauagaucaaguaucccuuacccauaaugcuugggcccagagguauuucagaugucagauuuuuccccauuuuggaguauuugcauuauacuuacagguugagcaucccuuccaaaaugcuccaaaaucccaaacuuucugaguuucaacacgaugcucaaaggucaugcucaaaggaaaugcucacuggagcauuuagauuuuggauuucuggaugaaggaugcuuaaccuguacuagugaaccuaagugaaugguauccagguguguauugcacuaguuccaccuuucaguagauaagaaauuuuucgaaagaaaauaaugggccaggccuggugguucacaccucuaaucccagcacuuuaggaggccgaggcaguuagaucucuugagcucaggaguucaagaccagccagggcaauauacugagacccuguauguuuugaaauaaauauuucaagaaauaauaaauuaaaaaagaaaauaaugagagagggcauagaagguuucaaaagacaaagaacuuuuagaauuaggguuuuaaaauaucaggaaaaggcaaaaagaauuagaauauaaccaaugaauuacgccaccauuaaaauggcuagacuguaauaacauguacuuuuuaaaaauauauauauauauuacaauuugucugugaaaaaaaggacaauauaagccuguucaaauauaacauuuuuuuaaugauugagggaaaguacuggaaaaauauaucuaaaauacugcuucugcuuuaaggugucaguaugaugcaucauauuuccuguuuuccaaacauuuuuauaauguauuuuugcuuuaaaaaguuuuaauguaaugaaaagaucagccagauaaccacauaccauguuacuacugaacaauuucagguauuuguacgauuaucuagcuucaguuugaaaaauaccagcagcagaaauccuacugaugaauauuuccuguuguccuuugaggaauuauggaucacccaaaagcacaacaaaagaacacuucuaaacugcuuaaaugguaacaaaacugucacauccaaugaucuuuacaaaacucacuguaaauaugaauguaccucaucauauaugcucccauuaauaucugcaccauagauaggugccacaaaaguuaaguucuuccaguacuugcgcuccaaaucuucguaauccaaguaucuuggaguacaauaucuguaaaagguagaugacaaaaauguacaaaccaguaagucaguuuuaggguuuuucccaccaaauugauuuaaaucacuuucuaaaacaaaauccuaccaaaacgaaaauacugcauguugucaauucuaacaaguaaacauacaaacugauuuacauagcuaucugaauagucuuaagauugcugaauacucaauauuacuuuacauuuuauuagaaaacuacuuucacgaaaacaacaauagaagcagaaaagcaguuuaaaagucauuauuucagcuuuaaaguauuuuuaaaaucuuuaaucaacuauacuaugcuaagaaauuuuacauauuuauauaaaaaugacauaacacuuagagaaacacugacaaacaauaaucucacuaaaaauccaagaaaguaaaguuaaaauaagauauuuugcaguuauuauauugguaaaugcugaauauauuaauggcaagaaaauaaugacaccucuuagacaacuagagugggaauauaagcuggcaaaaccauuccagcauauaauuuuucuaaacauauaaaaagcuuuuuaaaaauugacauaucugacccaaaaucuaaaaguagaaauucacccuaacaacagagagauguguacaauaacaguugacccaggauguuugcugcagcauuaauugaaaauacaaguuuauauccaucaacuaguaauuagcuaaaaaaaauacagaauauaaaacaagauagcucuuucaagauacugacaucaaauucuauccacagugaauaaaucagguuacauaauaguguguauacuauauccuauuuacaguuuaaaaaaccuguaauuguauauuaagucauuagaaagaaauguacaccaaauuauuaaugguuaucucucacauagaaauuacagaaaagcacuuacuucucuguauuauuaggaauuugaacaauaaucucaccacauaaaaggaauaccaauguuucuucaggaagaaaauaagcaaagaaagaaacaaaugagaauauaaugaagcaaaguuaaaaagguauuuagcaguaguagaaucccuauaaagcauacuggacauuuuagauugacuacagaauaaccgacaucuacacucacuauacuggggaccccaaacuaguuaucuguguaacaagaauaccaaauaauggaacaacuguauucaaaauaccaaacaacuuaauuuaacaacuguauuuaaaacauagaacaauuugaauuuacccagaacacuagaauauaaagcacagucaaaaauaaaaaggaugggcaugggaugggcaugguggcuauaaucccagcauuuugggagcccaaagcaggaagaucauuugagcucaggaguucaaggucugccuagguagugagacccucuauuuucuaaagaauuaaaaauuuuuuuuuuaauguuuuucuucuguuuuguuuugagacggucucacucuuguugcccaggcuggaguacagcggcacgaucucggcucacugaaaccuccgccucccagguucaagggauucuccugccucagccuccccaguagcugggauuacaagcaugcaccaccaugccuggcuaauuuuguauuuuuaguagagacgggguuucuccauguuggucaggcuggucucgaacucccgaccucaggugauccgccugcaucggccucccaacuccugggauuuacaggcgagagccaccgcacccagccuuaaaaauguuuuuaauaaaaaggauuagcaugaaagcacuauuaaucugucaucauuccaccacuucugcuaguagguuccaguaguaucgggaauuccaggcacaagcuaagcaagcuaacuaaagaucagagucaggugacagagacagguguacaucccuauuucccggagaauggguccccaauccccaguagggguccgcggccuguuaggaacagggaugcauaggaggucaguggcaggugagcauuacugccugaguuccaccuccugucagaucaguggcauuagauucucauaggaguaugaacccuguugugaacugugcaugugaggggucuagguugcacacuccuuaugagaaccuaaugucugaugaucugagguaggaccguuucaucccgaaaccaucccaccacucccauccauagaaaaauuaucuuccacaaaaccagucccuugccaaaaagguuggggaccacugccccaaaacacagaaugaucagaaaggagaagauagcagagaugcuguuuauuaggacuucuacagaaaccuccaagauuguuggaaacugaagcccuaaucugcuuuacaccuauaccaagaccaaucuaucacuauguacucaaucaguaacaacuuuuuuuuuuuuuuuugagagucuuguucugucacccaggcuggagugcgguggcaugaucucggcucaaugcaaccuccgccuccuggguucaagggauucuccugccucagccucccgaguagcuggaauuacaggcaugugcaguaucaauuuuuuaaaacucauaacucuaagagagaaagauaaaguuugguauuguccauugaaguuaaauucuaaaauccuuaaauauauuaaacaaauauuaauucuaaacaaaauaaaugacuuggcuaguaacugaucagaguccuuccuaauggacuguccuuccuaauggacaaucacagcuauuccacaaauccaguguaaauuugcccgauacugauucaaccauaucuucuuacccagaaccucucacucauugcaguacaguucuuaagaggugagcuccagggccaggcuacacauguuuaaacucaggcuuccauucauaagccacaaaacccuagacacggggcugaauuucucuggaacucaguuauucuucuaaaaaauagggauaaaaacaggaagcuuguugugagggcuccaucagauaauuauggaaagcacuuggcucugugccuagaggaaaguacacaucaguaaugugauucauauuaccuaccauuauaaauuuuuauauuagaguuauaucggaaaucucuagguuuucuuuggacuacauugcauuaucaaccaaaugagcaugucaucgucucuacugcuaagacugaguacauuacagacggugcaccaaugccaggucaggugcuaaagaaaaacagaugaauggaaagaucccagcacuuugggaagccgaggugggcggaucagaggucaggaguuagagaccagccuggccaacauguugaaaccccaucuccauuaaaauacaaaaaacuuagccaggcaugguggcacgcaccuguggucccagcugcucgggaggcugaggcaggagaaucacuugaacccagcaggcggagguugcagugagccgagaucacgccacugcacuccauccugggcaacagagcgagacucugucucagaaaaaaaaagacagcccagcagaaaaccucuugucuccaacaaaaauuaaucuccuaacaugaccauuccacaaccaggugauccuggcacagcucuguguugacaaguaagagcauugguucuugaggcuuagaaauccauuuccuuggcauuugaaauaaauuucuacaugaaacuggcagaagaaauacaaaaaauaugaauuucaaaaguuguuuaacauuacaacaauuauaaugaaacuaguccaaaucaaaagaccaauuaacuuuauuuauuuauuuauuuauuuuuuuggagacagggucuugcucuugucacccaggcucgggggcaauggugcaaucacaacucacugaagccucagccucccaggcucaaguaauccuccugccucagccucccgaguagcugggacuacagacacaugccaccaugcauggcuaauuuuuuauuuuuuguagagacagggucucacuuuguugaccaggcuggucuugaaacuccuggcucaagcaauucuccaaccucagccucccaaaguguugggacuacaagcgugaaccacuguacccagcguaaauuaacuucaaaagaaauaaaauuaaagcuagaaauaauuuuucaaauaauuucccauaaugguuacauuuuacaacuuaaaaaaaaccaaaaauuuuuuaaaccaucucuaaaccccagaaugucaagaaauguauauucuguuaauaaguaaaucuuuacaauuugccuaaaaauuuauaccauuuuaaguggauuuuaguuuuuauaacacuauuuauucauuugaaaaagcaccuaccauaucccagauacuauaccaagcacuguguacacagugauacacaaaacaaugucaccugaauggcuaucuucagaaagaguaaaucuacaaccaagucaguagaguaauaauuuaacagagauauguauaaaauguguacucaguaaaauuaucuugaaguagaaaaccgauaccaugcugaaauaaucaaaugggcuagagaggaugaucaaaguuucuuuauaacaagagaagaaagaacuucaaggcucaagucuuaauaauauuuugaauugccaaguaauacuaacaaugauugccucuuagaguuaaaguuauauauggcuauauuugaaauuuuauuuauuuuuuucaagacagggucucgcucugucacccaggcuggaguacaacggugcaaucacgacucacgguagcaucaaccucccaggcacaagcaauccucagccuccugaguaccugagacuacaggcacauaccaccugccuggcuaauuuuuguauuuauuguagagacuggauuuugccauguuauccagcuggucucgaacuccuggguucaagcauuccaccuaccucggcuucccaaagugcugggauuacaagugugagccaccacaaccagccuauuuuugaaauuuuaaauaagcacauauuacuuuuguaacugguagaaauguuucugaccauccuucaaaauccaucucaauagugccuacaaaaugaaauuacccauuccuuaugaacaaccacagaagccuuguauuccuuugaaaccucauagcacuuuguaccuuuccuauggcaguuaugacaauuaucaagaguauuaacaauaguuuuuaguaaguaucccuugaaauaucaaaggagccaagcagaguuacuacucaaugaccuaaccuauucaauuaacacuuuaagagagacacuggaaauggguacuaaaacacaguaacagaaaacagucaauaguuuauacuuguaaacagguuuaauugccucugcaaucuuguuucaacagcauugcacuuauaaaagaauucuggaagagucugaaagaaaaugcuuccaaucuuuguugaaaguuucauguucucgauuaauaagaucugaaagaauaaaacucuauuaauaccaacccaaaaaauucaaaagaaaugauucaaauuauaucaaauauaaaauuuucaauuucuuuggaauagccagaauguuccacaguaggaauuuaacaugcagaaauaagagucuucaaguagcaucaugugcuuacaaugucaaauauaauuuuuuuaaaggaagauaccuaaauucauucaaagucuuaaucucauucacacccauccagggaauuuggaaacuaugauuuuuuguuggucuuucagguuuuuuuauuuuguuuuuguaagauuuaugcuuucaucuggggccuuaauuaucauaucagaauuuuuuaaaagaaguuuaauaauaauaauugugacaacauuuaaauaugcccacaaauucauugacacuccucccuucaagaaguagagcuucauucuccuccccuugaguguaggcuagcuacacuuaacaacuggcuuguaacaaacagaauauggcagauguaacagugugccacuucuuuuuuuuuuuuuuuuuuuuauugauaauucuuggguguuucucacagagggggauuuggcagggucaugggacaauaguggagggaaggucagcagauaaacaagugaacaaaggucucugguuuuccuaggcagaggacccugaggccuuccgcaguguuugugucccugauuacuugagauuagggauugguaaugacucuuaacgagcaugcugccuucaagcaucuguuuaacaaagcacaucuugcaccgcccuuaauccauuuaacccugaguggacacagcacauguuucagagagcaccggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggagcuccucacuucccaguaggggcggccgggcagaggcgccccucaccucccggacggggcggcuggccgggcagaggggcuccucacuucccagcaggggcggccgggcagaggcgccccucaccucccggacggggcggcuggccgggcaggggggcugaccccccccaccucccucccggacggggcggcuggccgggcggggggcugacccccccaccucccucccggaggggguggcuggccgggcugggggcugacacccccaccucccucccggacggggcggcuggccagguuggggggcugacccccaaccucccucccggauggggcggcuggccgggcggggggcugaccccccccccaccucccucccagacgggguggcugccgggcggagacgcuccucacuucccagaugggguggcugccgggcggagaggcuccucacuucucagacggggcagcugccgggcggaugggcuccucacuucucagacggggugguugccaggcagaggguauccucacuucucagacggggcggcugggcagaaacgcuccucaccucccagacggggucucggccgggcagaggcgcuccucacaucccagauggggcggcggggcagaggcgcuccccacaucucagacgaugggcggccgggcagagacgcuccucacuuccuagaugugauggcggcugggaagaggcgcuccucacuuccuagaugggauggcggccgggcggagacgcuccucacuuuccagacugggcagccaggcagaggggcuccucacaucccagacgaugggcggccaggcagagacacuccucacuucccagacggguuggcggcugggcagaggcugcaaucucggcacuuugggaggccaaggcaggcggcugggagguuauagugagccgagaucacgccacugcacuccagccugggcaccauugagcacugagugaacgagacuccgucugcaaucccggcaccucgggaggccgaggcuggcggaucacucgcgguuaggggcuggagaccggcccggccaacacagcgaaaccccgucuccaccaaaaccagucaggcguggcggcgcgugccugcaaucgcaggcauucggcagacugaggcaggagaaucaggcagggagguugcagugagcggagauggcagcaguacaguccagcuuccgcuccgcaugagagggagaccguggggagacggagagggagagggagagggagagggagagggagagggagacggagacggagagggagagcaacagugugucacuucugaaacagggcaaggaaagacauguggcuuccuucuugcgaucucucucggaucacuugcucugggagaagccagcugccaugacaugaagagcaguccauaugacaaggaacugaggaccccaucaaaagccaugaaaggggagcacucuuguaagagaaucuuccagccacaauuaaaugcucagaugacuguagcccagccaacaugcuaacugcaaccucaugagacccugaggcagaaucugaaggucagauuccugaccuucagaaauuauggguugguuuaagcagcuaagauuugggauuauuuauuuauuuauuuauuuauuuauuuauuuauuuuuucgagacggaguuucacucuuguugcccaggcuggagugcaauggcgugaucucggcucacugcaaccucugucucccagguucaagcaauucuccugccucagccuccugaguagcugggauuacaggcacgugccaccacgcaugguuaauuuuguaguuuuaguggagacaagguuucuccauguugaucagacuggucuugaacucccgaccucaggugauccgcccacguuggccucccaaaguacugggauuacaggcaugagccaccaugccuggccaauuugggauaauuuguuacacagcaauaaauaacuaaugcaaugguggccuuucaagucauucaagguuugcuuuuaaaaguacuaaucuucuaauacauauaaaucauuuaaggcuuaaacauuaucaaacacacaccaaaaaaacugcccaacaaacaugaaucauguguagaaacgaaaacucauggcaacuauaggauaagaaguuccacuuauaacugcuaggaacgagauaauaaaauaaagagcaauuucuuuaagucaaauguucagcaaccaccuaaagaacagaaaacagaaacaguucaaugaagggugaaaaauugcaugggagacuccugcuuuucauuuauaagcuccucugucuacuuuguuucuuaacauauuuacauaaaucuuugaaggaaacagaaauagcaaacugauucuacucacuugccacuguuggccagcugccugaacuccuucacagucaucgcuuuuuucuggauguuguacugagugaacaguccugacugcccugugaccaucugcugaauuggugcuggaaugagcaaauuaucaaugucaucauagcacugucuuggcuuccacuccuuaggaggaaucaccuaaaaauaaaauaaugaaauaaaauaucaucuugaaaauacuccaaguaauuuagcuuuuaaguauucugauaaacuacaacugaagaauuucucaguaucucuaugacaaauguguaaaaaaaaaaaaaaaagaugaauauuugcaauaaagcaauaugauguuauucaauagcaaaauuuauugaguacucacuaucccaaacacuguacuuguauuaaacucauuuugaguagguacuauuaacaucuugauuuuaaagauaaaauugaaagacacacagaaguaaaauaauuugaaguuaaaauggcuaaagacuacuugagcugaaauucuaauuaaaacaguuugaauucacacugagcgauuauguuaaccugccucucaauagaugaaauuggcagggcgcaguggcacacaccuguaauuccagcacuuugggaggccgaggcaggcggaucaccacgucaggaguucaacaccaaccuggauaacauggugaaaccccgccucuacuaaaaauacaaaaauuagccgggcgugguggcacgcaccuguagucccagcuacccgggaggcugaggcaggagaaucgcuugaacccaagaggcagggguugcagugagcugagaucgcgccacugcacuccagccugggugacagagugagacucugucucaggaaaaacaaaaaaagacgaaauuauguuuacauaaauaauuucuuccccaaagaaguucaucuuuauugaauaugaucuaaguaccuaugugcuguuuauauuauuaugagaaaaauaaguaaauacauagucaacauuauauucuuuuuuuuuuuuuugagacggagucucacucuguuacucggcuggggagcaguggcacgaucucagcucacugcaaccuccgcuucccuggguucaagcgauucucccaccucaggcucccaaguagccaggauuacaggcgccugccaccacgcccagcuaauuuuuguauuuuuaguagagacaggguuucaccaucuuggccaggauggucuugaacuccugaccucaugauccacccgucucggccucccaaauuguugggauuacaggcgugagccaccacgcccggccaacauuauauucuuuauagacuucucacacaauauggcgauagcacagcgguaugcuaguagaucuuuaauaaccagcuuuccagaaagguggaggaaaccuugauuuguagcuuuuaccuguguccauggcauaguacucccaccauggccaaucugaaccuaccaacgugacaucacuacauaagcagcugggaagagaugugcacuaucaacucucaaaugccaguauaaggugccucagcacaccaguguuugccugcaguauuuaaguacuuaauuacuaagagugaaaagauacagaaaacauuaagaccaaaaauacauauugauaggauuuaaaaguagaagguaacagccagccguaguggcucacaccuguaaccuuagcacuuugggaggccaagauggguaaaucacuugaggccaggaguucuagaccagccuagccaguaugguaaaaccugaucuccacuaaaaauacaaaaauuauccgggcguggugacaggcaccuguaaucccagguacucgagaggcugaggcaggagaaucacuuugaacccaggagguggaggcugcagugagccaagaucacaccacugcacuccagucugggugacaguccaucucauaaacaaauaaauuaaauuaaauuaaaauagaacguacaacgucaugaagcaauucaugaucuauugcuggaacuuuucuuuuuuuuuuuuuuuucuuuuuguuacagaugggguuucgccauguugcccaggcuggucucaaauuccugagcucaacugaucugccuuggccucccaaagugcuggaauuacaggcaauagucacugcaccuggccacuuuaccaccuuuagaaguuuuuuuaauuuuuuuaaaacaaacuuuuuuuuuuuuuuugagaccgaguuuugcucuuguugcccaggcuggacuccaauggcccaaucucggcucaccgcaaccuccaccucccggggucaagcgauucuccugccucagccucccaaguagcugggacuacaggugcgcaccaccaugcccggcuaauuuuugcauuuuuaauaggacgaguuuucaccauguuggccaggauggucucgaucucuugacagcgugauccgaccaccucugccucccaaaguguugggauuacaagcaugagccaccgugccuggccuaaaacaaucuuuuuaagguuuuuuauugaaaaacagcacacauguagaaaaugcauaaucacaagcacacagcucugugaauuauuacaaagcaaacaccaaaugaccuacugcccagguguaagaggcaagauauugcuggcacgauacaggcccuccaagcgcccuuuuccagccucaucuucccuauugcccaagagguaaccacaauuacgguguuuauggcaaugacuucauugcugggcuuuaguuuuaugcuucuauaugcauaccuauacaccaguuuugcaaauguauaaaaauguaacccuacaguauauacuacuugagguuuaucuuuuauacuucacucauauuuugugagauuuaaauauaacggccuaggccagacacggugacucacuccuguaaucccagcacuuugggaggccaagguggacagaccaccugaggucagaaguuuaagaucagcuuggccaacauggugaaaccccaucucuacuaaaaauacaaaaauuagccaaacgugguggucaaugccuguaguccaagcuccuccggaggcugaggcaggugaauuguugcagugagcugagaucacaccacugcacuacagccugagugacagagugagacucugucucaaaauaaauaaauaaauaaauaagcaaauguaacagccuauguagcugaaguucuuugauuuucauuccuacucaguauuuugucuuauaaauauuuauguauuuauaaacugauaaccauugaugggcauguggcuuuuucuaauuauuggcuauugcaaauaaugcuauuaauauuuuuguacagauauucuagugcauauaugcacaugggucucuaaaacauccaugcauacacagacacuucuaagagucaaauuacugacacauaggauacguguaguucaaauuucauagauauugccaacuguugcaaagugguuguaccaauuugcacucccaacugcaauauacgagaguucccauuccuccacaccuucaucaucaccuaauacuguccaucauuuaacucuuagucuuucuguuaaguguacaaugguacucaagugugaauuuuauuuguauuuuccgaauaaaugaagaaagaaaccuuuucauccauauguuuacugaccuuacugauacuuuuuuuuuuuuuuugagacaaaguuucucuuuuguuccccaggcuggagugcaauggcgcgaugucagcucacuggaaccuccaccuccuggguucaagcaauucuccuaucucagccucccuaguggcugggauuacaggugccugccaccaugcccagauaauuuuuuguauuuuuguagagacaggguuucacuauguuggccaggcuggucucgaacuccugaccucaggugauccacccgccucagccucccaaagugcugggauuacaggcaugagccaccgcgcccagcucacugauacucucuuuuauaaaguacuuauucaagucucuuuaucauuuuacuauugcauuguuggguuuuuccuuauuaauguauagaagucuuuuauauauucuuuuauauauccaaggagaauacucuucgauguguauguguauauggaggcauauacagagagagagagagagagacagagagagagagagagagagagcauaucugcacaagagcauguaaauauauucucuuauccuguaacuugcccuccaaucuuuuuuuuuuaagagacaaggucaggcugggcacgguagcucacgccuguaaucccagcacuuugggaggccaaggcggguggaucacgaugucaggagauccagacuauccuggcuaacacagugaaaccccgucuccacuaaaaaaaaauacagaaaauuagccgggcaugguggcaggcaccuguagucccagcuacucuggaggcugaggcaggaggcagagcuugcagugagccaagaucacgccacugcacuccagccuggggacagagcgagacuccaucucaaaaaaaaaaaaaaaaaaaaaaaaaaaaaaaauuucccuacucaaggacauaaaaauggucuacuuuauauucuaagaguguuaaagucuugucuuucacauuuaggucuacauguaccuauaacucugaaacucaagucaagcgucaucagauaaagaaacuuggggucaggagaugaguaacuuggccagugcuauacagcuuauaagugagaguuguuagcucaaaaaaaauaaaaccaccucacagugagcugucaauuuuaccuuaauuuucauuagcaauauaaggauacuacauauuuuauauccuccaacguauguuuguuuaaaaugagaauacuguccaggaacgguggcucacgccuguaaucccaacacuucaggaggccgaggcuggaggauaacuagagcucaggaauucgagacaagccuaggcaacauggcgaaagcucagcucuacaaaaaaauacaaaaauuagccaggugugguggcacacgccuauaguccuagcuacucgggaggcugagguggggcgacugcuugagcccgggaggacaaggcugcagugagccaagaucacaccacugcgcuccagccugggugacagagcaagacccugucucaaaagaacuaaauaaaaauaaauuaaaaaauaaaauaaaauagauagauauacauucauaguauauguuacugaaaucacacccucauuauuuuauuuaacuuuuuuuuugagacagggacucuguugcccaggcuugaauauaguggcaugaucgcagcucacagcagccuggaccucucaggcucaagaaauccucccaccucagccucccaagcagcuaggacuacaggcacaugcuccuacgcucaguuaauuuuuuguuuguuuguuugcuuuuugagauggagucucacuguugcccaggcuagagugcaguggagcaaucucggcucacugcaaccucagccucucagguucaagugauucucgugucccagccucccaaggagcugggauuacagaugugcaccaccacacccgacuaauuuuuguauuuuuaguagagacagcauuucaccauuuguccagguuggucucaaacuccuggccucaagugauccacccaccucagccuuccaaagugcugggauuacaggcgugagucacugugccuggccuuuuuuauuuauuuauuuuuuuuuuggaaaagauguggucucgcuauguugccagggcuggucucgaacucaugggcucaagcaauccucccaccuuggccucccaaagugcugggacuacaggcgugagccaccaugcccagccacacucaauauuugaaaagaauaugaacaaucagacuauaugaauaugaauaaccuuacuacauucauaugaauaugaauaaccuuacuauuuugaugacauauugaaaggggaggggcacuauauuuaagaauguuauaaaaacuaacuuuuuuccucggaaauaagccagaauaauaaaaaaauggaacacagauuuauucaggcucuucauuagcaauaaagauauccacaaucaaaauuaauauuauguguagaauuaaauguuuuucuguuuuguaaaaaaaaaaaaaaaaaagaaaagaaaaaagagcccucucccgucucccgucucccgucuccccuuuccacggucucccucucaucccucuccugucuccccuuuccacggucucccucucaugccaagccgaaguuggacugugcugcugccaucuuggcucacugcaaccucccugccugauucuccugccucagccugcagagugccugcgauugcagacgcgcgccgccacuccugacugguuuucguauuuuuuugguggagacgggguuucgcuguguuggccgggcuggucuccagcuccuaaccgcgagugauccgccagccucggccucccaagaugccgggauugcagacagagucuccuuaacucagugcucaauggugcccaggcuggagugcaguggcgugaucucgcgucgcuacaaccuccaccucccagccgccugccuuggccucccaaagugccgagauugcagccucugcccggccgccaccccgucugggaagugaggagugucucugccuggccgcccaucgucugggacgugaggagccccucugccuggaugcccagucuggaaagugaggagcgucucugcccggccgccaucccaccuaggaagugaggagcgccucuucccggccgccaucccaucuaggaagugaggagcgucucugcccggccacccaucgucugggaugugaggagcgccucgacccgaccgcgaccccgucugggaggugaggaacgucucugcccggccgccccgucugagaagugaggagacccuccgcccggcagccgccccgucugagaagugaggggcgccucugcccggccgccccuacggggaagugaggagccccucugcccggccaccaccccgucugggagguguacccaacagcucauugagaacgggccaugaugacaauggcgguuuuguggaauagaaaagggggaaagguggggaaaagacugagaaaucggaugguugcugugucuguguggaaagaaguagacaugggagacuuuucauuuuguucuauacuaagaaaaauucuucugccuugggauccuguugaucuaugaccuuacccccaacccugugcucucugaaacaugugcuguguccacucaggguuaaauggauuaagggcggugcaagaugugcuuuguuaaacagaugcuugaaggcagcaugcucguuaagagucaucaccacuccauaaucucaaguacccagggacacaaacacucugccuaggaaaaccagagaccuuuguucacuuguuuaucugcugaccuucccuccuucccuccacuauuguccuaugacccugccaaaucccccucugcgagaaacauccaagaaugaucaauaaaaaaaaaaaaaagaaagaaagaaaaaaggaaguugcuugccuauaaaauauuuugcagcaauuuucuaaagacagagaagcaaggcacacaauaaacuuacaaaaauccaaauauuaccuugugcuuuuuguguacaaguucauuuaaauuaaagaguucaaauggaauauauuuucagaaguucagcucuauaacaaaaaucuuauuuuaacuauaauuugaaauccuaagacaucagauuuucuugcauagggaaacacaacauacugagaucuuuaaaagauuccaaaguuaaaucuuuauguuuagugaaucuaaaugagggaaagccauuccuucugaaguucaccuuccugauuauaucaaaacagaauauaccuucuuuuaucaacaaccccacaaacccagccuggccccuauucccugugggaaacuuucugcuaaaaugugcauuugcacuacuugccuugaaauaaauugcaauuucuaccaucuaccuagugagcaaggaggaggaagagaaagaguggugcuucuuauaaucuuucuucaccuugugagcaaagauagcuauuugcacucucuaggcuguucauaaaacuacaugaugugcauaagcuacaguccaggacaaucuauguucagauuucuguuggggaccaauuucacccacuucauauauaaaaaaaguucaucauaaucuccuuccacaaaaacaguacaaguuuuacaugugaagagacugccacucuuuucacuuucgcaaccugaccaucaacuuuguagacagucaaagugucaaaccuuccacucaaaaaauaaauguuaaauuuaaagcaugaaucuaaaaaaugggaaagagaaaaaccaagacagacugucaucugaagcuaaagucacuacuguugcaccuacucgaccaauuucuucaaaucauaaauuaagaccaauucauuaaaucuugucaauaguggauuaacgggccaggcacaguggcucaugccuguaaucccagcacuuugggaggccaaggugggagaagcacuugagcucaggaguucaagaccacucuggguaacacagcagaccccaucucuacaaaaaacaaaaaauaaaaaaaauuacccaggcguggguagucccagcuacuugggaggcugagucccagcuacuugggaggcuacuugcuugagccugggaggucaaggcugcagugagccacgaucacaccacccagccuaacagggcaagacccugucucaaaaaaaaaaaaaaauagugcauuaacaaagaacaucauggguggcucgguuccccaggacuagcccccaaagcaaaccagcuucauuaaugcagucuugauuuuuauaauaugauuugauucgguacaguuuuauacauaugcuacuacugcaacuuccagaacaagagggaaaguaaguaaaacugagcuuaugugacuugacgucaaagauggcaaaaaugauuugaaacaguucguuguauuccuaauaaugaguaauaggaaauuaucacaggauugaguaaauuaaugucuccaacuuugucaaugagucucaauuuuaaaaaugaggcacggucuggacucagguguguuuuguaaucauaguucucauuaacuuuauucaguuacauaaugcagacagcgacgcaggugugcucugugugcaugcagcucccuugugaggguagcugcuguuuccucuucuaaaguuacugaacgugccacccuaccucacaagacacuccacuaauuucaguggaacacaguacauguuuuccggaaacaaaagugggagagaacaggacaaagggcugcauucagagcccagagaagagaagagaugguuauccccaaccucugcccuccaccucccggguucaagugauuauccuggcucagccucccgauuagcugggacuacaggcgcccaccuccaagcccggcuaaaauuuguauuuuugguagagaugggguuucaccauguuggccaggcuggucucgaacuccugaccucaagugauccacccaccucggccucccagagugcugggauugcaggcgugagccccacacccagcccaaaugagauuuuuuuuugaugagcuaacccaauaaagaaguuaaacuaaggauagcucaucugagaaagucauuacgaagcuuuaguuucuguuuguuuucucuuuaucuuguuuccucucucucucacccaccccuaauuaauuuucacucaacuuaauauucccaaauuuuaaaacuuuucuaggaaggggccaggggcaguggcugaugcuuauaauuccagcaauuugggaggccaaagcgggcagaccacuugaguccugguguucgagaccagccuaggcaacauggugaaaccuuggcucuacaaaaaauacaaaacuuagccaggcauggugcugcauaccuguaaucccagcuaauugcggggcugagggagggggaucgcuugaaccuggaagguccagacugcagugagccaauaucaugccacugcacuccagcuugggugacaaaaugagacacugucucaaaaaaaaagaaaaaaaaaaaauuuucuaggaagggcaugaacuuuaacaagauacauguccgggcacgguggcucaugccuauaaucccagcauuuugggaggccaaggaaggcaggucauuugaggucaggaguuugagaccagccuagccaacauggugaaacccugucucuacuaaaaacacaaaaauuauccaggcauggugguacaugccuguaaucccagcuauucaggaggcugaggcaggagaauagcuugaaaccaggaggcagagguugcagugagcugagaucgugccucugcacuccugccugggcaacagagcgagacucccgucucaaaaagaaacaacaacaaaaaauauauauauauacaaccuaauuacaggccucaggguacagauaccagaaacaguaaaguaguggguuacaaguagcaucagguccauuugcaggaggaguugaacaccaaucccaauaguucuggaagcucucuccucaacuaucuucuguuuuccaugcuaucugaccuccauagcuggggauuucaaggagaacccuuuacauaagugcaacugagugguucggccuggcagcagacucugucaggacucagggauuuaugcagugauauugacaagucuacagaaacccagauuauaaauuuaacauuuagaacaauaauaaauugaaacaagugcaaugaaauauauucuuccaugggaaauuuuuuaauuaaaauagacuuacauuauagaagggacacacaaaccaucucaaguuggacgaugaauuauaucauauaguggaucucucuuucaaagaucuuacuuuggaccuaugcauccaaaugugcaaugaguucucagcaccucacugaccaccccuaugacucggggcaugucacuuacacccacaaggcuuaagucacuaccauuuuuuuuuaagaauauuaucuggcacccguaagaauaagauaagaugauauuuucaaacauauccagaccaaagacaacuucucccaucuucacuggucugggucaccauuggcucuucacuagauaaauauaacuaucccagacaaggugcuuuauuugugcucugcccccacaacaccaauucauucuucauguaggagccagugugaucuuuucaaaauaaugucccaaaaauagcaaaagaaagaaacaaacagccaccauaucuuccucucccacuuuaagccugucagugcuucccucuacacuuaaaaucccaaaugccuuaccauagccagacaaguccacugaccaccuuccuauuccucccagccacaaaguacaggucagccuccaggccgcuggacuugcuauucuuucuguccccauaucuugaaaagacugguuuauuuuuauccuuuggaucugugcuuaaauguccuuauuucaucauucuaagaugcuacaacuagaauguaagcuccaugggggcaggaacaucgucuguucugcucccccauaucccuaccucuagcaccuggcauagugucuggcacauagcaggcaaucuccacauuuguugaacaaauaaccagaaagaaaagagaauaggcaaauguagagagagaauaagucaguuugugguugccuaugggcugggggugauagcagggaauggagaaugacugcuuaaugcauaugaaguuucuuugggggaugaugaaaauguuacagaauucuauagcgguaaugauugcacaauucugugaauauacucaaaaucacugaauugcacacuuuaaauggaugcauuauacaauauuauuauaugauaaaauauaucaauaaguguuauauaaaaaaaaagaggccgggcacaguggcucacgccuuuaauccccgcacuuugggaagccgaggcggauggaucaccugaggucaggaguucaagaccagccuggccaacauggugaaaccccgucucaacuaaaaauacaaaaaaauuagcggggcaugguggugggugccuguaaucccagcuacuucgggaggcugaggcaggagaaucacuggaacccgggagguggagauugcagugagccgagaucacgccauugcacuccagccugggcggcaagagcaaaacucugucucaaaaaaaaaaaaaagaaagaaagaaaagaaaaaacauagaaggaaagaaaaaggauaggagagagaaauugugguuaaccuucagguuaauaauuguugucuacaaaaaaacugacaaaaacuaugaauacucucacaccucugaaacccauacauggaucuccuugguuuccaucagccacccuugguugguuuugauuuuuuuuuuuuaagccuuagaagacaaccuaguaugaauaguuauacuugaaggaaaaauaagacaauuacuauuugaagaaaucaaauguuucacauggauuaacgagaacaaagauuuugcaaauuucuuccuucagaaacaaugucccaaaucgugaaaacuaagaacauaaauuaaaggccaagugauuguuuuucauuuaaagcaucgaaggauaaucaccuuugcaagacccgcacgaugggcuccuuuagacuccauguaugcaagguauuuguugaacucccggaacuccuccauggagggucugaaggucauuaucuuacagcugggguucagaggacuuuccaccucggccaccuccaugaugguuagggcagugucuggagagaagacaguagggucaacagaacugaauuauuauaugcuuuaggucauuuuuaacaaauaguaugucagcucccccagcaggaacccuucucuuucagucacuucccauucccuucuaccagucucagggagacucccucaucucugccugaaccccugaacaaacaagggccucuagucauuccucuugccaaguucccuaugccagguagagaaccacugaucugacuauacuguuagccuccucaaaacccuuccaaguaaaaauaaauuuucuaggccgggugcgguggcucacgccuguaaucucagcacuuuggggggccaagacgggcagaucacaaggucaggaguucgagaccagacuagccaacauggugaaaccccaccucuacuaaaaauacaaaacuuagccggguguggugguacaugccuguaaucccaguuacucaggaggcugaggcagcaaaauugcuugaaccugggaggcugaaguugcagugagccaagaucucgccacugcacuccagccugggugacagggugagacucuggucugagcgacagaguaagacuccgucucaaaaaauaaauaaauaaaaaauaaauaaaaauuuuuuuuuugagacagucucgcuauauugccuaggcaggagugcagcggcgcaaucucggcucacugcaaccuccaccucccagguucaagcgauuuuccugccucagccuccccaguagcugggauuacaggcacccgccaccaugccgggcuaccuuuuuuguauuuuuaguagagauggaguuucaccauguuagccaggcugaucuagaacuccugaccucagccaauccgccagccucugccucccaaagugcugggauuuacagaugugagcuaccgagcccagacguaaaaauaaauuuuccuuuucucuuuuucuuuuugagacggaguuuuacuccuguugcccaggcuggagugaaauggcgcaaucucggcacaccacagccucgaccucccggguuccagugauucuccugccucagccuuccggguagcucggauuacaggcauggucuaccacacccagguaauuuuguauuuuuaguaaaaaugggguuucuccauguuggucaggccggucucgaacucccgaccucaggugauccacccgccuuggccucccaaagugcugggauuacaggcaugagccacugugucuggccguaaaaaugaauuuucuaaccuugcaaguuuacaaaagauguugcuucuauauaccaguucugaaacagacucucacucacauacguaccuguacaaaggccuagucuaggcugaguagagaauguuaaaaaucguuaguuuacucaggugugcuuacagauugucauaucaugccuuccuacaguaauuaacaagccauccauucagcaaaaucgccaagcaccaggcaaaacacggaaaagaaugacgauggagacagaaagggaugaggucugucuucaccuuccaaacugucuagaggcugaacaaacuucaauauaaaaauguacacaagggcugggagugauaguucacaccuguaaucccaacacuuuggaggcgggcauaucacuugaggccaggaguucaagaccaccccgggcaacacgguaaaacgccaucucuacuaaaaauauaaaaaauuagccgggcgugguggcacacgccuguagucccagcuacuagggagacugaggcaggaaaaucacuugaaccugggagguagaaguugcaguaagccgagaucaugccacugcacuccagccugggugauggagugacacaggaagaaguaacuaacuccaccuggguuaaugagcaaucauuuucccagaaagggggagaguuaagucuuauaagaagguaugggaguuggccagacaagagaaagggcacucuaggcagcagaaauaucuggaaguaccgcuggaacggacaggaguuuaauaaugugucuggagcauagaaaggaaagacuauaggagaucaaaguaggaaaguaggcagguuuuacuaugaaaacacaggcuuaaucucgcugucaauaaacaggaugauuccuucagcaaacauuuauugagcaccuaucaugagacaggcacacagaaugcaaagguaaguaagaagcacuaaaguggcugccucaggaaggagucccaccccaaccuucuucuaaauccauuaggaccuggcaucugacagcacaaacaacaaauccuccuggaaaaaaguuuuccucuuuuuuuuuuuuuuuuuuuuuuuuuuuugcugaauuuaaucugccugacagaaaaauuagaaaugagggauggggcagauaaaagggugaaacgucaugagauaguaacagguuaaaacagagcagggcuggccagggcuagggcucaugccuauaauccccgcacucugggaggccgaggcgggcggaucaguugaggucaggagauggagaccauccuggcuaacacggugaaaccccaucucuacuaaaaaauacaaaaaaaaaaaaauuagccaggugugguggcaggcaccuguaguccaaguuacucaggaggcugaggcaggagaauggcaugaauccaggaggcggagcuugcagugagugagcccagaucacgccacugcacuccaucucaaaaacaaaaacaaaaaaacaaaaaaaacagagcagggcuacagauagugauguagucauuauuuguuuaaagaaaguuuggccaggcgcgguggcucacgccuguaaucccagcacuucaggaggccaaggcgagcggaucacaccaccacacccggccaauuuuuguauuuuuagggauggguuucgccauguuggccaggcugaucucaaacuccugaccucaggcgaucccacccgccucggccucccaaagugcugggauuacaggcgugagccaccgcacccagccuagaaaguuuaaaugagcaucuaucucacaaugcacacaugaggaaguaggagauacauaaaauuuaaaccucaccacccuuuaggaacuuacaauccaaaggagaaaauaaucugcacaaaaauauauuaacacaugguagaaaauauucugaauucucccugccucagggagggggccugcaacagggaaaaaccuuccaggcuacauuccuaccugccucuguucacguguagacagguacauacccccaaauucaugggcuucaggauagcagccucacucuauauaguauacacacaguccuuuagaagcaucuggaucugguccaggcacgguggcucacaccuguaaucccagcacuuugagaggucgaggcaggcagaucacucgaguccaggaguuggagaccagccugggcaacauggcgaaacccugucucuaaaaaaaaauauaaaaauuugcugggcguggccgggcacaguggcucacgccuguaaucccaacacuuugggaggcugagguggguggaucaccugaggucaggaguucgagacagccugaccaacauggagaaaccccgucucuacuaaaaauacaaaaauuagccaggcgugguggcacaugucuauaagccaagcuauucgggaggcugaggcgggagaauugcuugaacccaggaggcggagguugcagugagcugagaucacgccauugcacuccagccugggcaacaagagcaaaacgccaucucaaaaaaaaaaaaaaaaaaauuagccaggcgugauggugagcgccuauagucccagcuacucggaggcugagacgggaggacugcuuuaccaccccggggggcagagggugcagugagccaagacugugccacugcacucccacuccagccugggugaaagagugggacccuguuucaaaaaaaaaaaaaaacaaaaaucuggaucuggcccucaccuaacuacuauggccucguccaucaucacugucugcacuguacuuuacacuccaacaauacucacugacuugugcuucuguaaacaagcaaagcuuucuguguuucugcacgguauuccuuccccucacagcagccucugccugcuuccucaccugacaaacuccugcacaccccugagauuccuaauccucuggaacaggccugccugacccaucaccguguucccaacucccccucugcguucauuauagcaguugccugucccaacugcuggcacuuccaaccacccacugagccaucagcuccuccagggaaaugccggcucgccaccucuuuaagcccuagcauacagucuggcaccccagccuggcucacaguaucugcugcaauaauuauuugccagcugaaugaaggaguaagugccaaauuguuaacauauuuacauaaugauaccaaauucaggaaaaggaaagcaguagucccaaacacagaaaaguuacuuagaaaacagauucacuugcaugacugguaaagaauaaugcaacagaaaaaucugggcagugagaacaggguagaagcccacagaucaccuuuguagaaacauuugguacacagaaggcaguguucaucuucgacaggcuaaagaacaaggguggcccgagcauuucccuaggcagaggaaaaagccaauaggaaaaaggaaaucacugagucauucaacaaauaguuauuguaugccuaacugcugggcagucauucaccagggaacaaaguccugacacuaauggaaugaaacagacaauaaaaaguacaugcuaugaagaagaaccaaggguaaggggauagacugcaaaggggagggguggcuauuuuauacaggguaggcaagggaagguacuucggaggaacaaagggcugaaggagggaauuaaucauacagauaucuggaagaagaacauuuuaggcugaaggaacaacaaggaaagagacuaucggacucuucaaggaacagcaaagagaugcguguggcuggaacucaguaagcaaggaggagaauggugagaaaugaaacuggggagaaaaggaguuuggcauuuacucugcaugagaugggaacugauccugggguuccucccccucuuaguuauccaguucuugguacucaaacauccauuccccuuuaaggagauaauggcugucucuaaagaaacuuuucuggaccaucugaagcagagaaaugagcuggcucacauauuguaaaucacauucuggcucuugugucaaaaaggacaaggcuggaagcagggaggucgacaaggaggcaauuuacacuaacccaggcaaguuaagacggcagcuuggaccaugaugggcagagggaaaugcucagauuguagauugcaaauacauucugaacaaaauuucuugacagaaguaagagaaauacgaaucaagauuucuggucuaagcaacagaagaauggcucugggccugggcgugguggcucacgccuguaaucccagcaccuugggaggccuaggcaggcagaugaccugaggucaggaauuugagaccagccuggccaacauggcaaaacccugucucuacuaaaaauacaaaaauuagccaggugugguggugcgugccugugauccgagcuacuagggaggcugaggcacaagacucacuugaaccccgggggcggagguugcagugagccaagacggugccacugcacucuagccugggcaacagauaaagacuccgucucaaaaaacaaacaaaugaaaaauggcucugacaagaaauugaggcacagaaauuguuaagacaugcagcaaauuaguggcuacuagaauuaaaccuagaccuugaccuaguuugcuaacuggucuaggaaauauacucugccaguuucuagcaucacuacucccuugauuacacaaaacuauuucuaccuacaaaucagauacauagauuaaagaccuagauagcuuagguuuuagaccuuuuucaaucuuggaaguuaauauaggauaaucauaaaauuuuaaauauguuaaauaaucuaaaaaguuaacuuucacuacaccacccagaucuuugccaauaugaugggcaaaaaaguaugguuaaguuucauuuauuugauucuuagugacagugaucauuuuugaacacacauagccauuugcauuucuuuuucugggaggugccuacuuacauucauuacauuuaaaagguauuuauauuaauaaauguucuguuccuugaguucuuccuaaucuauauuuaucauuacuaaacuuaaucaugcuacaauuaaauccccagucccucuuguuucucuuuuaccuuuauuuuucugaaccaagaagaaacagaaguuuaaaauguucuuccaguaauguuuccaagucacaggaaaauagguauaucuuaaaacaagcaccacuaugauuuuuagcugaaggugauaaucauuuuuuuaaaugcuacccuucuuuugacugaguccacaaagugaaugacaauacuaucucugaaggcaacuguuaucuugcuuccacagagcuggucuucaauguuucugagaccaccuacagcaaaaacgauauuuauagcaaguacccuaagaauuuuuuuaauaagcuaaagaccuuuccauugaauaaaguccagcacuaacucauauaacaacccauguuuguuucugaaaauuuuuacauuaugauaaaggacaaacaucuacucuccuuguucuaaugagaacgugucuuuauuugguaauaaaaaagaaaccaagucugaugcuuuccggccaaauguaauacucuauccaacauugccuuccuucccugucuacaccuguguuucugacuuguauucucuuaaacaacuucugugggaggaguaaaaacugacagcucucauuguguauuaguuucuccaacaaagccugccacagaacugaugugcacugcugccucugaagagaacaguucaguaucuacuuuaaaacacagcccucuaggaaccuaagcacucacaguuagcagacuaugucucuggcuagaaaaagaaggauucugggcccuaccugaggugauggagucuggccuuucaaucccaacacucagcacacuggguguggccucacaggagccaagcaagcuucugcucugcacacugcuuuggcugggcauuguuagggauugacuuguguccccccaaaagacacgcugaaaccuaacccccaacaccugugaauguggccuuauuuggaaauaaaguuuuugcaaauguaaucaaguuaacaugaggucauauuugauuagggucggcccugauccacuaugacugguguccuuuuaggaagagaagaagccaggcgcaguggcucaugccuguaaucccagcacuuugggaggccaaggugggcagaucaccaggucaggaguucaagaccagccuggccaauacggcaaaacccugucucuacuaaaaauacaaaaaaauuagccaggcaugguggcgggugccuguaaucccagcuacuggggaggcugaggcagaagaaucgcuugaacccgggaggcagaguuugcagugagccaagaucgcaccacugcacuccagccugugugacagagugagacuccaucucaaaaaaaaaaaaagaggaagaggagaagagacagacacaggaaagagugccaugugaagauggaggcagggacuagagucaugcagcugcaagccaaggaaugccaaggacuccuggcaaacacaagaaacuacaacaaaggcuguaagcagauuccugccuaaauccuucagagaaaacacgguccugccaacaccuugauuuuggccuuuagccuccagaacugugacaggauagacgucucuuguuuuaaaccaucccaguuugugauaauuaguuacauuagcccuagguaacuaauacaggcaugaagggccagacuggagggaaaggagaagaggaccacguucuccaaucuuagcuuuaucaacagcaaagcuccuaauacucugacuuuucaucuaacuucauccuucucaaaugguucuaaacuggggaggaaaagggaagucgcaggccaccuccacaacucuccauuaaucguuagcacaucuacccaguuauugaaccacaagagggcuugaaagggccccccaggccugggccccagcuuagaaagcaacacagcaaagaaacucccugagccuccugaccauuuuugccuaagccaggacucauuucucucucacaaguccaagcagcuuuuauuucauccguuucaucccauuccgaucaccacuccaucuuguuccaccugccugcugaggccagggguaggaauggaagagcagacucaaggagauaguucuggaacagagugccuuggauccuagaccaaaaggauuuuuuuuuccucuuuucuuuugcuauaaagaauacagugggccgagugugguggcucacaccuguaaucucaccacuuugggaggccaagguggguggaccacuggaggucaggaguucacaacgagccuggccaacauggugaaacccugucucuacuaauaauacaaaaaaaauuagccaggcaugguggcauguacccguagucccagcuacuugggaggcugaggcaggacauaacagaccuaacuggauuuuuauuuucuccucaggaccaggaacaauaacuggauuuuaaucccucccacaugccuccuccacuuaguagcugugugaccucaggaaaguuacuuaaaugaggccucugcuuccccaucaguaaaaugggguaacauuaccuaaccaacugcauugugauggggauccaguaagccacuaaauguaagaauuuagcauauugccaggcuauaguaacaucugcaugcuggcuuugaaagaaagaaaaaaaaaacauucaaauuaaauaucuuccaugagcuucuuccucacugccuacagaugcucaaauuucucccauauaacuuucaaaggcuuccuguaugucauguccccuccuagacucacccaagcuacagccuucucuccccagccucucacagacaaaccccaacagagaacgggguuucuuugucaguucaccuccugacucaaaucuucaucugcaaucugaugucugccuccaccaauggauugaaaucacuccagaaaaaguugccaguaacuuuuuaauugcuacaaucaauauguuguuuuuaguccucuuaccaacccuucugcagccucugaaaccagaaaagccucuccaggcacagcuuuuguggguggugggcaacuagccccuccucacucucugauggucacugcacucucuggaacuccuuuccaugccccuauuccucagcgaaccccuccacuauugguaugcugcaagucucuuucugcaguuaucuucccuuuccaccaaacacagacacuaugggagauuucauccaugcuggccucaacuguccuucccaauacaccucggaaaaaugcuacaugggccucucucucaugaaucucaguccagucugcuaggcacagucauuugaagaugaguauaaagcuguauagagacaauaaugaaucuaaaacuuaacaaggauaaaaacgaaucuguccuccaaaaucugcuucucuaucccagucuugguccuuauucauucaauccauccacaguuuagcuugccucuuuguggccagcacugaccacagcuaauccucaaagagcuuacaagugcaggaaagaacaaguacacaggcgguuauuauaccacaggucaggugcugcaauaaagggaagcagagaggaccacaaaacccuuuagaacaagaacagugggagcuaccuuuuaccaggguaaagguggagaaagaagugaaaagugaaagcaucuccuacacaccaagcccauccucuacugcacggccaacaucagaaucccaagagccuucccaagccuacccucucuuacucuccacuucuaaguggugaccuuuguagucaauucaacauccugagcaucuuucacauccauucucuagucuccauaccaacuauuacuaucccgagugacuucugucguucuuuucuucaaccaccccaagagucuuugcugauuuucccaccuuuaguucaccaccgucaauucucuuccauacaucuauauaaacauaaagcaaacuuucuagacacaaaacugaugaugcuaucccucuuuuaaacccuucaauagcucaauaucguuccaguauggagccaugaaucuagcuccugccuuuccccucccuccucaaagaccccuuuugcccacuugaaaccuuugcuucacuuuaaaccacucgauguucccaaaggagugaagccauuucccuccuuugcugugcuauauauagacauaugugucacguguacgccguuacgaauaccuucugugagcaagacaucuguuaagugcauuaauguucauucucuuaauuaaaucucauaagaacuccauugagagagggaccaugaauaucccuauuucacuaaugacagagaauaaaaugcuugcucaaggucccaaguuaguaggagcagaagaugggaaaugagccuaaucugagauucuacucauaacugcuuugcuauuugcuucuccuauccucaguggugccuaucuggcaaaacucaucuuucaacuuuaucuuacacguugacucccuuaugaagcuuuuugggcaacacuccccaccaacugacaacguccuuuuuaaaugcucucggcacuccacacacgucaucaaucuucauuauucacagauuccguaucuacaaauuuaccuacucacuaaaauuuauaaccaggccaggcaugguggcucacaccuguaaucccagcacuugggagaccgagguggacagaucaccugaggucaggaguucgagaccagccgggccaacauggugaaacccugucucuacuaaaagcacaaaaauuagccgggcaugguggcaggcacccguaaucccagcuacugaggaggcugaggcaggagaauagccugaacccaggaggcugagacugcaggugagccgagauaaugccacugcacuccagccagccugggcacaagagugagguucugucucaaaaaaaaaaaaaaaaauuauuuauaaccccaaaaucaguauuuguaucaccauuuguauggucauucacagacacgcauagcgcaaugaaaaauuugaauugcccaaugcacacauucccagcugaggccaaacaaaggcuuucuuguuucagcucucauaaugcaaacaaguguccauucuauggucuauuuagugccaugauuuuugcacuuuuacacugucuguuggugauuuagcugcuuaaaauggcucccaagcauaaugcugaagugcugucuuguguuucuaaguacaagaauaccaugguuuauggcuauagcuauauggcuuaugacaaaaauucauguuacauaagguugguucagucaugaguuacagugcuguuggcaacaaauuuaauguuaauaaaucaacaauuauauuuuaaauacagugucuuuaaaaaaaaaacacaaaaaacaagauuauguauugaucaguugaugaaaauguucugaccagagggugacaggaaccuaaacuuguacuuccacuaggagcaacauuucaguauuuacuaguucauuguucaugaugacuuuauagaacauaacuacugcaaauaaugagaaucaacuauaccuuggcccuuguaauaagaccauucagaaaaauccccugccccaaagaagcuucccagccuacagggguaaauucaggcagccacuccuacagacuacaauugacuagccuggcacaaucacuuccccgggacucagaacuagagagcagagacaaugccaugaggggcuacagcagcuacugucugcuauaugcauaaacagaaaaugagagaaggaaagagaucagcagagaaaaguagaaucaagagaaugcaaggccccaagaaagaugaagggaccaaaaagccaagacugaaucaucauaggcauaaugaaaucaugagcucaaugccugaagaaucugcaccuucaagagacugcauucuggagagcugaaaucuacauuauaugagacauuccaaauaugauuaaagucgcuuuuuuuuuuuuuuuuuuuuuuuuuugagagggaguuucacucuuguugcccaggcuggaguacaauggcggaaucucggcucacugcaaccucuaccucccugguucaagcaauucuccugccucggccuucccaaguagcugggauuacagguggacaguaucacacccggcuaauuuucguauuuuuuguagagacaagguuuugccauguuuccaggcugguccuggacucuugagcucgaagagaucugccugccuuggcuucccaaagugcugggauuacaggugugagccacagcaccuggccaauuucucuuucguuuuuuuguggguuuguuuuuaauaacaguaugagaauuaggauacuugagaagcaauaugagccagaauccuugcagauguuuacaaauucccgaucucuuaacuuuuuacuguuauaauucccacaccucguuugagauuaaaaauaaauuaccucaucuuuaauggugcuuuccaaaggauucaacuuaaauuugguagaaacaauaacaccgcuguauucacagcuaaucuauuuacauaauuuuuaauuauaucucauacuuacacagcuggcauaaacuggaugggaaauacuguugaccugcugaguauucaacugguauuuggauauauuaacaauaggcauagccuacuuagcccugugugugaggucagugguguucuuuagagagaauguaugguaucccuuaucugguuaagauaagggugagucagagcuacuauaguaggccaguaagauuaaguagcuguagguggcuggcuaguuugcuuaaauagcucaauuaguaauugcauucagugcuacaaaaugaauuuugagccacucagguuaauuucauaaagauuacaccaaugaaccaauuauuagaaaggauuauuaucaaaacgcaaauaggagugaauaaaccuccaugugaugcacaucugguauuuguaaaacagcagguuucccacuugccauugucaucaguuuauauuugauaauagcaucagucaugauucaauuacccauagacacugcucugguuaacuuaagcagaaagggauuugauauugacugguguuagagcacuguugaagguugcaagagcagacucucagcucaauccccagggaugucucccagaacacugcugcagcaggagcugucaagggaacugccacugcuacuacaaacagaagaucaggguccaaguucauagcaccuugacugagaucuggggagcaggaaguugcuguggaaccuguuuguuucacgaacacaccaaauuaguuaugaucuaggggucaggaaucgugccagaacuauuucuucagacccaagcuacuucugcuagaucuacuccagcaagaaugccuuacagguuuccacucucuccuuacccugcucaguucugaaucuaagucuuuucauauuaaaagacuuuaaucagccaggcacgguggcucacgccuguaaucccagcacucugggaggccgaggugggcagaucacgaggucaagagaucgagaccacggugaaaccccaucucuacuaaaaauacaaagaauuugccaggcaugguggcgggcaccuguagucccagcuacucgggaggcugaggcaggagaauggcuugaacccggaagguggagcuugcagugagccaagaucacgccacugcacuccagccugggcgacagagcgagacuccaucucaaaaaaaaaaaaaagacuuuaaucaggccuggugagguagcucaggccuguaaucccagcacuuuggaaggucaagguggguggaucaccugaggucaggaguuaaagaccagcuuggccaacauggugaaauccugucucuacuaaaaauacaaaaaauuagccaggccacuugcacuccagucugggcgaacaugagacuccuucucauaauuaaaaaaaaaaaaaaaaggcaccaaaucuccaccuagauagacgaaucucacaaauguaacacugugacacagagucuugcucuguuacccaggcuggaguguaguggcaugaucccagcucacugcaaccuccgcuuccuggguucaagagauucuccugccucagccucccaaguagcugggauuacaggcaugugccaccacgccccgcuaauuuuuguauuuuuaguagaggcgggguuucaccauguuggucaggcuggucucaaacuccugaccuuaggugauccucccagcuuagccucccaaagugcugggauuacaggcgugagcuaccgcaccgggccuuggaaaaaucugauaaacuuuuguauuuagcuguggaagcagagagcugucacuugagugaauaaguuauuuagcuacaaaggccugaaacccaggaauggugggguggcucaugcccauaaucccaggacuuugggaggcccaagcgggaggaucaccuaaggucaggaguucaagaccagccuggccaacauggugaaacccugucucuacuaaaaauacaaaaauuagccaggggugguggcaggugccuguaauccuagcuacucagaagguugaggcaggagaauugcuugaacccaggaggcagagguugcaguaagacgagaucaugccacugcacuccagccuuggugacagagcaagacucugucucaaaaaaaaaaaaaaagaaaaaauuaggcaagcaugguggcaugccuguagucccagccacucaggaggcugaggcaggacgauucccugaguccaagaguucaaggcugcagugagcuaugauuuugccacugcacuccaggcugggaaagagugagauccugucuuuauggggagaaaaaaaaaaaaaaaggccugaaaaccuguauguuuugaagaaaaaugauggaaugaugggacuaguuauccugacuaucaaacugaagaauuucaaguuuuuauggcuugcaguuggaaaccauuucaguuuccaauuacaaaccauuuuaaaucuagaggauggcuuguuaagaauguuacauuugauuagccaaacaugguggaagcagguggagguugcggugaaccaagaucgcgccacugcacuccagacugggcgacagagcaagacuaagucucaaaaaaaaaauuuuaacuucaaggaccugggggcaauaaggagaacagauauaacaacuuucuugucuuagacagguaaagggaacaaucucaaaaauguaaaacacaggcauucacuacugaaagagcuacacucacuacagaaaagauaaaaugaggcagaucacauugucauucuaaaaguccucccacagccccggagaugugcccagcugaagcugaaggaagacucuuugcaugacuuaacagcuggggcagcuaacauuuaaguacuuaacaugaacaucaagagguuaacaaacucacucaaaagcagcuuugaaaagauaaaaccuagcaguuacugagguuuugcugagaacguaaguggcagaaaggaguagagagcuuugggugcuuaaggucugcuuccacccugcuguagaugaaaacaccaaaaguauaauauuaauaaaaagaauucuucccagauagcugccuaaauugaccaaaauccaaaggaaaucaacaacagcaauacagauuagacaacugacuacagaguaagugaaaaucuguuguuuccuuacuuggggguaggggaugaaaauacagaagggugaggaauccuggaaaaguugacaauacaagacaauaaaaacuuaagggucaaacucaauauacaaaccuaagugcuauaggaauuccuggggaaaagauaagacuacaaaugggcacaguaggagaagccuuuaaaaggugggauugaggcccagcacgcgggcucacgccuguaaucccagcacuuugggaggccgaggcggguggaucaugaggucaggaguuugagacccacuggccaagauggugaaacccugucucuacuaaaaauaacacaaaaauuacccgggcguggugguaugugccuauaaucccagccacucggaggcugagacaagaaucgcuugaacccaggagguggagguugcagugagcugagauagcgccauugcacuccagccuggucaaaaagagcaaaacuccaacuuaaaaaaaaaaaaaaaaaaaaaaaguggguuugagacaggccuugaagauaaaugggacuugagccaaagaaagauguguugaggcugggcacaguggcucacgccuguaaucccagcacuuugggaggucaagagaucaagaccauccuggccaacaugguggaaacucugucucuacuaaaaauacaaaaaauuagcuggucgugauggcauuggcccguauucccagcuucucgggaggcugaggcaggaaucacuugaacccgggaggcagagguugcaguaagccgagaucgugccacugcacuccagccuggcaacagcgcgagacuccaucucaaaaaaggaaagaaagauguguugagcggggcaugguggcauacaccuguaaagccuguaguuccagcuacccaaaaggcugaggcaggagaauacccagagcccaggaguucaaggcuucagugagcuacgaucgcaccacuacauucuagaccaggagacacagugaggccuccaucucuaaaaauaaaaaagagaaagguguguuauccuucuaugggauauacggaacgcacaaaaauaauuuuuaauuguucauguaucaaaaguaacaaugguucucaaccaggggugauuuuguauccuugagacauuggcaaugccuggagacauuuuugucacaagaggaagaguucaaguugcaucuaauggguagaugcuguuaaacauaaaaaaguccccacaacaaggaauuaccaagcaccaaaacaucagcagugcaacuguuuaaaaaccauuugucgcugggcgcaguggcucaugcuguaaucccaacacuuugggaggccgaggcaggcggaucaccugaggucaggaguucgagaccagccugaccaacauggagaaaccccgucucuacuaaaaaugcaaaauuagccaggcgugguggccaaugucuguaaucccagcuacuccggaggcugaggcagaagaauugcuugaaccugcgugguggagguugcagugagccgagauugugccacugcgcuccagccugggcaauaagaacgaaacuccaucucaaaaaaaaaccauuugcuagggccucaagaaauucuagcguaaguucaacaauagacauguacaauaauguucauuacagcauuuucauaagaacuaaaaacugaaaacucaaaaaucaaucuacaagaaaauaaggaaaugaaucacaauauauucacccgauggaacuacacagcagugaaaauuaacaaaucauagcuacucccaggaauauggaugaaucaccaagcaggauggcucacgucuguaaucccagcacuuugggaggccgaggcaggcugaucacuugaggugaggaguucaagaccagccuggccaacauggugaaaccccaucucuacuaaaaauacaaaaauucgcuggguauaguggcauaugccuguaaucccagcuacucgggaggcugagacagaagacuugcuggaguccaggaggcagagguugcagugagacaagauugugccacugcacuugcacucugaccugggcaacagagagagacuccaucucaaaaaaagaaaauaaauauggaugaaucucagaaagccuuaaacuaaccaaagcguaaguccauuuucacaaaucugaaaucaaauuuaaucuacucuuuaaggauaaaugcauaaaagacaaauccauuuuuuuaaagcaagggcauauggaacacaaaaaucaggacaugguugccaaggagagaagauggaugagauagaagagaaacauacagugauaucugggugaauucauagaacuauaccaugucuuuugcaugccccaaguaucauauaaaaccuuuuuuaagaugaaacaaucaauauagguaauauauuucuauaaauaucugcaagaaaauauuuuaaugcuauguuaaaauuuuuuuuuuaaacacucugucacccaugcuggagugcgguagcacagucucagcuuacugcaaucuccaccucccagguucaagugauucuccugcuucagccucccaaguagcugggauuacgggugugugccaccacaccuggcuaauuuuuguauuuuuaguagagacagggucucgccauuuugcccagccuggucucaaacuucugggcucaagugauucgcacaccucggccucccaaagugcugggauuacaggcaugagccaccacgcccagcguaaaacuguucuuuaagaaaucccucuguaugucaagcaauuacucuugaguuuuuaaauuugacaguuccauauguuuguauauuaccuaaaggaagacaaaccugcaugccuggugaaggacugugaacccaacagaggacuguagacuguuuuuucauuguauuuuguuacauuaauuucaaugucuaggguggccaggcacgguggcucacaccuguaaucccagcacuuugggaggcugaggcagguggaucacuugaggucaggaguucgaaaccagccugaccaguauggugaaaccccgucucuacuaaaaguacaaaaauuaaccagguauaguggcaugcgccuguagucccagcuacucaagaggcugagaaaggagaauugcuugaacucgggaggcggaguuugcagugagacuccaucucaaaaauaaauaaacaaauaaauaauaaaaauaaauaaaauaaaugccuaggguuugguuaugcauuuguauccaagcccuuaaaauggaaauaacuugccuaggucucuucccccaaucuuacuguauuauacaaccaguaacacaucuacaauaccuauacuuuuuuuuuuuuuuuugagacagagucucacucugucgcccaggcuagggugccauggugcgaucuugacucacugcaaccuccgucuccuggguucaagcaauucuccugccucagcgaccugagcagcugggauuauaagcgugcgcuaacacacccagcuaauuuuuguauuuuuagucgaaacaagauuucaccauguugaucaggcuggucucgaacuccuggccuaagugaucugcccgucucagccucccaaagugcugggauuacaggcaugagccaccacgccuggccuaugaauaccuauacaaauuaaacugacagauuaaauggacaaucaaguguagcucauuugguaaaauaccuuuaacuuuuaaauaaucauaaacuauaacaucaacaaugacacuggcauuaaauaaauaauuugucuaaaguaucugcuuucguuuuuuaaaaaaugguaauuuaugguagcauuugcacauuguggcugggcacagccuguaacuccagcacaauggaaggcugaggcaggaggaucgcuuaagcucaggaguucgagauaaggcugggcaauauagggagacccugucucuccaaauaaaauuaaaaaauuagccagguguaguagugugcaccuguaaucccaguuacucaggaggcugaggcaggaggaucacuugagucugggaggucgaggcugcagugagccaugaucucaccacuccacucuagccugagugacagagugagaccuugucaaaaaaacaaaaaagaaaaagaaaagccaggcacuguggcucacaccuguaauccuagcacuuggggaggccgagguggguggaucaccugcggucaagaguucgggaccagccuggccaacauggugaaaccccaucucuacuaaaaauacaaaaauuggccaggcauggggguggcacgcaccuguaaucccagcuacucaggaggcugaggcaggagaacugcuugaauccggggggcagaggcugcagugagccaagauggcgccacuucacuccagcaugggugaaagaacgaaacuccaucucaaaaaaaaaaaaaaaaaaguaaaagaaaaaaaaucaaagaaaauaaucugugccaggcgcaguggcucacaccuguaaucccagcacuuugggaggccgagguggacagaucacuugaggucaggaguucaagaccagccugaccaacauggauaaacccugucucuacuaaaaauacaaaauuaaccaggcgugguggugcaugccuguaaucccaccuacuugggaggaugaggcaggagaaucgcuugaacgcaggaggcggagguugcggugagccaagaucgugccauugcacuccagccugggcaacaagagcaagacgccgucucaaaaaaaaaaaggaccagucuggccaacauggugaaaccccgucucuacuaaaauacaaaaauuagccaggcaugguggcaggcaccuauaaucccagcuacucaggaggcugaggcagcagaauugcuugaacccaggaggcggagcuugcagugagccgagaucgcgccacugcacuccagccugggcaacagagugagacucugucucaaaaaaaaaagaaaaacagacuguucuccuacgaauauuaauuuagaaaccuaacucauuuacuuucuaaauccuuauuuuuauguaacuggauugauaaagggagaaggcagccaaacaaggccauuccaacaguuuccaaaauuugcauuucacaggaguguuaaguucacacugaaagccugcugggcuugcacugucucccucaggggggcuggaauggggagaggcuucccaacaccugcaagagcuacuugagucucccagguaggucacaaccccuugggccugcuuuggcuuccuggcaacuaccaugcaggucacccauugaggcccuccagcacucagccugggcagcgagccccucaccaaauacuggacuguacugccccugcacccagcuguggccuggaccagcgcuuuccagcaauucuacauugugacuuuuaugagauuauccagccuauuuaguccuaucagaaggacucaugggaggccauggagacuacucauccuuaguuucaaacauaaaaacuaagccuuaaauuugaaauacuggccgggugcaguggcucacaccuguaaucccagcacuuugugaggccaaggcagguggauaaccugaggucaggaguucgagaccggccugaccaacauggagaaaccccgucucuacuaaaaacacaaaauuagcagggcaugguggcgcaugccuguaauccaagcuggucgggaggcugaggcaggagaaucacuugaacccaggagguggagauuacaaugggcugagaucguaacauugcacuccagccugggcgacagagcaagacucugucucaaaaaauaaauaaauuaaaaaaauugaaauacuuagaaaacauauuucaagacaauuuaauacgcaaacuuuccaauuauuccuaaagauucacaaucaggccaggugcaguggcucacaccuguaauccuagcacuuuggggggaggccaaggcaagaggaucacuugagcucaggaguuugagaccagccugggcaacuuggagagaccucaucucuuaaaaaaaaaaaaaaaaaaaaaaaaaaaaagauucacagucgggcgcaguggcucacgccuguaaucccagcacuuugggaggccaaggcggguggaucacgaggucaggaguuugagaccagcuuggccaauauggugaaaccccgucucuacugaaaauacaaaaauuagcugggagugguggcaugcaccuguagucccagcuacucuggaggcugaggcagaagaaucacuugaaccggggaggcagagguugcagugagccaagauugcgccacugcauuccagccugagcgacagagcgagauuccaucucaaaaggaaaaaaaaaaaaaaaaaaaaggaucaaaaucgcaaaaaccauauacgauaccggcuauauugaaaaaaaaaaaaaaagacguugaaaaacaucaaacacaauaaucugaccauccuugcuuuuuucauuauuaaugaaugcaagaaauacuauuuuagagaauuauggcaauuugcacauuuuuuguuaacuaccugucaaaaaaaaaaacaaacuugagggaaaugaaugugauguauuaucaugccauaugcaaucugugacacugaaacuuggaaaaguauuuguugaucauguauucccucaauccugauaccaauacacagcuuccuugacaugaaauacacagauauugacauguauuuucaauaucuacaaaaugaaauaggaaaccauaaauccaaacugauaaguugacagcuugacaaguuuaauuuccccaaagucucaaauauuuaaccaacuuauaauaaaauuaaauacaaucaugauauaagcacaaagucaagucauagucuguuacccaacauuuuuccuugauuuacaacacacgggguucuuuuuuuuuuuuugguguuuuuuguuuguuuguuuuguuuuuccuuuuugagauggaguuucacucucguugcccaggcuagagugcaauggcacaaucucagcucacugcaaccuccaccacccaggaucaagcgauucuccugccucagccucccaaguaccugggguuacaggcaugccccaccaugcccggcuaauuuuuguauuacuagcagagaggguuuccucauguaggccaggcuggucucaaacuccugaccucaggugauccacccgccucaaccucccaaagugcugugauuauaggcaugagccaccgggcauggcguaacacaugguuuuaauaaauacaugaccaaacccucauuaauguucacaaaaauaaauucuaucuagacuacauuuugucuaauucauaauuuuucuuuguuguuaaacagcaaaacaaauguguccauugacccuuucuccaugugcuugcucuuggagcaggaggcauuguccaucuacacaaacuccuucaguagcaugauauugagaucuauccucauugacaacucuuugaguacugacgucuuauuaaaaagaaccuucuuauaaaaaaaagucuugcauuugcuugguucuuuacugugcuuuaacauauguuacuucauuuucauucuuaaaaguucucugugauguuaguuagcaggcugugauuauucccauuugagaaaugaugaaaccaagacuuagaaauggaaauaaauuuucuaaggucaaacagcaaauaggugcaaugaacugacuccaaguuuuguaucccggacccagaucccaaauauaacugaccucuuugcuaggcucuccagcugccaaaaaagaaaagagaagagaagaaaaaaaggaaaaagaucacaccaaagcccacuaaauaaggaacaaaucuucucuccacuagauaaacaauucugaucaauuuuuaagaaauguaugacauguuauuuaagauguuccagauugcauggaaaaaaaaaacagcaagcuuagaaauccuuucuuaagaagccuaaaaugaguaacaaaacuuaaaaacgacccaagaaaacugcaaaccagcuucacuuaagaguauugaugaaaauuuccuuuuuuaaaaugaacaaacuccaggccagguguaguggcucacgcuuguaaucccagcacuuugggaggcugagguggguggaucauuugaggucaggaguucgagaccagccuggccaacauggugaaaccccgccucuacuaaaaauacaaaaauuacccgggcauggugaugggcaccuguagucccaguuacucgggaggcugaggcaggagaaucacuugaacccgggagguggagguugcagugagcagagauugcaucacugcacuccagccugggcaacagagugaaacucccucuuuaaaaaaaaaagaaagaaaaacaaaaagugucaagaucaugaaaaucaagaccaugaagaucaaggaaaaaaaaaucaagaucaugaaaauccuucucaaauccauauuugagauugaaggaugcuuaaaagaccuacaacaagaauacauauugcacaauucuggacuggauacuuuugcuaugaagaacauuaauuacuauaacaaauagugaaauaugaagaaucuaaaaauuagaugauaguaauguaucaguguuaauuuccugauuuugauggauauacugcaguuauggagaaaaauguaggaaauacacauugaguuacugaggagugagggagcaugaagacaaccauuuguguaaaaaaauguaaacacacacauaaauuuauauagaauaucucuaaaauucccuaaaagggaagcccagcagguuaaaaaaaaaaaaaaaauccuguucagcacuacccaucagcuggggccugccuaucugucaccaaaaacuaugugaucauuuaugugcuuucccagggaccgagauuuucuagaaagagcccuaaugagaagacacaagcauuucagauccagauucuaguucuucuugccaguuuaauuagggaaccacacugaagacauuagucuuccaaugccugacacucucggucgacugaaaaaguucauauucccuaaaagggaauuuuagacagaagggaacuagcugucuaaaggcuaaaagugagaaccauguacacauuuuacccuuuaauaccuucugaauuuuauaucuuguuacauaccuuguauugccuauuugaaaauacuaaaagaaauauuauguguguauauauaauacaaacuuagaaaaauaaauaaaauuaucaaaaaaaaaaggaaaaugauuuuaccuaucucagggccagauucuuccugcuaaugaaagcugccugaauauuauagacugagagguaucacuuuaugugcccaaauuuuagggaaggauuccuuuuugaaaguuaaauagauggccagauggccaagcacagaagaucacgccuguaaucccagcacuuuggaaggcugaagcggacaucaccugaggucaggacuucaagaccagccuggacaacauggcaaaaccccaucucuacuaaaaacggcaaaaccccaucuguacuaaaaacacaaaaauuagccaggcaugguggcaggugccuguagucccagcuacucgggagacugaggcagaagaaucgcuugaaccugggaggcagagguugcagugagccgagaucaugccauugcacugcauccuaggugacagaucaagacaccgucucaaaaaaaaagggggccgugcaugguggcucacgccuguaaucccaacacuuugggaggcugaggcaggcggaucacaaggucaggaguucgagaccauccugccgaacguggugaaacccugucuccacuaaaaacacaaaaaaauuagccgggcgugaggugaggggugccuguagucccagcuacucgggaggcugaggcaggagaauggcgugaacccaggaggcggagcuugcagugagccgagaucgugccacugcacuccagccugggcgacacagcgagacuccaucucaaaaaagaauaaaaaaaaagcaaaaaagaaaguuaaauagauaaaaaacaaaaugagauaaacuaccugcaaaaaaaacacuucaguucacccacucaaagggaugccugugaccauucaaaguaucugauggacucucagaacagaacagaaucaacaauauacuaaugaucagacaaagccuguccugaggacuggaauuuaaacaaacaucugguacaaaaaacaaaugcaaagauggagguaaaaagggagccaaaugaaggaauuuaucgcuucuuuaaccuuauucaacaagagaaaacguacuggcagagaagaauguucugauaagcagaggugaaugcucaagggucagggaagcccagcagguuaaaaaaaaaaaaaauccuguucagcacuacccaucagcuggggccugccuaccugucaccaaaaacuaugugaucauuuaugugcuuucccagggaccgagacuuucuagaaagagcccuaaugagcagacacaagcauuucagauccagauucuaguucuucuugccaguuuaauuagggaaccacacugaagacauuagucuuccaaugccugacacucucggucgacugaaaaaguucauauuucuaaauguacaaugcuaaaaauggaagcaggacuaugaacuccacuaaaaugucccacaccgagacccccacuaaagggggccaacuguccuaagucugacauuucuaauuucaaaaauuuucccauuccuucccaguaaacagcaaaucaauacuugaaauuauagcuuuuuguacgauuaucauacauaaguugagcaucucaaaccaaaaaucugaaauacuccaaaaucugaaaguuucgagggcaaacaugacacucaaaguaaaugcucauuucagauuucaaauucucagauuacagaugcucaguuguaacuauagcaucuguaauguauaguaaaaugcaauauucccaaaucugaaaaaaauauaaaauucauguauuucagauaaggaauacucaaccuauacaauauauuuucauauauuuuaaaauauuuacuuugccaagcacaguggcuauugccuguaaucccagcacuuugggaggcugaggugggcggaucaccugaggucaggaguuagugaccagccuggccaacauggugaaaccccaucucuacuaaaagcacaaaaauuagccuggugcgguggcacacaccuguagucccagcuacucaggagacugaggcaggggaauagcuugaacccaggaggugaagguugcagugagccgagaucacaccacugcacuccagccugggugacagagaaagacuccaucccccugcaaaaaaaagaaaaagaaaauagaguacagcauaguugauaaaguuuugugaaacuuuuguuucaauuuuauauauuuauguguguugggucacgauggguaagauguauuucccaaugcguguccugguuuuacaguuccuucauuuuugcauauauguaaaagucauuaauuugcacaauaaauguucguugagcaccuauacuauagugcuagugagggaacagugugcuauauagaauagaaggaaauaaaaauacuuggucucugcccuuguagaaucuuuacaguguagaaacaaucaaauaaucacaaaaauauacaauuauaaaccacuaaguguuagggaaaaauacagggaauuaagacagcucaucauuagggaagcugauuuaaucagagaagagaaaugaguaacaggucagguuucucugaagaaguacuuucaaguagagaucagaaagauguaugaaaagggggaaaaugagaggagaaaucagucaggcaaaaaacagcacauucaggaagguuguauacaguuugaagaaaagaaaagccaauagguagagagaacaugaaaaaccaucuagauaagacauggguggagcuugggguagaaagagauauggcaggaauuuuaaauauccugaggccuaugagaacaauccaauaaggcaauaggccuuaaagaucaugcuggaaagagauuggagggaggaugggagugaaugguaggauaaugcauuggagguggagacaagcggauugauccccacaauauuauuccugaagcagaaguuacaagguguuaagugauacuuuggaugugagggcugaggaaccaugaaguguuggauaacucauaaugaaaugagugagcaaugaaaugagaugagaugcaggagaaauuccagagaagcagagcugagaggaaagaucagaguuacauuuguuauacuuaacaaguagagaugccaaauuaauaccuggaacuggauggagauauaaaaaaagaagucauuagcacaaaggcuuugaugacucaucauugugcuccuuaaauauccacccauaguaauauacaauauaaacccagaagaauccagaauaaauuugaggcuuuaugcaguagcaguucauaaauaccauaguagcugaaauaccauguguaucugaacaguauacagugcaacaguuaacuaaacauucacacucuuaaaauaauccacuuccaugaaaucauagggaauccagucuauuguguucacugcuguccacaucugacacaguguauggcacauaguacaaguuaaucuacugaagaaauguauccacuacuaugcaaaauauaccacccaucaaaaauaaaacaaacaguacaaauaaugagcaacugugcaagggaaaucuuuguacuaugaaacauauaaaugaaccaauuaggacauuuuucaaggaaaaagggaaaagaguuauuuagcacuuaagugcucauacccuaauagucuauauucuguucuaugcuacauauaucuaaugcuauauucuguucucuaauaaucagcugaauuucaacaucggaaauuccaacugggcagccuauuguaaguacuccuaccauucucuagaaaucucugaguaauacaagcaacaacuaaaauguaauaaaagcuugaugcugaaacuauaacaaaaucucaucuaaguuauuaaaacaaaacaaaaacuguuaaaaguguauucuggcugggagcgguggcucauuccuguaaucccagcacuuugggaggccgaggcggauggaucaccugagguugggaguucgagaccagccuaaccaacacggagaaacccuccgucucuacuaaaaacacaaaauuagcugggcgugguagcgcaggccuguaagcccagcuacucaggaagcugaggcaggagaauugcuugaaacugggaggcggagguuguggugagccaagaucgcuacauugcacuccagccugggcaacaagagcgaaacucuaucucaaaaaaagaaaaagugcauucuccaaugugaaaagggcaauaacugauuauuuuucuuuuuccucuaucuucuccuguuucccagcuuuucuaacaaacaugaauuuuuauuaacuuauuuucccucuucacaaugguaacacugauucauaggagaaaauuuagaaaaugcacauaaacacaaaggaaacaaauuacccacaauuccaucacccagaaguuacuaacuacugucaauauuuuugugggaaccuuucucugggcuugcaugaggguagggagggaagagagauacacaaguaauggcaugauugcuuaagacuaugaaggagacuacagaaugcugcuauggccagugugcaggauugagagaacacuaacuugaagaaguugacaacugagcugagcuuccugaagaaugagauggaaucaaucaaagaagugcaacugggguagcaguccaggcacagggaacaacagcaugggcagaguaccaagcccauucagggaacuaggaagaaagaugaguuugguaggaaggagacuggcugggcagucacacacagagcugagaguuaggacuuuuucccuagagaaagcagccuugaagcaggagcaggggggauaggcuuccuuaaaggaauuauucugacuguuaguaugggaaaaggauuaggcccagaaaguguggauuuagaagaucguaaccacgcccccucuaccccccauccauccccccccaccagcggaaggguaaggaggaugaggaaguagggaaucuuuagagggucggggaguaaaaaagacaaugaccuggccgggugugguggcucaugccuguaaucccccaguaauuugggagggugaggggguggaucaccugaggucaagaauucgagcccagccuggccaacauggugaaaccucaucucuacuaaaaauacaaaaauuagcugggcgugauggcaggugccuguaauuucagcuacuugggaggcuaaggcaggagaaucgcuugaacccaggagguggagguugcagugagccaaaaucacaccacugcacuccagccugggcaacaagggcgagacuccaucuuaaaaaaaaaaaaagacaaugaccuaauauauuauauuauauauuauauaauauaaagacaaugaccuaauauauauuguauuuauauuauaaaauuauauuuuaggcuccacaaaauggucuacauuuguagcgauaaaaaagauacugugacuuuaauuaugauacaccuccuaagaaauucauaacagaaauagagcuugcaggccaagcacaguggcucacaccuguaaucccagaacugugggaggccaagucagaaggaucacuugagcccagaauuuugagacuagccugagcaacacacugagaccccaucucuacaaacagaaauuuuuuuaacugaaaaagaaaagaaggaacaaugagaacacauggacacagggaggggaacaucacacaccagggccuguugugggguggggggcugggggagggauaguguuaggagaaauaccuuauguaaacaacgaguugaucagugcagcaaaccaacauggcacauguauaccuauguaacaaaccugcacguugcgcacauguacccuagaacuuaaaguauaauaaaaacagaaaaaugggcaggcaugauggcucacaccuguaaucccagcacuuugggaggccgaggcaggcggaucacgaggucaggagaucgagaccauccuggccaacacggugaaaccccgucucuacuaaaaauacgaaaaaaauuaguugggcgugccuguaaucccagcuacucgggaggcugaggaggagaaucacuccagggagucggagguugcagugagccgagaucaugccacugcacuccagccugggcgacagagggagacuccaucucaaaaagaaaaagaaaaaagagacagagguugggagagaagcauuaaauacuaauauuuaacaaaagggaacacacauuuuucaguagauauugagcuuaaucaaaguacagaauguaccuaucuuaucacuaaauauagagcaaauaagugaauaucaagggaauaaccaugagcaguauaaagacugugcuaacaggaagggaugaucaggccaggugcaguggcucacgccugucauccuagcacuuugggaggcuggggcaagcggacugcuugagcccgggaguuucagaccagccgggguaccauggcaagaccacaaaaaucagccaggcaugauggcauguaccuguagucccaccuacuugagaggcuggggcugguggacugccagagcacagcagacagagagguuacagugagcugagacugucacugcugcacuccagccugggcaucagaguuacacccugucuccaaaaaaaaaaagaacaggaugaucuuaauacugacauccagaggccgggcacagugguucacaccuguaaucccagcacuuugggaguccaaggugggcggaucaccugaggucaggaguucgagaccagccugaacaacauggugaaacccugucucuacaaaaauacaaaaauuagccaagcaugauggugggugccuguaaucccagcuacuggguuggcugaggcaggagaaucgccugaaccugggagauagagguugcagugagccgagaucgcgccauuggcacagagugagacuccauggacaacagagcgagauuccgucucaaaaaaaaaaaaaaaaagacauccaggaaaggaaaacacagcauuaaccauagaauaaagccccacuuuagagaacuggagaacugaaguuggcaguggaauagggaaagaucaacaggccccuucaaggcuugaaagaguaucaccaagccaggcacgguggcucacgccuguaaucccagcacuuugggaggcugaggugggcagaucacgaggucaggagaucgagaccauccuggcuaacacagugaaaccccaucucuacuaaaaauaaaaaaaaaauuagccaggcaugguggugggugccuguagucccagcuauucaggaggcugaggcaggagaauggugugaacccaggaggcggagcuugcagugagcagagaucgugccacugcacuccagccugggcaacagagugagacuucgucucaaaaaauaaauaaauaaauaaauaaauaaauaaauaaauaaauaaaaaagaguaucacccaagacuaacuaucccuccuuacgcaugcagucauucaacagauguuuaaccuagcaauuacauuauauauauauauauauauacccaagaguagagaaaacacgcguccacacaaaaacuaguucacaaauauucauagcauuacucagccaaaagcagagauaacacaaaugucuaccaacugaugaauaaacaaaaugugauguauccauaauagaauauuagccauuaaaaggaaugaaguacugauacaggcugcaacauggaugaaccuuaaaaaacauuaugccaagugaaagaagucacucacagaagaccagauaguguauuauuccauguauauaaaauguccagaauagccaaaucuauugagacagacagcagauuagugguugccuagggacagaaggggauagaauuggagggaacuaggcaaugacagcuaauaggaacagagcuucuuuuggggauuaaaaaaauucaaaaauucauuguggugaugguugcacaagacuauucauuuacuaaaagcuuuuauuuauuuauuuauuuauuuauuuauuuauauuuuuacuuuuuuuuuuuuuugagauggagucucagucugucacccacgcuggagugcaguggugccaucucggcucacggcaaccuccacuuccaggauucaagugauucucuugccucagcugggauuacaggcgccugccaccaugccuggcuaauuuuugaauuuuugguacagacgagguuucgccauuuuggccaggcuggucuugaacuccugaccucaggugauacacccgccucggccucccaaaguguugggauuacaggcaggagccacggcgccgggucugauuuucaacuuuagaaaagcaacugacuaaagucuguuaauaaaaagaaauaagucuucgguuuaaauuguacuguauuaccaaguuugcgggauacuguaaagcuuaugugaaaacuuuucauaacacugaaauugggagaaaaagcaccuaaaaaacccgaacaaccguguaauccguuccaaaacaaacuaugggcggguugcgcggaggccagcaagguaagaaagcaagcgauaaucgcaaagcagagccgacugcuuccuaauaaaaaauggaccuuuaaaaauuaaaaccacuaguuuucaaccacaacacuucgaaaugagaauauuagucaccguugccauagaaacaguaaagccaagcugcccggaauuuagacauuuuuuuaaauaccgcaaacugaaaugggugaaaauagggcagaguuuagugugaaccuaaguggccggaaccuacuaguaacuuucaccaggauaaaagugacucugcuuuucuaaccuacauuuccgaacagugcuuuauaaaucaccucucgggguuaguuuaucaagcgcaaaaaaaaguuuaccuugucucuuccggaagaaggaaccugacaaaaccccucccgguaguauugcccacaaucagagccagccagcgcaggcuugcaccgcgcagcaaagggggagcccagcaucaaguccacgcggaaagcaucugaaucccggcugcuggcuuuacuggcggagcacagaggaaaaccccaagcuccugccuacagccccggccugucuggcucccuccuccacguccccacuccacgccacguucugugccuggcaguccacgcgcccuaauccaacucgcauuuauuuaagcacccgccgucuacaccgcaucaugguuccuccaggcacugcaggaagaaauggccccaugccgggggaaagaaacaccaaaaggacagccgcgagggcugaagacgaccccgaaugacgggaugacugccugcaacggguggucaggagaggagcucccacccucaccccgcgggucgugacacucccagggaagggagggccccgaggggugcaccaggcccggccuuccuggaguccgccacagccgacuggcggcguuaagagguccgcaucccaggaccgcccgagcgcuccucugccccaaggaggcgaccccgacuccggaucccgggaaaacggcgagcgcggguaccgaaccucgguaagggccggagcgggcugucaccggcccccgcaucccuccccugcggccgcggccggccgcucccuccccagcuugacagucgcugcagucacggacggagcgucucugccccagcgucgccgcucgcccggacgcccgcacccccgugccccacgcggaggggggcagugccgggaagaccucuccggacccuccccccgcccuggcccccagacuccggaaaagcgguuaccuggcgcgcggguuggggcgagagcacgacucgguggaggaggaagagaagacaguggccuccggcccagggagauuugggaaauuugggagacuuguuccgcacuaggugacagcuguucgcugcgcacgcgcacaggaccccggccgcccgaucacugcgccgcgccucacccucccgucgagggggugggugggaggcagcggcgaaggcgcgcgcaccgccggcucucccugcgcgagggcgcgcgcgccgucacgugaccgcuggggcccgcacuuggugagucacgugggcuuacaaacagcuuaaaggugcccggcacgcucuugcuuugggcucaacuuccgcgcugugguuaacuuaggcuugcuggcgcgcaucuucuuguccuuuggacacaggcauaucccauucuuuccggaggggaaagauacucgcguagaaggagaaaacaggugcacagaaccuugcccggaagcgcuggcuggggucccgcagggcuggaccugauguaguccacgcgccacacguccuccugggcgccgacgcgcaccuauggcggccuccgacgcgcggacgucagcguggcguuaccgggguggagccucggaauguacuggagagccuggcgagaaagucggggcucgcagcucuccggcgaugacagcgcuguguucccguucucccuucacccgguggccgggaccacugagccuccuucccacaaugggagaucccgaauaggcgaagaguaucuucgugucccaacccuuuaacaacuaccgcgcaggagcgugucagccucuggaagcaaaacuguccgguguugagucaccuacacccagcacgucccgccccgacccgcccaagugugcucuuaagauagggaggcacaaaggugaccccaauaggaauccugggcuggcggucccucagaaacuagaguugauaacaguuuggccagaacugaagugacuagaaaugcaggugccuccagcgucugagacuagauaaguuaacuuccuacaacuuguugcuuuuccucuguaacuccgccuuccgaggugucagaaggaaccaaccagaccuuaagccccuguacugccaaagacagaugguugagcaucagauguuuugcaaagcugaaugauuuuuuuuuuaaacuuccuacagagcucccagcugggucccuuguggcguuuucucuaacgucuuagcuaagaaagauugggcauaucuucacaccagugagcaaaguugggcuaauaugcugaauuuucuguuacauuauacugauaacagaauuuuaaaaauauaucgacaccgcuuaccacgcgcuugaacucguuucucacuggggugaacauugugaggacagauggaaugugauuaauugagcuaaggcuaacgggauuauugggucaccauauuucuuuaguuguuaaaaacaaaguuccgcuacacacacagacacacucuuuuuugagacggagucuugcugugucgcccaguuuggagugcaauggcgcuaucucggcuuacugcaaccuccgccucacggguucgagagauucuccugccucagccucccgaguagcugggauuacagucgcccgccaccacgcccagcuaauuuuuguauuuucaguagagacaggguuucgccauguuggccaggcuggucacaaacuccugaccucaggugauccgcccgccucggccucccaaagugcugggauuacaggcgugagccacuucacccggccacacacaauucugaacuuggcuaacguauacucaacugggaauuuuccaaaugugugcauguaacgucaggaucccaaccauccuuacaaguaaauuggauaugcuaaaauaauaaauaugcaaccuaacacuuacuuagaacaguaaugugagcuacacacugucuucagagcuucacauguauuaauaaauacuuauaauaauucaaugaauagguacuauuaauaccucauuguuacagauguggaaacugaagcauagcgguuaagaaauauguccacaaucaagcagcuagggucuuuuggaagccauaugcuauauuagaaaucuugugcaccagaauaaaaaaucuggaaaccugaaauccauuuucuucagaauuugcagaugcacaaauaacauuucuuuaccauugugaauuagaguaugacuuuuuuuuaaccugaagaacugaaguggauauacgaaccuugcuaacuucacugagcacuuuuuaauuuuaaggaagauaauguaaaaugucaaaacacuucaaaagcuguaaagcacuaugugaauccauuaagugcuucacagucuuggaaagugaagagagccuacuagaaaaucaacuggacucauggcacugagggcagucuugugucccuaauguaucaaaauaccuccauauuaugaauuaucgugaaaacauuuuagccauauaguaaauuuuuuauuuagauucaauuguuuaaaucccaauugcaauauauuaauggaaggcuguaugaacaauacauagauuccccuugaaguuuauauguaaugugaacuaacgaacagaucaucagaucaccucagagacaauacuuguuuuuauuuuauuuuauuuauuuguuuguuuuuugagacagagucuuacucuguugcccaggcuggagugcaguggcgccauaucggcucacugcagccuugaccucccggguucaagcaauucucgugccuugugccucauucuccugagcagcuggcauuacaggcaugugccauaaugcccagcuaauuuuugcauuuuuuuauaauugagacagagucucacucuguugcccaggcuggagugcaguggcgcgaucucagcucacugcaaccuccgccuccuggguucacggcauucugcugccucagccucccaaguagcugggacuacaggcgcgugcuaccacaccuagcuaauuuuuuguauuuuaaguggagacgggguuucaccguguuagccaggauagucuugaucuccugaccuugugauccacucaccuuggccucccaaagugcugggauuacaagcgugagccaccaugcccggccuaauuuuuguauuuuuuguagacaggguuucgccacauuggccaggcgggucucaaacuccugagcucaagugaucugcuggccuccgccuccaaaagugcugagauuacagacgugagccaccaugccuggccaauacuuguaaguuucuuaaaauauauauaaugcagcaaauuuauaugcugcuuuuuuuuuuuuuuuuuuuuuuuacuuugagacaggaucuucacacuguugcccagacuggagugcaguggcacuaucacggcucaauacagccuccacuucuaggaucaugcaguccucccaccucagccucccauguagcugggacuacaagcgcacaccaccacaccuggcuaauuuguuuauuucuuuguagagucagggucucacuauguugcccaggcuagugucaaacuccugggcucaaaugauccucccgccucagccucccaaaguggugagaauacaggagugagccacugcccuggcugcaaauugauauacuucuaaauaauagucuaauuuugaaucuguugaaguacacuacacuuuuuacaaauauaaauaauugagcugggcacaguggcucaugccucuaaucucagcacauugggaggccaaggcgggcauaucaccuaaggucaggaguucaagaccagccuagauaacaugguuaaacccugucucuacuaaaaauacaaaaauuagcugggcaugguggcaggugccuguaaucccagcuacucgggaggcugaggcaugagaaucacuugaauccaggaggcagagguugcagugagcuaagauagcaccacugcacucuagccucgaugacaagagcaaaacuccaucucagaaaaaaaaaagaaaaagaaaagaaaacaaaacaaauauacagaauugaaugaggcugggcucgguagcucacgccuauaaucccaacacuuugggaggccgaggcgggcggaucaccugaggucaggagaucgagaccauccuggcuagcacggugaaacccugucucuacuaaaaauacaaaaaauuagccaggcacaguggcaggugccuguagucccagcuaguccagaggcugaggcaggagaauggcaugaacccgggaggcggagcuugcagugagucgaggucgugccacugcacuccagccugggugacagagcaagacuccaucucaaaaaaaaaaaaaaaaaaaaaaaagaauucaaugauaguaauacuuaguguuuuuauuuaccuuuaccuuuaucaaauauguauguuacuuauacaggaauaaugagagaugauuaguccaugagggcucugcccuuauuaaugaauuaaugccguaacugcaggaauggguucauccucuucucucuuguucuuuguccuucugccaugggauaaugcagcacaaagucccucaccuaauacagccccucaguccuggacuuucuagcuucuagaacugcgagccgauaaacuucuguucauuauaaauuacccagucugccaggugagaugacucaugccuguaaucccagcacucugggaggcugaggcaggaggaucacuugaacccaggaguucaacaccagccuaggcaacauagcgagaccccaucucaauuaaaaauaauaauaaaaauaaauuacccagucugugguauccuauuauagcaccacaaaauagaccaagacaugauagauaaaagauagaagucaguguuuauagauuuaauaaucauggaacaaguccauuauuucagguaaaugccuggugugcuuacucuuaggccugaguuggaagacuuucagaaauaaggguggaagaaaaguuuuagauccaugaaauccuuaucauuggaaagacaguccaaacugacuaagaagagguagaaguucugcucuaggugagcuuaucauggccauuccugauaaggauuaggauuugugccagagucaaccaaaccauccauugggguagaaggagaggaacuucuugagauacugauuaguauuguaguuacaucagagcuuagaucaaaagcagcugcuauuucugacuccucagugguccccuggaacuagggugaggcauggguuucaguccaagcacacuucuuccauuaaugaucauagagugccuggaauaucacaggacaucuuucaucacugagggauaaaaugcuccuccaccucaggcaugaacuuaaaagauaucuucauugaggaacacagauauuuuauugcuauuuuuauaaagucucugauuauaauaggaaauagagcacuuggcauauauaaauaaaauucauauauuaguuggaaagagaccacaauauaacuuuuuggaaguugcuuuaacaaucccugguuuuaggcugagcgcgguggcuuacgucuguaauuccagggaaggcgagguggacggaucuccugaggucaggaguuugagaucagccuaaccaacauggugaaacuccgucucuacuaaaaauacaaaauuagccaggcaugguggugcaugccuguaaacccagcuacucaggaggcugaggcaggagaaucgcuugaacccaggaggcggagauugcaguaagccgagaucaugccauugcauuccagcuugggcaacaagagcgaaacuccaccggaaaaaaaaaaaaaaucccugguuuugagaacguuaccaauuuuuuguuuuaccuguuccuccuuaauuuuuuuuuuuuuuuuuuuuuuuuuuuuugagacggaguuucgcucugucgcccaggcuggagugcaguggcgcgaucucgacucacugcaagcuccgccucccggguucacgccauucuccugccucagccucccguguagcugggacuacaggcgcgcgccaccaugcccggcuaauuuuuuguauuuuuaguagagacgggguuucaccguguuagccaggauggucucgaucuccugaccucgugauccgcccgucucggccucccaaagugcugggauuacaggcgugagccaccgcgcccggccauccuccuuaauuuuuaacucaggaaugugacuugcuuaaucucuccagcaguagcuccuuugguaucacaaacaagaaccuaauugucaugggcuuucuucugcagaacaaaauguugccuuguaagauauuuucacauucuguaguuuaccucaaauuuaucaaauucacugauuuuaauauuucccuuucucccuaccuaauugcucugauuuuucuuuucuacucaaauucuuccagaagguauucugucugaucaaugagcucaauuuucagccugcagcuuuauaauacauuuucuaggggccuugagcugacuauugugaacaacuauccuguuccaucuuccuuaaguguucugauuaugcauaauugagaucucaucauucagcuaaaguuguaaguggcuucucucuucuugaacuaauguuaauauaguuuggguccuugucauauccauucccuguugugauaaauuguaaaauguagccacaagaucuucccaugauccuuugcaaugugacuuugcccuuccuuccaucaagagaucagcuauauccccaccugcugaaucuaggcugauuauuauuauuauuauuaauuuuaagacaggaucuggguguguuacccaggcuggagcgcaguggugcaaucuuggcucacugcaaccuccaccucccaggcucaagccauccucccaccucagccucccuaguagaugguacuacaggugugcaccaccaugccuggcuaauuuuuguauuuuuuguagagacgggguuuugccauguugcacaagguggucucuaacucaugagcucaagcaauccgccagccucagccucccaaagugcugggauuacaggcgugagacaccaugcccggccuaggcugaucuuuugacuugcuuugaucaacagaaugugacagaagugaugugauaugacuuccaaagcuagacauuagauacauugcagcuucugcuuucacucucuuaugauacgguccugagacugucauguaaggaaguucuucuagcuuaccagagaaugagagguuucaugaaaaaauaaccaagguacccacccaguggacugccagcaccagcugccagauggguaagugaggccaucuugaccuuccagcccaaccaccuccuacugaaugcagccacaagagcaagcccaggcaaaaccagcaguuaacugucagcuaacccagagaauaguaaaaaaugauaaaccacugcugcucuaaaccacuacguuuugagguuauuuauuaugcaguaauagcagcuagaacugccuucucugucuuucacuuucugaccuuguugagccccuggcucuucauugacuaauccagauaauacaauuucuuuucuauuacuuuucuccucagugucaaacuuaagagaauuauucauaacuuuagcaucaucguuuuuauaaucaagagauucuuuccucuccuuuuggaaaccuaugaugugcuuucaguuguuccugaacuugguguuuuggcuauuucaacuuccuauaagacagaagcuaugcuucacuuucgcuucaagugcuuuugccucgugaagagcuuuuuuuuuuuuuuugagacagagucucaaucugucacccaggcugaagugcaaugacacgaucucggcucacagcaacuuccaccucccagguucaagcgauucuccugccguagcccccugaguagcuggggcuacaggugcgugccaccaugcccagauaauuuuuguauuuuuaguaaagaugggguuccaccauauuggucaggcuggucucgaacuccugacuucgugauccgcccaccucagccucccaaagugcugggauuacagauaugagccaccgugccuggccaugaagagcugucuuaccucuaagaaauuuucuaaauucuuguucauuauuuuaauaugaacuuaaacuugucuacaaauugccuuacauuuucuucuuggccuacaccacagcaaguacauuuuccucuggcuuuagguuacucuuuuuuuuuuuuuuuuuuuuuuuuuuugagaaggaguuucacuguuguugcccaggcuggaguacaauggcacaaucuuggcucacugcaaccuccgccccccugguucaagugauucuugugccucggccucccaaguagcugcgauuacaggcaugcaccaccacacccggcuaauuuuguauuuucaguacagacaggguuucaccauguuggucaggcuggccucgaacuccugaccuaaggugauccucccaccucagccucccaaagugcugggauuacaggcaugagccacugcgcccagccagguuaccuuuuuuuaauuuuauuuuuuuauuuuuuugagacaggcucucacucuguuguccaggcugaaaugcaguggugcaaucauagcucauugcagccuugaauuacugggcucaagcaauccucccgucacagccucccaaguagcugggaccacaggcaugcaccaccaugucugguuaauuuuuuuuaauuuauuuuuuguagagauggggucucaccauauugcccacacuuagaugacuuuauuaguguuaccugauuuuauccagccccaucaugagaaagauacauguaguccuauuuuguuggcuguucucuucaaauuaguuauuagcucaugaaacuucuauugauauccugacaccuuuuuaaggauuccuggccaggcuugguagcucacgccugcaaucccagcacuuugggaggcugaggugagugaaucaccugaggucggggguucgaaaccagccuggcaaauauggcgaaaccccauuucuacuaaaaauacaaaauuagccgggcgugguggugcaugccuguaaucccagcuacuugggaugcugaggcaggagaauuacuugaaccuaggaggcagagguugcaggaaggcgagaucgcgccauugcacuccagccugggcaacaagagcaaaacuccauuucaaaaauaaaaauaauaauaauaagcuugcaagugugcucuuugugaaauuccaccauggcauacaguggccagggccagaaagugcagaagguuauggugcagcccaucaaccucaucuucagauacuuacaaaauagaucgcagauucagguguggcucuaugagcaagugaauaugcagauagaaggcuguaucauugguuuugaugaguauaugaaccuuguauuagaugaugcagaagagauucauucgaaaacaaagucaagaaaacaacugggucggaucaugcuaaaaggagauaauauuacucugcuacaaagugucuccaacuagaaaugaucaaugaagugagaaauuguugagaaggauacaguuuguuuuuagacguccuuuguccaauaugaacauuuauucauauuguuuugauuacacuuauguuuuuacaagauggcaauaaaugcugugggauuguuuguauuaaaacuaauaauacuaauaauaauaauaaaucuuuuuuuuuuuuuuucugagacggaguuucacucuuguugcccaggcuggagugcaauggcguaaucucagcuccccgcaaccuccaccucccagguucaagcgauucuccugccucagccucccuaguagcugagauuacaggcaugugccaccacuccuggcuaauuuuguauuuuuaguagagacaggguuucuccauguuggucaggcuggucuugaacucccgaccucaggugauccaccugccucagccucccaaagugcugggauuacaggcgugagccaccacgcccagccaauuccuguuguuuuuuuuuaauuguuguuguuuuuuguuuguuuguuuguuuuuuuuuugagaccaagucuugcucuguuacucaggcuggagugcaguggugcgaucucugcucacugcaaccucugccucccggauuaaggugauuccccugccucagccucccucauaggcgcaugccaccacacucagcuaauuuuugugguuuuaguggaggcaggguuucaccauauugcccaggcugcucucgaacuccugggcucaagugagccaccggccuuggccucccaaagugcugggauuacaggugugagccacagcgcccagccucuguucuuuccuagaaagaaauccuccacagacuaaagggcaaaugccaguaaggcagugauagggacggcauuccagggcacucccucuaaauucuagaucagagcgggcugcucaagcagcaaaggcccugcucuaaguugugcaggcaaagauuuucuggagcagugguucucaaaauuuguuccagaaacuggcaagguuaaaacuauuuuuauaauaauacuaugacauuaucugacuuuuccguucccauucacucaggagcauacaguggauuguuuccagaaaacuccauugcccugaaagcuaagauaauguguauuucuauauucuuuuuuuuuuuuuuuuuuuugaaucgcccugucauccagguuggagugcaguggcgcgaucucggcucacugcaaucucugccuccugaguucacacuauucuccugccucagccuccggaguaguugggacuacaggcgcccaccaccacgcccagcuaauuuuuauguauuuuuaguagagacgggguuucaccguauuagccaggauggucucgaucuccugaccucgcgauccgccccucucggccucccaaagugcugggauuacaggcuggagccacagugcccggccaucuauauucuugugucuuaaauuguucucagguucuuugguugguugguugguugguugguuugguuuuuuggagacagagucuugcucuaucacccgggcugaagugcaguggagugaucuuggcucauggcagccccaacucccugggcucaagcaauccucccaccucagacuccugaauagcuggaaccagaagugugcaccaccacaccugacuaauuuuuuucuuuuucuuuuuuuuuuuuuuuuuuuuuuuuuugagacggagucuagcucuguggcccaggcuggaguucaguggcaaucucggcucacugcaagcuccgccucccggauucacgccauucuccugccucagccucccgaguagcugggacuacaggugcccgccaccacgcccggcuaauuuuuuguauuuuuaguagagacgguuucaccguguuagccaggauggucucgaucuccugaccucgugauccacccaccuccgccucccaaagugcugggauuacaggcgugagccaccgcgccuggccuguuuuuuucuuagagacgagguuuugccauguugcccaggcuagucuggaauuccugggcucaagcgauccucccaccuuggugucccaaagugcugggauuucgggcgugaggcaccacacuuggccuaaacuuuucuguuuuaaaauacaaaaugggccgggcgcgguggcucacgccuguaaucccagcacuuugggaagcugaggcgggcggaucaccugaggucaggagauccagaccauccuggcuaacacggugaaacccugucucuacuaaaaauacaaaaauuagccgggcguuguggcgagcgccuguagucccagcuacucgggaggcugaggcaggagaauggcgugaacccgggaggcagagcuugcagugagccgagauugcuccacugcacuccagccugggcgacagagcaagacucggucuccaaaaaaaaaaaaaaaaaaaaaaacauauauauauauauaauggcuggcugggcacaguggcucacaccuguaaucccagcacucugggagaccgaggugggcagaucacuugaggucaggagugugagaccagccugguuaacauagugaaaccccgucucuacuaaaauacaaaaaguaugcugggcgcgguggcucaugccuguaaucccagcacuuugggaggcugaggcaggcggaucaccugagguuggggguucaagaccagccugaccaacauggugaaaccccgucuguacuaaaaacacauuagccagguaugguggcacaugccuguaaucccagcuacucaggaggcugaggcgggagaaucacuugaacccgugaggcagagguugcagugagcugagaucacaccauugcacuccagccugggcaacaauagcgaaacuccaccucaaaaaauaaaauaaaauacaaaaaggagccaggcaugguggcaugcacuagucccagcuacuggggaggcugaggcaggagaaucucuugaacccgugaggcaaagguugcagugagccaagaucacgccacugcaccccagccagggcaacagagugagacuccgucucaaaaaaauaaaauaaaauauaauguaauguaacauaauacaauaaauauaguauggcauuuuuuuuuuuuuuuuuuuuggagacaggaccacauucucuugcgcagaggugccaucacaccuccucugugauccugagcuacagcaauccuccagccucagccucccaaguagcugggacuacaggcacacaacagcacaccagcgaauuuuuuauuuuuuguagagacagggucucacuauguugcccaggcuggucaugaaccacugugcucaagcgaucuuccugccuuggccucccaaagugcugggauuauaggugcgagccaccaucccuggccuaaauuuuucucaguuuuaaaauauaacaaauacugauggaaauacccaugaagacaauuuucaacauuaagaagguuugagaccagaaaguuugagaacuguagauuggagggaacauuaucauaacaaagaucaaauuuuccuugacucucaauccugagaugcuccuuugacuuuaaggccucuccuuccuugggauguuugacccagaaaauggggucaaaaacugcugcugcaaacaucuccagugccaccacccaaggucuggggagaccuauugggucaaaggugaaagggcagggaaggagagggaccaggagguggaggaggaggaauaggaggaggaagagggcuggccgugcaccuccaucccauauaucugcuggaggcauguuucugcaggguauuagccccaccuagcucucucagugccccagguauccccugcucuccccaccccccaccuugcccuggugccuucugcaguccuucucccucucagcaucccaaggacucuucugcuuccccacaacccuggagcacaccacuccuggagucugugugcccaaaccuccaacaaggacaauaaagacaaccuuaccuggcagaaauuaagcuguuggcugaggguggcagcucaugccuguaauccuaguacauugggaggccaagaaggaggauugcuugaggccaggaauucaagaccaaucugaccaacauaguagacccugucucuauuauaaauauuuuuaaaaauuaagcuguuacuaguuuuuucuuuuucuuuuuuuugagaugaagucucacuuugucgccacacuggagggcaguggugcgaucucagcucacugcaaccuccgccucccagguucaagcaauucuccugccucagccucuugaguagcugggauuacaggcgcacgccaccaugcccagcuaauucuuguaguuuuuaguagagaugcgguuucaccauguuagccaggauggucucaaucucuuaaccucgugaucugcccgucucagccucccaaagugcugggauuacaggcaugagccacugugcccggcagcuguuacuaguuuuuuaaggagaucacaugugaauuagauccugaguucuccuauguuuggaaauaauuuuuuuccaaacgcuguugcuauugaggcuccagaagucagucugccuccccacccaccccaccccuuagagguaacaaaguguuguuaucuggaugaagcugauuuuuuacauagaacuggagaggggccggauauggugucucacaccuguaaucccaauaauuugggaggccaaggugggaggauuguuugagcccaggaguuugagaacagccuggguagcauagcgagaccuuauuucaaaaaaaaaaaaaaauuggagaggauuucacauuagugagucacuuagcugucaggugucccccaccccaacaagucaagugaauuugacuagcugcagauuccauauagaaagcagaaaaucugggacaggcauggugacucacgccuguuaucccagcacuuugggaggccaaggcagguggaucgcuugagaccaggaguuccaaaccagccuagccacaugacgaaacccugucucuacuaaaauacagaaaaauagccaggcuugguuguacacaccuauaaucccagcuacuagggaggcugaggcagaagaaucacuugaauccaggaggcagagguugcagugagccaagaucccaccacugcacuccagccugggugacagagugagacucccucucaaaaaaaaaaaaaaggaagcagaaaauauuguguuauucuuuguucuagcuucuccuuacuuaauaacaguuaacaacaacauaagauaacugugagacuaaagaugcacacucuugauaauccuuguugcucauuaacucaguaaaugaaaaugugccucauaccucccgugugcccugaauugugcggggugcugguuauaguuaugugcaagguagauguaauuuugcuugaacgaagugccucagugaugucguugaagggguaaagcccccaccacugacaaaaccauuucagucgaccuaauuucauuagcucuacuuaagacaagaggauugauugauuaccuagcagcuguauuguuuagucuguuucaucccuuauuauuuucauauuaguaauccuuugucagcagcauuuuuuucuacaaggaugucucuuaaaagccacacuuauguuugcugauugauuuuuuccuuuuuagaccuagaccuaggauuuuuguuuuauuuuuuaaacugagccucgcccugucacccaggcuggagugcaauggcacaaucuuggcucacugcaacuuccaccucccggguucaagcgauuuuccugccucagccuccuggugagaccccaugggucuccccagaccuuggcuacugacacugaagauguuugcggcagcaguuuuugaccccauuuucugcgucaaacuccccaaggaaggagagggagccucaaggagggccuuagagucaaaggccccgggguucaagcgauucuuagaucgccccacugcccuccagccuacucaauugagugagacuccuucuaaaaaaaaaaaaauuccccaccccaccaaaauaaaggagccugaggaaucugugaacaauaccaaagggcugauauucaugacaucagaguuccagaaggaaaggagaaaaagugcaguacaaaaaaaaaaaaaaaguugaagaaacaauggcuaaaaauuuucuaaauuuuggcaaaagacaauaacugauacucacgaaggccagcagaaccuuaacagaaaaaacccagagagucucucugaacuaacucuguuucagggggcugcuugauaauaaaauaaauaaaugaauaaaaaagacagauccaaaugaauccaaauugagauagauugcaaucaaacuuugaaaauauagacaaagaaaaucuugaaaauagccagggaaagauaauguauugcccacugcauuccagcacucuggggggccaaggcgggcggaugacgaggucaggaguucgagaccagccugacuaacuuggugaaaccccaucucuacuaaaaagaccagccugacuaacauggugaaaccucaucucuacuaaaaauacaaaaauuagccaggcaugguggcacacaccucuagucccagcuacuagggaggcugaggcaggaaaaucgcuugaacccgggagguggagguugcagugagccgagaucacuccacugcacuucagccugggugacagagcaagacuccgucuccaaaaaaaaauuaauaaauaaauaaaaacauuuuauuauuguuuuugagccauuagaaaaaaaaaagaaaaaacuguauuuguguguguguguguguguaacaacauuuuaaaaugcuuaacaggccaggcaugauggcucacguggauaaucccagcacuuugggagaccaaggcaggugaaucccuugagaccaggaguucaaaaucagccugggaaacauaguuagacccugucucuauuauuuuuaaaaaguaaaaaaaaaaagugcugaauaaaaagugucaccaaaagacaaaaaaaaaaaaaaaaaagagcugccaccucaaaauucaaugaaaauauucuucaggaauaaagaugaaauaaagacaugcuuagauacaaggaaacuaagagaauguguugcaaacaaaacuccucugaauaaauugccauaaguucagauauaagagaaauuacaucagaaggaagcuaggaacauaagaaaugaaugaagaacaauaaaaaggcuaaauacccgaguaaauagcauguacccggguaaauagaauauucuuuuccucuugaguuuuuguuuuuguuuuuuguuuuuugagauagagucucgcucuguugcccaggcuggagugcagugucgcaaucucugcccacugcaaccuccgccucccuaguucaagcgauucugcugccucagccuccugaguagcugggacuacacgcacgcaccaccaccuuggcuaauuuuuguauuuuuaguagagauggguuuucaccauguuggccaggaugcucccauucuccugaccucaugaucuacucgccucagccucccaaaaugcugggauuacaggugugagccacugugccuggccugaguuuuuaaaaauauauuucauaguugaaaacaaaaauuaagguagacggaucaugaggucaggaguuugagaccagccuggccaacauagugaaacccuaucucuacuaaaaauacaaaaauuagccaggcaugguggcaugcgucuguagucccagcuacucaggagacugaggcagaaucacuugaaccugggaggcagaguuuguggugagccgagauccucccacugcaauccaacuuggacaacagagugagacuccgucucaaaaaaaaagaaaauaauuauacuacuggcuggauacaguggcucaugccuguaaucccagcacuuugggaggcugaggugggcgaaucacuuggggucaggaguucgagaccagccaggccaacauagugaauccccaucucuacuaaaaauagaaaaauuugcuggaugugguggcgcgcgccuguaaucccagcuacuccggaggcugaggcaggagaaucgcuugaacccaggagauggagguugcagugagccaagaucgugccacugcacuagauccugggcaacagagcaagacuucaucucaaggauaaauaaauaaaaauuaggccgggugaaaggccaggcgcaguggcucacgccuguaaucccagcacuuugggaggccgaggugggcggaucacaaggucaggagaucaagaccauccuggcuaacacggugaaaccccaucucuacuaaaaauacaaaaaauuagccagguggggugacgggcgccuguagucucagcugcuagggaggcugaggcaggagaauggcgugaacccgggaggcggagcuugcagugagacgagauugcaucacugcacuccagccugggcaacagagcaagacucugucucaaaaaaacaaaacaaaacaaaacaaaaaauuaggcuggguguggugucgcacaccuguaauuccagcacuuugggaggccaaggcaggcagaucaccugaggucaagagaucgaggccauccuggccaaaauggugaaaucccgucucuacuaaaaauacaaaaauuagcugagugugguggcgcgcgccuguagucccagcugcuugggagacugaggcaggagaaucacuugaacccacgaggcagaaguuucagugagccaagaucacaccacugcacuccagccuggcaacagagugagacuccgucucaaaaauaaauaaauaaaaauaaauaauaaaaauuaauuaugagauagcuuuuacuuugcuauuuauucauuuuuauuuauuuuagagaugggggucaugcuauguugcccagggcagucucgaacuccuagcaauccuuccuccuuggucucccaaagugcugggauuacaauugugagccacauuccuuccagcuuacugggcuauuuaaagguuucuaauacuaccauauccugcugaucaaaagcucuaacuugcaaaaaaaaaaaaaaaaaucuacccugcauaucaauauacucauaucuaucuaucuagcuaucuaaaacugugaguaaaaccaaauggguaaccacauuuaaugcuacuuuacuggauaauguuauuugaugcugagaaguuuuaaaccugguguccaggagugaagccuuaguguaaacacaugauuguguccagugauuugucauuuuacaaaucccacacuagauggcagauuuuaaacaggauuuucugggucacaaauuaauuaggaaaaaaauggcuaggcacgguggcucacaccugugaucccagcacuuugggaggugcagggggacaggucaccugaggacaggaguucaagaccagccuggccaacauggugaaaccccauaucuacuaaaaauacaaaaauuagcugggcauggaugugggcgccuguaaucccagcuacucgggaagcugaggcacaagaaucgcuugaacccaggaggcagagguugcagugagcagagauuucaccacugcacuccaauuuaggugacagagugagacucugucucaaaauaauaauaauuaggaauaucuacauauagaucugcaaaggaaaaaauccggauguggaggcucaugcccguaaucccagcacuuugggaggcucaggugggaggcugaggugggagaauaaauugagcccaggauuucgagaccagccagggcaaacauggggaaaccccaucucuacaaaaaauauagaaauuagcugggcggccaggcgugauagcucaugccuguaaucccagcacuuugguggaucaccugaggucaggaguucaagaccagccuggccaucacggugaaacccugucucucaaaaaaaaaaaaugaaaagaaaagaaaagaaaaauuaguugggcgugguggcaugccccuguaauccuagcuacccaagaggcugaagcaggagaauugcuugaaccaagaucaugccacugcacuccagccuuggugacagagcgagacucugucuugaaauaaguaaaugaauaaauuagcugggcgugguggugcccaccuguggucccagcuacuccagggugcugaggcaggaggaucaccugagccuugggaggucgagacuccagugaccucugaucuugccauugcccuccagcuugggggacagagugaggaccugucgcccaagcuggaguacaguggcaugguuucugcuaacugcaaccuucgccucccagguucaagcgauucuccugccucagccucccgaguagcugggauuacagcaugugccaccaugcccuucuaauuuuguauuuuuaguagagacgggguuucuccauguuggucaggccagucucaaacuccugaccucagcugauccaucugccucggccucccaaagugcugggauuacaggugugagccaccaggcccggccagcaucuguuuuuuaguuuaguuuaguuuaguuuaguuuaguuuaguuuaguuuaguuuuugagagggaguuuuggucuuguugcccaggcuggagugcaauggugugaucucccucacugcaaccucugccucccggguucaagugauucucaugccccagccuccugaguagcuagaauuacaggcaccugccaccaugcccagcaaauuguugguauuuuuaguagagaugggguuuugccacguuagccaggcuccgaacuccugaacucaggugauccaccugcuucggccucccaaagugcugggauuacaagugugagccaccuugcccagcccagcaucugucauuuuuugacuuuuuaauaauagucauucugacuggugugaguuuguaucucauugugguuugcauuucuuuaacgauuagugauguugaacauuuuuucauguuguccaaguguaugucuucuuuugaaaauuaucuguucauguccuuugcucacuuuuuuuuuuuuuuuuuuuuuugagaugaagucucacucuugucccccaggcuggaaugcaauggugugaucccggcucacugcaaccucugccucucggguucaagcgauucuccugccucaggcucccaaguaacugggauuacaggugccugccaccaugcccagcuaauuuuuguauuuuuuuuaguagagaugggguuucaccagguuagacaggcuggucuuaaauuccugaccucaggugauccaucugccucggccucccaaagugcugagauuacaggcaugagccacugcaccugaccguccuuugcucacuuuuuuaaugggguuguuuguuuuuuggcuuguuaauuuguuuaaguuccuuauggauucucgauauuagaccuuuguuggaugcauaguuugcaaauauuuuuucccagucuguagguugucuuuuuauucuguugauaguuucuuuuacugugcagaagcucuuuacuuuaauuaggucccguuugucaauuuucuguuucaauuuaauuauauuuauuuguuuguuuuuugaaaauagagacaagaucuugcuaugcugcccaggcuaguccagugggacugaaaaacuuuuuuuuuuuuuuuuuuuuuuuugagacagaaucucgcugugucgcccagucuggaauguaguggugugaucuuggcucacugcaaccucccccucccagguucaagcgauacuugugccuccgccucccaaguaucugggacuacaugugugugcccccaugcccggcuaauuuuguauuuuuuuguagagacgggguuuggccaugguggcccggcgggucuugaacuccuggucucaagugaucccccagacuaggccuccaaaaguucugggauuacaggcgugagccacugcuccugguggauacugauuucuguauacugauuuuguauccuaaaacuuugcugaaguucuuuuucagaucuaggagcuuugggacagagccuuugggguuuuuuagguauagaaucacauugucuacaacagagauagucugacuuccuaauugagguucccaaaccucaauucuugacuucugugcacccauaggcucaacaccacauggacgcugccaacucuuagagcuuccacccucugaaggaacagccugagcuguaccuuggccccuuuuagucauggcuggagugucugggaugcagggcaacaagucccuagacugcacacagcacaggaacucugggcccagcccacagaaccacuuuuuccuccuaggccucuggaccugugaugggaggggcugccaugaauaccucugacauucccugaagacauuuuccccauugucuuggggauuaacauucagcuccucauuacuuaugcaaauuucugcaucuggauugaguuucuccucagaaaaugagauuuucuuuucuguugcauugucagguugcaauuuuccagucuuuuaugcucugcuuccuuuauaaaccugaaugccuuuaacagcacccaagucaccacgcgaaugcuuucaugcuaggaaauuucuuccaccagauacccuaagucaucucugucaaauucaaaguuccacaaaucucuagggcagggguaaaaugcugccagucuccuugcuaaaacauaacaagagucaccuuugcuccaguucccagcaaguuccgcguuuccaucugagaccaccucagccuggacuuuauuguccauaauacuaucagcauuuuggucaaagccauucaacaagucucuagggagugccaaacuuucccacauuuuccugucuucuucugagcccuccaaacuguuccaaucucugccuguuacccaguuccaaaguagcuuccacauuuuuggguaucuacagcagugcccugcucuacuaguaccaauuuaauguaugaguccauuuucacgcugcugauaaagacauaccugacacugggaagaaaaagagguuuaaugaacuuacaguuccacaugggugaggaggccucacagucuuggcagaaggcaaggaggagcaaggcacgucucacauggauggcagcaugcaaaaaagagagggcuugugcagggaaacucugguuuuuaaaaccgucagaccuaaugagacucauucacuaucaggagaacagugcaggaaagcccugacccauaauucaaucaccucccaccagguuccucccaugauaugugggaauuaugggaguuacaauucaagaugagauuuggguggggacacagccaaagcauaucacugcugucaagcaaagcugagagauuuaauugguaaagaaacaacaagcccuuuuuagauucaggcaguuuaauacugauagcaauacuaagauuggcaaagaugccagcgcccuguguccauuuuccuaccagacaacaccaaaacaaaagaggucaggugauaaugcaacaugggugaugggagcucuguuucugcagagccaauuucacacuaagcaguuugaugggaugcuggggggugggggcggggacagguguagccucuuugccuaauuguccccuagcacugcccagucauugcauaggcugcuggaaccaugaagauuugaacuuuggagcaucucuuugaccacccaugagaaacucuuacaauagcugcaaugcaguaauacccaaacccuaucaacuugagugugguuggaguugauguguuagacagacauauagaucccucugaaaaguugcacagccacagacuuagcacagacuggggacuaccuuccauugugaagucucuuauuggugcaagaaacaaaacauuuguguaagaacauucaguaguugauccuguagagaaaacaauggaacaggaaucuaccaacauuucauuuacaaacauauuuuaaguaggugagaggcuuauauacaagucacauccucaggacacagaaaaaauccuauuuugacucaggaagccauaaucacugugaaaggagucagccucggcaauuacuuugcaggacugauggcaaguauguuaucuccaaaugcuaauaaagggcaagaaacagaggaaugcaggccaggcauggugacacacuccuguaaucccagcaccuugggaggccgaggcaggaggaucaccugagaucaggaguucgagaccagccuggccaacauggagaaacccugucucuacuaaaaauacaaaauuaacugggcgugguggcgcaugccuguaaucccagcuacucgggaggcugaggcaggagaaucacuugaacccgggaggcagagguuguggugggcugagaccacgccauugcacuccagccugggcaacaagagcgaaacuccaucuaaaaaaaaaaaaaaaaaaaaaaaaccaaacauggguuuacauaacuuuccacuccuuuuucauccugaucacuuauccagguagcagccuagaaaagaucaaucucuuucuggggacagcugcauuuaaucacuaaauuaaggugccuuguuaaguugugugugucagaggcauuugaaccagaccaacuccaucuugaauaggggcugguaaaauaaggcugagacccacugggcugcauucucagacgguuaacgcauucuaagucacaggaugacauaggaggucagcacaagauauagcucauaaagaccuugcugauaaaacaggcugcaguaaagacgccggcuaaaacccaccaaaaccaagaugugagcgugaccucugguuguccucacugcuacacucucagcagcgccaugacaguuuacaaaagcuauggcaacaucaggaaguuaaccuauauggucuaaaaaggggaggcaugaauaauacaccccuuguuuagcauaccaucaaaaaacaaccauaaaaauagacaaccagcagcccuuggggcugcucugucuauggaauagccauucuuuuauuccuuuacuuucuuaacaaacuugcuuucucuuuacacuacggacucucccugaacucuuucuugcgcgagauccaacaacccucucuuggggucuggaucgggaccccuuuccuguaacauguauaccaggagaaaggaaguagagucaagguaucaguucacuguugcaaacugcaucuaauaccaaaagccaaacgcaagaaguuagcagcaguaagauggcccugagacaggguccagagucugaucucucaguacugggugaaagggucacacuugcugagaugugcccucccacagugugcagcuuuagcaggaaucacuacuuagaaaugcaaacagucucuguaacagaaacaaagagccaaugagcagaucaauuucagauggucccaucagaaauaagccccuuucuguaggcaauugugacccagcugguccagccagcauccaugauguuuucacagcuuugucuuucgagucaaaucugcaacugucccagagccugaguuuuguuuuuuaagcagagcaacuuugucaaauuugguuugucuuagcuagcuaauaggcaagccagcccagaaaacuugucaguuacaaacuuucucugaaaacaaaacaaaacuggaugaggucucuaucuucuuuuauguccuugggagcuugaccuuguaaccacguggugguacuuucuuuuuuuuauuuuuugagacggagucuugcccugucacccaggcuggagugcaauggcaugaucucggcugacugcaaccuccaccuccugguuucaagcuauucuccugccucagccuccccaguagcugggacuacaggcgugugccaccacguccagcuaauuuuuguauuuuuaguagaaacaggguuucgccaugcuggccaggcuggucucgaacuccugaccucaaaugaucugcccaucucggccucccaaagugcugcaguuauaggcgugagccaucacacccagccaccacguggugguacuuucuuuuggucucugccauuuuacaauagagggcuggguucaaucccgguuuaggaagugaguacuuucugguugauaccugugugaccuucaccauuuguugauucucuuccccugcaugaacaaugucuggcuucccuccuuaaccuucuuaaauuuuccuuucuggcugggugcgguggcucaugcccguaaucccagcacuuugggaggcugguuuccaacuccugaccucaggugauccacccaccucggccucccaaagugcugggauuauauacaggugugugagccacaacuuccggccucauucuuuuuuuuuuuuuuuuuuuuuuuuuuuuuuuuuuuuugagacagagucuugcucugucacccaggcuggagugcaguggcaugaucucagcucacugcaaccuccgcuucccggguuccagcgauucuccugccucagccucccgaguagcugggacuacaggcgcccaccaccacgcccggcuaauuuuuguauuuuuaguaaagaugggguuucacuguguuagccaggauggucucaaucuccugaccucgugauccgcccaccuuggccucccaagugcugggauuacagaugugagccaccacacccagccccagccucauucuuugaucuauuugauuuuaggugguuugguuuauggggacccuggguaaggaacauacuccaaacuguugguauuauccuccugauagugaugauaauagucucccuggugcacuguauucucccaaagguuuuaaauguuuacaugcagccaucucuagaaugucaaauggucucuguucaacuggaaugacaagagcugaaagaaaugugcaaccaugaggacacaguaaccuauaaaugacacacugaggccagaaacccaaaauggugguaacggaaaauggcgcuaaggcccuaaguucuggucacacugucagcuaagugagaaccugaccagaaagggauaauuuuuuuaaacaaaauuauggaaggccauuguuuugaacugagcucaugcgcuaggccccaacagaccaaaccaaacaaaaauggaguugcuuggccgggcgcaguggcucaugccuguaaucccagcacuuugggaggccgaggugggcggaucaccugaggucaggaguucgagaccagccucaacauggagaaaccccgucucuacuaaaaauacaaaaaaaaauuagcugggugugguagguagugcaugccuguaaucccagcuacucaggaggcugaggcaggagaauugcuugaaccugggagguggagguugcggugagcugagaucgugccauugcacuccagccugggcaacaagagugaaacucagucucaaaaaaaaaaaaaaaaaagcaaaaaaaaaauguaguugcuucuguuaaaugugacauaaucaaaugaagacuuuaaggaaacucauagauccuagaacagaccacguuuuguuuuucuccuguaaacaugacguucccaguauaagaagguacccucuacugaguccuuguucccaccuugcaaagcccacaguguucuguuucccagugaguuucaauaucaaauaaguacauuuaugacggugauagugacaucaaugacucaaguuuuggucaaucucuaaaaauugagaaaaugaccaaaagagggugauuguuaaagcgaacuaaggauggccugagaaggacucuguacuucuguauuugaguccuuuuggucaagcugcaaccuaacuaaauagguacacaagauugaaaacuaaauuaggaguauuugccuguaacaagagcugagucuuggcccaucccagcagccauacuucaaccacucauacacugcggaguguucaaacuguucaaauaaggcaaacgcggagcuguaacgaauccacuuaaggaccucaccucugauuucuauagucacuucucuuuuuugucuguaaauuuguucugaccaugaggcaucccuggagucucucugaauaucugcugugauucugggggcuaccugauucaugaaucauucauugcucaauuaaauuauuauuauuauuacuuuuuuuuuuuuuugagacagagucucgcucugucgcccaggcuggagugcaguggcacgaucucggcucacugcaagcuccgccucccggguucacgccauucuccugccucagccucccgaguagcuggaacuaggggugcccgccaccacgcccagcuaauuuuuuguauuuuuaguagagaugggguuucaccauguuagccaggauggugucgauuuccugaccuugugauccuccugccuuggccuccgaaagugcuggaauuacaggcgugagccaccacgcccagccgcucaauuaaauuauuuuaaauuuaauucaguugaaguuuuucuauuaacaagcccauacuauaaaguaucaaguuucagcuuagaaucagguccaggaaauuaggaucaggauuccgaaaagcccuguugcuuuuucuucgcagaagcaaagccaaaaugcugcaaggccucauggccauauuccaggugcaacugacaagccuuuuuuuuuuucuuuuuuuuaagacugagucucgcuuuguugcccaggcugcagugcaguggcacaaucucggcccacugcagccuccauuuccuggguucaagcgauucuccugccucagccugcagaguaguucggacuacaggcgugcaccaccgcauccagcuaauuuuuguauauuuaguagagauuaauuuucgccauguuggccaggcuggucuugaacuccugaccucaggugauccgcccgccucucccucccaaagugcugggauuauaggcauaagccaccaugcccggccuaaggaaggcuuuauuaagccuuuuuuaucucgucaguauuuaggcccaaagugacccacucagaaauaugcacaucuggcuggaaaucauuagcuuuuaugggucagacaucugauuuuacaagagcucauuagcaacuaaaaucaguuuuuuaaaacucuaaaaguauauuuccauauggagaguaccuccuuuuuaauguuauuuccuuuuuuccagaggcuccaauaggcaagacauacagcaaaaauaaucaguuauggagauuuguuuuuuuuguuuuugagacagggucucugucauccaagcuggagugcaguggcgugaucuuggcucacugcaaccuccgccccacuccccugggcucaagcaguccucccaccaaagccuccuaaguaacugggacaacaggagcgugccaacacaccuggcuaguuuuuuguauuuuuaguagggauaggguuucaccauuugcccaggcuggucuugaacuccuguacucaagcauuccaccugccucagccucccaaaguacugggauugcaggcauaagccacaacgucuggcccuguuucuuccauuuauuucuuuucuucuucuuuuuuuuuuuuuuuuuuuuuuuggagacggagcuuugcucugucgcccaggcuggagugcaguggcgugaucucggcucacugcaaccucugcuucccggguucaagcaauucucugccucagccucccgaguagcugggauuacagacacccaccaccucacccggcuaauuuuuuguauuuuuaguagaggugggguuucaccaucuuggccaggcugaucuugaacuccugaccucgugauccauccaccucgaccucccaaaguacugggauuacaggcgugaaccaccgcgcccagccuucuuccuuuuuuucauacaauuuuuuucuggccacacauuaaugagaauacuuuuuguuuguuuuguuuuguuuuuugagauggagucucgcucugucaccuaggcuggaguguggugguacaaucuuggcucacugcaaccucugcuucccggguucaggcgauucuccugccucagccuccugaguagcugggauuauaggcaugcgccaccaucccuggcuaauuuuuguaauuuuuaguagagaugggguuuccccauguuggucaggcuggucucgaacuccugaccucgugauccgcccgccucugccucccaaagugcugguauuacaggcaugagccacugagcccggccaagaauacuucguuuuuuguuuguuuguuuuuucagaguaggagucuugcuugcccgggcuggagugcaguggcgugaucucaguucacugaaaccucugccuccugaguuuaagcaauucuccugccucagccuccugaguaguggggauuucaggcgcguuccacugugcccagcuaauuuuuguacuuuuaguaaagacagaguuucaccauguuggccaggcuggucucaaacuccugaccuugugauccacccgccuuggccucccaaagugcugggauuacaggcgugagccaccacauccggccaagaauacuugguuuuuaauacucagagaauuuaaauacgaacccacccaccaauggcaagaagcaauuauuuauguaucccacuaacacuuuuucuuugcagcugucccugauugggaugguucccauagcauucauaaaauuacaaguguauaacacuuuuuuuuuuuuuuuuuuuuuuuuuuuugcagcuucaugguugguuuuggccaaacuuuuuauuuaguauucuguagugguuuaacacacacuuaaacggucuuauugggggaggggaaaggggagguucuugcagauucccaaggaaaugucagaaaggcaaaauggccagcauuauccauuugcuuuuugggguuuacugggugaauagcacuuuccuuacauaggcaugugauuucagguuuuucauacugagaacauugagauuucaguuggaagacacccugaaaucuuaugaguagcauaccccaaccacccucuaauagcuagcuuguuuguauagguagaaugauucaucucuccauuuuagauggcuagauguuuuguggaagaucuuagaauugccugccucauuuacugggaaaaaucagauaggaaguggccuuuagggauacuuuuacuuggaaaguuacaacacuaguacaaguuuuuuuuuuauuuuaguagagacugaguuucaccguguuagccaggauggucucaaucuccugaccucgugaucugcccgccucggccucccaaagugcugggacuacaggcaugagccaccgcgccggccuuuccuuuuauuuauuuauuuaaugauacaaaguuucgcucuuguugcccaggcuagagugcaauggugcaauuucggcucacuacaaccucuaccucgcagguucaagggauucuccugccucagccucccaaguagcugggauuacaggagcccaccaccacaccuggcuaauuuuuguauuuuuaguagagacgggguuucuccauguuggccagucuggucucgaacuccugaccucaggugauccacccaccucggccuuccaaaguucugggauuacaggcacaagccacugugcccggccguguauuaccaucuuauauguguaaaggacaggcgugagccacugcccuggcugcaaauugauauacuucuaaauaauagucuaauuuugaauauauugaaguacaguacgcuuuuuacaaauauaaagaaucgggccagaugcaguggcucaugccuauaaucccagcacuuugggagguugaggcaggaggaccacaugaggucaggaguuugagaccagccuggccaacauggcgaaauccuaucucuacuaaaaauacaaaauuagccaggcgugguggcguaugccuguaaucccagcuacucaggaggcugaaggaggagaauugcuugaaccugggaggcaaagcuugcagugagcccagauugagccacugcacuccagccuaggagacagagcaagacuccgucucaagaaaacccccaaaaacccaaaaauggauaaaaagauuaaggcaauucuuuuaguagugcaaacaugauugucagugaugaauggcaccuugggagguaaccuuggaggaggaggagguauugaugggaccaccugcccgagaguugaggaaagcaguguggagggugaccaugguagccaaagagaagcggaggaaggcgaagguguuuccaaggcaggagagcacuguggucuugaagcauucauucccugguaaaagugguugaggagacagcuuugagcuggugauagccagaugugucaucacugacuuagcuggccagaaggacagggaaagagaacuugcugacagugggacugacugagcgagcagugucagggggacacaaacuauuagagauucuugaucacauugagucagucgagaaaaccuucaaaacauuuacacuucagacaaauagagaaucucggaagucucucugaaccuauucugguuugaggggcugaccaguuuuaaaaagagaaucuggccgguugugguggcucacgccuguaaucccagcacuuugggaggcugaggcaggcggauugccugaggaguuugagaccagucuggccgcgacggcgaaaccccaucuccauuaaauauauaaaaaaauuagcuaggugugguggugugcaccuguaaucccagcuacuugggaggcugaagcaggggaauugcuugaaccagggagguggagguugcagugagccgagaucgcgccacugcacuccagccugggcaacagaucgagacucugucucaaaaaaaaaaaaauaaagaaagaaaagaaaagaaagaaaccccaucucuacuaaaaauauuuuuuaaaguagcuaggugugguggcaguugccuguaaucccagcuacuugggaggcugaagcaggggaauugcuugaaccacggagguggagguugcagugagccgagaucgcaccacugcacuccagccugggcaacagauccagacucugucucaaaaaaaaaaaaaaaagaaaagaaaagaaaagaaaagaaagaaacccaaucucuacuaaaaauauuuuuaaaaguagccagaugugguggcaggugccuguaaucccagcuacuugggaggcugaggcaggagaauugcuugauccggggagacagagguugcagugagccaagaucgugccauugcacuccagccugggcaacaagagcaaaacuccaucucaaaaaauaaaaauaaaaauaaaaaagagagaaucugugacauacgacagagaagauggaaaauuauucagcaaaagaaacauuauacaaggcaauuaccacuauccagaaaaauaucauaaagguuauaagcaagucucugauacucgaguggaaacagagaaagacacacacacacacacuagaugcacuccagcaagagcccaauguguucacccucaguugcugcaaguuaaagucgucccuccugcaccaucuccaaacacacugcgcucuaccccugcaacaugcuaccugguggaacauugucacaguggccucggccucgaucucccucaaggauaaggggaucacauuagauuuuuuaaaacaaaaaggcagagagagauuugacuccagaagaggaaguaggagaugugaugaugaaagcaagagauugaaacaaugugaggaaggugucaugacccaaggaaugaggagagccucuagaaacuggaaaaggcaaggaaaccgauccucccccagagccucuggagggagugcaguccugccaacaccuugauuucagcccagugaaacucauuuuggacuucuuucagaacugcaagacaauaaauuuaugucauuuuaagucacuaaauuuguaauaguggcaauaagaaaguaauacacccagaggccggacacuguggcucacaccuauaaucccagcacuuugggaggccgaggugggcagaucacgaggucaagagaucgagaucauccuguacaacauggugaaaccccaucucuacuaaaaauacaaaaauuagcugggcguuguggugcgugccuguaguaccagcugcucgggaggcugaggcaggagaauggcuugaaccugggagacagagguugcagugagccgagaucgugccacugcacuccagccugggcgacagaacaaguauccgucucaaaaauaauaauaauaauaacaauaauaauaauauguccaguuuacuucuuucuuggauauaccauuuccauuaaauaauggaugcucgcugagcauuaccuucuuuguugauguuuucauuuuugauccauccaagaauggacaugucagaauauaacaauaccugcugaugcuuucuuuguuagugucuaaguguccaaaagcacucacuaacaagccaacaauugcugcuuaaauggaguauaccaggcagcggugucaggcaaaugcugugcccaaaacccuaaauggcacuuacugccuauugccacaggcuccaaucaguguaacugucagucaccaucacuuguagcugaaaaggcucauuagaacuguuccaaaugagaggucagucugaauagccugcuggauaguuuccuuaagcacuccucuuucuucuagcuacuucaucaguauaguaguauuauccccucuccucccuuccuucuggcauccuguacuguuuuacuauuaugaagguaagcucuuaaucauguauucaucccacgaucacuguuuuaauuauggcauuuccccacugggaacauuccuuacaaucaaaagaaguguuauacauacuuaacacuucuguucuuacaauauauucagcaguaucaguuacaaccauuuggguaugugaacuguucacuaaauaaaacaucauacaguaaguuucaagggccacaaugguauggccucuucuaccacagacaaauagauuaauuuuggcaggcguuggaaaucugguaggucaugguagcuucaucagaaacaugcaguccuuuccuucguuagaggcaucaguucuuagacugcuggagggcuucaguguaguaaaucuauauacauaguccccaauuuuuuuuuuuuuuuuuuuugagauggagucucgcucuguugcccaggcucucuucagggagugcaaggcagugcagaggacaccagcagugggguugacuggagcagaguggacguuucuuuccuuaaaggaacagaggucaggguaagagagaggaagagaucgggggugugacaggagcaguuccacaccaauaagcacaguuuuggacuuacuuucagauuuaaguugccuucugcucagcaucuacaaacuuuuuuucuucuuuucuuuugagacagaguuuugcucuugucacgcaggcuggagugcaguggcgugaccucgucucacugcaaccuccgccucccagguucaaggaauucucauaccucagccucccgaguagcugggauuacagucgcccaccaccacgccuggcuaacuuuuuguauuuuuaguagagacgggguuucuccauguugggcaggcuggucucgaaauccugaucucaggagauccacucaccucggccucccaaaguguauggcgcccagccaagcaucuacaaacuuuuacaacuaagacaccauucaggcagcugcuucaauccuaccacuguaaaucucuugcuguuugaguuuuguuguuuuuguuuuuguuuuguuuuuaugagacaguguauugcucugucguguaucgcucuguugcccaggcuagagugcagucgugcgauuucgacucacugcaaccucaaccuccugggcucacgcaauccucccaccucagccuuccaaguagcugagaccacagaugugugccacuacacccagcuaauuuuuuaaaaaaucuuuuguaggccggaugcgguggcucauaccuguaauuccagcauuuugggaggcggaggcaggcggaucaccugagguugagaguucgagaccagccugaccaacauggagaaaccccaucucuacuaaaaauacaaaauuagcugggcaugguggugcaugucuguaaucgcagcuacucgggagccugaggcaggagaaucacuugaaccugggaggcagagguugcagugagccgagaucgcgccauugcacuccagccugggcaacaagagcaaaacuccaucucaaaaaaaaaaaaauauauagacauaggguuuugccauguugcucaggcuugcgucaaacuccugagcucaacagaucugcccgccucagccucccaaagugcuaggauuacaggcuugagccaccaagcccagccuccaaaucucuaaauauucacugauggguagcauguacuaucagacccagggaaaucuuuuccauuucaucuaacccagcccacacugucuaguaacaacuaggacacugggaggaaacugaauccucccaauucacugcuuaggcaagaacaugcacuacaagaucccagggagucuuaucacagcccuuaaccuggcccacaucccucuuucuuccaaaaaggcuucgugaccuuaccaggcucagguuggaugccaaauuugucaaggcuaacagaguuguccuaggcuauuggggaaccagcacggaacaguuccucuacaacuacaaaaacaaauuuuaauuuuuaauuggauuuaaacauugcuuuuaggccaggcauggagguucaugccuauaauuccagaucuuugggaggucaaggcaagaggauugcuugcacccaggagcucaacaccaaccugggcagcauagugagacccaaucucuacaaaaauuaaaaaaugggccaggcgcgguggcucaagccuguaaucccagcacuuugggaggccaaggugggcagauaaugaggucaggaguuugagaccagcauggccaauaugaugaaacccagucucuacuaaaaauacaaaaaauuagccgggcguggcggcaggcaccuguaaucccagcuacucaggaggcugaggcaggagaauugcuugaacccgggaggcggagguugcagugagccgagaccacgccacugcacuacagccugggcaaaagagcgagacuccgucucaggaaaaaaaaaaaaaaaaagagggccgggcaugguggcucaugccuguaaucccagcacuuugggaggccgagacggguaggucgcuuaaggccaggaguuugagaccagccugcccaacauggcaaaacccugucucuacuaaaaauacaaaaauuagucaggugucguggcacaugccuguggucccagcuacuugggaggcaaaggcacaagaaucgcuugaaccugagaggugaagguugcagugagcccagauugcgccacugcccucuguccugggugggagagagagagagagagacucugucucaaaaaaaaaaaaaaaaaaaaaaguuaauuuaaaauuaaaaaaaaaaaaaaaaaaaagccaggcauaguggcaugcacugguaaucccagcuacugggaagacuggggugggagaaucaccugagccugggauguugaggcugcagugaggugugauugcaccacugcccucuagccugggcaacagagaccuugauucuaaaaaaauaaaaauaaagaaauuaacauugcuuuaagugugacagaaccaccaacuauguacaaaguguccuggauuauguucagagcagcacucaccugcagcugcuucuucaguccucuuccagggcagcccauagugcuucaucaaacauccuuuagccucuuccacaugaaugcagaacacuccaacuauucaacaacuuucaggucacagaccaucaugucagccau

SEQ ID NO: 192987 - RNA, 37839 nt, Homo sapiens
gacggcgggagccgcugcucuccggcugagggaaucagagacagcuccgucccuaguggagcgcaggggaggcagaagucaugacaggcgagguggguucugaggugaguuuaugcacacgccccccacgggggcuuagaaggccgggcaccgagagguuagguggggccgggguagaccccgcugacccgaggcgcccgggcgggaggacugcggcucccggcguucgccgcgccggcucccgcggccucgagacucggccgggauggguuccgaccgggcaucccgucccgccgccgggcuucccgcgcuucgggcuccguggccggagagcuccaggucucugcggcgcgcacugccggcagcccagccccucuucagccgguuccugccgccagcccuccccuuuggcgcguuuccugucgcggaagcuccuccccucagggugcucugaaagccgggaggcucuagccgaacccggccgcagcggugcggggggauucuccgcagagagagggcgagcgaggguguuagggaguuccacacugggccugggaggggcccuggaggucaucgcgcgcaggcccuuugcguuuuccgaccgggccccgaguggggaagucaccgcuggggcuccuggcugguggcuggcagcucccuggcgaaauugggcauagaaaacagauguuuccagagcuguguccuuucugggccggauucgggcaaggcacucccgccuuaggagcaaaauuuaaaggggcgccaaaacccucaaucaaacucauauuuuaaugcaauauuuuuaaaaaaccaaaauuaaugcaaaaacuuuuuaugauuugauauugaacaaaauaucagacguuuaaacaaagacgagauccgaccagucauuugcacgaccuugccucaaucaccucacccuaauuccaucccuguuuccaauaaacuuuauuuacaaaagcgggcauauuauuuaccucaugagcuguagauuauugauuuaauuuuuuaaaaaauauugcauuaauguuauucauuuugauuacugaauuuuuugagaccucaccccacccuguuacuggcccugcccuuugacguugcugcaaauugccuagaagauaaucgucauucaaagcagcccuauuccuugagcugucugguuaccuaaauucgguuuccacacucacaaacagaaguaauaguuuuacugcuuuggauuguugagaggaucaucagugcauacauauuaauucucagcaaucccagcacuucgggaggcuaaggccggcagauugcuugagcucaagaguucgaaaccagccugcauagaaaacauggcaaaaccccgccucuacaaaaaaaaaaaaauuagccgggcgucgccuguggucccagcuacucggucccagcuacucggguggcugaggugagagaauccuuugggccugggaggucaaggcugcagugagccaugauccugccacugcacuccagccuaggugacagagugagacacuguaucaaaaaaaaaaaaaauuuguaccuugcauucaaaucaauuuaauaauuuuuuuuuuuuugagacggagucucgcucuguugcccagacuggagugcaguggcacaaucucggcucacugcaacuucugucuccuggauucaagcgauucuccugccccagccuccugagcagcugggacuacaggcacacaccaccacgcccagcuaauuuuuguauuuuuaguagauacgggguuuuacuguauuggccaggcuagucucgaacuccugaccuugugauccacccaccucggccucccaaagugcugggauuacaggcgugagccaccaugccugaccaauuuaauaauuuuuugagaaaccacucagcugaggccuugugcccuguuacauuacugauguucauauuucucccuuuauuaauaaguugauucagagcccugagaacacuaaggagguagacuuggcaucuaggguuagcuuuaaggucacuaacugaucaagucaccuaacacaccccuccuccuuagguuuuuauuugcgacuuuuuaaacugucuuauuuagaaauuuucaaaccuauacaaccguagaaaggaugguauaaugaacccaucaccuuacuucaacuacaguuugaauaucucucgucugaaaugcuugggaccagaagcguuuugaauuucagauucauuuuggauuuuggaauauucgcauacacauaaugagauaucuugggggagggacccaagucuaaacaugaaauucaguuauauuucauauauaccuuacacacauagucugaagguaauuuuauacagcauuuuaaaauaauuucgugcaugaagcaaagguuuuacugcagcucaucauaugaggucagguguggaauuuucaucuaguggcaucaugucagugcucaaauauuuuggaauugggagcauuucagauuuucagguuagagauguucaaccuguauuuucaagucauggccaaucuuguuuuauucauacagcuacccauuuuuccucucacaggauuauuuggaagaaaauccaagauaucauauuauuugaaccacaaagauuuuagugugcauaucuaacaaacaagagcuuuccaaaaauagauacuacgauauuauuaccacaccuaagaaguaucuagucaguguucagauuucuuugacucagagauauuucauuuauuuuuauaugccacuuuagcauaauuauuuacauuuuuaguuuuuugaaucaucauccgaaguuggcauuuuguaauuguuuauauuauauauguguauauaugcauauauguauguauuuuaagauauacauacauauauaaagcauacauuuauguauauagaaauauacagggccgguugugguggcuuacgcuuguaauuccagcauuuugggaggcugaggcaggcggaucaccugaggucaaaaguucgagaccagccuggcuaacauugugaaaccccguuucuacaaaaaauuagccgggcaugguggcacgcaccuguaaucccagcuacucgggaggcugaggcuggagaaucgcuugaacccaggaggcggagguuguagggagccaagaucgugccauugcacuccagcuugggcaauaagagcgaaacuccgucucaaaaaaagaaaaaaggaaauauacauauagccgggcgugguggcucacgucuguaaucccaccacuuugggaggcugaggcgggcggaucaccugaggucaggaguuggagaccagccugacuaacauggagaaaccccaucucuacuaaaaauacaaaauuagccagacguggugacacaugccuguaaucccagcuacucgggaggcugaggcaggagaaucgcuugaaccugggaggcagagguugcggugagccgagaucgcgccguugcgcuccauccugggcgacaacggcaaaacuccaucucaaaaaaaaagaaauauacacauagcauauagaaauauacauacauauauaaauauauagaaauauacauacguacacacauauauacauucacuuauguguuaacuuucuuuauagguuucucucccucucuuuuuuuuuucuuugcaauauauuguuaaagaaaccggccgggugcaguggcucauaccuguaaucccagcauuuugggaggccgaggugggcggaucaccugaggucaggaguuugcaaccggccuggccagcauggugaaaccuugucucuauuaaaauagaaaaaauuagcuggguguguugaugugcgccuguaaucccagcuacucaggaggcugaggcaggagaaucgcuugaacccaggaggcagagguugcagugagccgagauugcaccacugcacuccagccugggugacagagcgagauucuaucucaaaaaaaaaaaaaaaaaagagagagagagagaaagaaaccacccaguuugacuuguagaauuucccacgucuagauugcauaucugugguauuauucaacauguuccccuauucccucuauuuccuauaacuugcuaguuagaucuagagacuugauaggauucaaauuugauuguucugucaggaauacuuuauggcuaguauuggguacuucuauuaggcagcacauaaugucugguuguuucucuuuuggugauguuagcagccauuaaugauaauugccuaggucuguuauuuaauugaggguugauaaaauugugauaaucuaauucuaucauuuauuaauucauuaggauauuucucuaaauagaaacuuccccucaucaauuguauggauauauuggggaacaguucacacagaaaaggcauaauaaaugcuugauucuuuucauuuuuuuuuuuaccguuacuaaaagaguugguucuguuagcauccuucaaaggugaaaaaugaacuuuuguuuguuuguuguccaguaauucuaaaugucaucccuucaaggaaccauuguauuugguucuuuccuuaguucagguugaugaucccacgaugauuugugugucauuauguacuuggagcuuucggucaccugcugguugauauaaaguauauugucauuuucuagguucaccuagaaaucaaugacccaaacgucauuucacaagaggaagcagauaguccuucagauaguggacagggcagcuaugaaacaauuggacccuugagugaaggagguuuguaauaguacuuuuauuuuuaggaauagguugcgggagccucaguuguaaguagauuggauugauuucauuauucucuugauuuauuacauuauuaaugccccauccuuauuguuuguuuuauuauaaaagcaaaauaacagugcuuguaccuuuuugaaacuauguuauauuguugaaugucuaauagcuaccauauugccugguuaauugcauucauccuauaauaaaaggaauuuuaacaccugccggagguuagaacaacuuuacacauuguaaauauacguaaaauuacauuucccaguaagagacauuuuucccagggaaaauguuuuucaaaauguauuuuuagauuugcuuugcuacaaucaguucuuaacaguagucacguaauuucacaauguuauauaucacuuguauaaaaauauauuuuugaggaguagugggacuaggaggaagaucaaaugaugguauaauuaaaagaaaauuguuuccuccagauucagaugaagagauauuuguaaguaagaaguugaaaaacaggaagguucuacaagacagugauuccgaaacagaggacacaaaugccucuccagagaaaacuaccuaugacagugccgaggaggaaaauaaagagaauuuauaugcugggaaaaauacaaaaaucaaaaggauuuacaaaacuguggcagacagugaugaaaguuacauggaaaagucuuuguaucaggaaaaucuugaagcgcaagugaaaccuugcuuagagcugagucuucagucuggaaacucuacagacuuuaccacugacagaaagaguuccaaaaagcacauacaugauaaagaaggaacugcaggaaaagcaaaaguaaaaucaaaaagaagacuugagaaagaggagagaaaaauggaaaaaauuagacagcuaaaaaagaaggaaacaaaaaaccagguacauuuuaaagaauaauuugcuauugcuuggguagguuaacauuuuagaaaagguugcuguuaguacuugagguuguuucugcucucugacuauugcuuugaauugacuauuuuguguugagaauuauucucaauagguaugugauuuaaaacuaacuggucuuggccaggugcaguggugcauacgucuaaucccagcacuuugggaggcugaggccagagggucacuuaagcccaggaguucgagaacagccuaggcaacagagugagaucccaucucuacaaaaaauuuaaaaauuaguugggugugguggccguagucccagcuguagucccaacuacuugggagggugaggugggagaaucacuugagcccaggaagucgaggcugcaaugaagcuguaauuguaccacugcauuccagccuggaugacagagugagacccugucucaaaaaaaaaaaaaacaaaaaccaaaaaaacaaaacuuauuggucuuauucuauuuuggguaugcagaggacauuuccaaauaaauggguuucugauuuucuuuaugagcacauggaguaauucuuugcugucucugagcugaugaaaauuaacugaaagaaggcuuuuuuaugcaucuaucagucaguagucuuguuugcuaacuagaaaaaccauccucaaauuuauaaacuaguugcuuaacaaguauuuuacuucaaaaaaauauuuacuguuuauuaaguuaguuuuagacaguugcauaaaaucacaacuuggacuucaaaggauacaugugaguuagaaaccaguaagaauguucuagauuuuauaugcuugucuguugaugaaacaugggcuuuuucuggccugauccaaauugccauaugauguugugaaauacuggauuuuuaaaugauuggauuaugcuuuuuguuuauguauuacuuaggaagaugauguagaacagccauuuaaugacaguggcugucuucuuguggauaaagaccuuuuugaaacuggguuggaggaugaaaauaacucuccauuggaagaugaagagucauuagaaucaauaagagcagcuguaaaaaacaaaguaaaaaagcacaaggcaaguaaagcaugauugcaauaagaguuaaucaacugcuucugaccuuugcuauauuuuuaauuuacuguuggaaccuuaauuuuuuuuuuaacugaagaaaaacuugugucaguugacuuaaguguuucagcuguuaauuuuggagacuugcaguacaagugauagacaugcuaacuucuuuggaaacuaguguuuuguuauuacccuuuuaggaaugcugaaaaaaaaaaccacuaagauauuugaugguguaguaagaugcagguaaauaauagggaagagauguaaauuuugcaauccuauagccuuugagaaaugaacccuauaggguuucaggaaggguaucaaagagaggcaucagucaaaacauuguugucccgaguguuuggaagcauaauuuuucuuccuaagauuuuuuuuuagcuuccugcgaguuauuaucccucuuuagggaaagauguaagcagagguaaaagaaauaaggguccagacuccaucugagguaucuguuuucuaagcauaauaggaugcuguguguuuaauaauuucuaguugaugauuauugauuuauuaauguagcaugaugugguguuggacuacaaaaguagucuucagcuaaagcauccucuuauuugaauuucguuuuuguccuaaucaaccugccauuucuuuuagaaaaaagaaccaucuuuggagagugggguccauucauuugaggaaggaagugaguuaucaaaaggaaccacgaggaaggugagguagagcccuguauauuagucacacugaucucuuuacacaggagauuauagauuucuuagggauaaauauuuuauuuugucuaucauauuuuucuguuacccaucauauugcuuuguacauaguaggaacaaaauauggauuggauugaacaaauucucugagacuugggaauaaaugaauuccuugaguuuauacugcauuugggcuuacucaugcuuacuauuuccuuuccucuuuucuuggagagagcaaacucuugagugaugaauaucuaucuuucuggauauucauauaauuaauguagucucacuucuuguuuucuuuaaggaaagaaaggcagccagauuaaguaaagaagcauuaaaacaacugcauagugagacucagcgccuuauucgagguaaugcaacccaguaaacuuugaggcaaaaucacaacauuucuuuguaagcucaacuuggauguuggggacuuuuauuuuuuuaacacuucuaaugugaacucagguuauaauauuaaguuuagaauugaucuuggugaaaggccauuguucuaaagcccuuggaacauuaguauaaacugaagaaauuuucagaacuguagugcagguaaggaggaaauuuuuuaaugguugucuauggacugauugugucaggauucuuuggagagguaguaaucccucccuauuugcaguuuugguuaccugugucagccaugguccauggaacuuaaaaauaucaucccuuuguccagaguaucacgcuguauacauuaccugccuguuaguccguuaguagcccucucaguuaucagaucaaaaaaacacugcaugguuuaguaccaucugcaguuucaggcauccacugcaggucuuggaaugugucugucuggauaagcggggacuacuguauauaaauguuuaggucccacagagauucugauucaguagauucgaaaugggauccaagaaucuguauuucuaaaaaacuuccuggaucauuuugauuucacaucuagguuuaaaagccacuggucuucagggagcuuuuuuguacuuagcuccucugccuuuguuaaaggggaguuuucuauuucuagugauggcuuugguuauuauguuuaguuaacugaauaugaagugacauuucagaauauacaguauauauauuugcuuguuuuauuccauuuuauagagucugcacugaaccuuccauaucauaugccugagaauaaaaccauucaugauuucuucaaacguaaaccccggcccacuugccacggaaaugccauggcacuauugaaguaagaacccucuuuccuuauuauaauuuucaugaacauuuaguuuuguagcaaacaucuggcauaaaaaguucagauuucucacucccuuaaaacugauuuaacugauauauacuaagggaugagaauguuucacauuuaggauaauuuucaacuccagcucaauuucucuucucuaggucaucuaaauaucagucaagccaucacaaagaaaucauagacacugcaaauacuacugaaaugaacagugaucaccauaguaaagguucugagcagacaacaggugcagaaaaugaaguggaaacuaaugcacucccuguaguuucaaaggaaacccagaucauuacuggaucagaugagucuugcaggaaggauuugguaaaaaaugaagagcuagaaauucaggagaaacagaagcagagugacauuagaccuucaccuggggacagcucaguguugcaacaggaauccaacuuccucgggaacaaucacagugaggaaugucagguuggagggcuuguagcauuugaaccucaugcccuggagggugaaggcccccaaaauccagaagaaacagaugagaaaguggaagagccugagcagcaaaauaaaucaucagcaguugggccaccugaaaaagugagacgguuuacucuggauagacuuaagcaacugggaguagauguuuccauuaaaccacggcuaggugcugaugaagauuccuuugugauacuugaaccugaaaccaacagagguaauccuuuacauuguggggagccucccuggagugauuauccugguagcuuuugauuauugacuacugucgaggacagagaacacaggaggaaccaauaaccacuuugaucuuauccugcaguuguuccagauaugggcagagucuuuuuuagagaaauuuggcaggguaucagaaugaucuaagccauguuuaaaauggaagucuguuggcugggugcgguggcuuacgccuguaaucccagcacuuugggaggccaaggcgggcagaucacgaggucaggaguuugagacuagccuggccaauacagugaaaccccgucuguacuaaaaauacaaaaauuagccgggcaugguggcacgcaucuguaguccuagcuacucgggaggcuggggcaggagaauuacuugaacccagaaggcagagguugcagugagccgagacugcaccauugcacuccagccugggugagagagcgagacucugucucaaaaaaaaaaaaaaaaaaaaaagguuguugauaguuaauauaaaaaagagguacauugcuacuguguuaugguauuuaggaauuuauuauuucugccuuuccaaucugaaauuaaguuuuuucuguaauccugagucaaaucuuaagacauugaugaaaacaucauuuaguuuuuuacugcuaaagagaaacauuuugguucacuuaaauuaucugugaaaccgaauuucuuuuguuuucacucauucaacaaauauuaaaguaucuacuaugaguaaguugcuguggggcauaccaagauaaaucugacauuuaagguauacuuaagaugcuuuuacucuaaugggcgagauaagaaguaugcaaauaagaaguacaaaggagaaaaugguaaaugaugucuuugauaaugaauaugucauugauaauuggaaaauaaauaacaugaagaaaaaggaaaaguauuuucuuaaagaacauuuagaauaaaguacugugggaauucagagaagcauaaauuucuuccaaugaauaguuaaaagacagccugaagaauagguggauuaauuacuuguucacugccuucccuuuauacugugaguugguaucuucugccuuguucccuacucuaucccuagugcuuccucaguggacgacacauuguaggcacuuguauuuaucaaaugaaugaaugaucccucaacacugaacucaaguauuaccacauugaauaaauuuccugacucuuagauagagcuggaugcuccccacucugccuugaggcaguauggaauggugguuaagagcuuagacuuuguagcaagaccaggauuugaaucugaacuagcauaguaauuguuuaacauuguauacgccauuugaccucuucaagcaucuuuuguuuaaaaaagagaagaaagccagacacaguggugcacaccuguaguuccagcuacucgggaggcugaggcacaagagggucacuugaacccaggaguuuaaggccauccugggcagcauaugaaauccugucucaaaaaaaaaaaaaaagaaaaagaaaaaagcacuauaugacuugugggcuauggugaagauuuguugaaauaaugcaugcaaauggauaguauaaacaagcacucaaaaaguuguugcugcuucuacuauuauuagugaaaugguucacaucaagacuuuuuuuuuuugagacgggcuuucacuugcucuugccaccuaggcuggagugcaaugcugcgaucucggcucacugcaaccuccgccuccuggguucaagcaauucuucugccucaggcucucaaguagcugggauuacagguacccgccaccacacccagcuaauuuuuguauuuuuaguagagacaggguuucaccauguuggccaggcuggucucaaacuccugaccuuaggugaucugccugccucagccucccaaagugcugggauuacaggugugagccacuacacucagccaagacucuuucauuaaaccaagcauagucaguggcuuaugccuguaauucuagcacuuuaggaggcugaggugggaggauugcuugagcccaggaggucaaagcugcagugaguugugagcugaaauugcacuccugcacuccagucugggagacagaacgagacccugucucauaaaaaaaaaaaaaacacaaaaaaauuaucuuucauuaaacaucuuauuguuggcaggugcuaugucagugacuauaucugguguguaaaauaugcucagugagucuguuaauugaauggguugacuuuggagauggagaggauagaaagagcaccuugucucauuaaaacaaaaagaaaaacaaaacacacacaaaaaagauucuguuucauuaaacagcuuauuguuggcaagugcuaugucagccacuguaucugguguguaaaauaugcuuagugagucugauaauugaauggguugacuuuggagauggagagaaggacagaaagaacucugcaugguggugcguauugggaagaugugaaagucacuuugaccagggcuggagguucagguggcagaguuguauaacagaacuagcauagcuccauuagcaaagaagcaugagaauaagcuguuguccggaacacugagggaaaguuuuuguuauaugggacuaaaaguuaccuaaacaguccuagacugauaggaaagggagaaacauuuuuugaguaccaacuauauuagacacugguacauucuuuguuaguugucuuucuuaauucucacagugccagguauuauuuugcaaaaugaagagacugaggcucagagagguuagguaauuuuuccagcauuauacuuggcuuauaaagggaccuacacaguggcuggcauauaaugagcacuuauuuuuuaacuuggaacauguuuuccuuuagaaauaauugacacgaaauuuggguuuccagaccagccauaauauacaugaaguuagaaucaacauucauucauucauucaugcaauaaacuuuuauuuagcacuguguugggugcuguguauacacguaaaacacucccugcucucaaagaaauugaaguguaauaggagugauagacaggcaaacagaccauuacaauacuggaugguaagugcugcgaucaagguauauaauugagggugcauugggaaccuagaggaaggguaccuuacuuggagccuagaagucagggaaguuucugaaaugagcucaguagagauaccaaggcagagaggugagggagggcuuuuuugguggagggguuggaccugcagaugucagagacaauggaaagcacagggugaucucccuggcugaagugaagauagcaaggacauuggugaucagagcccagaucauucaggguuuuuaugccaugcuaggagcuuggacuuuagcucuuuguaaguagaggaccacugaaagguuuucagcaaaggaaauguucaaucagauacucacuuuaggaaguuaaaucugguagcuguugugguggaugcauuggaagggguuaagaguaaaaacagugggaacagcucaguuucuuuaccucauauagaauaagguuuccaugagaaaaugcauguaaauuuaaauuuugugaugucagaaauacauuauuucuguugcuugcaauagcauauggaauaaucccugccucuaauuccucuacuuucuggacaagagcaaugugaaugagaacaguucuuaugcugcugauagagauaagcuaggaaagagacuuuucacuuaagagaggagaugagaggugauggaggaugagaggugauggacuaauagagaugaauggagguagaggaacuugaacagggguuuuaggaugaagacagugaugguugcaucauguaauaaaggccaaagaaagugguugcuccaauggguugggggaggaagagcuuugaggauccuagcuuucuccaguuaugaaugaagauaccucuugccugacuacuauuuuaagucccagguaaucuucccacccaaccauuucucuuacccuaguggcacccauaauaaccugccuauuucuguucccuuuucccugcuaccaccuguugcuuucagcuuuacugaaccacugcaaaauaggaggcagacuuacagcuugucucucuacucuuuuguuugcaauguaaacauaccauccuuuagaguuggguuuuugcugcuaauaauguugggguuucaggauaaaaagauuuccuucauuuuucucuuuuucuaguaagaccgucuagaggaaaaaaacacaucuagaugcuagucacaaaaacaccgaaguaugauuugagugcauuuuagaaaauuagucaaguuucaugccuauagucccagcacuuugggagacuaaggugggaaguucgcuuugaggccagguguuugagaccagcuugggcaacauagcgaguuccugucuuuacaaaaaauaacaaagccagauguggugacaugcaccuguaguccuagcuacuugggagggugagguaggaggaaugcuuaaacccaggaggucaagguugcagugagcugugaucgcaccacugcacuccagccugagcaacagagcaagacccugucucuaaaaagacaaaugaaaaguggcugggcacaauggcucacaccuguaacccuagcacuuugggaggcugaggaggguggaucauuucaguccaggaguucaagaccagccuggacaacauggcaaaaccggucucuacaaaaaauacaaaaaucggccagucgcaguggcucacuccuguaaucucagcacuuugggaggccgagguggguggaucaucugagaucaggaguucaagaccagccuggccaacauggugaaaccccaucucuacuaaaaauaaaaauaaaaaaauuagcuggguguggugacgcaugccuguaaucccagcuucuagggaggcugaggcaggagaauugcuugaacccaggagguggagguuacagugagccgagaucaugccacugcacuuuggccugggcaacagagugagacuccgucucaaaaaaaaaaaaaaaaaauuagcuggauauggugguacaugccuauaguccuggcuaucucaggaggcugaggugagaggaucaccucuaagcuuggggagauugaggcuacagugagagccaagauugcaccacugcacuccagccugggcgacaaagcgagacuccauuuaaaaauaaaccauuuuaucauggacgagaaggccgccugaaaauauccagugugcaucaacuccaaaggaacuuucuccuuaaaacugccagcucucaucacagauuccauuaugauaugaaguguuaagcagagugaguagggauugguuccagguaacagcuagcugagggagaaggaaauucuaagauauugcaguggggaagagggguaaguuuauaucacuauuggauugcugaacuuacuguucccaguauauauauauuuccguuuguauacaaguugagcaugugguacuggggcugcaguauuuucuuucucauuguaccaauuguacuaguguaacaguuuucaccaaaaaacuuuuuacaguccugcugcuuaguuauaucacugacuggauugucauuuuauuuucccuucuugaaaaaaauugacuuugccuauauuuaguaagauugccaauaaugaaacauucaaaauagggaauuugaucccagcacuuugggaggccaaggugggcugaucauuugaggucaggaguucgagaccagccuggcuaacauggugaaacccugucucuacuaaaaauacaaaaaaauuagcugggcaugguggugcucaccuguaaccucagcuacucaggagacugaggcaggagaaucgcuugaacccuggagauggagguugcagugagcugagaucacaucacugcacuccagccugggcaauagagugagacugcaucucaaaacaaaaacaaaaaacagcaauaacaaauagggaauuuuaaaaggagaccaaaacccaugaaaaauuaagcccuugaauagaugagauuauaaucuuuuuuccuaccaguuuaauacuuuuaaagaauuuuuaaagaauguucaaaagaauugcacauauuuagaaauuucagguauaaauuucugucugauuuuuuaaagucugauuuuugaaacguugaggaagaacaguuguggcagucaauuaguuuggguuaaguuguaugaauuugacucaggaguuaguagcaagggguuuuugguuucucuguguaugugugguuucccucauaauuguugagcuaaaaaaaacuuagcuuauaagucuuaaaggaaagaguuuugagcauggcaaacugacacacugguuggcguuuggguuuagaacuggaagccuugaagcagcguuucuggaagcaugcuaauccagcagccaaacccagggcuggucagacagugaaugugaacgucauagugaaagacaugggcacugauggaaaggaagagcuaaaagcagaugugguaccugugacuuuagcaccuaagaaguuggauggagcaagccacacaaaaccagguauuugagcccacagguuuuguuuuuugcuuuuugcuuuguauucuaacagaucuucaaggcuauugaaaaccuuauaaugaaaaguuauagaaucuuuuuccuuggaggcuuugcagagcaguaucucuggcaugauucacguguagcacaccuagaggugugggguggacaagcuggcuuuauuuuuuuuuuagauaucauuugucuuauuauaaaaaaccccauuauagacaaauauauagaauaaaugaaaaacuuaaucuucuaucagagacagguucuauaaccauaucguguauccuuuuaaacucucuucuuugcacauauguauauguaauuuaaacaaaaacaggcugggugcaguggcacaugccuguaauccuagcacuuuggaaggacaaggcaggaggaucuguugagcucaggaguuggagaccagccugggcaacauagugagcccucaucucuaccaaaaaaaaaaaauuauccaggcaugguggccugcaccuguggccccagauacuugggaggcugagacaggaggaucauuugagccaggagguugagguuguaaugagucaugauuguggcacugcacuccagccuaggcgagagagugagacccugucucaaaacaaaaaacccaaaacaaaacaacccaccuauaaugugaucauaacaugcauucugcuuuguguuuuagaaauguauuaaggacagcucucaccccucccuugaaaucacaaguaauauaucacauggaaaacaguuuuaaacacugaaaaaagguaucaaaugaaaaacuagucuucccaaagauaacuauuaacaauuucuuguaugucuuuauaggaguauuuuuauccauauaccguauuuugugaaugugugugacauugaacauuuacucccugucaggcauugcucuaggugcuuuauauguuuuaucucauuuaauccuuacaacccuaugagguaaauaacauuaguauccuuauuuuguauaugaagaaacugauaugcagagcacuuaagacacuugcucaaguuuacacagcuaauaaaugguaggaccaguagucuaauccagaccaccuaacuccagagcucagaucuacuuuauauugcuuuugaggcuuuuuuuuuuuuuuuuuuuuuuccucuaagacagaguccugcacugucacccuggcuggagugcaauggcacgaucuuagcucacugcaaccucuaccuccuggguucaagugauucuccugccucagccucccgaauagcugggauuacaggugccugccaccaugccuggcuaauuuuuguauuuuuaguagagaugaaguuucgcuauguuggccaggcuggucucgaacuccugaccucgugaucugcccaccuuggccccgcaaagugcugggauuacaggcgugagucacugcgcccggccuugaggcuuuuuuuaaaauggcugcauaauauuccauugaaugaauacaacaugacucauuaaaccauacucguauugacagaugucuuguuuguuccaguuguugcuauugcauacaguguuauauuauagugccagauauauggugguauauuagaugaaaauuccuuacaguggaauugucaugauauauaucacauuuugauauauaucauccaguugucuuucagaaugguuguaccacucugaaucacaguguaugaguuccuguuuccucucaauagguauuaucaaaccuucuaauuuuugccaggcuaacaugucgaaaauguaucucguuauuuugauuuguagcucuucaauuagaagugagauuaagcauuacuuuuaauuuauuaacaauauauguuuauuuuucgugaacugccaguucauaucauuagcucauuuuacucgagucguuucucuuuuucuuuaauauagguaaauuuaucaauguuuuucuucauggcuuuugagccacagacuugaagcucuacucccuacccaccuuuucucucuuuugaacaauuauuuuauaaucccugaguaguauacuaucuagggugcagaaguucucuuugauacuucaauucauaauaauacucuuguguucaaauaacaaaaaagcccagaauacuagagucucagauuuuccuuuugggaugugacuagaauauuucuggaguugccuaaaaugcauaccuaauuauuguauuaugucuaaagcauuucuacauauuucuguucaggugaaaagcuucagguguuaaaagcuaaacugcaagaagcaaugaaacuccgaagguuugaggagcgccagaagcgccaagcacuguuuaaauuagauaaugaagauggguuugaggaagaggaggaggaagaggaagaaaugacagaugagucugaggaagauggagaagagaagguagagaaagaagagaaagaggaagaacuagaggaagaggaggagaaagaagaggaggaggaagaagaaggaaaucaggagguuucuggcaauuacguuguuuuguuaccuugucauggugaauaugagagaaaaagucagacuugaaaaagaguauaauaagcauguucaauuguauaagagguuuuaggggcaugaugaggguaacuaccucauauaucccuaaaucuuaggaacuucaguucugucaguaccacugaauaucuguagaucaucauuauauaucugaauacagauauucagugguacugacagaauaccauugccugggcuuccaccuguuuauauauuuuaauauaauaaugcuaauauuaaaaauggcuuuguauucguaggaaauuuuaucuuuguuguuuauuuagguuucucuagcagauuaaaaagcaguccuaaccuuggcuagauugaggccuggaguaaauucuuagggagguagaggccuuucugaguuauuuucguucuuuguagaagaaggcauuuguagaagggccucuugcccuuguuccguaguacuguuuucugccuagggaaaacaggugaugauacgauuguuaaguauuaaaaaacuuuccuuuuugggccgggcaggguggcucaugccuguaauccuagcacuuuggaaggcugagguagguggaucaccugaggucaggaguuugagaacagccuagccaacaucgugaaaauccaucucuacuaaaaauacaaaaauuagcugugugugguggcacacaccuguaaucccagcuacucaggcaggagaauugcuugaacuugggcagugaagguugcagugagccaagauugugccacuauacucuagccugagcgacagagcaagacugcaucucaaaaaaagaaaaaaaaaaaaaaacuuuccuuuuuguaugcugggaucacuuuauuuuauuuuauuuuauuuauuuauuuaaauuuuuuugagaugagggucucacuauguugaccagacuggucucgaacuccuggccucaagugauccucccaucguuguggccucccaaagugcugggauuacaggcaugagccaccaugcccagcaacuugaguuauuauuuaauuuuggguaaaggagaaagaaagcaauggcugagcuauacagccugucucagucugugcuugguuugagaucaguagucagccugcaaucuuagacugauuaauuaaccucuuacugccucaauaaaaugauaauccagucguccuuuauaaucuuagcaauuucgggaggguagaagguaaaaaaaaaaaauagaaaaaaguucuagaagugucagggaaaauuauguugauaauggucauauggaacuuccuucaaguuuaccuuuuugaauuuaagaugugaucuguaaccaaucagccauauuucaggcuaccaguguauuugcuuuuaaauguuuugacuuguauuuuuuguuuugugguggccugauugguaaagacugcagaauuccuucuuaguagugaagaaauagaaacaaaagaugaaaaagaaauggauaaagaaaauaaugauggcaguagugaaauuggcaaggcaguuggcuuccucucuguucccaagucucucucaucagauucuacuuuacuucuguuuaaggacagcucuuccaagaugggguaagugauucucucuaagaaaacuuaaaauugccuuggauuugccccuccuguaaaaacuaggaacagauacugaaccaauuuacuuucuuauuuugcaguuacuuuccuacugaagaaaaaucagaaacagaugaaaacucaggcaagcagccuagcaaacuggguaaguagugauucuugugcagaacuuaacauuucuuuugucccucagcuuugauauuuaaggacugcaguacgguaaguuuccauguuuuuaaaucuggucacuucccaguuucauauguagcuaugaaaaggguuuaugaauuagaauauuuuucuuggucuauuuuuugcaguuuauuuauaguagaccaugguacauaauguccuuagugaauguguguugauugagugagcaaugaaauguuucuguauguagaucaaaggaagacguauaauugauuggacaaugaagagugugaucauaggcauuaggaaggauaagagaaagaagagaacuuucggccaggcgcagugacucacgccuguaaucccagcacuuugggaggcugaggcaggcggaucaugaggucaggagaucgagaccagccuggcuaacauggugaaacccugucucuacuaaaaauauaaaaaauuagccaggugugguggcacgcgccuguagucccagcuacuugggagggugaggcaggagaaucgcuugaaccugggaggcggagguugcagugagccgaauucacgccacuacacuccagcuggggugacagagcgagacugucucaaaaaaaaaaaaaaaaaaaaaaaaagaacuuucaagugucacuuagcucagaguaauaagcccugauuauauaaugcuaucuuaguacuguaauuuaccuuuaacuuaauguuuuggaacauauaacuugagggguuugccuaugaauuuuaucugacaguuucauccucaacucuuuuuccuaaacaaauccaccuuauuucuguaaucaugugcuuaaaagguguuucucuuucuuuagaugaggaugauucauguucauugcuaacaaaggagagcagccacaauagcagcuuugagcugauuggcuccacgauuccauccuaucagccuugcaacagacaaacaggccgugggaccaguuuuuucccuacagcaggaggauucagaucuccuuccccugggcuauuucgagccaguuuggucagcucagcuucuaagguaagaugguaaugguuuuucuaaucuccuccucucuuugcuucccacauugcuaaauaaaguuugucccagccaaccaacucccaccacguugguacugagcuuauguguguucaguuuaaaaaauccacccccuuuguguauuaaaaacaagcuucauccaguauucuuacuuucuuggagguauuuuucuuuaugcuucucauggcuguguauugucccccucaacuacaauuuccugagaguagcuuaaauauugcaaauagcaacuuuugugguugucaugacaaugacugacauuuguaaaauguuuuguuauuguuuguuuuuguuugugugccagaguucagggaaacugucugagccuucacuucccauagaggauucccaggaucuguauaacgccuccccagagccuaagacacuuuuccuaggagcaggagacuuccaguucuguuuagaagaugacacucagagccaacuguuggaugcagauggguagguaguuuuguguuucugugggcgggaauggugcuggguacugcuuaauuuuguuuaaaaauaagugagcuucugucacuccaucugugcuuucucuucugagaaagagaagguguacagaccauuaguauuacauucuauaaguuugaacaaagucuguccagaaaauaaacauaaauagcucuugcuaacauucugguccuucaauuucugucuuauuugaaaugcauagaucuuguauuguaaggucaucaaauuucccuguauccauccugcuauguuauuauuguuggguaagguugagaauucacagacugguggcacauuacaggacauaaugccaagcccugcucuagcaucaucugaagcuaaaaguuauccuuuacacuuuaccuucugaguaacauuuuauucuuucacaaaacuuuucccucccucuuuagauuaacacaagccuaaaguuugaaucuuuugcuuucugguuugagauucagcuuuuaacugguguaggaaaugaauucagagguuuuucacccccuacuuugccauuucucugaggaauuuuuuuuuauuuuuuuuuuugaggcagagucuugcucugucgcccaggcuggagugcaguggcgcgaucucggcucacugcaagcuccaccuccuggguucacgcccuucuccugccucagccucccgaauagcugggacuacaggcgcccaccaccacgcccggcuaauuuuuuguauuuuuaguagagacgggguuucaccauguuagccaggauggucuugaucuccugaccucgugauccgcccgccucggccucccgaagugcugggauuacaggcgugagcuaccgcacccggcccucucugaggaauuuuuuacacuauucguugugcucauugguucuuagguucuuaaauguuagaaaccacaggaaucaguaccaagcuuugaagccucgauugccauuggccaguauggaugagaaugccauggaugccaacauggaugagcuguuggauuuguguacuggaaaguucacaucucaggcugaaaaacaucuacccaggaagagugacaagaaagagaacauggaggaacuucugaaccuuuguucaggaaaauucacuucucaggguaaauauccaaccgagaguaucaagcuuaccacacccaaguaucagugcccuugaaaagaauucccugggcgggugggguggcucaugccuguaauccuagaacuuugggaggcuaaguuggauggaucgcuugagcucagaaguuugagaccagccugggcaacauggcaaauccccaucucuacgaaaaaaaaaaaaaaaauuagccaggcaugguggcacgugccugugguccuagcuacuugggaggcugaggugggaggaucucuugagccugggagaugaagguugcagugagcugagaucacaccagugcacuccagccuggguggcagagacccugcauaaaaauagaaaaaaagaaagaaagaaaagaagccccuuacccucaggugaaaaguucacagaaaacagggcugugauggaaucuguguauaaacugaauucacugcuuagugcccugauauuuagaacucuuacuuucuuagagugguaaaguaucaacuuaagacuacuuuaggccgggcgcaguggcucacgccuguaaucccagcacuuugggaggccaaggcgggggauuuccugagcucaggaguucgccaccagccugggcagcacggugaaaccccgucucuacuaaaauacaaaaaauuaucugggcaugguggcccgugccuguaaucgcagcuacuugggaggcugagacaggagaacugcuugaaccccggagguggagguugcagugagccgagauugugccacugcacuccagccugggcaacagagagagacugucucaaaaaaaaagucuugaaaaaaaaaaagacugcuuuagcuuugcccauauaucauuuaugauuaauguauguacaaaguuuagaacagugucugauguauaauaaauuucauauaaauguuaacuuacuuccuguucccugcccccaauacacacaacugcuagaucgaacauaagcucuaugagaccugggauagugguuuguucauuacuguaucccugguggccuggcacauauggcacauaguaagcacuaaauaaggauuuguugaaugaauagaugguaggcucuucuuggcaagcuuaccuuagaacuguaucgagcuggcaugacuuuagauggcugggaaaagaguauaaagcuaucauuccuuggugacacaucuuuuccuuguugugauguagaugccuccacuccagccucaucagaguuaaauaaacaggagaaggagagcagcaugggugauccaauggaagaagcacuugcucuuugcucaggcucuuuucccacagacaaguaagucucagauugcugggaauuugggaaggccuggccuuuugauaaaaucaaaauaacugaucaucuuaagggcuuugcaccuuuucugagaaucuugcaguggauuugagucucauauaugccuaguaagcaaauuauaaugcuuugguggagaacaggguaaaaaaggcaagaauaugaaagcuauuuaauaucauuaauagagaaaugccaaucaaaaccauagugagacacccauuaagaugacuuuuaucagaaaaaccccaagaguguuagugagaauguggagaaauuggaaaccuuguguacuauuggugagaauguaaaauagugcagcugccagggaaaguaugauggcuccucaaaaauuaaaaauagaggccaggcacgguggaucaucugaggucaggaguucgagaccagccugaccaacauggugaaaccccgucucuacuaaauacaaaaaauuagcugggcaugguggcgcaugccuguaaucccagcuacuugggaggcugaggcaggagaauugcuugaacccgggaggcagagguuguagugagccgagaucaugccauugcacuccaaccugggcaacaagaacaaaacuccgucucaaaauaaauaaauaaaaauagaaugaccauaugauccagcaauuucacuucuuagucuguaccccaaaaaagugaaagcaggacuugaacagauauuugcacccccauguucaaagcagcauuauucacaguaaguagucaaaacaugaaagcgaccuauguuuauuggcaaaugaauggguaaacaaaaugcgguauauaugcaaaggaauauucaacuuaaaauggaaauucuggcugggcaugguggcucacacguguaaucccaacacuuuggguggcugaggugggcgcaucacuugagcucaggaguuugagaccagccuggauaauauggcaaaaccccaucccuauaaaaaaaauacuaaaauuagcuaggcgugugccggcaguaccagcuauucagggggcugaggugggagaauugcuugagccugggaggucaaugcugcauugagccaugauugugccacugcacucugggcaucagagcaagacccugucucaaaaaaaaagaaguucugacacuugcuacaacauggaugaaccuuagaauguuaugcuaaaagaaauaagccagucaccaaaagacaaauacuguaugaguccacuuacaugagauacuuagaguagucaaaugcauagagacagaagguagaauggugguugccagagacugagguuauaaggaaauggagaguguaauggguauagaguuuuaguuuugcaagcugaaaagaguucuggagauugcuuaacaauaugaauguacuuaacacuacagaacuauagaaagaucguuaaaaaggcaaauuuuauauuauguguauuuuaccacaauugaaaauuuaaaaaauuuucuuccuguuuauugaagagauuauuggugauaauaaaaguuuuaaauuuggcugggcgagguggcucauaccuauaaucccaguacuuugggagcccaaggcaagcagauugcuugaauccagaaauucaagaugaaccugggcaacauggugaaaucugucucuacaaaaauacaaaaauuagcugaacaugguggcuuguaucucuagucccagcuacucaggaggcugaugugggaggaucacuugagcccuggagguggagguuacagugagcugagauggugccacuguauuccaggugguguaagagaccaagacugucucagagaaaaaaaaaaaauuaacacacacaaaauuuuuuuuaauucauaacuuggcugacuacuuguaguuugcuuucaacaacuuauuuauugauucauugauuuacauuuuagggaagaggaagacgaggaggaggaauuuggagacuuucggcuuguuucaaaugauaaugaguuugauagugaugaggugaguaugaagggaacaaaguaaucauaacugagcuccauguauugcugcccucaaguguuuuuuuccccucaguucuugagaauucuaaguuuggcaucuuaucagaaacaauuuccuagaaugagguauuugggcagauguuuauaaauccuuuuuucauugaggacgcauuuuauucugcuuaauuuggauaugaugcugauuuuguaggaugaacacagugacucugguaaugaucuggcacuggaagaccaugaagaugaugaugaagaagaacuccugaagcgaucugagaaguugaaaaggcaaauguacguguuauuaauauguccauuccuucagguguauuuaaaauuuggucacuaggccaggcaugguggcuugcgccuguaaucccaucauuuugggaggcugaagcaggcggaucaccugaggucaggaguucaagaccagccuggucuuggugacacaggucaagagaucgagaccauccugacaaacauggugaaacccugucucuacuaaaaaauauaaaaauuagccagaugugaugacaggugccuguagucccagcuacucaggaagcugaggcagggagaaucgcuugcacccaggagguggagguugcagugagccgagaucgcaccacugcauuucagccugggugacagagcgagacucugucucaaaaaaaaaaaaaaaaaaaaaguugaucacuuaauauguccugugugcuaauaacugugcuuuacaggcauuaacauauuaucuuaugccaggcacaguggcucacgccuguaaucccagcacuuugggaggccaaggcaggcauauuacuugaggucaggaguuugagaccagcgugaccaacauggugaaacccucucuacuaaaaauacaaaauacaaaauaaaauacaaaaauuagccaggcaugguucugggcgccuguagugccagcuacuugggaggcugaggcaggagaauugcuugaauaugggaggcggagguugcagugagccaagauugccccacugcacuccagccugggugauagagcaagacuccaucucaaaaaaauuaucuuaugaguggguacuauuauucuccucauuuuacaguugaaggaacugagccucagaaagauuaaauuuacccaagaucacauagcuagaaggcagcagaggcuggauucaacuuagauuaggugaaaucuccccuaacagucaguuaauaguuugccacuuuuuaacuuaaauccuccugccucagcuucccaaguagcugggacaacaggcaugugccaccacaccuggcuaauucuuucuauuuuuuguagagauggggccuugcuuuguucccaggcuggucuuaaacuguuggccucaagugauccuccugccucugcuucccaaagucugggauuacaggcaugagccaccaggcccagcuuuuuuuuuuuuuuuuuuuuuuuuuuuugagacggagucucgcucugucgcccaggcuggagggcaguggcaugaucucggcucacugcaaccuccgccucccggguucaaagcgauucuccugcuucagccuccugaguagcugggaauauaggcacgugccaccacacccagcuaauuuuuguauauuuaguagagacgggguuucaccauguuggucaggauggucucgaucucuugaccucacgauccacccgccuuggccuuccaacaugcugggauuacaggcgugagccaccccaccuggccggcccaacucauuuuuuugauaugcuguucuggucaugaaaguaaaauauuuauuuuaggauauuuaaaagaauacaaacugggugcaguggcccacgccuauaaucucagcacuuugggaagcugaggcggguggaucaccugaggucaggaguucgagaccagccuggccaacauggcgagaccccgucucuacuaaaaauacaaaauuagccaagcgugauggccagugccuguaaucccagcuacucaggaggcaaagcuggagaaucgcuugaaccgggagguggagggugcagugagcugagauugugccauugcauuccagccugggcgacgagagaaacuccauucuccccgacccccgcaaaaaaagaauacagaaagauauaaauaaaaacuuauccauguccaccauccaggauauaaaugaaaguuaguuuguuccccuuaaucuuuuuuaugcauauauuuuuauauaguugagauuuguacaaucuuucuauauguauaauuuugcaucuuuuuuuuucuacuuagcauauccagaaacauuuuccuaugauguuaaaaaaaguuuuauaaagauaauucuaauagguauuuaauauuauauuguaugugaaugauuuggaauucacauauaggacaucauauugaucccuauuagauuuauaugguugcuuuuaucccaucauuucauucuauuaagauucacuuuggguucuaauuuaucaccuaucaaauuaacucucauacagcuuuagguuauccauagauuuuucuaagguagugguucuucucugcagagcucuuuguucaaauaaaaucuuuuaaagaaugacagauaaaaguugaacuguucaaagaugguaagugggaaguuugggaaacuuagugacuaguggccucugaaggaauuuuccaggaacucuaggauuuagaacaacuuagcuuuaagaaaauacaguauaggcugggcgugguggcucaugccuguaaucccagcacuuugggaggcugagauggacagauccccugaggucaggaguucaagaccacccuggccaacauggugaaacccuaucucuacuaaaaaaacaaaaauuagccaggcaugguggcacgcaccuguaaucccagcuacucgggagguugaggcaugagaaucacuugaacccaggagguggagguugcagugagccgagauggcaucucugcacuccagccuaggcgacagagcgacacuucaucucaaaaaaaaaaaaaaagagaaaauacaguauaggucuucgauaaaaaucaguuuucagaaagccaccaaacuucugccauuuuggaccacaugggaccaaggugacuuugaauccagggugacaccagauuuauucuccgggggagcugaagucauaagaaguaacuagucguuuugauuaccaggagcucugagccuuagucuuccuucugaugugggggucaagauuuguuaggcuguaagaagaucccaguuuauuaccuuucuacaccacaccaucucuaguuugucucuuaaagcuggugugcucaaaugcaaaaugaaauaguuugaaccuuccagcagguauucuaauacauguaaaagagauuaagaguuuucuggcuuucaaaucacccaaucuaaguugaauccaggcucugcuaccuucuagcuaugugaccuuggguaaauguaaucuuucugaggcucaauucccucaacuguaaaaugaagagaauaauaguacccauuccuaugauaauauguuaaugccuguaaagcacaguuauuagcacacaagacauauuaagugaucaacuuuuaaauacagaugcuccacaucuuacaaugggacuauauccugaucaauccaucauaaguugaaaaugcacuuucauauuauccagauauaacuccaucguaaaucgagaagcauacuaagugcguaucacauucaugucaucguaaaguugaaaaaucauuaagucaaaccaucauaaguggagacuauuacaaaaaaauuuaaauauuaucaaauguauuauguuuauuauuauuagaagugacucuguucugcuuuucuuugcuuccauauucugugaguauauucauuguugcauuuucuaauccucaaaauugcuuucuaggagguugaggaaauaccuggaggaugaggcagaggugucaggaagugaugugggaagcgaagaugaguaugauggggaagaaauugaugaauaugaagaggacguaauugaugaaguacuuccuucugaugaggaacugcagagucaaaucaagaaaauacacaugucaguaucccaauaagcccuucugaguaauaggguacaucuuaagacaagcccuguaaccagccagaaugguccuuguuuugaacaccuuauuucuccuguugcaggaaaacuauguuggaugaugauaagcgacagcuacguuuauaccaagagagguaccuugcugauggggaucugcacagcgaugguccugggcgaaugaggaaguuucgauggaaaaacauagguaucuugguuguugucuuuaaaagcaaucaguuacgggcugagcaugguggcucacgccuguaaucccaacacuuugggaggcagaggcagguggaucacaaggucaggaguucaggaccagccugaacaacauggugaaaccccgucccuacuaaaaguucaaaaauuagcaggcugugauggcacgcgccuguaaucccagcuacucaggaggcugaggcaggagaauugcgugaacccgggagacggagguugcagugagcagagaucaugccauugcacuccagccugggcgacagagcgagacuccaucucaaaaaaaaaaaaaaaaaagcaaacaguuacaaugcauauuugucgaguuucagauggcaaauggcaagcaaaacuauaacaggcuaugugaagaccuaguuguaacuguuuucuguuaauggaugggaaaaguuuacaucauuauauaguaaaugauaaggguuuauuuuuugucuguccaagcacccucuccugugaggacugccgaaugcugauuaccuucacucuuuguuuagaugaugcuucccagauggacuuguuccacagagacucugaugaugaucagacugaagaacagcuugaugagucagaagccagguggaggaaggagcgaauugaacgagagcaguggcuucgggacaugguaggaguucaccuacucugacccuaguuuaugagacugucccuuagcuugucaugauaguuucaaaaucuuagcuugucaugauaguuucaaaaucuuaggcaacauauugcuaucucuuuuaauccuugagcuaucuuuuguguuuugagaaggcuauaccauagacaguucucuucauguuugucuaagauuaauuuuuuuuugucuaaagcagcaaaggcugcaaaaaggaaaacaaauaccccaggaacucuaguuucacaauccaggccaugcuaacuauuuaggaagguuauagacuuuuaaugcuguauauauauauauauauauauauauauuuuuuuuuuuuuucaggcacagcaggggaaaauuacagcugaagaagaagaagaaauuggggaggacagucaguuuaugauacuggccaagaaaguuacagccaaagcacugcagaagaauggugagcucuuguuucuccuuagggucuagcccccuggauuguuagugguagagcuuuggaggugacucuaaccuucaggagcuguugcagcuuaaucauaagcuugugucuaauacugucuuaaagaggcuucacagagguggugggagacaguguacuuagaucuuagacuauugggcaguagagacuguauucaugaguauauguggcugguuuuacuuuauguucuaaggcucagaguaguuaauucuggcuuucucuaguugcccaggauuguauaccuaaguguuagagguaggauuugaauccaggaauauuuaacuccagaaaugaagcucuucacuauucccuacacugaccacuucuguuuuucuuaaaugauuacuguucaacuuaguugugucucuucuuggagccaauuauuauaguuugaaagucaccauuauauagaacagaguucccauggcuuuagcauauugauuuaguuacaagauuucuuagcuuguuuagauuuaaaaguaauucuaaucagcuuuucccagaauaggccucucugucuuuucuuuccagccagucgcccuaugguuauucaggaaucaaagucuuugcucagaaauccuuuugaagccaucagaccaggaagugcucaacagguugguugggaaccuuguuaaucugacaucauagucuacagguuauaaaggcccagguccagcuuagagaauagucucugucauuagaggaaggagguggcugcagggaaaaaguuaaugucaaaggagucugcuauuucuuuucuauuugaauaggguaggcauauguacccucaauaucuagggggaagcagggagggaaggacuuuucauucuuuaguuggcacuugggauuugauaccagaugacucuucuuuccucaggugaagacaggcucacugcuaaaccagcccaaagcugugcuucagaaacuggcugcucucucugaccauaaccccagugcuccucgaaauucaagaaacuuugucuuucauacacuuucuccugucaaggcugaggcggcaaaggaaucgucuaagucucagguauggaauuugagaacuaauaugguggcuucccaaaccagaauuuauucauuuauuuaaauuuaaaaacaaaaauucuggcuuaaccucuaugcugcaauguugaaaucuugcacuccccgauaagguacaagagaauugcuaccccagucgguaaucaacuuuuaaacuugccgagaaaguuuaucuuucuuucuuuuuuucuguuguuaaucauccacaauuuaugaguugcuugagagcuaauugaagguaaauacuuguaugaaggucuuuagcuggcccugacucccucucugcucucuagguaaagaaaagggguccaucuuucaugacuucuccuucaccuaagcaccucaaaacagaugauagcacuucaggauugacgcgaagcaucuucaaauauuuggagagcuaacaccaucaaaggugccaaaaucuacauugagacugcuuugagaaguuucuagcacugaaaguuggaauugacacuccagccaaugauccuuccuucuuucauaaucaaugcaauaagauugcagacagaaauuccagugauuucuacugcacagcucuggacaucucuuuuccuaguauuauucccugaauuggccacugauuucaauucugcaguauuuacaacaucaacaacucauggaauacuugggugagguuuccuuuuuuuuuuuuuuuuuaagaugggagucucacucuguugcccagcuuggagugcaguggcgugaucucggcucaccacaaucucugccucccagguucaagcgauucuccuccuucagccucccgaguagcugggauuacaggcaugugccaauacgcccagcuaauuuuuguauuuuuaguagagacgggguuucaccauguuggccaggcuggucuugaacuccugaccucaaaugauccauccaccucggccccacaaagugcuggucacaugcaugagucacugcaccuggccuuggguuagguuucacuuccuccauuagacauuugacauuuuauuguagcagcuuucuggguuaauaucucuuugugauugauagaagugguuggaagaggaagaguagggaaaagugugacauuacagauuaaacagugaaaaucaguaccauaaugacuccuuuacacccaugagauacguaccaugaugaccagggcucggugaaagaaagauuucuuuuuuuuuuuuugagauagucucacuuuguugcccagucuggagugcaguggcgcaaucucggcucacggcaaccucugccucccggguucaagugauucuccugucucagccucccaaguagcugggacuacaggugcaugccaccacaccuggcuaauuuuuguauuuuuaguggagacagggagucaccauguuggccaggcuggucucgaucuccugaccucaagugauccagcugccucagccucccaaagugcugagauuacaggcgugagccacugugcccagccaaaagaacgauuucuuagauggaggaccuaggaaccaacagaugggcugcuguauuacucuuaccccuuucauuuuccuguaugcuucuucccaaggcagcaucaaauuuugaauuaauuuuugcugcuuaauaaggacuuaaacugguacccaagucagaaagacucugccucuaauuuucuggggcuuggggaugaagauaaaguguuacacccaguguuuguccaccacagucuguggggcagagagacccuuccugggacugaauucucaauuugaagcacuguuguucaaagaucucccuucugggucugacaagaagaaacauaacccuuauuuauugcauucuucuggcuuacauacauugcccucacuaaucaauggacauuucagcauuucauuacuaauuuugagagaaggccaccauggaauuuaauaaaaauauuauugaagagaauugccaucauucuccauuuucccugaacuaccacaagcuucucagaauuuuagacaaauguuuuuccccucagaacugagcaucagugcugcuuuggaaaaacauuccaugugaauacugugguuucagugucaggaccuguacuugggcaguuggaagagagugugccaguuuuuuacugggagaugggaacaccaauuuaauugaugcaauuagguuguagguuuuuuacaguuuuucuuuucuuuucuuuuucuuuuucuuuucuuuucuuuucuuuuuuuuuuuuugagacauaggcuggcucugucaccuaggcuggaauacaauggcaugaucucggcuuacugcaaccuccgccuccuagguucaagcaauucugccucggccucccaaauagcagggauuacaggcaccugccaccacucccagcuaauuuuuuguauuuuuauuagagaugagguuucgccauguuggccaggcuggucuugaacuccugaccugaggugauccacccgucucggccucccaaagugcugggauuauaggcaugagccaccgcacccggccgguuuucuacaguuuucuaauacucaagauguugacuuugacaauacuuauguuuguauacuuguaaucuuauaauggggaaaauguguauaaagauguuuuaauauguauguaguuuuucaauaaaucuuaaugccuugaagggaagauuugcuguccagcuugaaugcucauucuugggucagugccugucuaaccuugaggagcauuucauuuucagguuaucuccaucccagggaaacccucugggucuaaacugagaagcugcugcaauuguccccucacuggcuucucaguccuagugaauugaucaaguuaacuuaccaagugguuuggguucagcucaggugaagaggauaauugaguuuacauaaaugguaccuucuauuauagcucuuuguuuaaaaaacuuauuuuuuagagacagucucauucuguugcccagguuagagugcaguggcacaaucauagcucacuguacccuugaacuccugggcuucagcauccuccuuccucaaccuuuggaauagcugggccacauuacaggcauaugccaccaugcccagcuaauuauuuuauuuuaguagagacagggucuugcuguguugccccagcugaucuugaacuccuggccucaaguaauccucccaccuuggccucccaaaaugcuggggucacaggcucagccaccaugcccagccuguuacagcuuugauuggccuuucucuuuagcuaaguuuguauguacuucauuuuauccauggguucaagauacauguuuuugccucuuucuuugaacucucuaaacaguucccaaggcaaaguagcccuugcugggcaaaagagaacugagcaggaaggcuagauauuucuucccucuuguuucccuacaugucuuuugaggagagauagaaaagacaauuggaauugacaacugaggauaagaaaauucagccagguccgguggcucacgccagcacuuuaggagacugaggugggugcauugcuugaacucaggaguucgagaccagccugggaaacauggugaaaucccaacucuaaaaaaaaaaaaaaaaagaaaaaaaaaagaaaauuagugccugagaaauccagggagaaaaugguuucugggcugggcgugguggcuuaugccuguaaucucagcacuuugggaggcugaggcagcuggaucaccuaaggucaggaguuggagaccagacugaccaacaaggugaaaccccgucucuacuaaaaauacaaaaaucagccaggcuuggugguggcaggugccuguagucccagcuacuugggaggcugagacaagagaauugcuugaaccugggaggcagagguugcagugagccgagaucacgccacugcucuccagcaugggcgacagagugagacucccucucaaaaaaaaaaagaaagaaagaaaaugguuucugauugaggcuccugggagaaagcacucuuuggagaaagaaaacuugagucaaacucuggguuacuuuuccuuaugccaggauggcugcuauaaaguaagcuaagccuugaucuugguaacaggauugacauggacaguuucaaucugacccauaugcccuuugcccaaagcacugagccagcagcaucaguuauguuuuaaugaaauugaagccccaggaccugccacuauggcucugaggaggacucagcuucacuagcuuggaaauuacauauuuggagggaugagagcccaugagugugggagauaggguaggcucagugucaguguuuuuguuucuuccuuguuccauacacuugaguagggauacaugguauuaaccucuuuaaacaggucucuaauuucaucucauuaauucacaguugcacagccauacuagggucucuuccauaaaccauaagauuuuauucaccaaagcucuagagacaagguacucagaucucuguggcaucccucauuuucucaacugcuucucuacaaacuucuccucacuuugagaguuucuaaugcucaggcugggagacuuuuuaggggguguuuuugguuuuuaucuccuaggguuaugucuaaucacucuuguggcauccuguccugggauuugugcuccuaaggauagaggagaguauuucugggaggaguguucccaugauacuauuugauuaugucauccuugagaugguauuguaucuucuacccuuauauccuacucaucgccuggcacacagcuuggaauguaguggugccuaccacaguuugaauaaauaacacuacaccuuuca

SEQ ID NO: 192988 - RNA, 102616 nt, Homo sapiens
ggggaacgagcuggggaagacggagcgggcucugugccgggcgggcgggcggcgggggggccagcgaccgcagccggggggacgcgggaggauggagcaaguggagauccugaggaaauucauccagaggguccaggccaugaagaguccugaccacaauggggaggacaacuucgcccgggacuucauggugagucucuccccucgcugucgcguuuucuugccggcgccggagcccaucgccgccucucccggccgggccgccagugcuuuguguaccucugugaggagaggggcggagggggcgcgcaccagccgggugagccggguggucucggaggccagcgggaggcgagagcgccuccccccguggccuccuuucuucucccauguucgcgacccccgcgcggguucccgggacgcgaagggagcggccgcgcggccgagcccgcagccugcaccguggcucgcgaccaccuauuguuuaccgggccgggagccguaggcaagugaggugcaggccgggggggggggcucgcguuuccacaccuccccgcgcaguucgcuccucccaggagggucgaggcaagguaucuggcugugaccgggaggagugcagaucguggcugacagaggaacggggguauugagguuggcacuaacuccugggaucccuuugcucuagcuggucucaaagcgggcaggguaggacuuaggccguuucuggggucgcagucaugaucuccaacgcuugggaaaggauugcccauaaggaaucucauggguuuaccuaauuuccauuuacccgcgucccgcuucuccucuccugaggcccagguuugagguggucuugggguccgugugacuauagguucaggggauaagugugggugggggaauuauccugaaggaagccagccgacuucggacuccccaggggauauugccgaaggcggaggggaugugacuaucacuuccuauccgggguggggguggggaacuugggaacaauaguccugguggggcggaggcgacgcuacgggccgaagcccugaacugggagauaaccuucccagcgcccccccgccuccgccacccccuacuuuccgcccucugcuugugcaggcagucuugagaggaggugaagguuaaaagucuuguucaugaaauugcucuagauacacuauugcuuuagcacacugugagggggucagauccgaaggcgugagaccagaagucgacuuccuacguuacccacccccccaacccccgcccuuuuuauuuuucugcuggacaauguucccucuaggguuguuucccggcuuaggaggcggugguugcggcugcugcuccuacggauauugcgcaagacuggggcguuggaaacccuguaggucuggggaaugaaaaaggaagugggacuuugggaagugguugcuccuuagucuuggcggggguugggaaugggaaauaagcuggggaaaauuuuuaucuuggguaagguacaccucgaagaauaaucacuuaauucugaaaucugauuaugagaaggauacacaguuaaugccuguaaaaugaaugggcagcaaacauuggcuaguuuuuauuuuuuguuuaaaaaguacaguaguuuuuaugguggaggugauaugacuuaguagugaauacuuuuucacguuuuaaagagacuggucuaguaaagcuuuagcguuaaauuuuuaacagcuuauaaaauaggcccuugaccauacacaguauuauacuagcaucguugagcuuugugauucccgccuccccagaccaauaauagaggacggaaguaaaguuuucucaguaucuuuugaagauugaaaauauaaguuaaauaaucuaacuuauuccuuauuaaaaauaaaaauauugcuuauauuuaaacauuugcucuugauauuuagccuauguauuuuugaaaaauuacuuuuugaucugaaaggguuaaggaaaacggcauuuucccuuuuuacuauugagaguuuuuauugucuugguaucuuuugaauggugucauuuacagcaauuggauggagucccuuuuuuacuacuuucuagcaaaaguagaagaaaauacuuugaauauuuaagauguuuaaaacuaguuuuuuuggguuuuguuguuugguugguugguugguugguuuuuuuuuugagacggagucucgcucuacgcucugucgccccggcuggagugcagcggcgcaaucucagcucacugcaaccucugccucccagauucaagcgaugcuccugccucagccuccugaguagcugagauuauaggcacgugccaccacgcccggcuaauuuuuguccgaaguagccgggacuacaggcgcaagcuaccacgcccugcuaauuuuguauuuuuaguagagaugggguuucgccauauuugcaggcugcucucgaacuccucaucucaagugauccaucugcuuuggccucccaaagugcugggauuacaggcgugagccaccaugcccggccuaaaacuaguuuuuuaccgucuuacuuugguuauggaagaagagaugguguggucccuggucauuucuuguuugcaugcuagucaccuuguuaucccuaggcauauaccgucaggaaggagcauuguuuggugaugcgggccaucaggacagguugcccagccucugaacuccuguacuggagaaguggccuuaggguucaugcuuuggggaugagucagggauuccuauuggagaguucauuucuuucuuucuuucuuucuuucuuuuuuuuuugagauguaacaccucgcugugucgcccagguuggagugcaguggcucaaucucggcucacugcauccuccaccucccagguucaagcgauucuccugccucagccuccugaguagcugagauuacaggcgcaugccaccacgccuggcuaauuuuuguauuuuuaguagagaugggauuucaccauauuggccagacuggucuugaacuuucaucugacugacuuugugaucugcccgccucagccucccaaagugcuaggauuacaggcaugagccaccgagaguucauuucuccaagaguaaaugaguuuccuuuuucuuccaugauaccuagguauagcuaggugauucuacauuagagauuugaugacuaaggcuauucuuuuauagggcuuuuuuuuuuuuuaauuuccugacuugauaagcaauagcuguaauuaagacagccgguaguuggugcugcuuuuuccccugacuggaaggcuggagaggaacuauguucuccuggcauggaaagagaaaaaaaagauuagcuuauagauucuauuauuuuuaaauucugaugucgauuaaaaaugcauuuuaaauucuuaacauuuuaugacugagccuuagagauaauguagcugauauaacuguuccaucauaaaauaauguuuauuccaaauuuggaaauuaauagaauaauaauaaugccuuacacuuagaccacaguucaaaugaacacuccacuugccugacuggugaugaugcucuuuucgcucuauccagcuguccuacaguccugucauuuaaaggcuaccucuguuaauauuuuuugguuuuguuuuguuuuguuguuuuguucuguuuuugagacagggucucacucugucacccaggcuggagugcaugguugcgauccuggcucacggcagcgucggucucccugggcucaggugauccucccacuucagccuccagaguagcuggggcuaugggcccaccccaccaagcccugcugauuuuuguauuuuuuguagagacaggguuuccccauguugcccaggcuggucucaaacuccugggcucaagcaauccaccugccucagccucaaagugcugggguuacaggugugagccaccguagccggccuacuacuugguaacuaucuuauaucuuaauuuuguuucuuuauguuugaguauuuaggucauucuacuuucugcuguuacauauaguaauucugugauuaacauuuuugcugaaacugacauuuuucacuguugcauaagauagcuucccaggaguacuagguagacguauauaaacauuuaauacauguucauaaacuugaaaaaguuuugucaguuuauacaacugucauaauguaugaguguucauauuauaauuuucuugaucuuuauuugaugguugaaaacugauaucuuguuuuaacuugaauuucuugauuacuauugaggauagaaauuuuccaccugucauuacuauucuaugagugucuauuccuggccuugguugugccccauacuguuaaagaggagacagcuaagguacccagacugugcagaacuauguugccuagaugguuauuugcauguugaaaacaugcuaauuuugcuaauaaauuagcaaauagcuaauuuguggcugauccagaauuugaucucaauuaucucuacuuuuaauauuuacaaaaugagagauaaauguauaaaguaggguggugcacauucauguuugacagaccuagguuuuaacuccacacagacucccucugauggcuggggguuggggaggugguccuggaccauacuuugagaaccagugagcuaauacaugguaaaugauaaagguaaugcugggaaaguuagguagaggucuuuuugugaaggaucuuacaucuaugcuauacuuagauuuuauucuacagaccgauaauagcaauucuggacagucugcauuguaacuccuagagacauggagaaaguagggagguguuaagaaaauagacaugcugguccacuccagcgucauucccccaucucaccuucuccagccugcuccuugaguuguacucugaaccuucacuuacuuagauagguucugguagaaaaggugagaaucauuagucuggguuucuggagcacuacugagucuuuuaagaaagguaaacagucauuuguguuuuacaaaguugaaucugauagcaguaugaaggguggcauuuuggaagcuguugaaauauaagaagugagaugugagggccugaagugaacugagauggggaaauagaguguauacaacacaucugauaagaauuaagaaaggagucucaaugauucauuagauguagguaguaaagaagaaaagaguauaguguuaugacucgcaaaauaucuagcuugguaucugucacccaagcuagagaauaccauuugguagaguaaggagugagggaggagaaacaaguagaggagaccaaacaacauuguaggaggaaguuucagggggagaagaggauaaauuuaauuuucaacauguuaaaacugcggugccucugagacauccaguagaaauguagagcucaagauuucugacaggacggaguuaaagauguaggcaucauaauauaagcauguaggagauagucgacagcaugggagugaaugagcuuauuccaacaaacuuauagagugaccagcuuuagguugaagaacaucagucuuaaaauaacagccaaaagaaggauauacuagugauuguuccugagaagguguggucaaggaggagggaggagaaccagagaugucagaaaagccagggagaguuucaagaaaggaguuauuaccagagucaaauaaugcugggaggaccgguaaggugagguugagaaaguaccuauuccauuuggcacauaggagugcuuuggugacuagaaaaaacaguuuggguugggguaugggaagaagcuagauuauagggugaaggguggguuuagugucuuuccauuuuuuuuaacauuuugaaaguagaugguaggagcuagaggaagauugguugaaggagagugugccccuuccacugccuuuuuuuuuuuuuuuuaaagagagaacuagagaauauuuuucuuauuauuucuugucuauguguauauccucuuuagccugggaagaucuuauguugcagucuugauaaauauaaaaauuuuaaucauuuguuuauucaguguuguagcuuauagguuuaaaaaaacuaauaauagcuuuauugagauauaaguaccuaccauaagauuuauucauuuaaagucuaugauucacuaguuuuuuauuacauugaugaaguuaugcaacaauaaccauaaucaauuuuaggacauuuucuucacuuucuguacccauuagcagucacuccccgccuucccauaagccccaggcaaccacaaaucuaccuucuguuuccauagauuuaaguauucuggacauuuuauauaaauggaaucauacaauaugugguguuuugugacugacuccaccuaacaugaugauuucaaguuucauccauguuauaguauugauccguaguacuuuuggccuuuuuauggcugaauaauauucuauuguauagauaccacauuuuguuuauccauucaucguguugauggguauuugaauuguuuccacuuuuuggcuaaugugaauaaugcagcuaugaacauuuguguacaaguuucuguguggacacauuuucaggucucuuggguauauaucuaaguguggaauugcucagucacgugguaacacuauguuuaacauuuugcggaacugccagacuguuauccaaagcugcugcacauauuacauuccaaucaggaauauaugaggguuccaguuccucuacaucuucaccgauacuuguugcugucuuuuugauuauaggcauccuacugggugugaagugguaucuucuugugguuagcuuguaagauuuugugugucuuaauuugucuuucaaagcuagagugauaggaaauauuuuccaguccuugcauuugagcuaaucuuagugcuuacccagugccacugguuuaguuaugguuuucuuauccauccuuugaugaguauucaccuaaacauauuuacaucaacuaacuucagaaguggaagugaacuuuuaaguaacucuccagacaugguucacugagacaguaaacuaaaaauuuacuuuaagcauucucaagaauguuuuacuuuauuuacuuucaaaauauauuaacuuuuuuccaucaauauuugauauuuaacuuggaaaaaggauuuuuaaaggaugaaacugaaaguaagacauuaacauuuagguggcuguagguuuuuuguucauauguuaaauacuucuguguuucuguagcacugaguucauuagauucauaaauauuuacauuucugucuuccccagacugaacgccucccaggcuagagacugggacuuaauuaucccuguauccccauugcuuaauauagugcuuggcauuuaauaggcacuaauguccauugcaugugcagacauuguagacaaacuuaaugcuguaagacagauuuauucuucaggugaauucuucagugguccaaggguuugucuucuagacgaucaugagaacugcuucuuccccuccuacacagaugugcucacauaacucguuguauuuucaguauccacugaaaaagaaaauacaagauaagagcuacauugaauucaaauauuuuaaauaaauaugauuuuauuagcugcaguuucuuaagguaacuucuguauuugugcaucccacacccaauggaucauacuuuguugacauugucuuagaguauuaauaaaaugucuuuuaaacuuuuggcuuuggacuuaauaaaaucaagauaucaugucaucgguaucucuucaaaaauagugaauuuguggguauuuagagagugauuacaagugauaucuguuguucucuacuugccucuaguuucuuuccucauccaguccauucaacacaucauacucacuuucaaguggcagcaucuguaggcuaauggaaaccauacugguuguacaaucaggagaugugggcugcacuggaagcaugguuuaauuuuuauuauuaaaaauauaaguuaaaaaaacucauugcucccuuugaugaccauuacaauuauuggaaauuuuaaauguguauuuugaaagucaauucaaaacauaugauccaagugcugcuccuuuuucaaacuguaauuaugucugucucucuuuccagagagauuugauucccugauuuuucccuucucagcucccuccaauuuuaaauauauauauauaguuuuuuuuaauaauuaaaaaaaaauacuucaccuggaaguuuucauccaauuuuguaacuuugguccuaguugagaaucacaggccuauaggauaaagucuguacuucuuagccuggcauuccagaaccuucuuaacauaaugucacaguaccuuuccaguguuaaacuucuauacucugguauguauccucucuucuuuuugaaggaagcuauuccugguccuugagcauaccuacuaaaugaaugaaaucuugcuuaucugugguuguacuguugaacauacuuuuucccucagaaagcuucccuuuuauuuuauuuuauuuuauuuuuuugagacaaagucuugcuuuguugccaggcuggagugcaguggcaccaucucagcucacugcaaccuccgccuccuggguucaagcaauucugcugccucggucuccugaguagcugggauuacgggcgcccgugaccacacacagcuacuuuuuuuauuuuuaguagagaugggguuucaccauguuggccaggauggucuccccuuuuauuuuauaaaccaguacuuggaagaugagaaagcuaaaaauuuaaaaugacuucaccauguucaccaaaaacucagaagcaaaaaugugauuaauucucaccuucuagaauaaauauuuuagcacaguuaaucuuaaagcacuuuuucuccuuuguaaaguuugaucuuuaauaucacaagaaaaaaagccuuucauuagauuugaguugaaaacuugauaagguaaaucaggugauaugcaauuucuaaaccacuagucuuuuccaaauaugaguugaacuccucuuccagcauuuuauauuuccuguaguauuuaaguuucuuuagauucaugcagucaaaccuugacaauuaucuccuuccuucugaaaucacacaaaaaucuuguuugcauuuguacaguauuguagggucuguagcuggccuauggcagauauaagaagcaaacaguaguugcucccuaaaaguuuuuuuuggagaaaguggaguguggacuguauuaguccauuuucacacugcuaugaagaacugcccgagacuggguaauuuauaaaggaaagagguuuaauugacucacaguucagcauggcuggggaggccucaggaaacuuacgauugugguggaaggugaaggggaagcaaggcaccuucuucacaagguggcaggaaggagaaugaacaugggaggaacuaccaaacauuuguaaaaccaucagaucuugugagaacucacuaucaggagaauagcaugggggauuauaauuacauagggauuauaauucaagaugagauuugguggggacacaaagccuagucauaucguggaccaugauaaucucagaggcuuugggaagugugcuaauaucuacauuuccuguaauaacuuuuauaucuaaucggcauuuaaaaagcuauuuuaacaacauuugagugacuguccugauaggcucugaaggaaugcaaagauuugucucugucauccauccauggucucugucauccauccauggucucuaucauuuauccauucauacagaagguauuuauggagauaccugagugcccacuaugcccuagguacuguguuuuugaauugacaguugaaaacauggcaguacucuguucaggaaguuuacuaacugaacagaccugugagaagcagcgggacuuuuccugggggcagugggugggcuucaggggaaucuuugaacccuuuuaaauuauauauaauauuuuuuguguguaagcccauuuuagggggaagaaaguucauagcucuuaguuucucaaggaguuugggucccuuagacuaguggaaagauaaggaguuuaggagcuauacagucauuaauuucuauccuggcccugcugugauucugagcagauuaucuagagaaguuggggcucuaauaccuaccuggaaagaacaagauaauauauguaaaguuucuaacauaguauauagaagguagucaaaggaauuugagaugacauacugcuccaguggaaguauauucggaauauaagccagagagacaggagagccuaaaucugucugaauagaucauggacaguuuccacaaagaugcuacauuugagcugguuuuugaaggaagaguuugucaggugaacuaggugaguaaaaggcaacaacacuuucaaagacuuggagauaaacagagauagaacuguggguuuuagaugggaagaacagggucaguguguauaaaauaagaaaaucuuauguacccaaauaauaggauuuccaaaggaauaucagcuuaaaugcuauuaugaaauuggccuguguuccugaguguuuugaugaggaguguuuugauguuccauuauuauggcauaguuguuugaucuuacaguaggaccuuuuaaaaauugaguccuugucacaugguaaauguucuuaaaucugguaauuuuacuuuaucucagguauauaaaguaguacucucucuguuuacacaguucuuagaugacuagauuaguguuucucauuggcaucuaucagauauguuuaaagugcccuguagaaagaaauuacauuuaaaaagccuucaggacuaaggcagcuuauuuauaauggugggucucuugcuuaguuuggauuccucagcgaauugaguuuuccauaagaugacucugaagagguuuugagacugcauuugugaccagaaccaacgugagaaaggaagggaguucuaggucacaugcuacaaaaccaugaagaauaacuucucuagacaccuucuuccccauuguguauguugguuuuacuccugacgucauaaacucuuuaguguuagaaggaacauaaaaacuguuuagaaauuaaggagcuuguuacaggucuugccauagaaaggugguggaacuggguuagacccaaguuaggaaagcagaugcuuuuuauaugacaugaugcugcuuaggccaacauuuucagucuuagggaaaaagucaauaaagccccacuuccuaccccccuagaguagagcauaaauauccucaaaauuacaaaaaaaguuuucugucaguauagauuuuugguugcagccuacuuccaaaaaguagcuuaagugaagaaagaauuuauugcaauggaauacugcccuugagcagguugaagcaucagaaccaagaaauagagagccugggugacuccucucuccaugccagccucuuugucuuucuaugguuuucaaguuuccaugucucuggggcugcuuggauacuucucuuugcuucucugcacaccugcuuuacuauuaccucucucugcauuuugacuuucacuguuuuggccugcaugugcugaauaaagacaucccuuaugguaaucuaaccugucucauucacuuuuaucucaaauuauggaaagagcucagaaugacuagaauugcuacaucuuguuuucaauuuccugaagaaaauaaccaacuugccagugagauggguguuguauaagguggugagcuuauucauauguguauggaaggaaggaacuuuuuuuagagaaaggaagggauggcuugauaacuaggcgggcaguccaaagagugucuaguagagaauccuugaagcaaaauugaaaaaaaauuuacuauuuuaagguuucagcuccauaugaacuccacccaccuucuuucagagauggaaaaagcacaaagaguccuugugacuugagagaacaauuuguuggcucuggcagagcauuauuucacauuuacaguuagacauuaaacaucaggcaaaauuuuaagguuucuguguagcaaacuaaaauuaagauuaucuauaagcugcuuauuuaugguaccuaaauuuaaauuauaauuuuucaacauuaaaauauggaaccuucuugcaaggaaauccuguuuuaaaguuuggguuuuuguuuguuuguuuuuuuuuuuuuuaagagauaggguccugcuuugucacacaggcuggagugcagugguguaaucauagcucacugcagcccugaccuccugggcucaagugauccucucaccucacuccugaguagcuaggacuacaagcauguugccaccauguccuacuaauuuuuuuaccuuuuuuguagagacgaggucuuacuauguugcccagcuggucucagacuccuggccuaaagcaauccuuccaucuuggcuccccaagugcugggauuauaggugugagcgacugugccuggcccuaaggaucacuuuuaucaaaguagucacuaugauuuacucccugaucauaugucagaaauauaucacuaucugaaaaacuaacauauuuucuucacaauagguuuugcauuguuaaaauuauccuaacuauaguucuuuuaguucaugaaucaucuaaaauuuauguguuacuauauucauuguguuugccuggcuauuagugugccugucuuugugccugugugucugccugccugccuuugugccucccuuugaaauucuauuugccuacucaccuuucucuaccuacucagucaguugguugucugugcccaagauuuauuaauguguguuaacguguggguaguagagauagacuggaagguacuuuguaguuuagaaaugucuguaauuuacaccuaguuguuuguaauucaucuaauacgguaaauagauuauacaaggggacuucaaaaagcucauggaaaaauggaauuaaguaaauaaauguuauuuauuaauaaauuuauaaauagacuaaaauuaaaauauaaaguuaauuucugaacauaaacuccaucaguuuacuuuuauaagugaugauacaccaaccauuuuguuuaucccuaagaacugaggguccuagaaauuuaaccauuucaaugcaguuuuuuuacauuauuaacugaagaguaaugaaugcccuuuaaagauuuuuuugagauuaggaaacaaaacgaaggcagaaggagccaaaucaggacuguaagguggaugccuaauggcuucccaucugaacucucacaaaauugcccuuguuugaugagaggaaugagcaagaggcauuuuuguggguagaaaaggacucuggugacgcuuucuuggauguuuuucugcuaaagauuuggcugacuuucucgaaacacucucauaauaagcagauguugucuuuccuuggcccuccagaaaaaucaacaugcauaaugccuugagcauccccagaaacuguugccaugagcuuugcucuugacugguccacuuuugccuugacuggaccacugccaccucuugguagauugcuuugauugacuuugucuucaggaucauacugguaaagccauguuucaucuccuauuacaguccuuuuaagaaaugcuucaggaucuugaucccacuuguuuauuuauuuauuuauuuauuauuuuucauuuuguuuuugagauggagucucgcucugucacccaggcuggggugcaggggcaugaucucugcucacugcagucuccgccuccuggguucaagcgauucuccagccucagccucccaaguagcugggauuacaggugugcgccaccacacccagcuaauuuuuguauuuuuaguauagacaagguuuugccauguuguccaggcuggucuuggacuccuuaccucagguaauccacccgccuuggccucccaaagugcugagauuacaggcaugacaguuuaacauuuccauugaaagcucugcucuugucuguagcuaucugggugcaaucauuuuggcaccaacugaguggcaauuuguucagcuuuaauuuuucagucagaauuguguaagcugagcaacuuaagaugucugugguguuggcuauuguuuaugcuguuaauugcagguucucuucaguuagggcaagugacaagaugaauuuuuuucucaaaaaucaauguggauggucugcugcuacagguuucuucaacaucacguuguccuuucuuaaaaagaggcauccauuuguaagcugcugauauuuggggcauuguccccauaaacuuugcuucaccauucuuccauccaagcuuugccauaaauuugauguuuuguucuugcuucaguuuuuuagcagaauucauguuguucugauaggggcucuuuucaaacugauaucuuauacuucuuagugcuucaaaugagauccuguucaucagacauguuauaagaaguuaguaugaguuuauuuuggugcaaaacaaaauugaaauccaugcauaguuuuuuccaugguacauauuuuccaugaacuuucugaagaccccuuguaugaaugccaaggagaaacauagggugggugguuauuaguaauaggauuuugcaacugaaauaauuaaacauguucagauauuuaucuccacacccauucacugacauuauuagauggugcacaaaaguaaaaaguuuauuuuaaaauuacuuuauaauuuagauagaagauuauuaaaauucauuuuuaagaaacagagucugucucuguugcucaagcuugagugcaguggcacaaucacagcucacuguagccucaaacuccuggacucaacagauccgccugccuuagccuccuaaguagauaggacuacaggcaugagccacugcucccugguggauuacuuuuaaaguauguuuuuuuuuuuuugaaaaugcaacuuaaacuagaaguacaggaugaauauuuaaccaauacauuuaauuucuugucauugcuuuauuagaugcuguuuuuguauuguuuauaaggucucagcaucauauguaugauauuuucaaauauguucuaaaaugaccucaucauuuauuucucuaguuguuaaagaagguauagagguuuuaucauuuuuuaaaauaggauguagguuggauuagaucuauaaauuauuauuuugccuuuaaaacagguuauagauaaaagagggaaagguaaucuggugauacuacugggcaggaaucuuuaaauuauuuaaagaggguguaaacgaaggaauguacaaaaguaaaaauaggcagggaagaaaagaccugauggaaguaacauaucuuuguuaggaauuugagugucuagcauuauaguggacaguccaaugauaugguuuacaacaguuauauagguauuagaccuggccauuacuuacuauguaauguugaguacaugauuugaaccacucucaaucuuagcuucuuuaucguuaaaacagaaauaguuuguaauguuugaauuaguaagaauaaaggacacagugucagaugugucagaaggaagcaugauuagggcauuaagugagaaguuaaauaaauaggaggggaaaaaggccaccccuugcucuuuuucucuuuuggaccuuuuuggugacagagacagaaagaauguguauaguauauuuaauuaucugaaaauacagagcugagcaucccuaaucugaaguuuaaaaugccccuacauccaaaauuuuuugagugccauuauggucugagagcagacauuguguaugauugcuguuuuaaauuuguugagguguguuuaauggcccagaauuuggucugucuuguugaauguuucauguaaacuugagaagaauguguauucuguaguuguugucuuagguagucuauagacgugcauuauauauccaguugauugaugaugcuguuaaguucaucuguguccuuacucauuuccugcuugcuugaucuguccauuucugauagaggaguacggaagucuucaacuauaauaguggauucaaauauuucuccuugcaguucuaucaguuuuggcucacauauuuuuaugcacaauuguuagacacauauggauuaaggauuaugcugucuucuuggagaacugaccccuuuaucaugauguaaagccacccuaucccugauaacuuuacuugccaugaaaucugcuuuaucugaaauuaauaacuagucucauuuuauuuuuguguuagcugauauauuuuuuuccauccauuugcuuuuaaucuguguguguuuguauauuuaaaguggaucucuuguagacagcauauaguuaggucuugguuuuuaauccacucugacaaucuuuuaauugguacauuuagaccauucacguucagagugauuacugauagcauuggauuaaugucuaccauauuugccacuauuuucuguugucauuguucuuuguuccuauuuuuuuuuuugucuuccacuguuuuucugccuuuugcaguuuuaauucaaaauaucauaugacuguccuuucuuagcaugucaguuuuacuucuuuuuuuuuuuacuuuuuuuguuuuuggucuuuucuaaagagacaaggugucgcuuaguugcuuaggcuggaaugcaguggcaugucauagcucacuguaaccucaaacuucugggcucacgugauccuccugccucagccuccugaguagcuaggacuacaagugugugccaccaacccucaaguaauguuuuuuauuuuuuguagagagaaggucuuaccauguugcccaggcugucaaacuccuggccucaagcaauccuccugccuuggcuucccaaaguauugggauuauaggcaugagccacugugcccagcuggguguuuucacuuuuuuaagugguugcucuggcauuugcaauguauauuuccagcaaauccaaguccauuuucagguaacacuguaccacuuuauggauggugagauuacuuuauaaugacaaaguaacccuaauucuaucccuuguaucauugcuggcauuaucucacuuacaaauaaacauacacacacaagcauauauaaccaaauacauguuugcugcuauucugaauaaacguaucagaucaauuaauaagaaaaauaaaaguuuuaauuuuacuuucauuuauucuuucucucauuucuucuuccuuucuuuauguagaugugaauuccagacuagaauaauuugucuucucucuaaaaaauuuauuuuaacauuucucacaagguaggucuguggcaacagauucucuuaaucuuuucugggggacagggucuugcucugucugucauccaggcuauaaugcgguggcaugaucauggcacacugcagccuugaccugcugggcucaaccaguccuuuugcccuagccuccggaguagcagagacuacaggcaugcaccgccauacucacuuaaguuuuuuuuuguuucuguuuuuguagaaacgaggucucacuguguugcccagguuggucuugaacuccugggcucaaaccauccacccaccucagccucccaaagcauuaggacuacaggcaugaaccaccuugcccagccuuaauuuuuguuuguugagaaaguuuuuauuucucuuugguuuuugaaggauaauuuugcaagguucaggauucuaaguugguggguuuuuucuucucaauaugauauuuugucacucucuucuugcuugccuaguuucugaaacagagucagauguaauucuuauuauacuugcuccucuuuagguaagaugauuuuuuuuccucuggcuuuuuaaacgauuuguuuaucuuuuuuuuuuuuuuguaguuugaaagugauaugccuacauaaguuauuucuggcauuuauucugaucaguguucucugagcugcuuggaucugugguuugguuucugacauuaauuuggggaaauuuucaaucauuauuucaaauauuucuucuguucccuucuucucuuucuguuauuacccuuaugcauauuuacaucucuuguaguuguccccacaguuuuugcauauuccauucuguuguuucaguuuuuuucuagucuuuuuaaucucuuuucaguuuuggaagcuuuuauugagauauccucaaguugagagauucuuuccucagccaugucuagucuacuaguaagcccaccaacaacauucuucauuuuuguuacaguuuuuuaaaaaaaucucuagcguuucuuaggccgggcacgguggcucacgccuguaaucccaggacuuugggaggcagagguggguggaucgugaggucaugagaucgagaccauccuggcuaacacggugaaaccccaucucuacuaaaaauacaaaaaaauuagcugggcgugguggugggcgccuguagucccagcuacuggggaggcugaggcaggagaaugucgugaacccaggaggcggagcuugcagugagccgagaucacaccauugcacuccagccugggcgacagggcgagacuccgucucaaaaaaaaaaaaucucuaguguuucuuuuugguuauuucuuugaauuucugucucuuugcuuauauugauugcccaucuauucuggcauacugucuacuuuaucuguuagaguucuuaggauauuaaucauaggguguuuguuuguuuguuuguuuguuugugugaaacaggguuuugcuuugucucccaggcuggagugcagugauacaaucauagcuaacugcaaccuccgccuccugggcucaagcaauccucccaccucagccuccccaguagcugggaucacaggcaugugugaacaugccuggcuaaguuuucauauuuuuuuguagagaagggguuucgucauguugcccaggcuggucucgaacuccugggcugaagagaccugccuaccucugccucccaaagugcugggauuacaggcaugagccacccagagccaaggucucagucuuuuagugagcuuguuuauggauuuugaacuauauccuguuucucagcgccucacccccaggauggcuugaaugaccuguaguuggguauuucccuuaccucauguaaauaaggcucuguuaaaaccccagcagguuaggcucagguuaaaucauuucuccgcagggcagaccuuguuaagaagaauggaauauucggccaggcacaguggcucacaccuguaaucccagcacuuugggaggcugaggcugguggaucacaaggucaagagauagagaccauccuggccaacauggugaaaccccgucucuaauaaaaauuagcugaguguuccuguagucccagcuacucgggaggcugaggcaggagaaucacuugaacccgggagguggagguugcagugauccgagaccgcaccacugcacuccagccuggugacagagcaagacuccaucucaaaaauaaaaaauaaaaauacaaaaaaagggauuuucucuaauacuuacuaugagaaccugguagagcuccuggagguaaaacaaaaaugugggguccccuuuggauuggguacaccaggaguuuuuguuuguuuguuuguuuuuguuuguuuuuuuuuuagagcggucucgcuguuguccaggcuggagugcaacggcacagccuuggcacacugcagccucaaccucguggccucaugugauccucccaccucagccucccuaguagcugggacuacagauguaugcaaccacacuuaucuauuuuuaaauuuuuuguagagguggggucucacuguguuugccuaggcuggucucgaaccccugggcucaagagguccucccgcuuccaccucccagaguacuuggauuacaaguaugagccacugcauccagccuccccuggagauuuuaacccucauaguuguucacacugagccucuagcaguucaucaauuacaguucagguuucuuauggaaguuugcugugugaguguuucugcucugauuacucgugauucuccguauucaccuucugucucuccaguuugggggcagcuguuugaccugugacuuaacuucucuuacagaucuaagaaaaguuguugauuuuucaguuuguuuagcuuuuuacuugcucuuaagauugagugacagauuuuuuuuugcauuuuuuuauugugauaaaauguauuaauacaaaacauuuaucauuuaaguguacaguucuguggcauuagauacauucacacugugcaauuaggacucuuaaaaggaaaaagucacauacuguuagaagggucauacaaggcuuuauagaaaggauuuuuaagaugagcuucuauauaucaauuaaaagaacauuucaguagaaacaugggcguaugguaugauaauuaccagaagacaaaugcaaauaagugcugaacacaggaaaaaaauaaucaaccucuccaauaaucagaaaaauugaaguuaaucaucauuaacuguugggggaguagcuaccaaauuugauaaaaacucaaaaauucguaauaauucagaaauugagaauagcggccgggcgugguggcucacaccuguaauucuagcacuuugggaggcugaggcgggcagaucacgugagcucagaaguucgagaccagccuggccaacauggcgaaaccccaucucuacuaaaaauagaaaaauuagcugggccugguggugggcgcguguaaucccagcuauucgggaggcugaggcaggagaaucgcuugaacccaugagguggagguugcagucagccaagaucacgccacugcacuccagccugggcaauagagcaagacuccaucucaaaaaaaaaaaaaaaaagaaaaagaaaaaagaaagaaaaagaaaaugguaaggauauagaaaacuaguguuucuagguccauuaaggggaggguaaacuggugaagccuguuuuggaaggcaguuuggccacuucuaauagaauugauaaauguacauacucuuugauccagcaugucaacuuuagggaucuuuccguaaaaauacuugcauaugugcauaaaauaguauguccaaguaugcaacaauuuuugugaaacaaccuaaaauagcuauuaguaaggagacuuugcauaacugguuaccuaaaaggaaacagauguggaggggagagaguuuggcuuuuucauuuuauaccuguaugcagaaaagaguaacauagcaggccuaagacuacuauccuuagaaaggccugcuuacaauguuaucccuuggcuggugucugggaacuuagacuuuugggagaauuuccauuauccccugauaagagugguucacugugcccaaacuguacaaacaaugugguuuaugagcugggcccaguggcucaauuguguaaucucagugcuuugggaggccgaggcaggaggauuccuugaggccagcuugggccacauaguaagaccucaucucuacaaaacauuuuuaaaaauuagccagaugucauggugugcaccuguguagucuuagcuacuuugggaagcugaggcaggcagauaacuugaguccaguaguucaaaguugcagugagccuuaaucaugccacugcacuccagcauggguagcagaacaagacucucucucugaaaaacaaaaauaaaaaauaauaugguuuauguugaacaucuacuuuuuuucugggagucuggaauuuugguauauucuuaggcagagugccuguguaaccagccuccaauaaaagccuugggcacuuuauuucuaaugcgcuucccuuguggacaacguuucacacauguugucacaacuuauuucugcaggaauuagaggaucguguguaauuucauuagaagaggauuuuugaaagcuugugccuaguuucuucuggacuuugccucuugugccuuuuucuuugcugcuuuuacuuuguaucuuuuagcugugauaaauuauagcucugaguaugguuauauucagugauauguuggaucaguugauaugcugaguuuuuuacauguguguauuaucuaaccccuuuauugugcacauuuucccuugaugguaaaacagugaaagcuuuccuugguaacauuguaggugauauaauaaagaagugaaucaaaaagugagugucuuuagguauguuauuuaggacaaggagauacuacuuuagguaaauuauuuuaaauuacacuuccaguuuuuauuaccuucauaugucaauaggaugcuaaaccacagauguuaaauuucaaauagcauuuuaaguuuugcucucuaguuuuauaaaucauauuacauaaacuuacugaacuaaaugugaaaauagggugccaauucacugacuaugugauguuccgaauggguuaucaaugucuauuacgucuagcagacuugcccugcuuuguugaauguguauuuggaagacacuaggcucugugggggaagaaaaagaaauagguuauuaucugugaggcagugaauuauaaucuugggugauggcggcauugguagugaugggauaaaauguguaaacaugauggauauuaaaggcaagaaugacaaguacuauaugacuaggacauguuuuuggaauauaugccucauuagagcagggauuuuguccuguucaucucuuaucacuagcaccuaaaacagucccugggcauaggauagguuagguggaguuaaugugaagccagucgucgucauaaaagugauaauugaguuugaagaggaaguucuuuuuauuauaaaucucugaauccaguaugucagcaaacuuaaaaauauuuuuugggaauaucauaacaguuaauucaugaauaggucagaacuuucuaauguuguaugaauauuaugugaccugguaaucugagacacuuuaauggcgcuugccugcaacuagcuguucuuuuugauacuggauaggacauuuaauucuguacaaacaacuacuaaggguuucuuucccuuaaaaaauuuuuuuuaauugugguaaaauacauguaacaugaaaaccuaucaucuaagccauuuuuaaauguacaguucaauagcguuaaguacauucacauuguuguauaaccaaucucuagaacucuucucaucuuagaaagcuaaaacucuguucccauuaaaccacccucuuuauuccaaacucauucuccuccuuccuccaaccuguagcaccauucuauuacacuuucugucuguauggauuugacaauucuaggugccucauauaauuaggauuauaaaauauugucuuuuugugacugguguauuucaguuagcauaauguccucaggguucauccauguuguaguaugugucaaaaucuuccuuuuuaaaggguugaaaaauacugcauuguauguauauacuacauuuuguuuaucuauuugcccauagcaugacacuuagguugcuuccaccuuuuggcuauugugaaugcuccugcugugaacaugguuguacaaauaucuguucgagacccugcuuuccguucuuugggguauauacccaaaaauggaauugcugaaugauaugauaauucuacuuuuacuuuuugaggaaccaccguacuguuuccuauaguaacuguaucauuuuacauuucacaacagagcacaaggguuccaguuucuccauauccuugccaauaccuguuauucuggcuuguuuuguuuuguuuuuuguuuuuuguuuuuuauagaguugagguuuugcuguguugcccagacuggucuugaacuccucaaguggcacaagcgauccuccugccuuggccucccaaagugcuuggguuauaguuaugagccacugugcccagccuauuuugguuuuuugauaguagccaucacaaugguucgaguggauugcuaagucauacagggauguaaaauugugucuguugaaucaucuauaugaaauacuucauaggaauugaagcuauuaagauuuugaugccuguuggagauuauuggugacuugcuaaaaguaauuuuaguaggguaauaaagggaaaaaugaaauuuucagaggguguaggaguuagugguucaccaggaaguguaguuucucuuuagaaaguuuggucagcugaccacagcacuguggcagucuccggccuugcaaaaauaacuuuuuuccauauagcggucaauaaguauugaggucucuuaaacuacacaagugacucuuccugugcuauauuuguuuuugcagagagaagugugaauucugaaucucugcuacuaauuugggagucuuuguuuuauauuuguaaucggagguaaagagaauugauguaauuguggcuuaauauguuaauacuagaacuuaauauucucaauuuuacuguauguuuuuaauuaauuaauuaauuaauuaauuuuauuuauuuauuuauuuauuuuugagacagagucuugcucugucgcccaggcuggaaugcaguggcacgaucucggcucacugcaagcuccgccuccuggguucaugccauucuccugccucagccucccaaguagcugggacuacaagugcccaucaccacgcccaacuaauuuuuguauuuuuaguagagacgggguuucaccguguuagccaggauggucucggucuccugaccucaugaucugcccgccucggccuaccaaaguguauuuauuuauuuuuugagacagagucucacucuguugcccaggcuggagugcaguggugcagucucggcucacugcaaccucugccuccuggguucaagcgauucuccugccccagccucccgaguagcuggcauuacaggcgcaugccaccacgcccagcuaauuuuuguauuuuuuaguagagaugggguuucaccaccuuggccaagcuggucucaaacucccaaccucaggugauccacccaccucggccccaaagugcugggauuacaggagugagccacugcuuccggccugcuguauguuuuuauuauauacuaugagauaaugagauuagugauggauugcuuuguaauacuuugggagucuggguuuggcagagugugccccuaugaagacuaagugggacuauaaugauuguguuuucuuaaaucagaaucaggaugcauaaccagaugaaggaagacauagucgggagccauaguuuuaauaucuagauuuuggaauuuuagggugauuuacuauagggacaaaguauuugaaauugggauuggcggaacaucaguggaaccagcgauugcuaaguuaaauauauacagggacauuagauaauggaugaugaggaaauggguaaaagaaagugagggccuugugaguugaaacaaaaauaaucaaaccuggaacacuuuccauuuauuguauuagauaucuucauuucaauaaaauuaauguauaugacaaaauuuuauuguccuccuaguucaagugguauucuacuuuuauuuccauaaaaauauacuuucaggauagggaaaggguaaacuugcauuauaaguuuguauuuucucacgaagggacaggagagaagaaaaaaaucauuugcuuauugucuaggcuaugcaaaaaaaaaaaaagaacagccuuguuuuuuuauuacauuuuuucauuuaguuuaugauuugccauauuuauuauuuuaaaacaugaagucuguaguacaagguuuuauuuaaaaacauucucaaaaucaaggacuauuacuacaugcauucagggaagauuaucuagcuauauuggagagaucuccuucgcuaguaauugaugaaaccuaggaauugaaccccagcuucucugacuuaaagcugcccuauugugaaguagaaaugaaguguaagcaauauauucuuaaguauacuggucaauucugauuuacauagaagaccuaacaguuuauuuacucccuacuauuuguuaugggauuaugcugauaguagcuauuacuaauagaagauacggucuaaaucagggaauucguguucuaucagggauggcauaugugcauaucuaaauaauuacuguacacugggauauguucuagauaagagguguauauaaaguagauagagaugaggaaguggaugaugggccuguaugccaguacuacuaucaggaaaaauuucaugaagaugauuucuguauugggcuaguaaaaagcagggaguuucuuggcagacaauuaggggaauaagugaagcauacauuuugacaugagcaaagcacagaaucauuuuauuacuccaagacucauaagacuggcccuguuuacuucaaaguuacuuucuuuauuaucaauccugaguuggcuucaaaugaggaggcauagccaugcauuucugaaaaaaaagggagagaauuagucuguuaggcagcagugggugaacagugagcaaagauaggaagaugaauuuugauaggcagaguugcauauuuugcaacuaaagguagacauugcaguuguauaguugaaagacccuuugguuauuuuagcugcuuauaaccauuaucguuagugaugugcauuuuuucuuuuuuuuugagauggagcucugucgcccaggcuggagugcaguggugugaucucggcucacugcaaccucagccuccugaguagcugggacuacgggcacacaccacgaggcuuggcuaauuuuuguauuuuuugguagagauuggguuucaccauguuggccaggcuggucuugagcuccugaccucaagugaucugcccaccuuggccuccuaaagugcugggauuacaggcacaagccaccgugcccagcccauauacauauuuuuauguaaguauguuuguaaaguuagagauaaaauagugauaauacaguguuacuuugagauaguauaguguuacuuuggcugguacucuaauuuuacuguaugcugcuauuaauuuauauuugggguuuuaagaaauuuugguuugguuaucaugcaguuuguaggguuaaauuaauacuauuaagauggugugguuuuucuuacugaggacaguuaaaauuuucaaauauaaagccagaugaauuuauuuauuuaacaaugguuauugaaugugaacuaugucccaaaccugcuaccguuuaaaauucagaugaauucuccaguaauugccucagaaauuuuccggagcaauuagguaaaaggaguaugauuuuauggguuagguagccuuaauauuuugccacaguauaacucuuaagcuuaaaguaauuuccauuuuuauuuacuauacaaaguauaguuuuaauauuuguauauucuuauaugcauauuuacuaaaaguugugccuuaugaaacucauacuguguuuuguuguuguuuuuuguugucguguuuuuuuuuuuuuuuuuuuuuuuuuuuuuugagacggaaucucgcccuugugccaggcuggagugcaguggcacgaucucagcucacugcaaccuccgccuuacugguuuaagugauucuccuaccucagccuuccgaguagcuuggauuacaggcaugcgccaccaugcccagcuaauuuuuguauuuuuaguagagaugggguuucaccauguuggccaggauggucucgaucuccugacuucgugaucuaccagccuuggccucccaaagugcugggauuagaggcaugagccaccgcacccagcugaaacucguacuguguuuuaaguguuauaacauugaggaauuugaggcagugguguguggucuaauaacagagcaugagagagcuucagcuuugauacuuaauuucuauauaucccaucuuauuccgaaaggaauuucaguuagcuuaauuuccauuuuagugcuguuucuuuuuguguuaauuuauuguuuucuuaauugugcugauuuaaaauccagccaacaaauuaauuuaacgcuugucugucuaaauguauuuucacuucaaagucucuucagugaauaugaagacaauuagcuauauuuuugcuaacaagauuugcugauggggagaagagcgagauaaaggaacaaaucaaggaugaguguuagguuuuuggcuugaacuacuguugaaugguggugguuuuuggcuugaacugcuguugaaugguggugcuauuugggcauguuugugaugcccauuacacauccaguggacaggccaauagacagcucuuugacucuggagagauuuaacaaacuuuaaacauucucaggagcuuagaugaacaaugaacuguuccacucuuuuaagaacuugaaucuugacacacaaguggguaucuuaaagucacauugcaugugauuuuggaggcuuuugagaauccauuuauugauuuaggauuaggggaauacaaauuuaguguuuuaggaaauuguuuaaagcaaagugaauauuaaacucgaauuuuguuuguaucaaaaauucuaaguauuaaaaauguuucucugacuugucugagaaggcucaguaaauaauucuucaauuuguaaugagaguuuugcuuugcauuagcuauuggucuauaaaguccaguaagauagucuaaucucugccuucaguuuuauagauuaguggacgagacagacaaguacugaaauacuuaagaaauacuuuucacaaguggcaauagaacaauguguuauggacucauugcagaaggcugaggagcaguaaaggagggaagguucaagaaagccuucaaaaaggaaauaacacuuuagccagagcccuacucaccaguaagagcaaaaauugugcaacuuugauauuuaagaaauggaggguuacugcuagucauagugguggugaguaauucuauaugacuaaagcaucaaacucuaauaagagcauuauaaaaagaggcuagaaaauuggacaggcaacauucaacauaucuuauaauuaaagauuugguaguuuauguuagaggugauagacacauaggagaguuuuuaaaugugggaguaaaauggucagacuugacuuuuuagaacaguaauaaaggagugcaguuauuuuuggaauucauuuaugugacuuuuuaaagacuucugggguaggcuggugcaguggcuuauggcuguaaucccaucacuuugggaggcuaaggugggcagauggcuucaguccaggaguucgagaccagccuggacaacguggcgaaaccccaucucuacaaaaaauacaauuagccaggcguggcggugcgugccuauagucccagcuacucgcuaagggacgcugaggugggagaaucaccugagcccaggaguuuaagacugcagugagcugugauugcaccacugcauuccagccugggcaacagagugagucccugucucaauaaagaucuuuaggguagacuuaauugcaaaugcuuucuuaaaggauuuguuuguuuucuuagcuuuuuuuuaaaaagucacacgauaaagggugugguggguaccuauaacuuaauacggacaucauuuagcuauauuuuugcccaguuaauacaguaaaugauuaaaaauucuuucuugcuuuaggauuauaugaaauaauuaaauuauauaauaaaugaauuauuuuauuaauguuuagugcuauucucauacagucuaugaauaagguuucuuaguauauuauguuucucaauaauacagaauuuuuuuguuucuuucuuaguaauagcuucaucagagacaauagaauaguggucgggaaguuaaaaugaaauuauauguguagauaauucuguuucauagaguuuaaaugaacuuuggugcuacuucuauucaggaacuauuuagacauuaauguugauguguuaaaaaaaaaaaaaaaccugcucuaggccaaaucagaucuuaaucuggugguaauuuuguacccacagaguuuauuguuuaacagggcaaauuagauguauucucuuuauauauuuaucauaagaguaagaaauguaaguguucuaaaaguacauauaaagguaaaacaauucagaggggaagauuaugucuggaggaagggcaucagaaacucuguaggagcuagggcuuaaaauuaaaagauaaguaagcuuuggaggugugcaaguggggagaccaccaacaagcaaagaaaaagcauacacaaagacacagaaaaaugauuaucaugggauuuuuuuuaaaguagaaucuuagcaacuuuuaaaaagacaaauuaucaggcaauuaccaccucagaccuacugaaucagaaacuacugggaugaggcccagcaauguggcccuccaggugauucugaagcacacucaaauuugacaaacugcuuugcaauuucaggcagauaaauugaccuggaauaugcaacucuuucugaucuuugaucuaggaaagguuuuaaagaaauaaaucugaaguaacaacauuuaaagaguuccaguaauuaguucaauaauaauaguuaacauuuauugagccauuuuauguacuagaccuuuugcugaguaaagguuauuaucucaguuuuauagaugagacacagagagguuaaauauguuaauugucacacagcuaagaaaguaccagauccagaauuuuaauuuauguagcuuacuauaaagcugacauuuuuuggugggaaauaaguuccaacuuguagauaccuuuuuaaaguacaaaacaaaguuuuuacuuguuuuauggaccacuuuuguaucucugaugggcaugaaaauugcuaagaacacuauuguagauuuuuauuuuaauagagcauucuccauuuuaaacuuuaauuauagaaagcauuuuaagaaauggcaugcuaggcuuuaagaaaacuggauaaaugaaaauccaaacuuaaauaagauaaauauuuggacgcaaaaguucucaagguucauuaugagaaauguagucauuucacauaaaagcuuuguuuugcacauuucucaauaauguaauuugucauguaaaagaagaaaagucuggagugggccaggcaugguggcuuacacuuguauuccccagcacuuuggaauguugaggcaggaggauugcuggagcccaggaguucgagaccagccuccgcaacauacauggggagaccccagcccuacaaaaaauaguaauaauaauuagcugggcauggugacaugagccugugguuccagccacuuuggaggcugaggcaggaggaucauuugaacaugggaguuugaagcuauggugagccaugaucaugccacugcauuccaguuuagacaacagagugagacuccgucugugaaugagugaaugaaugaaugaaaaagaaaaagcuuagagugauuguaccaggcauuccugagguacauucacauuuuauaauuaaacucaaccacucuuuguacuaaauuuuuucucgcugacauugaccuaagauauauuccuuuccccucuguguuucugcaacuauuuaaguugauauccuucucuaagucagauucaaaauaauauuuugaaaugcacugauacuauaaguaucuaaaaauacaucuuuucagaugcuuaaucuuugagcagagaaaauacaaacauucuaauuaaaugugcaagaugcguauauaaguaaccaugaggaucuuuguuaauauggaguaacgacaucauaaacaaucuuuucuacuguccuuuuuuauuuacguucaauuuuuugaacaggcaauacagucauacaauccaaaagauaugaaaagacauaauaguaaugucucauucucauccguuucccuuagguacccauuucccuuccccacagacacauacuuuguuaauaguuuuucuuccagagaugauauaugcauauguacaagcaaaugcaaauguuuuuauuucuuuuuaacaccaguaguaauauauuacauauauacauacugcacuguguauauaauguacacuauuguuuccugcuuuuuacauuuauacuuaauauguauuuuucagauacugucaucuuacuauauauaaaaagcuaacucauuuguuuuucagcucucucauauuugaugguaugaauaaaacaaauuuagccaguuuuguauuaagagguuucuuugauuguaguuuuuugcuguuacuaacaaugcugcagugguugggcgcguggcucacaccuguaaucucagcacuuuggaaggcugaggcggguggaucaccuaaggucaggaguucaagaccagccuggauaacauagugaaacgcugucucuacuaaaaauaugaaaauuagcuggaccugguggcacgcaucuguaauuccagcuacucaggaggcugaggcacaagaauugcuugaaccugggaagccgagguugcagugggccgagaucgcaccacugcacuccagccugggcaacagagugagauccugucucaaaacaaacaaacaaagugcugugguauguaacuuugaauauaaaucauuucaugugugucccauuuuuaucuggaggacaaaguuguagaaguacaauucagagacagggucuugcauuguuaagcaggcuggucuugaacuccuggcuucaagcaguccucccaaagugcuaggauuacaagugugagccaccaugcucggcccccacuugcuuuugaauacaguuuuuccucugacacauguauauauuuggagaacucuauuaccacaggaaaucacaagaaauagcaucauaaauguggggaauuuuacuuugacauugugccagugcagaauaagauucuaguaaaucuuuaucauaaagaaaaaaauguauuccuguuguaggucucuaguauugugaugauaaaauuuagucguuuuucaaagaaaaagaaagguuuauaggcaguuuuaguuccuuaaauaucaguaucacaaguagcaaaaauuaaugagaaaguuaaauuuuaucagauuuauuuuucauuuuauuuguauuuaauaauuuguugaaugguaaaaccagaaugcuuuuaauaugucuugaggccugaaagaaaguuccuuugaaauuaaauuucagcaauguaguuguguagaauuugaacaauucacaauacugacuuucagugcuucugaaagcaggaaguguauuacugacacgcagaaauauuccagcccaaagaacaucccuacugccauaugugguaagaauuugucacuaacccacaaacuaguucuguaaugcagugaauaagcagaauuggucuuuguuggacauuuccaauucaauaugaaagaacuuuguuuugcagugucuuguaaguaauuauuagcuuaugccuugggagaaagccuggcacaucaugggugcgugcucaugguuuauugagagaagaaaauucuuuuaggcauguuuuuaaaacuugguuauugugacccuuaguuaaaacacugaaauuacucgaauauguuaaagacugaguuaaauauucugacucagcuuauuaaugauaucuuuaaauuauauuacuuuuauucuguuuucccucuuugcugcucaugugaaauaaauaugaaucuuauguuugcacuuaugcuauaaaagaaauuauccuugggguuaauuauuaagggauggggaaauuaagagcuaagagacaggaaaaugaguugugaggaauuggggucaccagauuucauuaaaaauuugaaaauaucacuguuucucuaaacuuuaauuuuuauuuguuguauuuuaagcgguuaagaagauugucuaccaaauauagaacagaaaagauauaucccacagccacuggagaaaaagaagaaaauguuaaaaagaacagauacaaggacauacugccauguaaguuggaaaugcccuugauaaaauacauagaaaugcuaauuagccuuuuguaaccuaacuaguuuuauucuuccugaguuucacuguuaaggaaguaguaauuaaccuaucuuucaaaguacauggaaagauaauaauucauaauugugcuuuuuguuuuuccuucugauccuaauuuuuguuuaauuuuuuuccuguaaguaucacaguugcucuaauacuaaauuacuuuuaaauacuguaaauccaagugaaaauaucuucugucaacucucuguucaaagauguuauuucauuaaaauaauagacaacugaauacauuuuauaaaaugcuaacaauguugauuuuucauauaucuauacauaagaaccuuaauugauuaauuaugcaugagaaaaugaagcauaggaugacucaaacaucugugugucuacuauucucagcagucugaauaugugccucuaaguauaugucuuagacugauugcauuacauucuaaugauauuuuauuuauuuauuuauuuauuuauuuguuuguuuguuuguuuagagguggggguucucacuguguuccccaggcuggucucaaacuccugagcucauacgauccucccaccucagccuccccaaguguugugauuacaggugugagccacugcgcccugucuguauucuuaaauagcacaguuuucuggcaagauaacuuuaacucugaaaguauacuuaaggugugccaucacuuuauccaguaaaagcuauacgucauacuugcuaucuuuuaaagcugccgucguuuuucuuucuucauaaguauuuugaaauaucuacauuccaucacaucauuuccucaauucuuauucagucuuaaagguuguucucucuaaaaugccuuuaaaguucuuggugacuuuuuuuuuuuuuuuugugacagucuugcucuguagcccaggcuggagugcgguggugggaucuuggcucacugcaaccucugccucccagguucaagcgacucuuguaccuuagccuccugagagcugggacagcucuaauacaggugccugccaccauacccagcuaauuuuuuguauuuuaguagagacaggguuucaccauguugcccagggcccaguggcuuuuuaauugccagauuugguggucuuuuuuuacuguuuauucuaacaggaagaauauugauuauucaagaauguugaacuauuuugaugccauugaucaaucccuauuuuugaaauuuucuucuuccaugauaacucuuuuaaaacaccucuucccucucaucucuuucccucuuuucuccacuaacuucuuugccucaauuuaauccuucauccuuuuguuguucuacauuauuaucagcugugggauauguggauagccuguguuggcagaauuaacaaguggcaacauaacauaaugguauaguguucugauucuggaaguugaaauccugacuccaccaguugcuagcuauaugaccuuggacugauccucucugugccuugguuuugucauccuuaaaauggagauuauaauaauacuuuuuaggauuauuugcacaauagguuaauauuaaaugcuuaaaaguguacccaguggccaggcgcgguggcucacgccuauaaucccagcacuuugggaggccgagacugguggaucacgaggucaggaguucgcgaccagccugaccaacauggugaaaccccaucucuaucaaaaauacaaaaauuagccagaugugguggcacgugccuguaauuccagcuacucaggaggcugaggcaggagaauugccugaacccaggagguggagguugccaugagccgagauugcgccauugcauuccagccugggcgacagaguaagacucuaucucaaaaaaaaaaaaaacaaaaaaacaaaaaaaaccaguguaccuagcacauaguaaccaaucauuaagcuuuugcaaaauaaccaguauaccuagcacauaguaaccaaucauuaagcuuuugcaaaauacacuccacuuuucucaccuguugucuuagucuguucaggcuauuacagaaauaccauaaacaggguugcuuauuaauaacagacauuuguaucuucaaauucuagagacugggaaguccaagaugaaggcaccagcagauaugcugucuagugaagggucacucuggcucauagauggugccuucucacugcacuucacaugguggaaggggcaaacaagcucucucgggccucuuuaguaaaagcugguaaucccauucacaaggcauaaucuaaucaucuccuaaaggcccuaccacuuaauacuguugcauuggaauuuauguuuuaacuuaugaauuugggaaggacacaaauauucagaccauagcaccagucugccucagaauaggggaugacauggcuuucuggauacuucguauuaagcaagauaauuuuaaggugauccuacauugcucuggaauuauucaugcacacauucaaagaguuagccuguccacuuucuuuuucugucgucuagccguagguuucucuuuucauaugauguuucauuuucuucuuuguuuuugaaacggugucuugcucuguugcccaggcuggagugcaguggugcgaucuccgcacacuauaaccucugccuaccagcuucaagcuauuuuccugccucagccucccaaguagcugggauuacaggcacccgcugccacauccggcuaauuuuuguauuguuaguagagacgugguuucaccauguuggccaggcugcucucgaacuccuaacgucaggucauccgccucccuuggcauuuacucauuuuacagaaagcuucugaggguguacuguaugcugggaaugcaacaaaaaacaaacuggcaaaaaucccugcccuuguggagcuuauauguuagucaaggugauggacgauacauauuaacauauauggucugucauguggugguaauuaguguuauugagagugugguucgaaugagggauagggagaaagcagagaauagaaggguaaguuuacaguuuuggcugggguagugggaaagguuagugguguaguguuaaacugguccucugaaaguucugauuuguauuguuugcugauuucugugauaaauggauuauuuaccauaaucaucacagcaaaacucugagguaaguacuguuaugugccauuuugcaaacaggaaacugagacagagagguuaaaaagcuugucacacaguuaaauauugugggguaagaauuuaaacacaggcgguuuuaaagccuucacuagggugauuuugccucucaagggacacuuagcaaugucuggagagauuugguugucacaacugggguaugggaguggacaggcugcuaauggcaucuaacaaguagaggcuaggaauacugcuacacauccugcagugcauaggaugcagcccccuuccccaaacaaagacuucucgccaaaauauaugagugucagcguugagagaccuuguccaagagcuugaguucuuaauuacugugcaguaaucagauugacagugccuuuuuuccuuuaaguuauuuaaaguuugauaaguaggucuccaguaaauuucuaguuauuuugacuugggauuuuuuuuucuuuuuuuugagacagaaucucacucuugucgcccuggcuggagugcagugugggaucucggcucacugcaaccucuaucucccggguuuaagcaauucucgugccucagccucccaaguagcugggauuacaagcaccugccaccaugcccagcuaauuuuuugguauuuuuaguagagacaggguuucaccaugucggccaggcuggucucaaacuccugaccucaggugauccacccgcuucagccucccaaaguacuaggauuacuggugugagccacugcaccuggccuggaaauuuauauugaaaguaauuguacugagagauaugugcuuauuuacuguuagauaacuauuuaauucauugcccgggcacaguggcucaugcauguaaucccagcacuuuaggaggccaagcugggcagauuauuugagcucaggaguucaagaccagccugggcaacauagcaaaacucaacacacacacgcacgcacgcacgcacacacacauacucucucuuucucucucucguguguacacuuguggucccagcuacucaguaggcugaugugggaggaucacuugagaccaggaggucaaggcugcagugaacuaugauugcaccacugcacuccagccuggguaacagagcgagacugucucaaaaaauaagauggagaagaauuuaauucacuaacuuccuuugcauguuuuaacaugugcagugcuugcagaaauagaauuuuuaaaacagguuugagguauaauuuacauacccaugaaauuuauccauuuuaauugugcaauucaaugauuuuuuuaaaguaaauuuauagaguuuugcaacaauuaauacaaucuaguuuuaggacauuuccaucaccccuaaaagaucugagucuucagcccugggcagcuguuaaucagcuuucugucuguauagauuuuccuuuucugugaauuuaauauaaauguaaucauacaauauauagucuuuugugucuagcucuuuuaacaguuuuuuuuugagaugaagucucauucuguugcccaggcuggagugcaguggcaugaucucggcucacugcgaccuccgccucccagguucaugagauucuccugucucagccuccugaguagcugggauuauaggcgcacaucaccaugccuggcuaauuuuuuguguuauuuuuaguagauacaggguuucacuauguuggccagacuggucucgaacuccugaccucgugauccgccugccucggccucccaaagugcugggauuacaggcuugagccacugugcccagccucuuguuaacacauuuuaaagauucauucacgauguagcaugcaucgauaguucauuccuuuuuguuguugaauaauauuccauuguaugaaugaugaacauauugaauaaugcugcuaugaacaugucauacaacucucuguguggaccuaugguuuuguuucucuugguuggauagcuagcaaaaccauggagaggaauaauuguuuucauuuuuuugauauuuagauuauuucuaaauaugcuuaauaagagcaccaaucuggcagggcgaggugacucaugucuguaaucccaggacuuugggaggccgaagcgggcagaucacuugagaucagaucaagaccagccuggccaauacggugaaaccccgccucuacuaaaaauacaaaaauuagcuaggcaugauggcacgugccuguagucccagcuacuugagaggcugaggcacgagaaucacuugaaccugggaggcagagguugcagugagccaagauggugccacugcacuccaaccugggugacagagccagacacugucucaaaaaaaaaagagcaccaaugaagaauauuaaaacagccacccaaguucuuucucgcuacuucuaguucccggcgcuuugccggguguuaaugguggcccaaaaucaugggugcuguggcuuucucccuaaggugucacaggagcuaagggugccacuuaacaaacugcagaagaugcaggcaggugaaggacacccagucugcuguggcaguggaauguggcagaaaagccagcugggagggcggggagcaauccuggaaggccuggcugaccccacaauugaacaggguuuggugugucauugcuuuuaggccuuuucaguggacagaacugggguggauauacacucauuuauuugaaaucaugcauuuguuccauacuccaauuccagcccaccccuucuuugcucuauggucaagugagugagaacaggcggcuacauuuucagccuuguugcucaccgcuuccuuccaguagucccauguugcuucauaucucuucaguacauguauuauuuagacccagagccuuggcuuuuaaaucaggcagccccaguuucaaaugugucacugccaucucaguuuugugauuugggcauaccucugucugugcauagcgauauuaacuucuaucuccauggguguguggugaggauaaaauuaugugcuuagaggaaacguucauuccaugguagcuauuuuuuauuaauucuauacuuuugaaccuauuaugcuaccuauaaugcccuauuuuuuuuuucuuuuuaaucauuggcaaacuucucauucccugagacccagcuugucacaccucugaagacugcugauauccucaagauguuccuuacucccuuuccuugcuacuacuuuacuauggauauaugaacaacauuauugugcuuauuacaugcaauaaauauuuauuggaugaaugauacuaaaauucacauuuaaaaugccaaaaucaaaauacacaugauaugcuguauaaguagcauaauguugauuuuuaaaucuaaugugcuguggguacauaguagaaagcagugacuaccaaauuugccuguguuuuagaauuuaaauggggaguuuuaaaaaggguauuucugugccccauuuuuaauuuacugaauugaacuuacuacaagauguaguacuccagaaaucuuggauuuuaauuugcuuuccccagcuguugaaugauuggggauagaugaaauaagauuggcaaaauguugauaaugaagcuggguaauggauauacaaagauucauuauacuguucuauuuugguguaugcuuaaaauuuuccaucuuagaaaauuuuuuaaaaaaagaaauuaccagccugcauguagccagccuggcaccaguccuaacuaucauuugggagccacuauucucauuuggauuuacagucaccagaaacuuuacugaggacccagugguaaaccagcuauuguauucugccuuugagauacuuugaauagaggcuaauaugucauaugaauaaggguaauuaacugagaccccuuauuacuggcaaacaugguaagaggaagcuuccuguaguuauucagccaucauuauccuaaccacugaauauucuauucucauuuuccagagucauagcuuuuuuuuguauguguauuuccuaucccaaauggcauauaaaaagggggaugggacauguaggguggcgugaaauaaaugacagagcauugacaaacauauuuuaaacauucuguuucuuagaauacagugaggagaugaauaauuuucaccagaagcaaguauaucuuccuuauaugugucuucuacaaauuucuaaagaagacuuuuuuaaaaguaaauuuaucaauuaaauuagcagaacugggccuuuagugcuauguauaaaauuugagccaaugaaaaauaaauuaguuacuauuaguuguucuuuaauacuuugcuaagaaguuuauucaugucuguuaacauuuccguauuuccuuuuguauuuuuacugccuuugauacucauucauggauuagaagggauuauaauuugauaauaauaauggcauuuuacauguuauauguuauggucccuucuaauccagaaacaaugaauacuaggcaauucuacuuuaggauuucauaaucugaaagcgucuaaccucaaauacuuacuaacuauaaaagggaaaggcaguaacuuucccuuuugguaaccaagcaauaccauauuaaccaagugaccaagguuaacaucacaaguacuaaagcauauguauaucauguauccucugauguguugugcugagaaggacacaauaucguucugugguauuaccaaaaauucauaacuucguuccagucauuuaaaaaaaaucaaucagagaaacuuuuuuagauugaaggagacuaaggagaaauaaaaauuauuauuauuauuaucuugagauggagucccacucugucacccaggcuggagugcaguggcgcgaucucggcuuaccacaaccuccgcuuccuggguucaagugauucuccugccucagccucccgaguagcugagauuacaggcaugcgccacgaugcccugccaauuuuuuuuguauuuuuaguagagaugggguuucgccaugugggccaggcuggucucaaacucuuaaccucaugugauccgcccaccuuggccucccaaaaugcugggauuacaggggugagccacuaugccuggccacuaaaaauuaaauuuaauaugagauccucgaaagagaaaaaagauuagaaaacacugacuuguauagucuuguuuaauuaauaguuuuauaaguguuaauuuugugguauuauugaucauugucuuaugguuauauaagauguuacuauuagaggaaguucagugagaggcaugggaauucucuguacuauuuuuacaguuuuucuauaaaucuaaaauuaguucuaaauaaaaaguuuuaaacaucagcacaaacuggaaaaaacuauuugcacuuccugugacagagggcugauuuuuucuuuuuacauagaucucauaaaaaucaguaggacaaaacagacguggaaaaaugggcaaaggauauaaacaagugguuuauggaaaaagaaguacacagaaccaauaaauagauuaaaacauacaauccuuugcauaauucaagaaauggaaauuaaaacaagauauuuuuacuuuuugguuugucagugaugaaaaguuugguaauacccagucacccuuauuacauaacccuguauaaauuguuucauaccuuuuagaaggcaaguagcaauuccucuguuaggaauuuacccuacagcaaugcugguaacagcuauauauacauuaguguucauuguaguaauguuuuuaauaggaaaaaaauggcccaucaguagaguagcuaaauaaagaaugaaacauucacaugauggaauucucuguuacacuaaaaagagugagauagccuagugcaagcugagugcaaugguucacaccuguaauccaaacacuugggagccugagccaggaagaucuguaguccaggaguuuuagguucgaaugagcuaugauugcagcacugcacuucagccugagugacagagugagaccuugucucuguauuuuaaaauaauaguaaaaauaauaaaguaaaucuuucugugcuuugggaagaguuccaggauauacuauaaacugaaaaguaaugauacagaacagcauguauaggaugcuugcauuuguguaguaguuuuucaaaguauauaacuauauguguaauaaguacacuuggaaugggaaaaguaacuuuaauauaguaucuugaugggagagagcccuggaauugaagggcaggggaggcuuacuuuucacuuuauaccuuucuuuaaggucuaauuuuuaaaaauuauauacauauuccuuuaaaagaaaucaauaaaaacuuaaaagaaaaauauacuucauaaaauuuuuuaaagauuuuuuuacucuauuaccuaauaauaacuauuauuagccaagagcaguguugaacacuuuuuauauauaaucucaauucauuaauuuguuauaauuugcuuuuuauaguuucuugugaaauaugaaaguuacauuuuuuaaauaagaauuuuagcauaugggcuuguguaucacugguuaguauucaucagccacuugguauguuuguuaaaagcugcagaggcugaaacccuagacucugcucuaguaaaucagagauaauguccuggaauuugaauuuuaaaagaguuccagagaugauucuuauugcaacuuuaauacacugcuuuacgucacugguggugguguuuuuuuguuuuguuuuguuuuguuuuguuuuuuugcuguuguuguuuuguuuuaagacagaaucuucacucugucgcccaggcuagagugcaguggcgcaaucuuggcucacugcaaccucugccucccagccaguuucaagugguucuccugccacagccucccgaguagcugggauuacaggugccugccagguggugguugucugaaaauuuauuucauuuccuuucaguuuaauguuagaaauuacccugcugguaccuagaguccauuuucauccauuguuuuuuaaaauaaauguucuuaagcugucuauuuaaccuuacuuacgcuucauuagaaaauaccugugugucaaccauacauauuuuaugaauuuuuuucucguaguugaucacagccgaguuaaauugacauuaaagacuccuucacaagauucagacuauaucaaugcaaauuuuauaaagguauguacuaacuuuaaaugguguuucucugccauauuaaugucuuucuacauacuaguuuuguaaaaacuuuuugaauugcucaaacaugauaccaacagcaaaagaaauaaaaauaaagccacugcccuggcacaauguuuuuauaugcuuuccuucuagccuucuuauucauauagauaaauaguuucuacuuaguuuugugauagcagagauaacauuuucuuuuuuauuucuucuuucccauggaagucuuaccuauuacuaaauuauuuucucaguuaucccuuuggacacaaaugaacaucaucaauccccguuguugacccauauagguuguuuccaaauuuuuaaaaugauaauauugcaguaaacaucuuuguuguuuugaauaauuucuuaggauaaauuacuaggggugggauuacuggauaauacugauuuaaaauucuagaacauagcuuuaaauguaaaacuuuuggcaguugucacuguuucagguggcaacccaaaauccaagauuaaauagucucuuuuauaaccuuuguuuggauacccuuugaugaaaagcagucaaguucuuuuuuuuuuuuuuuuuuuuuuuuuuuugagacggagucucgcucugucucccagucuggagugcaguggcgcuaucucggcucacugcaagcucugcuucccggguucacgccauucuccugccuuggucucgaucuccugaccugugauccacccgccucugccucccaaagugcuaggauuauaggcgugagccacugcgcccagcgucaaguucuuuaugguagcaguagagauagaugcaaagugcuacuugauucaguuuaaauaaaaggcuuuuuuuccaucagcuaaucugugauuuuuaaucuuucaagugauaugauaguauaauuuucauuuauuuuauauaugguguuuauacauauuuucauguuuuuguugauaaaaauguuaacugauaaaaguuuaugccaggccgggcacgguggcucauguccguaaucccagcacuuugggagaccuaggcggguggaucaccugagaucaggaguucgagaccagccuggccaacauggggaaacccagucucuacuaaaaauacaaaaauuagccggucaugguggugcaugccuguaauaccagcuucucgggagacugaggcaggagaaucgccugaacccaggagguggaaguugcaguaagccgagaucgugccaaugcacuccagucugggugacagagcaagacuccgucucaaaaaaaaaaaaaaaaguuuaugugguaaaauuauuaucuaugucaauauucagcagucaugguuuuaaauaaaaauuucuuuuuuuaacaaaguuaaaaaccaaaaugaauacauuaaauaaaaacuaauaaauugauaguuugcuauuucagauguugucaauguucauauucuuuuuuuaaggcuguuuguuaaaaguuauaguuuuuacuuaugcuuaaugacacugauucauuguaugagucaguuauguaccaguuuaguauuuuagucagugacauuguuugguuuauauucucauguucauuauuaaaaaccuguauaguagaugcuugauaaacuuuugaguugaauagauaauggaagguagcuauggaagaaacuaagaaagagcucuucacuaguuuuaguauuguuuuagaaucagagcaugcucuguauuucugccaguuagcuuuguugaguagguauuagggcuuuuguuauuaaugccuagauaaguaauaauuuuuaauuagcauaaggcgguucuuaaauaccuauucugugcaccauauccaguaaacacaaaguaauagcagucaucaaaagcuuaagugaauugaauauauuuugccaugcuuuaauauacuaugaaagacacauuauuuggaaaugguuuaaguuaaaacaacaauauuacuaauacaauuugaaaccuuauauuuuggguaaugaaauauuuuugguaaucaaaauaaaugugaaauuugcuuuuaaccauuuuuagggcgucuaugggccaaaagcauauguagcaacucaaggaccuuuagcaaauacaguaauagauuuuuggaggaugauaugggaguauaauguugugguaaguaauuuacuuuucacaauaaauuuugagaaauacuuauguaauaacauaggcuauuuuacugaauaaggaaugaggggauuuuuaaaaaauccauaauuauguuuacuuauugcugauguuuacuaaaaagauggacccauuuuuaggaugucucauuaaauuuuuacaaacuaggcuaaauauuuuaagaaggugugauaauaauuuaaaucuuguccuaagucaguaaguaaugauacagcuaucaaacaacuuauaaaaagcagaaaaggauuagugcucuaauaggucaguaaaauacuugauaguacaguuauacucauuugagucccucuucucaggaaaauauauauaaacacauaacuauaaauagacuauaaauaugcaguauaagagaauuucaucuaucccuggaguucauucagugcccucuuguucuuuuggaugaagggaaauaauaugcccuuagauuuagaagcagagaaauuagaauacugcgaagagcuacccuauacugcucuguaguauucuugaaaccuaaccaugugcauugauacuuuucauuguguggauguggaaaaucaguaaugugaaacuuucauuuuugucuuacggcuuuuuaauggaauuguaaugauucuaaagcauugacaugcucuggucuuugaaagauuaauaaaaggggggaaauuuuccaguuauuuauauuugcuguacuucacuuuaaaaacuagaugugcuuggggauugagaaagagcaugaagaaacuuucuggaugaugggaacauccuguaucuugauaagauuuguguugcacagauguguguauuuguccaaacucggagaauguucacuuuaggauuugugcauuucauuauauguaaaauuugccucaagggaaaaauacuggaaacaauauaaaaauuauguucuagauuggccgcgugggguggcucaugccuguaaucccagcacuuugggaggccgaggugggcagaucacgaggucaggagaucgagaccauccuggcuaacacggugaaacccugucucuacuaaaaauacaaaaaauuagcuggacgugguggcgggcgccuguagucccagcuacucagcaggcuaaggcaggagaauggcgugaacccgggaggcagcgcuugcagugagcugagauagcgccacugcacuccagccugggcgacagagcgagacuccgucucaaaaaaaaaaaaaaaaauuuauuguguucuagauaauaauaugcaugcugaaguauuuuggggagaguguacugauguucacaacuuacuuugaaaugcauuuuuaaaauaagauggauugauagagggauagcuaugugauaaaacauggugaaauguuaaugauagaauauaggugauggcuauacaauguuuacuguaaaauucucaacuaugcuguguguuggaaaguuuacauuauaaaaugggaaaaagcaggugugaucaacuuuuaaaaugguguuaaacgcauucaauauuuaaauaauuauaaauauauuuuuaauuaauagugcuauuuauaauuagguaaauauccuaaaagugauauuuuaauauaauuucagaagucacaaaguaaaucuguaagauuuacaugauuuaauucaaaccaaaaacaucauguuaauuggaaccaauuuaauuuguugcuguauaguuagcccuuguuuggaaagucuaauuuugauaauuucuuuaacuuacacauuuaauauugaaacuacuuuuuuaggcaagccaauuauacuucucggugcaaaauucuugaaaucuguauuuuauuaaaaaguaaaauuguguuuaacugauacguucuuuaucucacuccccaccaucacuuuuuagaucauuguaauggccugccgagaauuugagaugggaaggguauguauaaucuauuccucuuacuauuucauuuuuacggauaaauauucuuagucuuuuauuauuauagucuuaacauaagcgguuaauguagauacuucuuuuauuuugggguacugcuguugcuuuuauuucauacaagggacaaaauaaucucucaagcauguuguuuucuuuuauauuuuguaaguauguuuuaucacacacaggcauaccucagagauauuauagguucaguuccagaccaccacaauagcgcaauucaaacaaauuuuuuguuuucuuagugcauauaaaagucauauuuauacuguauuauagucuguuaaauguucaguagcauuauaccuauaaaacacuucaugccuuauuuuauuuuuuuauuuuuucuagacagagucucgcucuguugcccaggcuggagugcagugguacaaucuuggcucacugcaaccuccgccucccagguucaagcgacucuccugccuuagccuucugaguagcugggauuauaggcaugugccaccacaacuggcuaauuuuuguaguuuuaguaaagaugggguuucaccauguuggccaggcugguuucgaacuccugaccucagguguucugcccaccucggccucccaaagugcuaggauuauagacgugagccacugcgccuggccuuccaugccuuaauuuaaaaauaauuuauugcuaaaaaauguuaaugaucaucugagccuucagcuaguuguaaucuuuaugcugguaaaggguuuuguugacguugauggcugccgacugaucaaguugguauuugcuaaagguugggguagcuguggcaauuuuugauaaaauacaagacaggaccaggaacgguaguucacauuugaaucccagcacuuugggagguggaggugggaggaucacuugagcccagaagguugaggcugcggugagcuaugauuaugcuacuguacuccagccugggcagagggagacuccaccuauaaaaacauaaaauaagaaacagugaaguuugccacauugauugucucuuccuuucaugaaagauugcucuguagcaugccaugcuguuugauagcaacagcaguugcuguucuacccacaguagaacuacuuggcaaauuggagucaguccuuucaaacccuuccacugcuuuaucaacuaaguugauuuaauguccuaaauccuuuguugucauuucaagugcucacagcaucuucaccaaaaguauauuccaucucaagaaaguagauuccaucucaagaaaccacuuuauuuucuuauccguaagaagcaacuccucauccauuccagguuuuaucaugagauuguggcaauucauuuccaucuucaagcuccacuucugauucucuuuguuguuuccaccacauuugcaguuacuuccucuacugaagucuugaaccucucaaaguuaucacgaggguuggaauuaacuuuuuccaaacucguguuaaucuugauauuucgaccuccucccacgaaucaugaauguaauuaauugcaucuagaaugcugaauccuuuccagaagguuuucaguucacuuucccuagacccaucagaguaaucaugauuuauggcagcuuuagcuuuacaaaauauguuucuuaaauaauaagacuugaaacucaaaauuacuccuugauccaugggcugcagaauggauguuguauuagcaggcaugaaaacauauuaaucuccuuguacauguccaucagagcuuuugggugaccaggugcguuguaaacggaaauauuuugaaaggaauuuuuuuuuccaaccaguaguccccaguagugagcuuaaaauauucauuaaaccaugcaauagggaugggcugggggugggguugaaaaaacaaaaacaugcuguaaacagaugugcugacauccaggccuuacuccauuuauagaggacagacagaguacauuuggcaugauuuuuagagcccuuaggauuuucagaaugguaaaugagcauuggcuucaacuuaaugucaccagcugcauuaaccccuaacaagagagucagcauguccuuugaagcuuugaagcuagacguugacuucuuuucucuaguucugaaaauccuagauggcaucuucuuccaauauaaggauguuucauccauacugaaaauaugucauuuaguauagcuuguuucaucagugcucuuagcuuagaucuuuggauaacuugcugcagccucuaaaucagaauuuggugcuucaucucgcacuuuuauguuauggggacagcuucuuuccuuaaacuucgugaaccagccuuugcuagcuucuaacuuuccuucugcagcuuccucacacuuuauagaaaugaagggaguuagugccuugcucuggauuaggcuuuggcuuguagaaauguugcagcugguuugaucuucuaucuagaccacuaaaacuuucuccauguaagcaauaaggcuguuugaccuacuuaauuuuuguguguuuccuggaguagcucuuuuaauguccuccaaaaacuuuuccuuuuuguucuaaacuuggcugauuaguacaagaggccuaccuuucugccuaucucaguuuucaacaugccuucuuuacuaagcuuaaucauuuuuagcuuuuuuauuuaaagugaaaaguuugugacccuuuucacuugaauacuuugaggccauuguaggguuauuaguuagucuaauuucaauauugugucucaggaaauaggaaagcccaaggagaggaagagagacuguacaaaaacuugucaauggaacagugagaaugcucacaacaucuguugauuaaguuugccauuuuauaugggagcaguuuguagcaccccaaaacagaguaguaacuucaaacaucacugaucagauuacaauaacagauaucaucauaaugaaaaaguuuggaauacugcaagaguuuccaaaaugugacacagaccugaagugagcauaugcuguugaaaaaaugauaccgauauacuugcuuggugcaggguugccacaaaacuucaauuuguaaaauaugcagugucugagaaacacaguaaaaugagguaugccuguacuuaacaauaauuaauuagguauuguuacuuaguaaacuucaaauauucagugguguuguaacuagaaugcuaucuauggacugaaauagagagguauuuuuaaauaggaauaaaauugaacaaguggaaauacauuuuaaaaaucugguuaucauuaauauaugguuugaauuuuuguuuguuuguuuguuuugagacugugagacagaauccugcugugucagucaggcuggagugcaguggcgcgaucucggcucacugcaaccuccaucucccggguucagguauauuuccugucucagccucccgaguagcugggacuacaggcgccuaccaccauggcucagcucauuuuuguauuuuuaguagagaugggguuucacuguguuggccaggcuggucucgaacuccugaccucaggugauccgaccgccuuugucucccaaagugcugggauuacaggcauauaaucccauguaauccaccgcaccaggccugaauaucuugauuagucuguuuguuaauaccacaguauguuuuguuuguuuccuaucuucaaaacugagagaagauaauuucuuacccugauuuucuaacauugguauuuuuaugcuaugucgaaguaaaauuuauuucaaagcuauucugguauccuacagcaucauauucuguccucacuguaggagguaaugauauauuuacagauaauucauauuuaaauaaaacuuauaaaguguggucuucuauaaauauggcauacaaaucaaacuuacaaauuacauagugauuuuauuugaaguuuuuuaauacuaauguaguuaauauauuuaaaauuaucuuuaguuuguaaauauguuaauuuuuucaguaagcaauauauugcaaaagauacaucuuucaguuauauuacauaaauaauugggaagccuuaauuuauuccauuacucccaacuauuuccuaugucaguauuaaguaauguuggacagaaagugaauaaaaugagaaaauauaaaaacugagaaauuauuaaguaaucaaguuaucuauuuaaggguugucaauauauacauuaauauuauuaaucaauugucuaagagaauuuaaaugucauucuccuaauguuuuaaguuacuguuaagguuuaggauguauuucucuuuucauuauauuaguaagcucauaguauguaucaaguuauugaugaaaaaucaaguagcauugaguacauaauuuuuugaagcgaaagguuuuugugauucacugugucuuauuaguaauagauuaugagcaaguuaggaacuaugaaauuaucugauaaccuugacuuugaucuugacuuugaaugugaccugguggaaaaagcauagauaauuaaaucagacaaaccuaccuuuuacaagcauuuugaccauggugcaguacaguucacucugagcuucaguuuccucacauuugaaaggaaauaauacccaccuugcaguguuagagauuauguauguaugauauuuaacacauaguuuuugauaucauuauuaguuuuauaccaggaauauaaguaccaauauaaucuuauuacugcucaucugaaugaggggcauuguuagucacaccgcuuucuauucuuaacuaaauuaaucucuuacaacuuguuuucuaucuguuucaaaguauuaaaguuuugucagguaaaagauuaaaaaaauguuuuuuaaacucucaaaaauaauuuaagguccaaguguaaguauaguggcucacaccuguaaucccagcuacuugggaggcuagggugggagaauugcuugagcccaggaguuugagaccagcuuuggcaacauggcaagaccccaucucuauuuuuuuuaaaucuuuuuuuuuuuuuuguggggagagacagucucgcucugucgcccaggcuugagugcaguggcacaaucucagcucuuugcaaccugcaucucccagguucaaacgauucucaugucucagccuccugaguagcugggauuaaaggcaugugccaccaugccuggcuaauuuuuuuguauuuuugaguagagacaagguuuugccauguuggccagucuggucuugaacuccuugccuuaagucauccacccacguuggccuuccaaagugcugggauuauaggcaugagccaccacgcccggccuccaucuauuaaaaaaaaaaaaaauuagccgguugugguggcacacgccuguggucccagcuacucaggaggcugaggugggaagaucacuugagcccagaagguagaggcugcagugagccgugauugcaccacugcacacuccagccugggugacaaagugagacccuaucuaaaaaaagagagaauuuaauuuaaucauuuucuguaaacaucucuuggaaaaugagauuuggaaguuaccuguguuuuuaagccucuaaaauguuagcuaacccaacauaccagacaguucuacuuuguuucucugugagcauuacugucaacuuauaguucauucagccuauagguaauaacuccauuuacuguauuuggaacugugaagauuuaauuaggaauucauuaaccaaugcauuucccacugcuuaaaagguuuauuuaagcuagauggucacuuagagacuuugauuuuauugggccuugauacaaauugcaucauuucuuaauaccugaaucauucuauuuuccauaaaguuaggcuuuucauucacuuaacugauuuucuaaaaugaugaggugcuugauauuagaaacugaugaaaauuuaucauucuuuuucuauaccuguuuaaaauaggaagguaagaggagaaauuauuugacuacacuuucuguaaucucuaauaaaauugaauaguuaauacaucauguuuguguagggcuuuuaccaucugugguacauuugaaauacacuguuauuuaacaaacaugcaacaacucuguaagauaaggauuauuauuccuauuuuuacagauaaagaaacuaaaggucaauaaaggaguagaauuaguacuugcaaaauucuucugauuccaaguagaauauucuuuccacuucaucacauauuuuacauuuaaugagaauucagccagauauuuguagagauugucauguuacaagcaauacaacuuaccuagcaaccuuuauaccaaauaccuccuuguaccagacacuuuuuuaaaauuaguuuuucuugucuagaggaggaucuuuggucuacucuguagaccuggcagauagcaaugaacaguuaugcacuuaagucaguaagguucuuaugacuauucuuggagaagacacaguagccuauuuuuuaaaacaacuggguaaaucuaagcucucucagcuccaugccugcuaauguggguuuuucuguuuuggggaaguagaaguaagcagaaccucaggacacaaaauauuuauaacaguuuaagaaaaacuuacaugaauuacuuacuaauuuuuuuuuuuggaugacagaaaaaaugugagcgcuauuggccuuuguauggagaagaccccauaacguuugcaccauuuaaaauuucuuguguaaguauccauuuuuguaaacacuuuuuucagaaaauuggcaugcuauacugaugaauaauuaaauuauaaugugguaugaacccaggcuuauagacgccaaggacucacaaaccuaugcuuacauuuaaaaaaauuuuguuuauauacugcuuuuaaauuuggaagcuuuuggguugacuucauaaaugcauauuuuccuuguaucuuacuauauugauuguguguuagucuuuguauaucaauugauaguagguguuuacauguaaaugaaguaacugugcuuuuaauauuuggaaaucguguauucauuucaaauugauuaaaugggaaagacuugguaacuggaguacaguguaucauauuaacccuucauaucuaauugugcucucaaaaauuguuauaauuauauauaaagauaaguuuaagaccuaccauacuggaaguaaagauugguccugucuggcagauuauuugauaugaaacuuaaaauguuuucuuaauauguaaugaccucuggaaaugaauuaaauucaagcucaaaagcuaacacagcaaaaaucugagaaaaugaauaaaaaaaugaaaacagugaaggaaauaggaguaggaaaaagaaaggcauggacaaaaagaaggaaaauauaagugaauuuuaaaauagaaccaaguuuucuuuaggugccauaaaaagacuguaauugaacauaaccuaaaaaucaauuaauuuaggccaggcacaguagcucaugccuguauccuaccacuuugagaggccaaggcgaguggaucacuugaggucaggaguucgagaccagccuggacaacauggcaaaacuccuuuucuacuaaaaauacaaaaauuagcuggguaugguggugggcaccuguaaucccagcuacuugggaggcugaggcacgagaauugcuugaaucugggagguggagguugcagugagcugaaauugcaccacugcacuccagucugggcgacaagggugaaacuccaucucaaaaaaaaaaaaaaaauuaaugaauuugccuauauuaggguucuccagagaagcagaaccaauagaauaagagugugugugcaugcgucugugugcauguguauacauuuaaggagauuuauuacgaggaauuggcucaggcaguuauggaggcuggccaguccaaaaucugcaggguaggcuggagauccuggagagccaaugcugcaguuucagucugaaugcugauaagcuggagacccaggagagcugauguucaguucuaguuggaaaagucuguuguagaaucaggaugagccaauguugcagaugaaggcagccugcuggagaauucugucuugcuucaggaggcugguccuuuuguuguauucaggccuucaacagauuggaugaggcccaacaacauuauggaggacaguuugcuuuacucagagacuaccaguuuaaauguuaaucuucuccaaaaacagugucacagaaauaacuagaauaauguuugaccaaauauucugggcacacuguggcccagccaaguugacagauaaaauuaaauaucacauuccuuauucagaguuucuuguuuuugacuuuguuuuccaugauuaaacgaaauauaauuucugugguuuuacuugucauugcugaguucuugaacuccauaauuuuaugacuuaguuauacucaugacuucugaauuccucucauacauacccaaaguuuagugcuuucuagguugacauaaaaaaggacaggacuguaucuguauuaugcugucuacuuuauaaaucaauguuguuuuuauaauguuaacuauaacucaccauugaacuuuuuggauguaguauuuagucaauauucuuaaggugcugauuagaauuaacuauuugugggguaaauguaaaaauuuuaggccaggugcaguggcucacaccugucaucccagcacuuugggaggcugagguggggaggauugcuugagcccaggaguuugagacaagcccgggcaaaauagugagacauuauuaacauuuuuaaaaacguuaaaaaucccacugcauuuccuuuuauuuggcuugaauaauacccaauacacaccacacugucuacuucaguggggaaauaccaacccuccuucaccaauccagaaagaaaucuguaauauuagauuccucgacaguguagaaaccuaguucuguguaguaugguuguuuuggacauuuguaaauuuauuuuuaaaguuuuauuuguauauaucuuuuugagacaggauuuugcccugucagccagguuggagugcaguggucugaucauggcccacugcagccucaaucccccaggcucaagugauucucucaccucagcuucccaaguagucggggcugcuggcaugggccacuacuaauuuuugucuuuuuguagagacgaggucucccuguguugcccaggcugauuuuaaacuccugagcucaagcaguuugcccgccuuggccucccaaaguacuaggacuacaggccaccacacccggccaaacauuuguaaauuuagauguaauaagauaacuauagugaauauuauaauucaagagaaaauacagugcuuaacaucaacaacaaaccaacuugaaauuuuugaacauuugagagucaggaauaguaaacaauuuacaauaauggauauaaggcagaaugcaauaguuuauaauguagaaaaugaauugauucuugggggaugguuuuucaauuaaacuaaaagguauaucucuauaaaugguucacaaagaaaaaacaaaacauggagaaagauuuauuaaaaagaaaacagauaacuugaaaggucucuagauaagugguuugguuugauuugauuaguaacgacuugguuuaauuugucagcgucaggauugauccaugcugaagaaauauuuucuuugauaauuuuaaaauggaagguaauuuguuugucuuauaauugguucagacaacucgggauuuguuaucauugacuuaacugcaaagaaaaaucaaauuuauaaauagcauguugguaaaaauauucguaguaagucauuugacuacuuggcagucagaguuugagacugagaaaugacugucuuuucuagagcucucucucgaugugggaugaggacaaggguaaagugguggugaaagggugaagacugguuagcaggagcucaaucacauguugccacauguaagcacuuagacuggaugucagcacacuacccauggcucagaucuagcccacugccuguuucguaaauaaaguuuuguuagaacacaucuauaugcauuaauuuaugaauuugucuaucacaauagcaaaguuguguagacaaagacuuuguggcccaaaaagccaaaaauauuuacuaucugguccuuuacagaaauauuugaaaaaguucaaauauuauuugaaaaguucaaaguaaauuacuguaauuuuaaaaauuaaagcagguauaauaguauuauuuuuauuaauaaaacaacauacacuguuguucuucauaauccuuguucuaaacuaucuguaguuuuaaccaauaaggcaaaaagaauaauuugcuuagugauagacugauguagauuaacacuuugacuaaaucacaguaagagaccuuuaaagugguuauguuaucaacaaccacaauaauaauaauaauuugggguguucuucccucuuccuucuucaguugcuauccaguuaauugaaacuugaauguuagggaaaaucauguguuauggaaagguaaaaugguugaagauaggauauggugguugguacugaggaaugacauucuauguauauuuacaugauucugggggugguuacuacuuugcagauauuuuauugggugguagaugcuuaaguaauucguuuagacacuuuuuuuuagguauaaguaaaacuuacaaaagcaaauugauguuuuuuucuuuacugucuauacaaauuuuuuuaaugaauuuuuuuucuucaaguuucuuaguuuaguagguaacuugauucccaaauucacuucucuuauuuguacauauuguuugggucuaucuguuaggagacuuuaucugauaggagacuucauuuuaagguuuuuaaaaaaauuuuuuuuuuaguguuuuuuguuuugagacagggucucacugugucacccagacuggaaugcagcgacgugaucgcagcucacuauauagccuuggccucacugcugggcuuagugauccaccuaccucagccucccaaguagcugagagcacaggcuuacgccucaauguccagcuaguuuuuguauuuuuuuguagagacaggguucugcuauauuguucaggcuggucuugaaccccuaggcuaaagcgauccguccaccucagccucucaaacuacuggcauuacaggugugagccacugccuaacuuuuucaagacuauuuuuuuuagagcaguuuuagguuuacagcaaaauugagaggaagguacagagauuucuuauauacacccuguccccacacauguagcccucauuaucaacauucccuaccagagcagucucuuuguuacaauucacaaaccuacauugacaagucauuaucaccaagaguucacauuuuacauuaggguucauucuuggugcuauacauucuguggguuugaagaaauauaugaugacguguauccaccauugugguaucauacagaauagugucauugcucuaaaaguccugugcuccaccuauucauucaucucacccccuucccaacccuagguagucauuauuuuuacugucuccauaguuuugccuuuuucagaagucauauaguuuguuuuuguuuguuuguuuguuuguuuugagacggagucuugcucugucgcccaggcuggagugcgguggcacuaucucagcucacuauaaccucugccuccuggguucaagcaauucuacugccucaaccuccugaguagcugggauuacaggugcgcgccaccacacacagcuaaguuuuguauuuucguagagaugggguuuuaccauguuggccaggcuggucucgaacuccugaccucaagugauccaccugccucagccuccugaagugcuggaauuacaggcaugagccacugcucccagcucagaagucauauaguuugaaucauacaguauguagccuuuucagauuggcuuauuucacuuaguaaugugcauuuaggguucauccaugucuuuucauggcuuacuagcucuuuuuuuccuuuuauuauuuuuaauugacacauaguaucuauacuuauuaaugggguacaugugauuuugguacauguauguguaauuuaaaauguggagugacuaaaucaggauaauuagcaugucuaucacuucaaacauuucaaauguuugaugacuuuuagaauuuuuuuauaauuaucagguacaucuggaauuuuaaagauuaauuuuauauuguggacuuugauacaaguauuuuauuuguuuugaugugucuuuuuguuuuaacguuuucacugacuuagaaauguuucucuuuauuuaggaggaugaacaagcaagaacagacuacuucaucaggacacucuuacuugaauuucaaaauguagguacuuaccauuuauagacuaucuguaagaauaguuuucaggcugggugcaguggcucaugccuguaaucccaacacuuugggaggcugaagugggagggugacuugaguccagggguucaagacuagccugggcaacauagugagaucuugugucuacaaaaagaaaaaaguuagccgggcaugguggcaugugcccauagucccacucacucagaaggcugagcccgggagguugaggcugcagugagccaugauugugccacugcacuccagccugggcaacagagggagacucucaaaaaugguuuugagaauagagaauaguuuucaaagagaagacauagagagggaggggagcgugggcugaaaaaccaccuauuggguaguaugcucacuccuuugguaaggaucauuuguauuccagaccucagcauuauacaauacacccauguaagcugcacauguaccccuuaauccaaaauaaaaguugaggccagguaugguggcucacuccuguaauccccaacacuuuggguggcugagguggguuggucacuugaggccaggaguucaagaccagccuggccaacacggcgaagccccaucucuacuaaaaaauacuaaaauuagcugggcaugguggugcacaccuauaaucccagcuacucaggaggcugaggcacuugaauugcuugagccugggagacagagguugcaauaagccgagauggugccacugcacucuagccugggcaacagagcaagacucugucucaaaaaauaaaauaaaaaauaaaauaaauguuuuaaaaauagaaaauauaauacuacuaccuaaauguuuuauuugguaaaauggguuugcuagaaaauuauuuugcuuuauaucugcaaaaugcaaauaauauauauaauauauauuauuauuuugcuuuauaucugcuuuauaguuuuuuguaaguaaaaaaaguaacagcaauuuuuauuuuuaaagcaugugaaguuaguuuuugucuuugcaaacuaaucaacuuuuagcuacuaaaaaaauaaaacaagcuauauaaauaguauacuauguuauuuaacauaauuaaugaaauuugguaauuuuuuaguuacgaagaugaaaugagaguguaauauuuagucuugacauuuaugcuuaucacauuacauaaaaaguaauauuaauuauaacauacccuaaauuuguuaaauuuggaauaguuauaccuucuuugcagcaaauauuuuuauucuauugcaguaagcagguuauugcauuguuuauauaauuauuacccuguuuuacugguuuacaauuuguuaaagaaaagucacuaucaaagcuaagucuucauuuagauauauauuguuuuuaguugaaaccccccacagcgccccgacuuuuuuuuuuuuuuuuuuggcaacagggucucacuauauauugcccaggcuggacucaaacuccugagcucaagcaguccucccaucuccaccuuccuaguaucugagacuauagggaugagccaccaaacccagcuaaauuuuuuauaguuuauagagaugaagucuugccauguugcucaggcugcugucaaauuccuggccuugagugaucuugccuuuugcauuggccacccaaaguguugggauuacagaugugagccacugaaucuggacugguugcuaauuuuuuaaucuacgguaauaauaauaaguaccuuaaugaauuucugugguagaucaggcaucuuaauucugcuaacugcaucauauccagauacuguuacgucuguugcacauagaugaagauacagaagcuuuaagaaguuaaauagcuuaccugaaguuauuuaggaaauggccaaaguaggaauuugaguaugguuugcuuagauuccgaguauugcucuuucuguuaaacaccugcaauaaccauucucaaaacauuugacaucaguacuccuuuacauucuucaaaguuauugaggaucccaaaguuuuuguuucuggggguuguaucuuucaguauauacuauauuugaaauuaaaacugagaaauuuuuaaaaaacaugaauacauaagcauauauuguauuggcuguuaaagaauaaggcacguaacauuuuaguauuauucugagaauuauuuaaagcucauagacucccucaaaaggguugaggggaggggguacccagaccguauauugagaaccacuaaucuguaagaagacuagugaguuuggcauuggacaaauucaucucuccauucuuuuucaguuuaauguucuguuagucuucugauuacaaugaauacuacucuaaccuacucuaacauggugcuuacgguauauugcucauccauuuaauaguguagauuaguuaaauaguauauauaguguuauguuuacaguacaugcucuggaaguagaacugccugguuuagagcccacacuugucacuucuuaggaaaguuugggcaaguuauuuuaucuguauaucucaguuauaaaaugaggaugguauuaacaguacuuuccucauggaaauuaaauuguuacaugugaagcccuuagguauuuggcauguguuuaacagucaauaaguguuggcuauuauuuauuuggguuuuuuuaaaagcagugcuaaaugccacacaaauuucuuagaaauggcaguuuaaaugagcugugcaacuuuaaacuuugcaaaguauuuucauaauuguugacuuucuguuuuucuugaaggaaucucguaggcuguaucaguuucauuaugugaacuggccagaccaugauguuccuucaucauuugauucuauucuggacaugauaagcuuaaugaggaaauaucaagaacaugaagauguuccuauuuguauucauugcagguacaaaagaauuucccaaguuuauaaauacauuauuuaaguuugauguuacacaagguuuuauuucugcauuaauauguuaguaaucuugaauuucuccuagccuugauacaauguuugggacuagggccuuguaaguugauguggucucauuugguugacagaccguuuagaguauuguugcauuaaaacacaggaucaucuauuugaaaauaguauucacauggugggaagcuauagaacauacucuuuuuacuguucacugauuagagcauauaaucucagauccucaucauacucuacuuucuaaagucaguaugguaguauuuucuuuuaaucaauuucccugaaacaaugaccaagcaauuuucauuccugauaaacacugacaugagauuuuuaaaaacaggauauugcucugaugcccagguuggagugcaguggcacaaucauagcuuacuguaaacucaaacuccuggccugacgugauccuucugccucagcuucccaaguagcuaggacuacaggcaugugcuaccacacugaacuaauuuuuuuuaauuaaaaaaaauuuuuuuuaagagaccaagucuugcucuguugcccaggcugauccgaacuccuguccucaagugauucucccacuuugcucucccagagucuugggcuuacaggcgugagccacuacgccuggcaacaugacuuucuuuuuuuaauauauguaagauguacauacguaggucuuauugaucuaagauaucaucaauucuaagacacaccauuauuauauauauuaacaguaaaaaaaucacugccaauuauaaggggacaaugucauuuguaagaagccauuggugguaagauacauaccaaucucagagcuguuacauugagaugaaaaaguguguuuuaguuugaugaaaaacuaaaugcuguuuuuauucuuggggaacaucaguuuccacguuugcaccacuuccugucauaucaugaaauuuuauaauuuauagcuacugaaaaauuuaaagccggaagcaagcauucuuguaguaaaguaauaaaaacuauugauacacauuuacuagacauuuuuauuauguuuuauaguagauuacuucauuauaaggauuacauaaaauucaaugauuacugaccuaguuaagcuaccucugaaugugaaaggacaaguauaggugcaccuacuuuaaauugcacaauauaaaucuuuucauuuauucaaauaauauuugaaguucaguuagguuuugcaaaauuacucguuuggauguguuaagaaaucauguaaacucuuccuuugacuuugggggaaugaacaugagauuuguuuauucuuggggggcaguuaauuuuguauucuagaagggggguuaauguauaauauauuuuagcuaagagaaaucaguuuaagauaaccaacuuuucuuaaucuaacauuuuggcuuauuucugucaucuggucauucucauacaaauaauacaaagcuaaauauacauaauacauaugcacauauauguauauguauacauuauauguaauacauaaaacaaagcuaaauuuguauuauggauuuaggaguguaauggaaaauaccccuuuaagaggaaaagcacaaaacugaauuagucaagaaaauaauaaauguuugcaauaagugucaugaccggguauaguggcucagugcuuugggaggccgaggcaggaugauugcuugagcccagaacuuugaggcugcaguagacaccaauuacacuacugcacuccagccugggugacauaguagacccuaucuuuuaaaaaaaaaaaaagaauauagguaucauuauaauaugggugauacaggauauuuugaaaccuaauuuuuggaauuucauuauauagguauggguuucuacauaguagaagcuacuugaauccuuagacaguuuuucuacucugaauuuuuaguuuacauuagauucuucuaaaggccuuacagucauaguacuuacuucauaagacugcuaucaauuuauuccucuaagggacuuguuaucugcauucacauuuguuauaaaaaguaaaugagauuuuucaaacuuaagagauuuauuuuuuauuauuuacauaguuaaaauauuuuuucaguggaguugaagcauugaagauaguuuucuuauucacuugguuugaccguaaugcucauaauuaacgaaguaaaagggcuacuuuuuauucaugggccaggaaaguaacuugcugguggagaugugggaaucaguuaacaacuugguucauuaaaacuauuuuuuucugugguuaauucagugguuaguugaccauuuaauuaaguaggauugaccaguuaaaaauaaacaauauguuuaauuauagaauuaaaagauaaagaaauugcuuucacuuugacuucuuauaaguuaguuaaaauaauuuccuguucaaucauaaauccauuuguauaggaaggcuuuucaucaaaaacuaaauugaccguuaaauauuuuuagacaaucaaaacaguacguuaacuguaaggacuuagaaaacacauccauaaaagcaagaaaauucuuuugcuuuccacuaguuccacuggagauaaccauuguuaaaacucgagaauguguccuuucaguguguguauguguacauacaguauuguuuuguuuuauuuuguuugacggaguuuugcucuuguugcccaggcuggagugcaguggcacaaucucggcucacugcaaccuccgccucaacuauuuuaaacagcaguuuaaaugcuuaguggccacucuguuuuuuuguuuuuaauuuacuuuaauggccaucuuauuguuaaaucuuugagcacaucugcaguuauuaggacaaaguuauuauuggauaaauauccagaagugagauuuguuggucaaggacauaaacuuuuaaaguauuuuaaugaguauuuuuuaauguguuauccagaaaauugaugcuacuuaauucugccacuggcaguaugugagaguaccuauuucccuauaccuuccccaauacuguguguuaucuuuuuguuugcuuuuuuuuuuuuuuuuuuuuuuugagacagagucuugcacugucgcccgggcuggagugcaauggcacgaucucagcucacugcaaccucugccuccuggguucaugcgauucuccugccucagccucccgaguacugggauuacaggcacacaccacuacacccagcuaauuuuggguauuuuuuaguagagacgggguuucacuauguuggccagacuggucuugaacuccugaccucaugaucugcccgccuccaccucccaaagugcugggauuacaggugugagccacgguucccagccuuuguuugcauuuuuuucuuccuuuuuuuuuuuuuuuuuuuuuuuugagacggagucuugggcugucgccugggcuggagugcaauggugcgaucuuggcuugcugcaaccucugccuccuggguucaagugauucuccugccucagccucccgaguagcugggauuauaggcaugcaccaccacacccgguuaauuuuauauuuuuaguagaguuggggauucuccauguuugucaggcuggucuugaacuccugaccucaggugaucaccugccucggccucccaaagugcugggauuacaggcgugaaccacugcgcccagccucaucuuuuaauaguuauacaagugcuuuauauauugaggacauuaacuuuuauucauguuguaaguaccaugguuuuuccugucuucugccuguuugcaauacauaaguuucauuuugucaugucagauuuuugaaugguuuuuguccauugagauauuuguacauagaaagucuuucccuaacacaauaguguauauauuuugcauauauuuuuaguacuuucauagauuuacuuuuuaacauuuaucauuggauaaauauccaauauguuuauaucauauauauauauauauuuuuauccaccuggauuuuuuaugguuaagguaugugaucagaauuuaauuuuuugcucuucauugauagcuaacuucuccuuugccacuuacugaacggucugaucucuggagaauucacuguuauguaagaaauguuacauguacucagaucuguuccugaacuuucuauuguguuucauugaucugguuaucuguaucuuuauguuauacuuuuaacuaucaaauuuuagauauauauaauuuaucccaguaacucaacuaaaauucuauaaauguuuugaugcacagaauucacaaauguaucaacuaaaaauuaauauaauugauuauguuuauuaagaguuuuaaaaaaucuuucuagguuguuuauaguguacuuuuaucaggaauuuuagguuacauguuuaacaaacugcugauagguauacauuucaaaauaugcauuaaaauguuacacaacuuuguggggguuuuugccaaagauuauucuggugaugucaguaacaucuuauaauuacucauagugauuuucaauucuaagaugcauaagccuuucucuaguugagaagcaguuacuuuaaaauacuuuugucaugaguuuuuuuuuuuuuuuuuuuuuuuuuuuugagacggagucucgcucugucgcccaagcuggagugcaauggcgugaucucagcucacugcaaccuccgccucccagguucaagugauucuccugccucagccucccaaguagcugggauuacaggcgcccacuaccacgcccggcuaauuuuuuuuuuuuguauuugcaguagagacgggguuucaccacguuggccaggcuugucuccugaccucaggugauccgcccuccuuggccucccauuguguugggauuacaggcgugagccacugagcccagccugucauguuuuaaaauaaaaaaaccuaugguauguuacucuaaaguccccagcucccauuaguuuuuugggauaugagagcauaucauugucuuguucuuuuguggaaaucacugcuguugcucaauccguuuucuagggcuuauagcauucuucaccuuuccuauaccuucuauagauugaaaugauguaccauuuccuccuguacucuaaaacaagagccaucuuuuuuuuuuuuuuuuuuuuuuuuuugaguuggaguuuuacucuugcugcccaagcuggagugcaauggcacgaucuugggucacugcaaccuccacuuccccgguucaagugauucuccugccucagccuccugaauagcugggauugcgugugucugccagcacgcccagcuaauuauguguuuucaguagagaugggguuucaccguguuggccaggguggucucaaacuccugaccucaagugauccaccggccucaggcucccaaagugcugagauuacaggcaugagccccugcgcccagccacaagagccaucuugaacauagaauaaaugucucuguaagacguuguuagcuagucacauuuucugauguagcauuagacuuccagagugacaacuuaguagcuauucucugugucacuuacucuuggaaguuccuuaaauuaauuuuuguuuuucuuuuugagaugaagucacacucuguuacccaggcuggaaugcauuggugccaucauggcuuacugcagccucgaccucccaggcucaagcaauccuucugccuuggccucccaaagugcugggacaacaggcaugagccacugcgcccaaccccuuaaaaaugaaauguuuaaaagauagaagacaauaggccuuccuuauucaagacuucacuguccucaguuucaguuacucauaguucaaaaauaucaaauggaaaauuucagaaguaaacacuuuguaaguuuuaaaugcugcaccauucugagaagcauggggaaguauguccugcuugcaagauaaaucaucccaugguccaguguguacacacuguagacucuaccagcccauuagucacauaguagauacugcaguuaccagauggacugucauggugucccagugguuauguucacaugacccuuauuuuacuuauaauggcccaaaccucaacaguagugagguagugacuagugauagauuguuauaauuguucuaauguauuauuaguuauuguuguuaaucucuuguugugccugauuuauaaauuaaacuuuaucauagguauguacauauaggaaaaaucauaguguauauguauauguauucuguguaacagauguugccaugaacacacuguaaguuguauuuuguuuauuacuaaguagaauuuugucaaacuucuuaaaugauuuuuuguuucugaauauuaacaugucuauccacauuuauuuuauaguuguuuuaucacaaaaaucaauuguuuuucaaacuuuauauccuuagugcaggcuguggaagaacaggugccauuugugccauagauuauacguggaauuuacuaaaagcugggguaagaauaauuuuuuguagcauuauguucaauugaucuauuaugauuuucaaacuuaauuauaauugcaguaaauuauaguguauauuuuauuauacauguuauuuuuuccaaaguaguuuuauuaaguaagaaauaaagguagugaaggccgggcacaguggcuuacgccuguaauccuagcacuuugggaggccaaggugggaggaucgcuugagcccuggggcucgagaccagccuggggaacauagggagacccccgucucuaaaaauaauuaaaaaauaaaaugauuauaaaaaauaaagguggagaaaagguauaauugcugcauauugccuuugauaggaugcauuggggaacaaugugacaguguucuaggugagugaauacuugcauuaggauauaaacuguuacugacuuuuccaauacuaaauuuucauugccuuuuuuuuuuuuucuuuuuuuuccgagauagaguuucacucuuguugcccaggcuggagugcgauggugcgaucucagcucacugcaaccuccaccuccuggguugaagccauucuccugcuucagccucccuagcagcugggauuacaggugccugccaucacgcccagcuaauguuuuauauuuuugguacagacaggguuucaccauguuggccaggcuggucucgaacuucugaccucaggugauccacucaucucggccuuccaaagugccgggauuguaggcgugagcuacggugccuggcccauugccuuuuauguuuacucuagguauaaguguauuucacucaguauguauuuaugccugcuggagacauuauaguauuguagucuaugaaugcugacucgagccaaauugcccagauuauaauucuggcuuucucauuuacuagcugugggaucuuggucaaaauacuaaucccauagugccucuauuucuuuaucagaaaauaggggucauaguaguaguaaugcauaagaauuaaauaacuuuugugaaguucuucagaacuaugugguaaauuguaaguacucaguuuauuguuaguguugauuacuguugcuguugugauuguuguuccuacuacugcuuuuuccaagaaauaguguuugauacuguggaugauacagagauaaauaagauacagccuucauuauagauuugaaaaacaagucucuucauuauguauacauuugauucuuuugcugguuccauaauguguucauuucuagagaggcgccuuuaauccuucauagcuuuauaguuuccaugaauuguucaucuuugucuuguacagaguagaauuaauaaaauguuuauuuuuucuuuuucuuccuucuuccccuuauuucucuuuuuucccugccaucucuccauuuuuuauuguugcaaggaaauauuuacauguuaaacaguuccuuaaaaagcccucugggguuaaauauuuuuuuccucaaaaacuauaaucaucuaauucucaaaugaaaaugcuuaagugaacaaaauuuaacuggaauucgaucacauuuuaacauaaaagucaaagauuaaaauuggaaugagaagggacacauaaaugaaugcuagcaaacaaaacaaacauuuggucauuuuaaaaguuguguauuuuggauaggugccauggcuuaugccauaauuccagcacuuuugaaggcugaggugggcggaucaccugaggucaggaguuugagaccaaccuggccaacauggugaaaccccauuucuacuaaaaauacaaaaauuagccaggcgugguggccggcgccuguaaucccaguuacuugucaggcugaggcaggagaauugcuugaaccuggaaggcagagguugcagugagccgagauugugccauugcacugcaaacugggugacagagcaagacuccgucucaaaaaauaaaauaaaauaaaaguuguguauuuugaacauaguucucucucucucuuuuuuuuuuuuuuuugagauggagucucacucuguugccuaggcuggagggcagugguguaaucucggcucacugcaaccucugacucucagguucaagcgauucuccugccuuagucucccgaguagcugggauuacaugcacgcggcaccaugccuggcuaauuuuuguauuuuuaguagagaugggguuucaccguguuucgggcuggucucaaacuccugaccucaggugauccgccugccuuggccucucaaagugcugggauuacagacaugagccacugcacccggccuaguuguuaagucuucauguaaaaaucuuggcugggcgcgguggcucacgccuguaaucccagcacuucgggaagccgaggcgggcggaucacgaggucagcagauugagaccacccuggcuaacacggugaaacccugucucuacuaaaaauauaaaaaaaaucgccaggcguaguggcgggggccuguagucccagcuacuccggaggcugaggcaggagaauggcgugaacccgggaggcggagcuugcagugagcggauaucacgccaccguacuccagccugggcgacagagcgagacuccgucucaaaaaaaaaacaacaaaaaaaaaacccaaaaaucuuaugauguauauaaggacuuccaagcagcaaaccuggaaaucauuuuuaacccuuccaucuuaaucacuccaaaauauucuuguugauaacaguuaugauauuucugcuucuguaaaccuccgccaguuucucacucuuucagacuguccucuuccuugauacaaaaauugugugaauaucagaucuucucaugucaacauugccuauugcaguagucgcaauuccauauacacaaaagaauugucuaggucguuucauaauuaguuccccaacuuggagccaaaggaucuauauuuuuaccuaggucuuuuagcugguccuuauauagccaauccaggagauacuggccaauagaauaaauucagucucuuuauuauguucacagucugauccuaaauauccuuaucuucucuccuccuuugaguaccuucuccuucuuuuagucuuaggcuuuguuuacaucaaacuucucaauuccccacauagauuauacauugaaucugcugugcuuauguauauuuccuucacuuuuuaugggauaaccuucuuuugauauccaacuauguuguagcugcacacacucaacaguuagccauagccucuuuauucccuguauacugcagucauacuuuggcuggacauaacugucuccccaucuugaaugcugagggucaagaacaguuuuguuuccacagugccaagcacagugucugagaugcauuaagugguguucaauaaauguuugcaguaaaccagcagguauuuaaguuuuaugugaaaagcugaagaagauuuuacuauuuucugaauagauacacaaaguugauguauuaaauuuucuguuuuagaaaauaccagaggaauuuaauguauuuaauuuaauacaagaaaugagaacacaaaggcauucugcaguacaaacaaagguauaguuguuuguuucccuuuauaaacugcuauuuuauaaaugcuuucuucuuuuuuaaaauguuguuuucauuuuguuuuuuaaucauuuuucuccuucauaggagcaauaugaacuuguucauagagcuauugcccaacuguuugaaaaacagcuacaacuauaugaaauucauggagcucagaaaauugcugauggagugguagguguucuuggucuauuaauuuuaggaaacuuuuacucuuuguuaagauguaauauuuagccuuuuuuuuguugucuuguguuuugucuaacaugagaagaauauccaggacacuuaacauuuuuacuuaaacucauuuccuucuuauucguaucuguauuaugauggcuauuuaaugacuccgauauaagguaaauuauguucuaaaugaaauaaaguuaggaaagaucucaugucaaaaaucauauaauucguuaauguuuuacuuuuuuaaaaaauaauugcauuguucucuuuacucuucccuuccacccccacccaaguaauucugcauugauucuacuugaauuucauuuuguauaaaguguuuuaguuauuuguguauaugcuuuucuuuucuuuucuuuuuuuugagacagaguuucacucuuguugcccaggcuggagugcaauggcacagucucagcucacugcaaccucuaccucccaaguucaagugauuuuccugccucagccuccugaguagcugggauuacaggcgcacgccacugugcccagcuaguuuuuguauuuuuaguagagacggaguuucgccauguugaccaggcuggucucgaacuccugaccucagguggucugcccgccuuggccucccagugugcaaugugcugggauuacaggcaugagccaacacuccuggccuuguguauaugcuuuucaguuaagcagaauuaaagagccacaguuaacucccuuuuguuguguuauaauucaguguuauuuuagccuuguaacaucuuacuggauauucaacuucuagaccugacaaaaacacuguauucucuuaguauucucauuucugccuuuguuuucuaaccaauugucuugcuucaauucuauauauaaccaccuugucccugaaggugcugagauuuuuuuuuuuuuuuuguagaauuuguuuacaucuuugucauugagucuaugauaacuauuacauuguuaaaccaaguaugagaaaauaaguugcaaaauuuauaaccuucauuuuccuuuucucccuuuaaaugguuuugucaguucccagaauauuuguuugaauuuucuugguuuuccaaaugacagauuuauuaccaaaugcugaucucaguuuguuaggauaaucuaauaucgguccaugaguuuuaggaaauaugcauuucuuuuauuagccaagugacaauuucacguuuuuaaguuuuaugugacaucguucuuauuccuuuauuaacauaggaauuauugugcaaggaaauccuccuacaaugccuuuagcuuaauuaaauccuauuaugacaugcucugaaucuagccaaauauuuuauaauguagaaucaaauguguuuuuguuuuguuuuauuuuguuuuuugaaauggaguuucacuauuguugcccaggcuggagugcaauggugcaaucuuggcucaccguaaccuccgccucccagguucaagcgauucuccugccucagccucccuaguagcugggaucacaagcaugugccaccacaccuggcuaauuuuguauuuuuaauagagacggaguuuguccauguuggucaggcuggucucgaacucccaaccucaggugauccgccugccucagccucccaagugcuaggauuacaggcaugagccaccgcgcccggccucgaauguguuuuuuguuuguuuuguuugauugguuuuuuuuguuuuuugguuuuugguuuuuuuuuugaugacgaagucucacucugucacuuaggcuggagugcaguggcgcaaccucugccucccggguucaagcgauucuccugccucagccuccugaauagcugggauuacaggcauguaucaccacauccagcuaauuuuuguauuuuuaguagagaugggguuuugcauguuggccaggcuagucucaaacuccugaccucaggcgaucccccugccucagccucccaaagugcuaggauuauaggugugagccacugcacccggccaaacauuuguauuauuuuguauaauuuaaucuaaguugagauauuuaauauuucgaaaagcugaguaggcuauaaacaguuuucuuuaauuuuuggguuuuuuuuuuuuuuuuuuuuuuuuugagauggagucucgcucuguugcccagaauggagugcaguagcacagucucggcucacugcaaccucugccucccggguucaugugauuuuccugccucagccucccaaguagcugagauuacaggcgcccaccaccaugcucagcuaauuuuuguauuuuuaguagagacaggguuucaccauguuggccaggcuggucuuaaacuccugaccucaagugauccacccaccucagccucccaaagugccaggauuacaggcauaagcuacugcacccagcaucuuuaaacuuuaauugaaaagcauuucuguuuuauuccaugaauucaagauuaauuucaaagcuaaaguuuuuauaucuggaaauacagguuuuuaggcuggaugcaguggcucaugccuggaaucccagcacuuugggaggccgaagcaggcaggaucaccugaggccaagaguugaagaccagccugggcaacauggcaaaaccccgucucuaccaaaaauacaaaaaagauuagccucccagacucacggguacaucaccuugccgaguuuauuuuuuuuauagagaugagguuuuacuguguugcccagccuggucucaaauccuuggacucaagcaauccauccgccucagccucccaaagugcaggaauuauaggcuaaaguucuuuuauugcaauauucaguguuuggguuuuguuuuguuuuguuugagacgaggucuugcuauuucacccaggccagagugcaguggaacaaucagggcucacugcgcccucaaccucccggacucaagcuuuccuccugccucagccucccaaguagcugagacuauaggcacauauaccacaccuagcuaauuaaaaaaaaauuuuuuuuuguagagauguugccagguuggucuugagcuccugggcuccaacaguccucccccaccucagccucccaaagcacugagauuacaggcaugagccauugugcccagcuauuguuguauuuuuuaaaacuuuuaacuauauuuaaauaaucuccagaaaauaugugauaaauaccgcaucaccuuuucaucuuuuucuaauuagaucaaagucugaucuuuguaagguuuuauuccauugaaucaauccuuuuuuaauauccugaaaucuauacuaggauuauaauucuaucauaggcucuuucugucuaauaggucagagcuuuacgggaauauaauaaaaaagucauacuuuguaggagaugagaugaaauaauacccauagcagauaaguaguuaacuucaaaccuacuuucguaccucauugcaugguacauaguagacauaaacuaaauguuugagagaaaucucuccauagaugaauggauaaauaguaaaaaaaaacagaagaaaagauggauuaucauuccagauaacuuuuuaguauuuucuucuuaagaaaucauguuuucuguaaacuuguaaauauaggugacucuuuuuauaggauggcugucugugguugcagaccauaaaucuuaaagaaaauguggaaucugaaaaauugagaaaaaucaucuuagaacugugugguugaaugaaaugacuugaaagguguauuaacuauuuagaagcuaugcugugagaaguaaaaauaaguccccacuuacuacuuuucugacaauuuaaucgguaaaaguuuuguuuaaauguucuguguuccaguauuauuucuguagaaauuuuaguuugauauacuaguugguuguuuaagacuuuaaaaugaauaguguuuuuuagagauauuuauaacuacagugacuuccuggagugagagaucuaaagagaaaauuuauucuguaagccuguaucauauugacugaggauuuagagguaccuuaauaagcaaacaucuguuaaguugugcagugugccuuuuuaucuuguguguaaaggacaccguuacaaguacugucaacaccaguauuucaguucuagaaugauuaaguaauagcaauaacaguuuguauuaucguccuuuuauuguguuuguauaguacauuuuagaugugauaaugaauucuggauuuuuuuuccuaaaauauaauuuuuuuauuuuuaaagcacccugauuuauaauuuauuuucuucugcagcugauaauauucuuaaauauuagauaauuuguuucuuaauguuuuuguagcauuucauaaagcuguuauauggaaaauaacaguacgcaagauaacuuuagaaaguucuguuuaaaacaagagaacacaggcuaggcgccguggcucauuucaugccuauaaucccagcucuuugggaugccagggcaggagaauugcuugagaccaggaguuugagaccugccagggcgacaaagcgagaccccaucuauacaaaacaauuuuuuuuuaauuaccuggguaugguagcacgugccuguaguccuagcuacuugggaggcugagauggaaggauuguuugagcccaggaguucaaggcugcagagguaugaucaugccacugcauuagauuauuuaauuccuaaaauucuuuuccauuucaaaaguuggugauugcuucagcaaguuguauacaugacaaauguggacucaaaaauuauagguaauaaaagagagucagaagauguggguguguaggagacauuaacuaggaaauccaagaacauugugaaguccagugaccaggagguuuuguacaugcuguuuagguaguggcucuuuaucgaauugcaguucugcauugucacauugauuccuuucaucagaggaaacucaguauguucugaaagcuaaucucucccagaagcucucuuuugguucuuccuguuaauggcuucauccugcucuuacucacccagaaugaggaauccuucaugaaaccuuuacuuucucacauguaguguuugccuaaaauguccuuacuaucucuucucuuuacccuuccaccuguuuuccuucuuccaauccucauucauuuuuugucaaaaucuuaccaaucccucaaugccauucugcauuuuaccuuaauauugucaacuuacuuuuucucaauuauauucuuaauauucucaacuauagcuuuuuuuucugauuucauagcuucauaguacugauuaugccacuuuggggcuguaguauuacccuucuacuuuuuuucuggggauuuuaccagacuacauuuugaaguuaaagauaauaccauguccuucuuacauuuuaguauccucugcuuugcugacuuuauucagugcauuucacuagauguccacauugccuuaccugcaguuccaaaauccaaagaaaacauaguuuuguuuuguuuuugugaauucaauauuacacucacuuggcaacaaaauauuucauugacaugacaugaguuuaugugugcuacaaaagaaaaaugcuguuuuguauguuagaaacaguucaaaaggaguuucauaugguuugccuuuaauuuuuauuuaaccuacuuaaugcacauuuugguacaaaauaucaaguguuacagaauuaugguuauaucauuaauggaaauaauaagcagaugaucaauaauauguuggggguacuuuuuuguuuuuuuuugagacggagucuugcucugucgcccacacuggagugcagagacacgaucucagcuuacugcaaccucugccucucagguucaagugauucuccugccucagccucccaaguaacuggaauuacagacgugcaccaccacgccuggcuaauuuuuguauuguaguagagacaggguuucacuauguuggccaaggcuggucucgaacucuagaccucaagugauccaccagucucagccucccaaaguucugggauuacaggugugagccacugcgcccagccuaggggguaccuuuuugaugcagagucucuaaauucuggugguaccugaggaucugaaacuuuggcgaccaaaaguccugauuugcgugaggcacaccaguucacacuaguugucuagguuuaauaauuaauaaugcuucuuuuucauucucaaaagagcccugauuuagacaauaaauuauauggucacccuaccuauagccagauauuucugcaccaaaugccucgauuuugguggguggcuuuaauuaaggaagaaugcuuuaaguuuuaugacauaacucuguuguucuugucaggaagugauauguauaaaacuauuaauucaucagauuauauauaaggagauagggugcacuuaaaauugcuaggaaguugagaucucuaguuguuuaguuggaaguaauugaaguaacaguuggacaagcugucaugauggacauaguagaagugccuuuuaauuaaaaacaaugauaacaaaacaaaaugcagcuacgguuucagaguuccuuaguugauaguauguguaacgauggcuguugucuaaaauuaucugagauguuggcaagggugaaaaucauuccucucuucuggacauaacauacccuagaauuaaaauacccuagcuagauaaauaugagauauguugacagugaaacuaauucaaggccguauuuucauuucaccgcuccccuauucacaguccuaaaccuaagguucuuauaccuguauugacucugaaacaucaauguuaaugauguuauugguccuugugaccagcaagaaccaaggauauucuggggaugggcucugucugccuuuuugagguccauuuggguagccagugauauaggagcuauauucccuaauggauuagagcacuccacauagugacagagugagagugaggcaagaaaugguuaaaaugaauccuaggaccaccaguuuaaaaguacuagguaguaauggggagucauaaaaagauacuccauuacuugguaaaugguauaagccuuauuuguuggcuuuuuuuuugucucugcauauauuaaguuccuagugguagugauggcggggcggggggauacuacguucuuuaauccacauuaucuuggggaaucuguuuuuuuacgguagcauuugagauguguugaaaugcugcuguacaccuugaucuuuccaguaacugugaugcgcuguuuuuuugauacaaucucuccauugaagucugguccuucaggcuaaaauauagagccagaauauaagacuuuuuuuuuuuaacuuggcaaaauuggcauuguuuaaggauugaaaagcacagaaacaauuuaguugaaacaugaagaggaaaaauuauuuuucucuuaaccuuagugaaguauuuuuucccuuggcagaaugaaauuaacacugaaaacauggucagcuccauagagccugaaaaacaagauucuccuccuccaaaaccaccaaggacccgcagguauuguaugucuucgaacauuuucuuuaaaagcauacuuguuucuacucacuguuaauuaaaaugacaaauucugaauauuucuaaauuacuuuuauaacuuuuauuauuauuuuguuaggauguaacauacguaugacaacugauuuguuacugguuuauuaaaaauuugguuucauuuuggauaaaauuucaauaauauacuguagcagaauguggauacuaccaugaauugacuaugguuuauguuuugauaugugauauaacuaaaauuuuaguuauucuaaagauucccauuuuuuuccugaugacuaaauaugcuugccaaaaauugcaugcauguugaagugugaggauauuuaauaacguuacuagcaaagaugaguuuauuucuuuaauuuuucuugcuuuucuaccaagcucauuuauaauaguuaaaaucauauauauucauaucuuucuuuuccuucccuucuuguucaggguagcugcuuagucaguaacaugguaguauggagagaauacagaggcagaagaagauaguuucaacuccuuuuuagccauuuagcucugggaucuaggauuaauuuacuuaauccuggggagaaggaguuguuuaaauauuguccuaaggauuaaauaaaaaacuauuagaauauuuuauagugucuuucuugcacauagaucugccaaaacugaucgacuucccaucaaaauaaauucuuuuauacaggauacaccaauuguuuccaucuuaaaacuuuggggaaaguugggucagacggccagggucaugucuuagcauugaguugcuaauuccaagagaucauucuaacgaaaucaucucucugaacaaaagaaaaagccugcagcuucccucaguaacugaagguuugguuagaaucccugcacaccacaggaauaauuuauucucauuuugaccaugcaagauucuaacugccugggaaggaagcugcugaguacagaaagaggcaguguacucugguauaaagaggcuuuuuacauaaauaggucccauuccaaauuuuaacuuuagcauuugccacugaaugaacuuugacaagccacuucucugaaaauacuuuacuucauuguagugagaguacucguauucuccguuuuuaaaaauuagugauaauguauauaaagcauguaguuacaugcccggccuauaguaacagauuuuuuaaguguggugguaguuauagucucuagaauaccuuugcauacuucucuuaggaaccucaggaagccuauauauagaugagguuaggucucaacauuuaaauguucgagauguuaacugugugcuaucagaacuuuuaguaguucuuuccuguucgauuuccacuuugguauccaccaaaacugguuggcauuuuagccgucuguggaagguaaccaguugaaaccuauaaaauauuaaguucucuaacuucucuguuccauauaggagcccuagaauccuaaaagaaacuacuggcccuaaaaaaauuaaggaacauuuuugcugcccuguguuuuaauuugguuuuugagauugagccaauauagagguuuucaaagucuacacugauauuuaugauuuguauguucuucuaccucuaacuacauguagcagcagucucuucuuaauuuuacaggaaaaaagaauagaauaucugaauuuaaagccuuuuuccuauaccuguugaaaaguuuuacuucuguuacucucuaauaaacaaaaagauaauaaagaaaaaagcaaaugcauauuaagaaaaaauauucaacucaagacagauuuuuauuaggcauacauucuaaaaguucuuugugugugauuuuauaauacaugcauaggucaccuuuuuucuucuucauguaauggagucaaaugccagaaugucauuauuuuugacaaagagaaccuugugacuucuaaguugggaugauuuuuagaacuauuauaaauuguuccaacauaacugaaaauaaaaucacaaaaucauaagauugauaacaaguaaaauaguauauuuuguuuuucaguauggcuacaguaaacacauuaauuguuuguuuaaaguacaugauggggccaggcgugguggcucacgccuguaaucccagcacuuugguaggccaaggcaggcggaucacaaggucaggaguuuaagaccagccugaucaauauggugaaaccccgucucuacuaaaaauagaaaaauuagccaggcgugguggcacgcgccugcaguuccagcuacuugggagacugaggcaggagaaucgcuugaacccaggaagcgaaggugccagugagccaaguucaugccacugcacuccagccugggugaaaaagcgagacuuugucucaaaaauaaaaaaacaaaaauaaaguacauguuggcugggcauaguggcucacgccuguagucccaacauuuugggaggcuaaggugggcggauugcuugaauccauauauauauauauauauaaaaauauguguuguguguauauuucauuuuuauuuauuuauuuauuuauuuacuuuuuaaacguuuuuguuaaaaauaagacacacacacacaguagccuaagcauacacagggucaggaucaucaauaucacugccuucugccuccauaucuuguccugcuggaagguaucgggcagaaacacacauggagcugucauccccuaugauaacagugcccucuucuagaauaccuccugaagaaccugccugaagcuguuuaacaguuaacuaauuuuuuaacaauuagaaggaauacacucaaaauuaacaacaaaaaguaaguacguggccaggcgccuguaaucccagcauuuugggaggccaagguggguggaucaccugagguugggaguucgagaccagccuggccaccauagcgaaacccugugucuccuaaaaauacaaaaauuagcugggcguuguggcgggcaccuguagucucagcuacuugggaggcuaaggcaaaagaauugcuugaacccgggaaguggagguugcagugagccaagauugcaccacuggacuccagccugggugugacagagcgagacuccaucucaaaaaaaaaaguacauaagccaauaacuauuuucuuuaucauuauuaucaaggauuguguccuguacguaauuacaugugcugugcuuuuauaugacugacagcauaguagcuuuguuuauaccagcaucacaacaaacgugaaugacgcauuuugcuacaaauucaugggaauuuuucagcuccauuauaacuuuguggggccaccauguuauguguggcccaucauugacugaaacgucacaugacuguacaugucuuucaguaauuuuuaauauuccaauucuuucuguuuuauuuuguuuuguuuucagacagagccuugcucuuuugcgcaggcuggagugcaguggugugauuauggcucacugcagccucgaccucaauugaaccucccacccuagacucccaacuagcuggaacuauagacacacaccaccaugccuggcuaauuuccguauuuuuuguagagauggguuuucuccuuguugccuaggccaguuuuaaacucuugggcucaagggauccacccauuuuggccucccaaagugcugggauugcaggcgugagccaccaugucccaccaguauuccaguucuuccaguucuuaaaagugaacagaacuaggaaugacugggcauuugacagaagccucuaauaugaaaaaacagaggaaauggagacaauacagaguaaaaugaaaaagaugggggaaaaaagaaacaacaguccacuuuucucagucauugggaaaugcugcaaccacgaaauaagaacuguggguaauaaguaagaagcucuuagaaauuaagaauauaggccaggcgcaguggcucaugccuguaaucccagcacuuugggaggcugaggcgggcagaucacaaggucaggaguuugagaccagccuggacaauauggugaaacccagucucuacuaaaaauacaaaaaaaauuagcugggcgugguggugugugccuguagucccagcuacucaggaggcugaggcaggagaaucgcuugaacccgggaggcggaaguuacagugagucgagaucgcgccacugcucuccagccugggcaacagaaugagacucuugucucaaaaaaaaagaaagaaagaaauuaaaauacuauaaauuuaaaaauuaagcagaaguuuggaaaauaaggaacuccauuuuccaauaaaauuuccaaaauaaagaaauucauucauuucaagaaaaugaauggauaaagaaaaaguaggagagaaaagauaaggaaauuagaaagcaaaacuagaagaucugucacugaacuaauaauagucuaaaaggagaguagggaagaagaaauuagcaaaaaaaaaaaagaagaaaaaauguguuagaauuaaagggcauaaauuuuuauauagagcguauacaccaagcuugauauacaccaccaaaugugauggauaaaaauaaaauuguuaaaaaauauaguuuuuuaaguuacauuaugaaauuauagaacauccaacauaagaaccuugcuuagguuuagaguaagauaaaaauaaugcugaaauuuggaguaaguuuuuuuaaauuaaaaacuuugaaaauacucgauuaacaaacccauauaucauacucgauaucugucaagcacuguucuaauuguuguucagauguuaacucauuuaauucuccuaacuacccugugaaaaagguacuguuaaggauauaugggguuuguuaaucaaguaaaucuguaaaauacuggucaugaggccgggcaugguguuucacaccuguaaucccagcauuuugggagccugaggagggcggaucacuugacguuagaaguuuaagaccagccuggccaacauggcgaaacccugucucuacuaaaaauacaaacauuagccgggcgucauggcgcgugccuauaaucccagcuacuugugaggcugaggcaggagauucgcuugaaccugggaggcggcggagguugcaguaagcugagauugcaccacuguacuccagccugaguaacagaaugagacucugucucaauaaaaaauauguaaauaaaauacugauuauggaaaaguggucucaccauguacacguagggaaaauaauacaccucaauuuauaucaaaauuuuaucucauccuuuuaaaacucauauuuucuauuuguauuauaauauguucuuaggauaaccuauuggucuuugcauaugcuuuauaaauuguaggaggugucugcaauuauuuuuguuuuagaucgcaaaaauuugacagccacucuuucagauuaagaaccaacuuguaggccagguacaaugccucacaccuguaaucccagcucuuugggaggacauggcaggugaauugcuuaaguuuaggaguuugagaucagucugggcaacaugaacauggcaaaaccacaucucuacaaaaaauacaaaacuuagccaggugugguagugcacaccuguagucccagcugcuugggaggcuaaacugggaggauggcuugagcccugaaggcagagguugcagugagccaagauagugcaacuguacuccagcccagguggcagagcaggacccugucucaaaaaaaaaaaaaagaaucuacuuguaaaacuugaacagauauaggaauaucuuaugagaguauugcugucauuuuaauaugaucaguauucuggagauauucauuuaucuucucauguccuaggaaugugggaaugugucuagagaaucugaacuucacagagucuuuauuuauuuauuuuauuuauuuugagacagagucuugcucugucaccuaggcuggagugcaguggcgugaucucagcucacugcaaccucugccucccgaauucaagugauucuccugacucagcuuccugaguagcugggauuacaggcgcacgcuaccaugccugacuaggguuuuguguuuuuaguagagacgggguuuugccauguugguuaggcuggucucaaacuccugaucuugugauccgccugccuuggccucccaaagugcuaggauuacaggcgugagccaccaugccuggcccacagagucucuuuuaaggggaaaccugguguaccaugugauuacugccaguuaucugguuggauaaaaaaagguugaucaccuggggggagaaaaaaaagcaaaaacucugaggugggguccaguggcucaccccuguaaucccagcacuuugcgggggccgaggcaggcaaaucacuugaggccaggaguuggagaccagccuggccaacauggcaaaaccccaucucuacuaaaaauacaaaaauuagccaggugugguggcaugugccuguagucccagcuacucaggagguugaagcacaagaauugcuggaacccaggagguagagguuccaaugagccaagauggugccacugcacuccagccugggugacagaacaagacucuaucucaaaagaaaaacagaacacaaaaacuuaaauauacaagcccucaagaaguuugcuucauauaaaguucuuaaaaagcaacaaagccugggcaacauaguaaacccuaucuucuucuuugguuuuuuuuuuuuuuugagacaggaucucauucuuucacccaggcuggagugcaguggcaugaucagagcucccugcagccuugaccuccccaggcucaggugauccuccuaccucagccuuccuaguagcugggacuacaagcaugcauugccacauccaguuaauuuuuuuguauuuguuaaagacacaggguuuugccauauugcccaggcugcucgcucucucucucucucucucucucucucucucucucucucucucucucucucacucucacucucacucgcgcucucucucucgcucucucucucuuuuuuuuuuuuuuuuuuuuuuuggagacagucuugcucugucgcccagacuggagugcaguggcgugaucucaacucacugccaucuccaccuccugggcucaagcaauucuccugccucagccucccaaguaucugggacugcaggugugugccaccacaccuggcaaauuuuuguauuauuaguagagaugggguuuuacuguguugcucaggcuggucucaaacuccugagcucaauugauccacccaccuuggccucccaaagugcugggauuacaggcgugagccaccaugccuggccccuauuucuuuaaggaaaaaaauaaaggcaacuagaggguauaacccacccgaacaaaggaguauacccagaaagaggaaaaugagaccugggaaacaggagaaucugaaaccagagagaacauuagcucugugauggacuagggaaccaguaguccacacuggagcaggaggccaaaaguuacuaacaaggaugucugugguauugauacuuacuaugugugcuugucauuauugagaggagguauaccaaucugcaagaaaguuagaagaaaagcugaguaacugaugaugcauagagagcuaagccaucagaaauccaaggcagucauuaggggaaaacaagacacuauagaagaaaagauacgaaaucauggugucauagaugggaauacuaucugcagucauacgacugagguaaugaaaaauuacaauauaacaguauuggaaagauagagaaggacacuuccacaguaggaagucaguagaaaaugugugaaacaaagaucaagaaauaacuuuugaaauagucugaaauacagagguguaaauuuuagaagcagcuauaaaaaaauguugaaaguugaugccucuggcuaacaggagggcugcggggcagagacuauguuuuucauucaaagucuuguauuugacuuuuuaaacaguauauguguauuaccuugaugaacauuaaauuuucuuagucugaaaaacugcaguuuuuauucgcaaccagauuguaauggcucuuaauaugcuacucuuagcuacauaauucucagguaucaacuuguuuaacagucuuaaaaugcccuuuuuaaauguuuguuuuucaguugccuuguugaaggggaugcuaaagaagaaauacugcagccaccggaaccucauccagugccacccaucuugacaccuucucccccuucagcuuuuccaacagucacuacuguguggcaggacaaugauagauaccauccaaagccaguguugcauaugguuucaucagaacaacauucagcagaccucaacagaaacuauaguaaaucaacagaacuuccagggaaaaaugaaucaacaauugaacagauagauaaaaaauuggaacgaaauuuaaguuuugagauuaagaaggucccucuccaagagggaccaaaaaguuuugaugggaacacacuuuugaauaggggacaugcaauuaaaauuaaaucugcuucaccuuguauagcugauaaaaucucuaagccacaggaauuaaguucagaucuaaaugucggugauacuucccagaauucuuguguggacugcaguguaacacaaucaaacaaaguuucaguuacuccaccagaagaaucccagaauucagacacaccuccaaggccagaccgcuugccucuugaugagaaaggacauguaacguggucauuucauggaccugaaaaugccauacccauaccugauuuaucugaaggcaauuccucagauaucaacuaucaaacuaggaaaacugugaguuuaacaccaaguccuacaacacaaguugaaacaccugaucuuguggaucaugauaacacuucaccacucuucagaacaccccucaguuuuacuaauccacuucacucugaugacucagacucagaugaaagaaacucugauggugcugugacccagaauaaaacuaauauuucaacagcaagugccacaguuucugcugccacuaguacugaaagcauuucuacuaggaaaguauugccaauguccauugcuagacauaauauagcaggaacaacacauucaggugcugaaaaagguaauaauauagugucaaauacuuaaaugucuuuccuaugugcuagucacuguuuuaagcacuuuagcuguauugauuuauuauguuuuauuccacacucuaccauagaaccuacagcaaaaucugucuuagauacuaauuuuuuaauauaagcuuuuaauguauuguuaacaauuuggucacauuauauuacuggguuuuguguuucuaaauuauuuuaguaguuauaacuggauaacuuauuuucuuuuucuucuguauuauagaucuuaguguuuuuguaucggucaaaaauuuaucugacugaauaauuagaaauaauuuagggaagaaucacuuaaaauaacaguggcaaaaauacuguagaaugucuugauuggccauauaauguuacucguuuuuccuaaauguuuagucauuuuuuacuguuccuuuaacuacagauuacauuuuuuuguuuguuuguuuuuacugucuucacaaaugcuuccaaauauggcugcuuccaacccugaguuuaacccaggaacaauacugcaaacugcucaauucaguagugagugggcuauaugcauaccuacucaucaaagcuauuauuuaaagaauuauuauuuuuuuagcacucuuagcauuucaagauaaugcaugcacucaguucccaaaguguauuauugcuucuugaaacuccucuuugaucugcugaaaguaaugauggcuaccaucuuaaacagacccuaagguugagaguaaacauauaaauuugaaagcuguuuauugauauauugauuaucaguggucacuuaccuaucagugaacuuugguagugacacauacagacugguauuuauaacgugcaggcaaaauaaguacugugaccuugaaagauuuuuuuuuuuuuuugagacuugcacucaaaagauuuuuuuuuugagucuugcacugucacccaggcuagagugcaguggcaagaucucggcucagccucccaaguagcugggauuacaggcacccacuaccacacccagcuaauuuuuauguuuuuaguagagacaggguuucgauauguuugccaggcuggucucaaauuccuggccucaagugaucugcccaccuaggccucccaaagugcugggauuacagacgugagcuaccacaccuggccuugaaagauuauuuucuauuucugacccauuauauaccacccauacuguagugcuuguauuuucucucacacauacuguauuuuuuaacuugagagaguguauuugguagacuagaugacagucuuuuugagacagaguuuugcucuuguugcccaggcugaagugcaguggcgcaaucuuggcucacugcaaccuccgccuccuggguucaaggaauucuccugccucauccucccuaguaguugggaauacaggcaugcgccaccaugccuggcuaauuuuuuguauuuuuaguagagacaggguuucacuguguuagccaggauggucuggaucuccugaccucgugauccgcccaccucggccucccaaagggcugggauuacaggcgugagccaccacgcccagccaggugacagucuuaaacuauuugcuuaaauuacagaauuaucuuuucuugauuuaucuuuguuuuauuugaaggaucuuuagaagauaaugaauaguauaauauuacuuuaccaguuuaccauaauuuuaaauugcuaaugucuuuuguuccucagcuucagaauuugaaauauaacugcccagcuguaacuauauaagaaaauauguagauaagaaauuuucauuuugaguuuuuaguauaucaagcaugugguauuguaccuaggaaguuuuauuguuuuuuuguuguuguuuuguucuuuugcuuuuuuuuuuaaaaaaaaccaaaaaaccauuacuggaaauaggauuuggugagggccagaaagauguaugaugugauaugcuuauuaaaaguuacuacuacaugacgagucuguugguggcucaugccuguaaucccagcauuuugggaggcugaggcaggaaguucacuugagcccaggaguucauaaccagucugggugacauagugacacccaaucucuacaaaagauaaaaaacuagccgggcaugguggugcacacuuguggucccagcuacucuggaggcugagguaggaagaucacuugagccuaggagcucaaggcugcagugagccauaauugcgucccggcacucugccugggcaacagagggagacccugucucaaaaaaaaaaaaaaaaaaagaguaagauauagcuaaaagcacccuacuaugugccagcucauuucuguuuguuugguuuuguauuucaaagcaaaaaucacuauacaugugauuucugguuucuuuuuacucaaccuuaacuauguuauugguuugauuuuaaccgaagauuuuccuguguguaaauguucuuuguugcagcauaacuacaaguagucucauuuuuaauguguugccaaauauuuaccauauggauuauuuacuuuauagauuguuuauuuaccuuauagauuauuauuuccuuuguagaucauuaucuuauagagccauuggcaccagaauuagaguuuugggggguuuuuugguccuagaacuuguuagugaauuacagucacacauuucuuaauggcagggauauguucuaagaaaaauaugucauuaggcaguuuugccauugugugaaugucauagaauguauuuacacaaaccuagaugguauaguauauacuacacaucugggccauacaauguaaccucuugcuccuaggcuacaaacuuguauagcauauuaccauacucaacaauuguaacacaaugguaaguauuuguguaucuaaacauagaaaagguacaguaaaaauaugguaucauaaucuuacaggaccgcuguuguuuaugcggucuuguugaugaaaacaucauuauguagugcaugacuauaauggaauacuuuuguauugauaccuaaaaaaaacuuuugcauaaguuacugccugacaaaaauucuuagcuaucaauucuaauuucagucuugacuuaggccuccugaaagauuucucagauucaacuacagaaggccccauacaguguaugauuugcaaaagccuauauaaaauacgcaauaucugguuggauaaccucuaaaacaaaaguuuuuaacaggaaaggcagcccaaaguuccagggagaaacaugcauuugcaaagcaagggccacgcuuagaaaauaaaaguuuuuaagggugagaacugccaugagagaaaaagcacagaguuucuggaagauaacugauagaaaaagggcugaacugcccuuuuuguuuuguucauuuaauuuaagaaaugguaccagaaugccaagauuaugugucccuuccuuccaacagccaucucuucacugugcgcuguuaguagcaagagggcaaggagacauauggugaugacucagacuaccacuacuggauaagguagauaguucuuuaguggcaagagagaguucugguacucuugguagauguaucaaguauuggacuggaacuccucuuucaggaggacccagaagcuguauuuucuugcgucuccagcuaaauaaauguagguggggcaaaagcaaucauacucaccucaugcguguugaaaauugacaagaccuaugcauagccaucaggugugguaaaauagcagaguaucauggcagaacuguguguucauuuaagaacaaugggcaaggcucaagacaaaauaauacaggaccgucgcauuucuuuuucuuuaucccacccuccccaaccugagaguucacacacaggauuguauucuuauauuuucuuucuauuccuccagugaaaacucaaagaucaaauacacucauuuaccuuaagccauaauaaagcuaaccaaugaggcuuacuuaaugcacucucuuucccaagagcuaauuuuguuuuuacuagugaaaaaccuguauauagcuucagucagcauucucaaaguacagccaugugccacuguacacaaaaucuuuagcaauaaauaaaugaagauuuuuuaaaaaacuuuaauagcuauaucuuuaucuguuuuggaaaaauaacuaguauuuccaauguuauuucaguuauugcuguuuaagacaugacugagguacacaguuaaguuuaaaaugagucagauuuuaaaagugaauaggacacauguuacauaguauggcaaaaaucaugaaagguguuaagcaauugaauccuguuugggaaacacuggcuuaggcguuucauaacgcaaaugaccaaagcuuuccuuuuuggacacaaaacaucaucaguaagcucaguagagaagucacuugccagcugacuucucuacugaagauucccuucaggcuuggagaacugaaugaugucuguagagugacaggaaagucaugggagagagucauuucuguauacauuaucuuugcucaauaagcaucauaauucuugauaaugaguggaaaagguuucuugcauuuuuuugcauuuuuaaaaacugaucuagauauuugugacaggaauuuuuagaaugucaagaaagcucucugauuuuguuuagaugacauguuaauuugucuaaauuuuuauguguuuaauuuagauguugauguuagugaagauucaccuccuccccuaccugaaagaacuccugaaucguuuguguuagcaagugaacauagugagugucucuuuugcuuuuacauuuacuucauauucuaauaauaaacuccgaaaaacauaccugauuuuaaucuauuagcuauugugcuacauaauuaaauucaaaaacaaguaaauugauguugacaugcuuuuaauucuuuguuugaaaaaugcuuuuaaauuauauuuuuuacuugcuaagaucgauagaaauuacugcauuuauguuagauaucagaauucaauucauuuaaauguaauuauaggcugggcauggugguucaagccugugauccuagcacuuugggaggccuaggcagguggaucaccugaggucaggaguuggagaccagccuggccaacauggugaaacuccaucucuacuaaaaauauaaaaauuagcugggcauggugguggacaccuauaaucucagcuacuugagaggcugaggcaggaaaaugacuugaacccgggaguuggagguugcagugagccgagauugcgccauugcauuccagccugggcgaagagcaagauuucgucucaaaaaguaaauaaauaaauaaaugcaauuacaaagccaggugcaguggcucauaccuguaaucccagcaccuugggaggcugagaugcacugaucaccugaggucaggaguucaagaccagcgugaccaacauggagaaaccccgucucuacuaaaaauacaaaauuagccaggcgugguggcgcaugccuguaaucccaccuacuugggagacugaggcaggagaauugcuugaaccugggagguggauauugcagugagccgagaucacacuauugcacuccaaccugggcaacaagagcgaaacuccaucuuaaaaaaaaaaugcaauuauaaguguauuugcaaucugguguauuuucauucauuaaaaauagcacuuauugacucaugccuguaauccugccacuuugggagaccaaggcgggcagaucacgaggucaggacaucaagaccauccuggcuaacacacugaaacccugucucuacuagaaauacaaaaaauuagcugugugugguggcaugcaccaguagucccagcugcucgggaggcugaggcaggagaaucgcuugaaccccggaggcagagguuggagugagccgagaccaugccacugcacuccagccugggcaacagagcaagacuccaucucaaaaaaaaaaaaaguagcacuuauuuaugaaaacauuaauugcuuuccuuagauuuaggucaguaaacauuucuguugggugggcgucacuggauugguguuaacugaaagacauuuaacaccacuggaguagacugagcacauuggcucauaccuguaaucgcagcacuuugggaguccaaggcgcgaggauugcuugagccuaagaguuugagaccagccugggcaacacagugauaccuccucucuucuaaaaauaaaauaacuguccaguugugguggugggcgccuguaaucccagcugcuugggaggcugaggcaggagaauugcuugaacccaggaugcagagguugcagcgagcugagaccacgccauugcauuccagccugggcaacaagagcaaaaaacuuugucucaaaaaauaauaauaacaacaaaaaauuagccaggugugguggcaugugccuguaguccuugcuacucaggaggcugaagaagaaggauugcuugaucccuguaguuggaggcugcagugagccaugaucgcaccacuguacuccaguuugguaacagugagaccccgucuguggaagaaaaaaaaaagaccacuggaguaucagaacugggagaaagugaugauacuuuaaaacauugauaauauacuucucccuauuaauccucuaaaaaagagugcagaaacagcuugauuguauuuacagugucucaugcucaguggaggugcucacuugucuaaguacauuuuaccaauauauuaauuuugacugauuuuuguuuuguuucauuugguuuucuuuuuauuuauuuauuuuuuauuuauucauuuuuuugagauggagucucauucugucgccccggcuggagugcaguggcacgaucucggcucacugcaagcuccaccucuuggguucaugccauucuccugccucagccucccauguagcugggacuacaggugccugccaccacacccggcuuauuuuuuuguauuuuuuuuaguagagacaggguuucaccguguuagccaggaugguccaucuccugaccucaugauccgcccaccucagccucucaaagugcugggauuacaggcaugagccaccacgcccggcuaauuuuuuuguauuuuuuuaguagagacaggguuucaccauguuagccaggauggucuccaucuccugaccucgugaucgcccgccucagccucccaaagugcugggauuacaggcgggagccaccacgcccggccuuguuuuguuuuauuucgaguuggaguuccacucugucacucaggcuggagugcaguggcacgaucugggcucaagcuguucuccugccucagccuccugaguagcugcgauuagaggcauacaccgucacucccaacuaauuuuuuuauuagagauagggucucaccauguuggccaggcuggucuugaacuccugaccucaagugaucugccugccucagccucccaaagugaauuuugacugauuuuaagauaaauguuaaagagccaagcacaauggcuuaugccugugaucccagcacuuugggagaccaaggcagguggaucucuguuccauuugcccuaggaguuugagaccagccugggcaacauggcaaaacccugucuguauaaaaucaaaaauuagccaggcgagguggcaugcaccuauagucccagcuacucaagaagcugagaugggaagauugccugagccugggagguugaggcuccagugagccgagaucgcgccuggucaacagagugagacccugucucaacaacaauuaaaaagaauguugaaagcaaugaaacgguauacuucaguugucuaagucugucacguugucuguagauuaagcaguauacuucacuugucugucacauuaucuauagacuguaauacacugaugacugaauuuauuuacuuagguuuugaaggaaggaaacagaauguucucgaauuaauagaaacuacaauuuuuuuuuuuuagaaacuucagaaauaugcuuacccagaaacuacaaaauuuuuguggaagcgauaguuucuaaaaucuuuaggaucuguuuuuuguauuacuuuaaugcaaagaaauuucagaaauucaagguguuaauaacaauaagauuucauuuuucucagauacaccuguaagaucggaauggagugaacuucaaagucaggaacgaucugaacaaaaaaagucugaaguaaguccuuuuggaauuggaacaguuauagcuuaacauuucuacucuuuuguuaacuaaucuugcaguuguugaaauagcugucaucuuaagaucguuaaauauaguuuguaauuuuugaucggcauuucuuauacuaagauuucagaugaaaagcccauauaaaagguagguucugaaauuuuuuaaaaggguaaccugaucuacauacaacuaucacuuuaaaguauuguuuucucaagcuguuuuugaaauauguaaauuaugcuucaaauaauuuugaagguaugaaugaaauaggaguuacuauuuucaggguccuaauucuuucuuacauuucuagaugcuucccauuauaacacuaggcacauagucgcuucuuuuguuuuuuucuggcuaccuggcauuucuuugacauucgagaaauguuuuggcaauuaaauauuuugagggcguggcaugguggcucaugucuguaaucacagcacuuugggaggccaagcagaaggaucacuugagcccaggaguucaagaccauccugggcaacauggggagaccuuaucucuacaaaaauuuuuaaaauuagccaggcgugguggcgcaugucuauggucccagcuuuuugggaggcugagaugggaggauugcuugggccccagaggucaaggcugcagugagccaugaucacaccacugcacuccagccugagugacagagugagacccugucucagcaacaacacauuuguccauaggagauaacauuuuuuauuaacauuaauacuuuuuguauuuucucccauacuuuaauaucucugaaauuuagcuacaucuuauauuugauuuuaagacaugauguaguuuaauugacauauaaaauacaauaaugauauaauuaguaauaguggcuggcaaaacacagcuguauguuccuucaugcaguagcccaugcuuuucagugcucauccagaaacauuuacuccaaggagaaauagcauaacauuuuaaaauuuuaagccuaauuaaaaaacaauuguuugcuuuuccucugaugcugaaaaugauaggccuugauuucuugggauauauacccauaacagacccagcuuucuauuauuuguauauaaaaugaauguauuguaauagguauuaaaugucuuccucguagggcuugauaaccucugaaaaugagaaaugugguaaguuguuagauuuuuuuuuuccuuuuuacuguagauuuuauugauuaauuucuacaaaauaacaugcuucauaguucaugcuauauaguuauuucuguaugugaaaaugucuaggacaacucuuguagaagcuuaauauuguacuauaauucuuccaaauuaauuauuaccaccagauaguaguauugaucuggaaaaucaugggagcauuuacuaucaauaauuacaggcuaaugggaaagagauuuuuuaaaaauauuuuucuguuuuuuauuuucuguuuuuaaaaacaccuagaaguuagaucccgacuuaaauaaaugauggaauugcuucuguagaaaccuauuguuuuagaaaucuuccuuuuaguacuuuuucauuuauuugugaagaccaauaaaauugugaaagaaugaaugaauuuuaguaguuaacaucuuuuguuacuaaucuuaaacacugguaauuaaagaguaaacuacaaucuaaacaacauaaaacuuuaaaaguggaguuauuaggccuggcgugguggcucacaccuauaaucccagcacuuugggagacccaggcaggcaaucaccugaggucaggaguucgaaaccagccuugagcaacauggugaaaccccgucucuacuaaaaauaaaaaaaauagcuaggcgucaugccaucugccuguaaucccagcuacuagggagacugaggcaggagaaucccuugaaccccggaggcagagguugcagugcgccgagauugcgccauugcacuccaacccgggcaacaagagggaaacuccgucucaaaaaaaaaaaaaaaaaaacaaguagaguuauuauuucaaggugcaaauagugcauuaauuaacccugaccuuguugauuucuuaaaauuuuuuuuuuuuuuuuuuuuuuuuuuuuugagacagaggucuugcucugucgcccaggcuggagugcaguggcgcgaucucggcucacugcaagcuccaccuccuggguucacaacauucuccugccucagccuccugaguagcugggacuacaggcgcccgccaccacgccuggcuaauuuuuuuguauuuuuaguagagacgggguuucaccauguuagccaggaugaucucgauauccugaccucaugaucggcucgccucggccucccaaagugcugggauuacaggcaugagccaccgcgccuggccugaccuuguugauuucuauacaaagacauuucaguugcaacuauucccuuagaacauaggcauauaguauagcuaccuuaagggaauguaauaugucaagaccuagauuuaugaaguaagaauaacgagaauccucacauugcagaaguacucacugcagauuucugugugaccacaauaauaccugacaugauuuucugugcacacuacacuuguauuuauauuguucuugaccuguaaaauuauggugcccaggagagaaaguuuucucuuuucaugcuugccaacauuuaaaaaauuaaagaguuauauauauaugaugcuacaaaggauggugauuaacaaaggcuuuguguugcuacuuagaucauccagcgggagguauucacuaugaaaugugcauagaauguccaccuacuuucagugacaagagagaacaaauaucagaaaauccaacagaagccacagauauugguaauuuguuuaauaaauaauuuuuaguaaguaguuaacacuggcaggaaugagaaaagcucauuugccauugugaaaugacacuugccaagaauaaaacaugauuuuccaaaguugcuuggacuagucaugaaauaaaugaaauacuuaauucuauuucacauugagauuaaaaacuaaaauagaaaacugcaguauaaaaaaucuuuuguguuggaaagacuaaauuaucauggauauuuuucuuacauugugauaaaauugguuuuauuuccagcauaagauuuuuaaaagaagcaaucauuuucaguuauuccaaauaaauuuacaauuguuuugcauuuaccaaguuuuguuuggcuuaaauucuaaauucccuuguggaaauuuauuuguuccagaaaaugagaaugucuguggacaugguuuuuaguaguuugaaaguauuucugaacacugacuaguuauugugguguuuucacuguagguuuugguaaucgauguggaaaacccaaaggaccaagagauccaccuucagaauggacaugauucagggagcuagaagacacuuuaaguuauacuggaaaauucaggugccacugaaagccagauuuauaguauuccaucuuuaauaugugggacuaacagcaguguagauuguuaccuuaauauuuuuugcugggaccaucuaccugccuuauacuacacuuaggaaaaaguauuacauaugguuuauuuugaaacuucaaguauuauugccuuaaugucucuuaacccuguuacacgcugcuuguagacauguuaauauaguaauaccuuuaugauauauugaguuuaaggacuacucuuuuucuguuuuaucauguaugcauuauuuuguauauguacagggcaaguagguauauaauuugauaaaguugcaauugaaauauuauuaacagaagauguaagaaauuucugcauggucuaaaucuuuguguacuuuauuuguaaauuauuugcccuggaguuuuagaaaauaguuucugaauuuuaaacuugcuggauucaugcagccagcuuugcagguuaucagagaucaaagauuguaauaauaauuuuguaaauuguaagcaaaaaguuauuuuuauauuauauacagucuaauuguucauccuaauuguuccuguuuucaucuagucagagauucaguaagugccuuggaacaauauugaauucucuuagcuuguguguguuucuuuaauauuugaacucaagugggauuagaagacuaucaaaauacauguauguuucaggauauuugaccugucauuaaaaaaaacaaacaguuuuacagugcc

SEQ ID NO: 192989 - RNA, 31510 nt, Homo sapiens
aggucuggaccugaaccgagacaaggagguaccacacuauucacugcugcgucgcagagcgggcugggcggcugucuggaccucgagaggccugaggcaaggaucgcgucagaccccgaaagcugguuuguugauuagugaucuaagaccgccggaagcgcuucuucucaaucaagcuaugcaacaggaagucauuacgaucccguuguaaccucuaaauauguccccguucugcacagcaucccgauaaccguuuuguuuuucucauauuaugaccuucucauguuagcaccacuucgcaacgcuccaggucgugaaggagcaacuucaccaucgccgccuacagacgccacugggagcuugggagagugggacguggacaggaacguaaagaccgaaggguggguuucgaaggagcggauuucgaaguugcaccgguugaggauggcugacauucucucucagucagagacccuggcgucgcaagaccucaguggggacuucaagaagccagcucugccgguguccccagcggcgcggaguaaggccccggccagcaguucuucaaacccugaggagguacagaaggaagggcccacugcguugcaggacuccaauucuggggagcccgacaucccuccuccucagccggacugcggugauuuuaggagucuacaggaggagcagucgcgccccccgacagcgguuucuuccccuggcgguccagcccgggcuccccccuaccaagagccuccaugggguggcccugccacagcccccuacagcuuagagacccugaagggcggcacuauccuuggcacccguagcuugaaagggacgaguuacugccuuuucgggaggcugucuggcugcgacgugugccuggagcacccuucggugucucgguaccacgcagugcugcagcacagggcguccggcccugacggagaaugcgacagcaacgggccgggcuucuaccucuacgaucugggaagcacccauggcacuuuucucaacaaaacucgcaucccaccucgcaccuacugucgaguccacguugggcauguuguucgcuuuggaggcagcacccggcucuuuauccugcagguagguagaaaaaccuagaauugaaauuucggguucauuggacugcguucuugugcuucuuaagcuuuggaugaggaagaagaaucucccacucagcgauuacgaaagugaaggaaucaagucuggccuaucaucuucagacggcuguacacauugcuauauuucugaaagucauguucacaaucccgaacucuaaaauaacuuguuuggccaggcgcgguggcucgcgccuguaaucccaacacuuugggaggcccaggcgggaggaucgcuuuagcccaggaguuugagaggaggcugggcaacauggcaagacccugucucuuaaaaaaaaaaaaaaaaauuagccaggcaucauggucccagcugcucaggaggcugaggugggaggaucaccugagcccaggaggucaaggcugcagugagguguauuacagccacugcacuccaguccagccuaggcgacagagcaagacccugucucuaaauaaauaaauaaccuuuuuuuccuugguucaucagggaccagaggaagaccgagaggcagaauccgaguuaacaguaacacaguugaaggaauugcgcaagcagcagcaaauauuguuggagaagaagaugcuaggagaagacucagaugaagaagaggaaauggauaccucugaaaggaagauaaaugcugguagccaagaugaugagauggguugcaccuggggaauggguaagaaauuaaaauugcugccggagguuaauauuuuaaguucauuacaagugguacccuuaaauguuuuuuuaaaucauacagcuuuucauggcuccuugagauagauagggcaaacacaauuugcacaugagguaaccaaaacccagagagauucacugacuuuacuguuguaaagaaauugacuuauaggcacuuuggauuuuuuaaaaauuuauuuuuaaugcacucucuuguucaaaacuuguccuaagcauaaaauuauuauuuuuacaauucuaaaauuuuauauuuauuaaguacugaccuugugcuaugugauuaucauuggaggggauggaacucuauucaaucaaauaaaugggauguuauucaauauaggauauucucuugaauuuuuuguacuuugugaagauauccugaaauguggaauaucuaaucagauaaagcuggucccuuagccaaaauaauaaacuuucuuuaacaccagauauuuuagaaaauggauauucaggagaugggaguauaaaaagguagaagauggcauuaauauauaguugggaagauaggaaaaauuaugaaauuacuugugcuaagugccaaacaaaagcuagaaaccauaaguaugcuagagugaaaguuuggagaagagagaacagucacuggggacuuagaccuguguugucugauaugguagccacuagccacaugugguuacugagcacuugcaguguggcuaguugcaauugaugugugcuguaaaugcaaaauacacacugaauuucaaagacuuagucugaaaaaaagaauguaaaauaucucuuucaugauauuuuuauauugaugacauguugaaaugacaauaauuuuaccuguuuccuuuuaauuuuuuaauguggcuaauagaaaauuuaagaugacgcauacagcugucauuauauuucuguuggacagcacugacuuagaucuuugggaaacuuaauuuuuuuuauuuuaguagagaugggguuucaccauauuggccaggcuggucuugaacuccugaccuugugauccaccccccaccccccccccccaccccgccccccggccucccaaaguguagagauuacaggcgugagcgaucgcacuccacagggaagcuuuaugagcauaaggauuuugagcuggaacuugaaggaaaggaaaagccuuaugaagcugaguauugggauugguauucaggguaggaauugaugauuuuaaggaaguugugaguagaccagucuauuuggcagauauaagaaguauuaggaaauuauauugggaacgaaaguuagauaugagugugagagaacaagaaugccaggcugaggagcucaaauuuuuuuuccacaaugugguagguaauuuuacuuuuaaaauauaaugauggagaaaaaaaaauuaaggugccaugaaaacaaguuuugacuugucacacaauuuagaaaaccugaauaugcucauacuagugguuuuguggugguuguuccacccccugucccugcaaguauuuauuauuuuucaucacagauaaacuauauauauauauauauuuuuuuuuuuuugggagacggucucacuguguugcuuggguuggagugcagguagcgcgaucuuggcucacuacaacuucuuccucccagguucaagcaauucuccugccucagccucccaaguagcugggauuacagacacccgccacugugcccagcuaauuuuuuuuguauuuuuaguagagaugggguuucaccauguuggccaagcuggucuugaacuccugaccuugugauccaccugccuuggccucccaaagugcugggauuacaggcaugagccacugcgcccagccuaaacuauaucuuuaugcagccugagagaauaguggguaucauucaaauagucucuucucaugucugauuaucuuuucuuucuuuuccauauccuguaggagaagaugcaguagaggaugaugcugaagagaacccuauugucuuagaguuucagcaggaaagggaggccuuuuauauaaaggaucccaaaaaggcucuccaaggcuuuuuugaccgagaagguauguaaacagauucugacccuaccacuaaaacauauccagagcagugugguuuucuagagcuucauguugagcuuuauacuaagauaugcuauaauuuuauugcuguccuucuuguucacuuuuuacucuuguggucaguugcuuuagguuuauuuugaaaauuauuccucauuaguauggcagaggggaaaaaaaucauaaaaaucuuguuagucuuucuucuuaucuuaaaaaaaggaaguacuuuuuccugacucaucucauucuucucaaaagauccuggacuuuggugguggggaaauugagccaacuuccuguaguuuuuuaauuccgaauucaccugaucuuuuguaauuccuaacauagguuuugauuuuauauuauaugauuuaaaauuuuuuuuccauagaggauuguuuugguaggaauacuuugagagaauaucuauguauauguauguauaucuguauauauuuuauauguauauauaaauaauauaugaaauagcugugcacuuaauaucugugcuucuaaaaaccaggcaacuguguuaaaauaaccacuaaagucuacaacuuauaaaagugaaacauacuauacagugaacagagcuauguauggagaauugguuacuuugaucugaguuuguuuuuuucucugccucagacuuacucuaauuuuauuaucagacaauaaucccuaggaaugagaagugaaaugcauugaaauuuauuauucagugugguaugggaacuuguucuuuuuuuuuuuuugagacggagucucgcucuguugcccaggcuggagugcaguggugcgaucucgccucacugcaagcuccgccuuccggauucacgccauucuccugcgucagccucccgaguagcugggacuacaggcgcccgccaccacgcccggcuaauuuuuuuuguauuuuuaguagagacgggguuucacuguguuagccagaauggucucgaucuccugaccucgugauccucccaucucggccauccaaagugcugggauuacaagcgugagccaccgcgcccagccagaacuuguucuuuuuuugagacagggucucacucugucgcccaggccggagugcaauggcgcaaucuuggcucacugcaaccuugaccuccuggguuuaagcuaugcuccggccuuagcccccguaguagcugggacaaaagucacguaccaucaugcccggcuaauuucuguauuuuuuguacagaugggguuuugccauguugcacagacugguuucgcgcuccuuaacucaagcugucaucccgccucagccucccaaaguguuaggauuacaggcgugagccacugcuaggaacuuguucguauuuaacguuuguucucauuuaucauuguaucaacuaguaauuuuuggauucuauuaaaauuguuuugucugucuuucucccacaggagaagaauuagaauaugaauuugaugaacagggacauagcacuuggcucugcagggugagguaugcucuuuucuuauuaauguucuuuucuggaaaauggccaauuucagguuuaauguaugguuauagauaacaacccaaagaguaacuuucaucuaaguuuaagcuauuucuaaauuugagccuuuaucguuuaguaacccuuauauuauuggagaguggggugggauggguaagaaauagaaagaaaauauuuuaaauccaacauuggaaagauagaacaagauggauucaaagacugaaaggccaucuaaaaaaaaaaugacuauuaucauagcauaguaguuguuuucuugagaauuggagcuuaaugcugugcuauaauucccaccaaaucaaugaagauuaccuguggacgauucaacuggaaaacaacugguggcugaggccauucacucaggaaagaaaaaagaagcaaugauccagugcucauuggaagcuugucggauucuugacacuuugggauugcuucggcaggaagcaggucaguauauaggagcccuuuuuuucuagauuuaaaaaaaggaaaacucaacacaaacgcuaauaaaacuucuuuauggggggaaaauguaaauuguacaaaauuuuuugaagugaaaagagaaaaauucucaauacccuaagguagccacuguuuauauucucccagacauuuucuaugcauauauagaugugugcugagaccuagauccuuuaacaaaaaacacucauacacaaauguagucauauuaauuacaaucuuuugugacuuacuuuuuuaacauaagaauguaucauggauguuguuauuauuauuauuuuugagauggagucucacucugucacccaggcuggagugcagcagcaugaucucggcucacugcaacuuccgucucccagguucaagccauccuccugccucagcuucccuaguagcugggucuauagguugcaccacccugcacaacuaauuuuuguauuuauuuauuuauuuugagauggaguuucacucuuguugcccaggcuagagugcaauggcgcaaucucaccucacugcaaccucugccucccggguucaagcgauucuccugccucagccucccaaguagcugggauuacaggcaugcaccaccaugccuggcucauuuuguauuuuuaguagagacgggguuucuccauguugguuaggcuggucucgaacucccaaccucaggugauccaccugccucggccucccaaagugcugggauuacaggcaugagccaccgcaccuggccaauuuuuguauuuuugauagagacgagguuucaccguguugaccaggcuggucucgaacuccugaccucaggugauccacccgccuuggccucccaaagugcugggauuacaggcaugagccacugcgccuggccguaucacgaauauuacaucaauacauuaauauguaucaauacauuaauuguguauuuugcuuuuuuuuuuuuaaagucugaguagagcaucauuuauuaauaaggcuuauauuauauuuuuauuauugcaaaguaacuuaugucugguucaaaacuaccaaaaggcuuauaauaaaauauacuuguuccuugcccuacccauccucagucuucuucccuaaaggcuuucaguuuuuucaguuauuuauucuggcauuuaaaaacaccuguauuucuuggccgggcgcgguugcucacgccuguaaucccagcacuuugggaggccaaggcaggcggaucacgaggucaggagaucgagaccauccuggcuaacacggugaaaccccgucucuaccaaaaauacaaaaaaaaaaaucaguugggugugguggcaggugccuguagucccggccacuugggaggcugaggcaggagaauggcgugaacccaggaggcagaguuuucauugagccgagaucgcgccacugcacugcagccugggugacagagcaagacuccgucucaaaaauaaauaauuaauuaaauuuaaaaaaaaacaacaaacaccuguauuucuuuucuuuucuuuuuuuuuuuuuuuuuuugagauggagucucacucugucacccagacuggagugcaguggcaugaucuuggcucacugcaaccucugcuucucggguucaagugauucuucugccucagccuccugaguagcugggacuauaggugcgugcuccacacccagcuaauuuuuguauuuuuaguagagacaggguuuuaccauauuggccaggcuggugucgaacuccugaccucaugauccgccugccuuggccucccaaagugcugggauuacaggcgugagccacugcgcccagccuaaaaacaccuguauuucuaagaacaagaguaugguguuauauuuuuagucacuuauuuuagacguuaccugucgacucugcuaaauuaguauuuaguauuuacgugauuaugcuuaugcaaauauuaguuauaacugagcaguuuuauuucuuuuuguuuuuccuaaggguaauaauugcguuugcuuuucauguguuuggggcuuuuuuguauuucuugcucauuccucccacaccuuucaguagccucaccacaucaaacaacuuaaugauuaaguaauuuaucaguucugauuuguuuuggagacacuuuuucugaagagcacuauuuuucuuucagggcuuauugcucugcagaucugcuacagaacugucaccugggacuuaacuuuccuaucauccuuaagauuucuuuguccuuucuccaggguugacuuuucuguuucuugauucucauauucucauauuucuugguuuauuuccuugcacaguaguacauccuucuguacuuuuagcagauuaaaaagcugguacaacacuagagggcaugggugaugauagucuucaaugaauuucacaucuuuccuuuucuuggucuacucucuuguuuugguggacauccucuaguagauuucagagaaagaguguauaggaaauaaauuuuauuaauccuucucuucugaaaauauaauuauuguagcuucacuccugauuaauaguuuggcugggaauacaauucuaaguuggaaacaauuuuucuuauuuuacauucaguguugcuuuugagaaauccuaaacuguucagauuuugauccuauuguaugucaucuuuuuuuuccgccuugccagagcuuguaagaguuucccuuuguucuaaagguucuaaaacuaugaaguacuuuucugugggucuauuuuucuucauuuuucuggguacuuguuggauccuuuugaucuagaaaccuuggcuguucaggaaguuuucugcaauuaugucauuaauuguuucgucccucuguuuucuauggaauuuuauuauucagacauuggaccucuuggacagaccauuuaaguuuuuuuucuucuuuuuuucaucuguaugucuuuuccuucuugagagauuucugcaccuuuaucuuucugucuucucuauuuugccaucaagguuuuaauuucuuucucuuuuuuuaaaguuuuuaaaaucaggcagucuuucaugccagagaaggcucagagacuccaagguuuuaauuucuaaaaguucauuuuugguuuuugaauuguccuuuuuaaaacauaauauccucuuguuucauggguuguaaauaucuccucucuguuuucuccauguuauuuuucuuuuuauguggucucuguucugcauguuaaaggcuuuucuuaggugucauguaauucuucauuguaguuuuuuuauuuggggaugaaaaaggugauugacaguuuggaauauauaggugggguuucugcauggaauauauaggugggguuuguugacuuugagcaguacuauugaaugaugugggugggccuuuuguuggggaacccuugauuuaaguauccuuuugguuuuccucgucugugagcgagauuccccagagagugcucuuccaaucuccugccugaaacgaaaggacuggcugccagcauuccuagagcuaagugguagaagguggcugaguggcuucucauucagcuguuuucaggacaguacuauuuuuagauuauagugcccaugccuucaacuuuacuagucaacucguaauccaaaggcuuucuguuuuacccuuuccagagauuaaccucuggauuucuacugcagauggaaaggagaugaguaggcagggaggaagaucuauuucucaaccaguuuuuacuuaguccuccauaaccuuaguauccauccccaguugcagauccguuugaggauucugcaguguaaucacuuuggcucucagcuuuccccacuguuuaggauuuaucuuuuuaaauucugcuaaguuaguuucuacucaucugucuacuuucuaauuuucuaaaauuugggucuuuaugaauuucuuucucucucucucucucucucucuuucuuuucuuucuuucuuucuuuuucuuuuccuccuuucccucccuucucuuuuuuccuuuccuuucccuuacuuucccucccucccucccucccucccucccucccucccucccucccuuccuuccuuccuuccuucuuuccuuccucccuuccuuccuucucuuuccucuaugcugcccagauuggagugcaguggucugaucacagcucacugcagcaucaacuuccggggcucaagcgauccucccgccucagccuccuaaguagcugggacuacaggugcacaccaccaugcccagcuacuuuuuuuagauuuauuuuuaguaaaggcaaggucuugcuauguugcccaggcguggguacaucucuuuacuaugguuuauugggauuuagggaaagagggaaauuagauauguguguuuaauguaccaucuuaaccugcaaauuaggcuuauauuaauaaggacuauuuuccuugcaaauaauagaaguccaauucaaacuagcuuaggggaaaggucauuggcugcagaagcugggaagaauagcucaggaugaaggaacaggagugaaggaacaacugcaugaaccagaaccucaaguucugaaaccauaacuuaguacuaccaaaguagacucagcaucaccaggacauauacaaguugugugugugugugugugugugugugugugugugugugugucugugagugagucugucucacgagugcauuuuuaaacuuugcagacagauucuuacccugugcugaaaagcugauugcuuacagcccugaacuuaacagucucucacuuuaauaaccucauuguaaagagagccucuuugccccaucucuaaauauaaauaugagggaaagagucuuacugauuuggcuuugguccuaugacuaucccuaaaccagauaaaaugggggaggaauuuucuaggggaaagagguacuuuuaucagaacaaagggaguagaauguuguagggugaacaaaaaaguaauagcugucauaguuucuuauugauggacucuuuacauauucacuguuauaaauacuauugcauugauauuuauagaauaaauuccuagaaguggaauugcuggaucaaugcauuuuuaauggcagauauuguaggcuugaccaucaaaaagguuguaucaauguacauucccaccaauuauuaaucuuuuuauguuuuucuagucuaauagaugagaaguaucuaauuuuuaaauuuguacuuuauuuuuuuuuaaaguaacauauuuaaaaauauuuauuguauuuuucugugaacugcuuucauuauccuuuuucaaauuuucuuuuggguuauuguccuuuuucucauuuuucauuuuccuuuuuuccucauugauuuuuuuuuuuuuuugagauagaguuucacucuugucacccaggcuggagugcaguggcgcuuucucggcucacugcaaccucuaucucccagguucaagcaauucuccugccuuagccuccugaguagcugggauuacaggcacccgccacuaugcccaucuaauuuuuguauuuuuaguagagacgggguuucaccauguuggugaggcuggucuugaccucaggcgauccaucccccuucagccucccaaagugcugggauuaccaugccuggccauccucauugauuuuuaaaagccguuugcucauuaaauaaauuaacuauuugcuuuaaugaaaaauuauuuaauaagaaauugugggaaaauauacauaacagaaaaguguaccauuuuaagcauuuuaagaguaucacucaguggcauuaaguacauucacaauauuauggaaccaucaacacuguucauuuuggaacuuuuuuaucauuccauacugaaauugguaucuguuaaacacuaacuucauucucccuccuucccagccucuggcaaccaccauucuacuuuucugucucuaugaauuugacuacuuuagguaucucacaugaugcaguaaguguccuuuuauauauggcuuauuucacuuaguauaaugucuucaagguuuagcccuuuguuuuuauacguaguuuggcagcuuguagaaccucucuuucaguaguugauggugacauuuuaagcuccuugccuacuugccuucuuucuuuuucuuuucuuuuuuaaaaacuuauuuauucaucauuuuaucuaccucuaguaucucggaaaaggaaagccaagaacugggaagaugaagacuuuuaugauagugaugaugacacauuucuugauaggacuggccugauugagaagaagcgucugaacagaaugaagaaggcuggcaagauugaugagaagccagagaccuuugaaucauuggcaaguuuuauuuauggaaguagcugugguauuuaauaguuuaauuuuuaauaacauaauguauuauuuaaauauguuuuaugauaauuuuuaaaguaguagcauugaaaucugauacugaaguauaacuuuuguggucuguuaauuuaaugguaacagacaacuagucuuauccaaguuguuugaaaaaaauauggcuugcugcuagauccuuuccuucaggauauugauccauuaauuaacauucuuuggauaugauauuaccucucucaaaaggaaaggaaaaaguuccaaguuagggcguucugaggugaaauugacuuuagccuucuggcagucaagagaagucaaaggaauuuugaagaauguaguaugguaauauguagucugaaacaguauguucuucaggaaauuaucacaaggugacguguuaauggguagguaacagacaauaauaggcagguaauaggcuaccuauuagacuagaaaaaaacauaagauuaauaaugcagagcuugaccagaauauggagaaguagacucucaauuggugggaauguacaauacaaccuuuuaagugaucaauccuacgacaucugucaguauuaaaaaugcauugauucagcaauugcacuucaaggaauuuguuacagguauuaauuuauaguaggauucagagcuuaaaacauuacccaacaucuauccuuuugauuuaugugaaaacaaaugccuugagcucuuucuucugaguaaaaugaaguccgaguuauucauucuguuuaauucuguguuuuuuaauucagaaauaaauuaaauuuggauuuaacacauaaaaaguguuaacuccuggcugggcaugguggcucaugccuguaaucccagcacauugggaggcugaggccgguggaucaccugaggucaggaguucgagacccaccugaccaauguggugaaaccccaccucuacuaaaaaaaaaaaaauacaaaaauuagacaggcgugguggugugugccuguaguccuagcuacucuggaggcugagacaggagaauugcuugaaugcaggaagcagagguugcagugagucgagaucacgccauugcacugcagccugggugacagugcgagacuccaucucaaaaaaaaaaaaaaaaaacuauuaacucuggccaggugugguggcucacaccuguaauccuagcacuuugagaggcugaggcaggcugaucaugaggucaggagauugagaccauccuggccaacauggugaaacccugucucuacuaaaaauacaaaaaguagcugggugugguggugcacaccuguagucccagcuacuugggaggcugaggcaggagaaucgcuugaacccgggagucggagguggcagagagccgagauugcaccacugcacucuacccuggcaacagaaugaggcucuaucucaaaacaaaaaaaaaaguguuaacuccauaaguagcaguuuaacuggacuuuugaauuaaucuucuuaaaacuucuaguaagaauaauuaaaacaggaggaugaaaaacaguuugaaagaagaaaaacuuuguaacccuguugauuuggguguuacagguugcaaaauuaaaugaugcugaaagggaacuuucugaaauuucugagagauugaaagccucaagccaagguaaguuuuucaucaaauauuuauuaauauaccacauauagugcucuaugcuaggcacuggggcuacauuaguuaauaagaaauaccauacagaauauggagccuuuuaaaggagcaacauaccguuuuagaacuagaaagaacauuauaaaucauuugguuuaaccucuuuauuuaauuguugaggggaaugaagcacauugagacaaaaugacuucccaaggucucauggcuauaaccuguuccuuauuccuauuacuagugauguccucuguccgguuuuauguuagugacuuuuauauggaaacuuuggcugaauuuuaaaauauucaggaucaucuuucuaaacauguguuauucuuuucuuggacaguucuaucagagucuccaucucaggauucuuuagaugcguucaugucagaaaugaaaucaggcaguacauuagauggugugucccggaagaaacuucaccugagaacuuuugaacugaggaaagaacaacagagacuuaaaggguuaauaaaaauuguaaagccagcagagauuccagaacuaaaaaaguaagucuuaguuauauuuggaauucuaaauaaguaugguagcauagauaacauuuucaauuaucgcuuuaucuucuuaaauaaucauuauauaauacaaauguaaugcaaggaacccuuuaaagcacagaaagcagugguuucauagaguaacuaaaaaccuguuucauauuugugaaauauagacugauagaggauuuucugagaaaacuauauugauuucugauucauuggaagguuccgaaguuuuuuuuacuuaaucuuuuaguguagaauaaacuccuuuaaaaagcaucaugcacaaaaagcuaauuuaucuaauauaaaaagaccucugaggcugggcguaguggcucauaccuguaauccuagaacuuugggagguugaagcaggcagaucacuuucaagaccagccugggugauauggcacaacccuaucucuacaaaaaauaaaaacaucagccagccauguuggagcacaccuguggucccagcuacuugggaagccgagguaggaggaucgcuugagcccaggaguuccaggcuacagugagcugugaucgugccauugcacuccagcaugggugacagaggaaguuccugucucaaaaaaaaaauuaaauuauuaauaaaaagaccucugaaugauaaguagacagccaaccacccaggagaaaaaugaguaaaggaugucuacucacaggccacaggaaaagaaauacaaauagcaucuuuuauacaaagaugcucaacuucaugaucauaagagaaauacaaauacuacaaccuaauaccuuuuuuuuuuuuuuuugagauagggucucacugugucacccaggcuggagugcaguggcacagugacagcucacugcagccuugaccuccugggaucaagugauccuccugccucagccucccaaguagcugggaccacacgcaugcuccaccauaccuggcuaauuuuuaauuuuuuguagagauggggucuugccauguugcccaagcuggucuugaacuccuggccucaagguaucugcccaccucagccucccaaagugcugggauuacaggugugagccaccacaccuggucuuaauagcauuuuuauauaugaauuugaugaagauuaauuaugauuuuauacugugcugaugaggcugacaaaaaggcacuuucuuauauugucauugaaggacaaauuaguacauucucuacaagacaaauuggcagucucuauccugauuacaaaugcacaugcccuuugaucuauuucauuucuaggaauuugucccucacauacuuaggaaaugauguacagcauuguuuguauuaauaguaguaaaaaauuagaaauccccuaaauguuuaucaaaggggauggauuaaauaaauugcggccaggugcugcggcuuacgccuguaaucccagcacuuugggaggcugagcugggcggaucacgaggucaggagaucgagaccauccuggcuaacauggugaaacccugucucuacuaaaaauacaaaaaauuagccgguugugguggugggugccuguagucccagcuacuugggagccugaggcaggagaauggcgugaaccaggaagguggagcuggcagugagccgagauugcgccacugcacucuagccugggcgacagagcgagacuccaucucaaaaaaauaaauaaauuaugguguagauauacaauagaacaccauauagcuguugaaaaaaaaggcaacuauauauaagauacagaaacacuaucaagauaaguaacaaaagcaaggugcagaacgguguguauaacaggcgcugucuguaaaaaaugauggugggggaagaauacauagauaaguaggccaugguuauguuuauaauaucuguuuaggucggguucccuaaaaacagacugaaucggagauucaucugcaagugauuuauuaagagagugcucucaggagaaaucuauaugggagugagggaagcaggagagggcaggagaagaagcugggcuaagauaugguuucaggagagccugaauggcaccacagaugccauggaggcauggggcuuggguuucgauacccuguccccccaacccuucauuggucauaggcugccggugacuggggggugggaggggcucacagcaauucugggaagggugcaggugugagccuuuagcagccgaugucugcaguagcuguuuggccugauaaagggaaucugggagggacagcaucugcuacuguaucucuggaaagauucguuaaaaauuaauaauauugauugccaauggggaaggcaacuggguggcugggggacagcaaugggagggagacuuuucacaguauaugugcuuuauacuugaguuuugaacaugugaauauacuuucuauucuauucagauauacugaauuugaaaagaaaauccuguaccaaauagccauaccacuuuagguccaaauuuacuguaauguaguugcaguucuaguucuaaauaacaaauaacuggaaaaaguaagaaucauauaauaauuuuguuacaguaaaacuauuuguuaauaaaaguggcuggggacgguggcucacaccuguagucccagaacuuuaggagagugagugaggugggaggauggcuugaguucaggaguuugagaccagccugggcaacauagugagacccugucucuacaaaagauaaaaacuuagcuggguaugguggugcuugucuguaaucccugcuacuugggaggcugagguaucacuugaaccugggagagugagguugcaagacccugucucaaacaaacaaacaaacaaaaacaaaacaaaaacaaaucucugcuuuggaaaacaacaacaacaacaacaacaacaacaacaacauuuggggcaagaagaauuaaaaaaaaaaaaaaacgaaaacgaaauaugucucagcuuccuccagagccuccucuccugcuaucagucugugugcuugccugguuuuuccucccuuuccuauuuuggauacuggucuagauguguaucuucuuccuccucuuuucacuuauggguugaacuuccaaacuuucugccuccuacccuaaccccugcaagcaaucuugauugugauuccaucuucugcuuuuucaucuccuuugagccagucuuagcuuauccucuaggccagccuggcuuuuuaauguagcugaaaacaucuguguugcuguugcuucugucuuucuaugccagagccuuccugaggccuguggggaagggugugaaggauaaugauuugacaaaauguccuucauggccaggcaggcagcauucuucugguggccuuagcaagggaauggguuuuaucucugguagggagaaaggggcuugaggcuggacuuaagagugcuacuaaggggauaagacuuagguaaaagaaggcaguaguagcaaguggggcuucagggagggccagguagcuaacaucugguaugggucacugugagucgaaugccauuacuguccuuauauuccaguuuucagggcugucccauggucaauaugaagaaaacagagggcuuucuuuucagucuaguaugcuuauucugggguuuccucugucuccucaugccauauucucauugucaccucugccugcucugaguaucuugucaacugaauugcuaucccuuuuguuuuugcucuguucucccccugccuuucuaauuucuacuaucucuucuuuauacccuuccucagcuuuguccuaaugggcuuagcuuuucuaacuaucuccagccguugagaauguugacaggcucagcaguugcagucucucacuauaucuuugucauuacuacacuggguauccugcauacuguacccccauccccaugcacacuuuuuuuuuuaagugcucagagcuauugcgcuuaagugggagcuccagauaaguaagacacucuucagagguuggugggaaguagggcuuuacaccauggaucaaucuccugcugcuuauauguucuccuuugccagugaccuuuguacuguagucauuucaugggugugaagucauguagcauguggcaaauuacuugacuaagggagcagccucaucauagcucugugucugugacagucagcauuguucuuguccauucaaaaucuguuggucugaauaccucuuucuuauuguuauaugcuuagauauucauuuugugguaauuuuuauuuugccagagguuucuuugucaguaucaugguauuuuuagauaaaaccuugggacucccuggaauagauguguauaauuauucuuucuuccuaggacugaaacucagacuacaggugcagaaaacaaagcuaaaaagcuuacauugccucuauuuggugccaugaaaggaggaagcaaauucaaauuaaaaacuggaacaguagggguaaguugugagucaggguguuaaacuuuuagcccuugaguuaucccugagcuaauuuuucucuuuucuuuuuugaaacuacaaaugacucauuccauaguaaugugagaaagggcugugggcuugguaugaucacaucuuucccagaacuugguucuuggauucuuuuuuuuuuuuuuuuuuggagacagagucucacucugucaccaggcuggagugcaguggcgugaucucggcugacugcaacuuccgccucccggguucaagcaauucuccugccucagccucucgaguagcugggacuacaggcgugcuccaccaugcccagcuaauuuuuguauuuuuaguaggaugggacuucaccauguuggccaggauggucuccaucucuugaccucgugauccaccugccuuggccucccaaaaugcuggguuuauaggcaugagccauugugccuggccaguuuguggauucuuuuucucagcuuaggguuaucaagaauugaugaauuaauuuaugccaaucaauuugcaaguaaaugguuuguaaauuagaaucauaguuuauuaauuucucaugaauguugcauuuaagaaugggucuccugcauuaaaugcuuuuccccagguggauagauguaguguucagacucaccaacauuuaagaacauagugugugcacuugccucugccauaugauuuuucuucauuuaauccuuccaacaccuuuugcugugugggaauuauugccucuuacaaaugaggaaauagagucagagaaguuaaauaccagaucacaccagcguuauguaacuaagcugguaaucagauccaggucugucucuugagcuuuaugauuucccugcuacccuacaauauaugucugucuguauguuuuugcuuuaucuauauuccuauucauagauucagcuuuuaaaagguuuucauuaccccuaagagcugaaccuugaguauuaguuugcuagggccaccauaacaaaauacuagggauugggcagcuuaaacaacagaaauuuauuuguucacaguugccagcaggguugguuuccucuaaggccucucugcuuaccaauggcugcccucuugcuggcucuucagauggccaucccucugugcacuugcacuccuggugucucuucuucuucuucuaaggacaugagucauacugaguuagggccccacccuaauagugucauuuuaauucaguuuaauuuaauuuacagucauauucugagguacuggggcuugggacuucaaacaugaauuugggcagcagggggcacaauucguccaaaacacccugaauuaggguauacugcccucugguggcagaaaucugaaguccuagcuauguauucuuuuuguuuguuucauugagagacagucucacacugucacccaggcugcagugcaguggccaucucggcucacugcaaccuccuccucccggguucaagcgauucuccugccucagcuucccgaguagcugggauuacaggcacccaccaccacgcccaacuaauuuuuuguauuuuuuuuuaguagagacaguuuuucaccauggccagacuggucucgaacuccugaccucaugauucaccugccucggccucacuauguauucugaaugaguaaugguuuaccuaacaaguaggcuuuucaaucuguugcgguggggacuuagguuuuaaauagaaaacuuuuuacuaaacagcccuccuuagagaauuuuagaacuaaguccuauauuuaaaagauaauauaggccgggcgcgguggcucauaccuguuaucccagcacuuugggaggccgagguggguggauugcuugagcucacuagucgagaccagccugggcaacauggugaaaccccgucucuacuaaaaauacaaaaauuagcugagcacgguggccugcgcaccuauaaccccagcuacucaggaggcugaggcaggagaaucgcuugaaccggggaggcagagguuucagugagcugagaucgcaccacugcacuccagcuugggccacagagcaagacucugucucaaaaaaaaaaaaaaaaagauauaaccaagauaugcuuugguuccuucccucuauuccauaacugugaucaaccuuuucuaauaaauacuuuuauugaauggcuuugauuagaauauuuagcuuuauucuuugagaaaugucuuccuccuuuucuucaggaucuguuugauggauuuacaugccuuguuuccuugaaauuacgcuaagucuaaaaugaaaaagcagcacaaaugacuuauuucugauugucugauuuauuccuuagaagauuuuguaaucaauugaaauccuuuaauaucaugaguuauaacaguccagaauuccuguagcuggcacucaucugaaauaacuauuuuaguuccuuacaagcuauuuucaaguguuuuguauuuaguaaucuuugacucuaggaacuaauaaagacacuuguuuagggucuauagagggguaaaauuucaugucaaagucccaccuccagcagacuucuguggaguucaucaaccuaaaaagaguaaacauucaguacauuuagacugaccuccuugaaaagauuuuucucuuguugucauuaaguagaacuacuuguucaugguuuuguuucccucuuagaaguuaccccccaagcguccagaacucccuccaacucuaaugagaaugaaagaugagccugaaguagaagaggaggaggaagaggaagaggaagaagagaaagaaaaggaggagcaugaaaagaaaaaacuggaggauggaagccucaguaggccacagccagagauagagccagaagcagcagugcaggaaaugaggccucccacagaucucacacauuuuaaagaaacccaaacccaugguaauaucuuucuucuccuuccuguguuguucagugggcaguuacauugauuguggauagguuuuaaaaagcaaggccaguucuugucugugcauuugacuuuguaugugauauacugacucuguagcaaggaaacauacuuucuuggucuucuuccuuugaccgccagucauuauuugucuucauugcaaauuaagggcaguuauuuccaauccauuccagaauuacagaaaauugaaggcuauggaaucugaaaccauagcugcuguggaauaauccugagcugcugccacugugugaguuggagggcaguggaacaggguacaugauggggccugaucagguggucuccggauaagucaaccccuauucauuuuuuccuccaucccuaaaacagaggccaaaccauaauuguacucauuggacuaaaguucucaagaaggaucuugcuucauucauuuuuguguguuuggaaccuagcacaaaaccugacacauauccacccgccucagcaaauauuugaugaaaaauguugaaagacggaauagauugauauucauauagauauaugcaucaauuaauucuguauuuucuauauauauauucuaauuacaaaggguuauauguucauuuuagaaacuauagaucauacauaaaaguccaaaggaaaaaaaagaaauccccacaaccccaccccuaaagaucauuguuuaucuuuuuaguauccuuucaucccuugucaacugcagggguuauuuuccugcugguuggccaaacugguuaggaagauaaagaucucagaaaauaaggaguaugaggagaaacaauaaaaacuggcacugaauguaugggaaugcaugcaugucuacuuccacaacaaaccaggcuuggcuacauaaaaacuccaggccugguauguagcccuucucuugaaucaccuucauuugucugggaaacagaaaaguuacuguuuccucaucugugagagguaaguauucuguaucugcauuuguccuuuucaaaaagguacuuacaugagcuuggucuuugggccauauauugugaagguggauauaaacaggucagcaggaggggagcaauaaguaucauaauuuuuuuguuuaacagaccaaaguaaguauguguguguaaaaauagcuuagauuuugaaacuugguuuauaagauuaaauaauuaguaaauuuggccaggcacaguggcucacgccuguaaucccagcacuuugggaggccgaggcggauggaucaccugaggucaggaguucgagaccaggcuggccaauguggugagaccccgucucuacuaaaaauacagaaaaaauuaguugggcgugauggugcaugcuuguaaucacagguacucaggagggcucugagcaggcaggagaauugcuugaacccgggagacagaaguugcagugaauugagaucaugccacugcucuccagccugggugauagagugagacuguuucaaaaacaaaacaaaacaaaauuaaauaauuaguaaauuugcagugaugagggauuaccccaggccuuuuuuccugugguuuguuuuuauuuuuacuuuaauauuuacuuuuauugagacagagucuuacuuuguuacccagguuggaguacuguggugugaucuuggcucucugaagccuugaccucccaaggcacaugcuuguagagaaaauagagucauagggucucccuauguugcucaagcuggucucaaacuccuggccucaagcaauccucucaccucagccucccaaagugcugggauuauaggcguaagccaccaugcccaguuuauauauugcuauuuuauaaccuaguuuuuuuuuuccuaugccuuagacuauucuuuuuaaaaugugguuucagagaaggagcauagugguucaucacaugcauaugccauaauguauuuagucaacucucaauuguugaacauguagguuauuucuuaauuuuugcuauuacaaacauauauauaacaaauuuuggggcuaggcugggugacucacaccuguaaucccaacauuuugggaggccgaaguaggagaaugacuugagcccaggaguuugaaaccagccuggacaagauagugaaacucuaucucuacaaaaaauuaaaaaaaaaaaauauuggccaggcauggugguacaugccuguaguccuagcuacucugcaggcugaggcaggaggaucucuguagcccaggaauucaaggcagcagugagcuaugauugccccacugcacuccagcuugggcaacagagaaaaacccuguuucuaaaauaauaauaaauuuugguggucaucucugauuuuuaaaaaaauauguucugggaguagaauuucuaggccaaggaguauguacauuuuugaggcuuuuaguaaguauugcuaaaaaguuuuaccucaauguuggcuaguguuuuaaguggaaaauuggcaguuuucuguaauacauuugaaacauauuuauuuaaaaccuuaagauuaguugaagcugaugauaauaaaacuggaugauuauguacuuagcuucucuuucucuuguuuuuguuuuuguuuguuuggcuuuccaccaugaauuaaaucaugacaauaugauuugauauugcuuuuuauagaaaacaugucucaacuuagcgaggaagaacagaauaaagauuaucaagacuguagcaaaaccacuucauugugcgcaggacccucaggcaaguaguacggcagccuucauugcugcucugcacacagguggcugacugguuucauaagggaggggcuggcagcugaccugaaggcagcacagagaaugguccuuuaguuauguugccacuaggccccuggacaaaguuggaacauaagagagguuuguauuuggugccaucccauuugccuuucuuuuacuccucuuccaccuucugggguucccucucccucccccacaaagcaccuaaugccuugauacuucccucuggcugugcaaagcucuccacaauuuuacaucucccaaagucaaauauguaccuauuaugggaguaauuccaaaacuaucuuaaaagaaauuguuaaaaggacugcuuuacucugguuuuaccuguaaugguuaaacuguggacuaguaaaaucagccucauuuuuuuuaaacuuguucgcauaaugugguuauauucaaacuuguagaacagccuuaggauuuaaaaacuaggguuauucauccaggaaaaauuuucucuugauauaguuuuuacagcaguagaaggaauuguugagaauugcauugucaugagcaucuuuucuucaauaauuguaauguucuuuuaggaagaauuuugccuuuuuauuuuacuuauacugaaaauagcuauugccaguuuuuuuuucuuaaauuagcaucaaagaaugaauaugagaaaagcagaggugaauugaagaaaaagaaaacaccugguccaggcaaaguaaguauuucacuugucugggaguaaaaaugaaucccuuugucauggaccacauccagaaaagugaaucuuuggagacugacuuaacagaguucccagcagccuuauuccccucuccuagaaaucuagauucuuugauuuuuguuuuugaauuuucuguugucuuuaucacucuuuucccuauaacugcucacauacaagcuaucucuuuuauuaguuuaugaaucuuucuuuauauccuaauuugccauauaaagacauuugaauaacauauucuuauuuuccuccuuuuauuacacaaaagguaggaugugauguacuccauucuacaucuguuuuuuuguuuuauuuauuuauuuauuuauuuaaaccacucauggaaauuauuuuguaacaguauauugagaguuucucaccauauggaggacguuaucuaacaguuccuuacagauggacacuugcauuguuuuuagucuuuuauuacaauaauacuauaaugaacaaucuuguauauauauaauuuuguguggauauaguaagcucccagaagugcuaggcuguaucaggagguccccaagaccacucacagguuaggucauucacgagaggacccaggucucagcguaugauuguacuugcaucuaugauauacuacagcaaaaggacaccaggcaccaucagcaaagggagaaggaacauggggcaaaauaugguggaaaccuggcacaggcuuccaaggaugucuuccaguagagucacacaggacaugcuuaauuccccuaagaacaaguuguggcaacacuugcgaaauguugcuaacuaaggaagcucauuagagacucagugcccaggguuuuuauuggcgacugaucacauaggcauucccugccuggcaucuaccaaaauucagacuuccagaaggaaagcagguguucagcaugaaucauauuguuuguacaaacaguuuaggcacaaugagccauucuugucaguuaggguagcagaaaccuucccaaagucuggauucccagaugccagccaagggcaaaccuugcaaauagguuuucaauggauagcagucagccuugcucuguuaacuuuucuaaaccuuggccaaaagguaaaugccaaauuucccucuaugggggcuguaccauuuagcacucacaccugcaguguguuaacugccccuuuuaaagagugucauguaacucacuggcugaaaaucagcuugugaugcuuuauggaaaaaagguucagagagagaauauucccccaaguagguuacuuaugucaagaucauuaauagaaacuguucucuguuaguuuuuguuugcuaacaggcauaaggacaauaguucuuagaguuaaaauuauaccuauauauauaauuuuuaaaaaauagcuuuuggguuacaaaugguucuuugguuacauagaugaaucauauagugaugaaaucugagauuuuagugcaccugucacccaaguaguguacauuguacccaauaugcaauuuuuuauuccucauccccuucccagccuccucccucugagucuccaaaguccaucauaccacucuguaugccuuugcauacccauagcuuagcucccacuuauaagugagaacauaugguauuugguuuuccacuccuaaguuacuuugcuuaaaauaauggccucuagcuccaaguugcugcaaaaaaauuuuauuuuuuauuuuuauuuuuauuuuugagaccgagucuugcucugucacccaggcuggagugcaguggugugaucauggcucacugcaagcuucaaucucuugggcucaagugauccucccaccucagacuccugaguagcugggacuacaguuguguaccacaaugcccagcuaauuuuuguggguuuuuuuguagaaauaagucuuguuuuguugcccgggcuggucucaaacuccuagcuucaaaugauccugggaugcugacuuuuauugaaugcuuuuucugcaucuauugagaugaucauaugguuuuuguuuuuaauucuguugcugugauguaucauauuuauugacuugcauauguuaaaccaucccagcaucccugggaugaaacccacuugaucaugguguauugaauaggguguauuauuuuucugauaugcuguuggauucaguuuacuagucuuucauugaggauuuuugcgucuguguucaccagggauauugggcucuaguuuucuuuuuuuuuguuauguccuuuccuaguuuuuguaucagggcgauauuagcuucauagaaugaguuagggaggauuccuucuuucucauucuuuuggaauacuuucaguaagauugguaccaauucuuccuugaaugucugguagaaucugacugugaauccuucugguccugggcuuuuuuuuguuggugguaauauuuuuuaauuacugacucaaucucacugcuuuuuauugguuuggucaggauuucuguuucuuccugauucagucuaggaggguuguguguuuccaggaauuuauccauuucuacuagauguucuaguuugugugcauagagguguucauaguagucucaaaggaucuuuuguauuucugugguguugcuuguaaugucuccauuuuccuuucuaauugaacuaauauagaaucuucuuuucuugucuaaucuagcuaaugaucuaugaauuuaguuuaucuuuucaaaaaccaccuuuuuuuucauugaucuuuugcaguuucuuuuguuucaauuucauuuaguucugcucugaucuuuguuauuucuuuuaugcuagcuuuggguuuaaucuguucuuuuuuuuuuuuuuuuugagacagagucucauucuguugcccagggagugcaguggugcgaucucagcucacugcaaccucugccucccggguucaagcaauuuuccugccucagcucuccugaauagcugggauuacaggcgugugucaccacgcccagcuaauuuuuguacuuuuguuagaagcaggauuucaccauguugaccaggcucgucuugaacuccuggacucaagcgaucugcccaccccagccucucaaagugcugggauuauagguaugagccaccgcgcccagccucauuuggucuguucuuguuccucuaguuccuugaggugugacauuagguugucaauuugugaucuuucagacuuuucucucucucucucucucucuuuuuuaaauagagaugaggucuugcuauguuauccaggcuggucuugaacuccugagcucaagcaauccuccugccuuggccuuucaaagugcugggguuauaggcgugagucaccaugccuggcucaagacuucuugauguaggcauuuaacacuauaaauuuuuccucuuagcacugcuuuugcuguaucccagagguuuugauaacuugugucacuauuauuuauuuugaagaauuuuuaaauuuccagugauuucauuguuaacccaaaaaucauuuagaagcagauuguuuaauuuccauguauuuguauaguuuugaagguuccuuuucaaguugguuucuaguuuuauucgacuguggucugagaagauacuugauaugauuucaauuuuuuuaaauuugagauuuguuuuguggucuaucauauggucuaucuuggagaauauuucaggcacugaugagaagauuguauauucugcaguucuggaguagauguucuguaaauauguuaguugauuuguucuggaguauaguauagguccaguguuuguugacuuucugccuugaugaucuguuugcuguugucaguggagugugaagucuuccacuaucauuguguugcugucuuucucuuuuguuaggucugguaguaguuguuuuaugaaucugggagcuccaguuuuaggugcauauauauuuaggauuguaauaucuucuuguuggguugauccuuuuauaauuauauaauagccuucuuugucuuuuuuucaguguuguugcuuuaaauucuauuuuauuugauauaagaaaagcuacugcugcuugcauuuggcuuccauuuguauggaauaucuuuuuccacuccuuuaccuuuagucuauaagaagccucacauguuaagugagucucuugaagauggcagauauuugguuugcgauuuauuuauuuauuuauuuauuuauugagacggaaucucgcucuguagcucaggcuggagugcaguggugugaucucagcucacuguaaccucugccucccggguucaagugauucuccugccucagccucccgaguagcugggacuacaggcacacaccaccacacuuggcuaauuuuuguauuuuuaguagagauuuugcaacguuagccagacuggucuugaauuccugaccucaggugauccacccaccucagccuccccaagugcugggauuacaggugugagccacugcgcccagccugugauuuuuuuuuuuuuuuugaguggaguauuuagaccauuuacauugaauguuaauauugagaugugagguacuguuacagucaucauguugauuguuaccuagauacuuuucuuccuucauuacauuauuguuuuauaggcccugugaguuuuaugcuuucaagagguucuauucuggugcaugccaaccuuuuguuuuaagauuuagaacuccuuuuugcauuucuuguaggucuggucugguagugacaaauucccucagcaugugcuugucugaaaaagacuuuauuucucuuucauucaugaaacuuaguuuuguuggauacaaaauucuugacuaauguuuauucugcuuaaggaggcuaacaauaggaccccaaucccuucugcaguuguaagguuucuggagagaaauucuugugaauaaaacaauccaucuuuucuuuuuagcuuccaccaacacuuucuuccaaauauccugaagaugacccagacuacugugugugggucccaccugaagguagauuguuuuuacuuuuuuuuccucuaagguucauuuauuuauauuuuugaauagguaauauagauuuaagguucaacauaagaaaguuacaagaguauguagugauaauuuguauaccauguuuggauccuuauucaaacaaacaacuguuuaaaaaaauuauuagccagucagauaauuuugaacacuaccuggauauuugaugauacuaagaaauuauuuuuuauuuuuuuaaagugugaaugauguugaguuauguuuuuuggaaaaaguccuugucuucuaggaauauauacggaaguguuuacagguguaauguuaucuggguuuuaccaagucaaaagaaaggaaaacaauucuggcugugccucagcuacucgguuguuuuccucacaagacaaccaauuguuguuaguuucuuauggauacuuauauauaaaaugcuaaguagagaggagcaucuauagaaaaaaaaucauaaaaguuaaccugcuggaucaaagguauaaacauuuuaaagauauuauaaauugcauucuauagagauuguaccaguuuuaugcucauacacacacccuuaaagcaauguaugagauacuuacuuccucauauguucaucacagcuugagauuucuaauauauuaguaacuaauauaauuuaguuacuugagaugucugcuuuuucuaugcuaacaaauguuaggguagaaaugaaagagggcuguauuuugaaauuucauacaaaaaguaaaauuucuaccguagaauaaaccuuuuugucuauuuuacuuuuuggccuacugauaucuggauaucuuuucucuccugacuuuggaagaguaaauaauguauuucuuuuuuuauauucugaucuaggucaaaguggagauggcagaacccaucuuaaugacaaguauggcuauugauugcuucagaaucccaaaagaaaaccuuguggaccaugugacauggaauauuugggauaauguaucaaauugaauggccagagaaguuuagaugauuauuuguaagaucuggugacuggcuuuucguucuguguucuuggcuuccuaaauuuaucugcccauaugauucucaugcauuugauauuuauguuuaaaaguguuuauauauguauguaaaaagggaaccauauguuuugagaauuuguaaagugagagacaugauccuauuaaaauaagaaggcaaaaauguuccuaaua

SEQ ID NO: 192990 - RNA, 31510 nt, Homo sapiens
uauuaggaacauuuuugccuucuuauuuuaauaggaucaugucucucacuuuacaaauucucaaaacauaugguucccuuuuuacauacauauauaaacacuuuuaaacauaaauaucaaaugcaugagaaucauaugggcagauaaauuuaggaagccaagaacacagaacgaaaagccagucaccagaucuuacaaauaaucaucuaaacuucucuggccauucaauuugauacauuaucccaaauauuccaugucacaugguccacaagguuuucuuuugggauucugaagcaaucaauagccauacuugucauuaagauggguucugccaucuccacuuugaccuagaucagaauauaaaaaaagaaauacauuauuuacucuuccaaagucaggagagaaaagauauccagauaucaguaggccaaaaaguaaaauagacaaaaagguuuauucuacgguagaaauuuuacuuuuuguaugaaauuucaaaauacagcccucuuucauuucuacccuaacauuuguuagcauagaaaaagcagacaucucaaguaacuaaauuauauuaguuacuaauauauuagaaaucucaagcugugaugaacauaugaggaaguaaguaucucauacauugcuuuaaggguguguguaugagcauaaaacugguacaaucucuauagaaugcaauuuauaauaucuuuaaaauguuuauaccuuugauccagcagguuaacuuuuaugauuuuuuuucuauagaugcuccucucuacuuagcauuuuauauauaaguauccauaagaaacuaacaacaauugguugucuugugaggaaaacaaccgaguagcugaggcacagccagaauuguuuuccuuucuuuugacuugguaaaacccagauaacauuacaccuguaaacacuuccguauauauuccuagaagacaaggacuuuuuccaaaaaacauaacucaacaucauucacacuuuaaaaaaauaaaaaauaauuucuuaguaucaucaaauauccagguaguguucaaaauuaucugacuggcuaauaauuuuuuuaaacaguuguuuguuugaauaaggauccaaacaugguauacaaauuaucacuacauacucuuguaacuuucuuauguugaaccuuaaaucuauauuaccuauucaaaaauauaaauaaaugaaccuuagaggaaaaaaaaguaaaaacaaucuaccuucaggugggacccacacacaguagucugggucaucuucaggauauuuggaagaaaguguugguggaagcuaaaaagaaaagauggauuguuuuauucacaagaauuucucuccagaaaccuuacaacugcagaagggauugggguccuauuguuagccuccuuaagcagaauaaacauuagucaagaauuuuguauccaacaaaacuaaguuucaugaaugaaagagaaauaaagucuuuuucagacaagcacaugcugagggaauuugucacuaccagaccagaccuacaagaaaugcaaaaaggaguucuaaaucuuaaaacaaaagguuggcaugcaccagaauagaaccucuugaaagcauaaaacucacagggccuauaaaacaauaauguaaugaaggaagaaaaguaucuagguaacaaucaacaugaugacuguaacaguaccucacaucucaauauuaacauucaauguaaauggucuaaauacuccacucaaaaaaaaaaaaaaaaucacaggcugggcgcaguggcucacaccuguaaucccagcacuuggggaggcugagguggguggaucaccugaggucaggaauucaagaccagucuggcuaacguugcaaaaucucuacuaaaaauacaaaaauuagccaagugugguggugugugccuguagucccagcuacucgggaggcugaggcaggagaaucacuugaacccgggaggcagagguuacagugagcugagaucacaccacugcacuccagccugagcuacagagcgagauuccgucucaauaaauaaauaaauaaauaaauaaaucgcaaaccaaauaucugccaucuucaagagacucacuuaacaugugaggcuucuuauagacuaaagguaaaggaguggaaaaagauauuccauacaaauggaagccaaaugcaagcagcaguagcuuuucuuauaucaaauaaaauagaauuuaaagcaacaacacugaaaaaaagacaaagaaggcuauuauauaauuauaaaaggaucaacccaacaagaagauauuacaauccuaaauauauaugcaccuaaaacuggagcucccagauucauaaaacaacuacuaccagaccuaacaaaagagaaagacagcaacacaaugauaguggaagacuucacacuccacugacaacagcaaacagaucaucaaggcagaaagucaacaaacacuggaccuauacuauacuccagaacaaaucaacuaacauauuuacagaacaucuacuccagaacugcagaauauacaaucuucucaucagugccugaaauauucuccaagauagaccauaugauagaccacaaaacaaaucucaaauuuaaaaaaauugaaaucauaucaaguaucuucucagaccacagucgaauaaaacuagaaaccaacuugaaaaggaaccuucaaaacuauacaaauacauggaaauuaaacaaucugcuucuaaaugauuuuuggguuaacaaugaaaucacuggaaauuuaaaaauucuucaaaauaaauaauagugacacaaguuaucaaaaccucugggauacagcaaaagcagugcuaagaggaaaaauuuauaguguuaaaugccuacaucaagaagucuugagccaggcauggugacucacgccuauaaccccagcacuuugaaaggccaaggcaggaggauugcuugagcucaggaguucaagaccagccuggauaacauagcaagaccucaucucuauuuaaaaaagagagagagagagagagagaaaagucugaaagaucacaaauugacaaccuaaugucacaccucaaggaacuagaggaacaagaacagaccaaaugaggcugggcgcgguggcucauaccuauaaucccagcacuuugagaggcuggggugggcagaucgcuugaguccaggaguucaagacgagccuggucaacauggugaaauccugcuucuaacaaaaguacaaaaauuagcugggcguggugacacacgccuguaaucccagcuauucaggagagcugaggcaggaaaauugcuugaacccgggaggcagagguugcagugagcugagaucgcaccacugcacucccugggcaacagaaugagacucugucucaaaaaaaaaaaaaaaaagaacagauuaaacccaaagcuagcauaaaagaaauaacaaagaucagagcagaacuaaaugaaauugaaacaaaagaaacugcaaaagaucaaugaaaaaaaaggugguuuuugaaaagauaaacuaaauucauagaucauuagcuagauuagacaagaaaagaagauucuauauuaguucaauuagaaaggaaaauggagacauuacaagcaacaccacagaaauacaaaagauccuuugagacuacuaugaacaccucuaugcacacaaacuagaacaucuaguagaaauggauaaauuccuggaaacacacaacccuccuagacugaaucaggaagaaacagaaauccugaccaaaccaauaaaaagcagugagauugagucaguaauuaaaaaauauuaccaccaacaaaaaaaagcccaggaccagaaggauucacagucagauucuaccagacauucaaggaagaauugguaccaaucuuacugaaaguauuccaaaagaaugagaaagaaggaauccucccuaacucauucuaugaagcuaauaucgcccugauacaaaaacuaggaaaggacauaacaaaaaaaaagaaaacuagagcccaauaucccuggugaacacagacgcaaaaauccucaaugaaagacuaguaaacugaauccaacagcauaucagaaaaauaauacacccuauucaauacaccaugaucaaguggguuucaucccagggaugcugggaugguuuaacauaugcaagucaauaaauaugauacaucacagcaacagaauuaaaaacaaaaaccauaugaucaucucaauagaugcagaaaaagcauucaauaaaagucagcaucccaggaucauuugaagcuaggaguuugagaccagcccgggcaacaaaacaagacuuauuucuacaaaaaaacccacaaaaauuagcugggcauugugguacacaacuguagucccagcuacucaggagucugaggugggaggaucacuugagcccaagagauugaagcuugcagugagccaugaucacaccacugcacuccagccugggugacagagcaagacucggucucaaaaauaaaaauaaaaauaaaaaauaaaauuuuuuugcagcaacuuggagcuagaggccauuauuuuaagcaaaguaacuuaggaguggaaaaccaaauaccauauguucucacuuauaagugggagcuaagcuauggguaugcaaaggcauacagagugguaugauggacuuuggagacucagagggaggaggcugggaaggggaugaggaauaaaaaauugcauauuggguacaauguacacuacuugggugacaggugcacuaaaaucucagauuucaucacuauaugauucaucuauguaaccaaagaaccauuuguaacccaaaagcuauuuuuuaaaaauuauauauauagguauaauuuuaacucuaagaacuauuguccuuaugccuguuagcaaacaaaaacuaacagagaacaguuucuauuaaugaucuugacauaaguaaccuacuugggggaauauucucucucugaaccuuuuuuccauaaagcaucacaagcugauuuucagccagugaguuacaugacacucuuuaaaaggggcaguuaacacacugcaggugugagugcuaaaugguacagcccccauagagggaaauuuggcauuuaccuuuuggccaagguuuagaaaaguuaacagagcaaggcugacugcuauccauugaaaaccuauuugcaagguuugcccuuggcuggcaucugggaauccagacuuugggaagguuucugcuacccuaacugacaagaauggcucauugugccuaaacuguuuguacaaacaauaugauucaugcugaacaccugcuuuccuucuggaagucugaauuuugguagaugccaggcagggaaugccuaugugaucagucgccaauaaaaacccugggcacugagucucuaaugagcuuccuuaguuagcaacauuucgcaaguguugccacaacuuguucuuaggggaauuaagcauguccugugugacucuacuggaagacauccuuggaagccugugccagguuuccaccauauuuugccccauguuccuucucccuuugcugauggugccugguguccuuuugcuguaguauaucauagaugcaaguacaaucauacgcugagaccuggguccucucgugaaugaccuaaccugugaguggucuuggggaccuccugauacagccuagcacuucugggagcuuacuauauccacacaaaauuauauauauacaagauuguucauuauaguauuauuguaauaaaagacuaaaaacaaugcaaguguccaucuguaaggaacuguuagauaacguccuccauauggugagaaacucucaauauacuguuacaaaauaauuuccaugagugguuuaaauaaauaaauaaauaaauaaaacaaaaaaacagauguagaauggaguacaucacauccuaccuuuuguguaauaaaaggaggaaaauaagaauauguuauucaaaugucuuuauauggcaaauuaggauauaaagaaagauucauaaacuaauaaaagagauagcuuguaugugagcaguuauagggaaaagagugauaaagacaacagaaaauucaaaaacaaaaaucaaagaaucuagauuucuaggagaggggaauaaggcugcugggaacucuguuaagucagucuccaaagauucacuuuucuggaugugguccaugacaaagggauucauuuuuacucccagacaagugaaauacuuacuuugccuggaccagguguuuucuuuuucuucaauucaccucugcuuuucucauauucauucuuugaugcuaauuuaagaaaaaaaaacuggcaauagcuauuuucaguauaaguaaaauaaaaaggcaaaauucuuccuaaaagaacauuacaauuauugaagaaaagaugcucaugacaaugcaauucucaacaauuccuucuacugcuguaaaaacuauaucaagagaaaauuuuuccuggaugaauaacccuaguuuuuaaauccuaaggcuguucuacaaguuugaauauaaccacauuaugcgaacaaguuuaaaaaaaaugaggcugauuuuacuaguccacaguuuaaccauuacagguaaaaccagaguaaagcaguccuuuuaacaauuucuuuuaagauaguuuuggaauuacucccauaauagguacauauuugacuuugggagauguaaaauuguggagagcuuugcacagccagagggaaguaucaaggcauuaggugcuuugugggggagggagagggaaccccagaagguggaagaggaguaaaagaaaggcaaaugggauggcaccaaauacaaaccucucuuauguuccaacuuuguccaggggccuaguggcaacauaacuaaaggaccauucucugugcugccuucaggucagcugccagccccucccuuaugaaaccagucagccaccugugugcagagcagcaaugaaggcugccguacuacuugccugaggguccugcgcacaaugaagugguuuugcuacagucuugauaaucuuuauucuguucuuccucgcuaaguugagacauguuuucuauaaaaagcaauaucaaaucauauugucaugauuuaauucaugguggaaagccaaacaaacaaaaacaaaaacaagagaaagagaagcuaaguacauaaucauccaguuuuauuaucaucagcuucaacuaaucuuaagguuuuaaauaaauauguuucaaauguauuacagaaaacugccaauuuuccacuuaaaacacuagccaacauugagguaaaacuuuuuagcaauacuuacuaaaagccucaaaaauguacauacuccuuggccuagaaauucuacucccagaacauauuuuuuuaaaaaucagagaugaccaccaaaauuuauuauuauuuuagaaacaggguuuuucucuguugcccaagcuggagugcaguggggcaaucauagcucacugcugccuugaauuccugggcuacagagauccuccugccucagccugcagaguagcuaggacuacaggcauguaccaccaugccuggccaauauuuuuuuuuuuuaauuuuuuguagagauagaguuucacuaucuuguccaggcugguuucaaacuccugggcucaagucauucuccuacuucggccucccaaaauguugggauuacaggugugagucacccagccuagccccaaaauuuguuauauauauguuuguaauagcaaaaauuaagaaauaaccuacauguucaacaauugagaguugacuaaauacauuauggcauaugcaugugaugaaccacuaugcuccuucucugaaaccacauuuuaaaaagaauagucuaaggcauaggaaaaaaaaaacuagguuauaaaauagcaauauauaaacugggcaugguggcuuacgccuauaaucccagcacuuugggaggcugaggugagaggauugcuugaggccaggaguuugagaccagcuugagcaacauagggagacccuaugacucuauuuucucuacaagcaugugccuugggaggucaaggcuucagagagccaagaucacaccacaguacuccaaccuggguaacaaaguaagacucugucucaauaaaaguaaauauuaaaguaaaaauaaaaacaaaccacaggaaaaaaggccugggguaaucccucaucacugcaaauuuacuaauuauuuaauuuuguuuuguuuuguuuuugaaacagucucacucuaucacccaggcuggagagcaguggcaugaucucaauucacugcaacuucugucucccggguucaagcaauucuccugccugcucagagcccuccugaguaccugugauuacaagcaugcaccaucacgcccaacuaauuuuuucuguauuuuuaguagagacggggucucaccacauuggccagccuggucucgaacuccugaccucaggugauccauccgccucggccucccaaagugcugggauuacaggcgugagccacugugccuggccaaauuuacuaauuauuuaaucuuauaaaccaaguuucaaaaucuaagcuauuuuuacacacacauacuuacuuuggucuguuaaacaaaaaaauuaugauacuuauugcuccccuccugcugaccuguuuauauccaccuucacaauauauggcccaaagaccaagcucauguaaguaccuuuuugaaaaggacaaaugcagauacagaauacuuaccucucacagaugaggaaacaguaacuuuucuguuucccagacaaaugaaggugauucaagagaagggcuacauaccaggccuggaguuuuuauguagccaagccugguuuguuguggaaguagacaugcaugcauucccauacauucagugccaguuuuuauuguuucuccucauacuccuuauuuucugagaucuuuaucuuccuaaccaguuuggccaaccagcaggaaaauaaccccugcaguugacaagggaugaaaggauacuaaaaagauaaacaaugaucuuuaggggugggguuguggggauuucuuuuuuuuccuuuggacuuuuauguaugaucuauaguuucuaaaaugaacauauaacccuuuguaauuagaauauauauauagaaaauacagaauuaauugaugcauauaucuauaugaauaucaaucuauuccgucuuucaacauuuuucaucaaauauuugcugaggcggguggauaugugucagguuuugugcuagguuccaaacacacaaaaaugaaugaagcaagauccuucuugagaacuuuaguccaaugaguacaauuaugguuuggccucuguuuuagggauggaggaaaaaaugaauagggguugacuuauccggagaccaccugaucaggccccaucauguacccuguuccacugcccuccaacucacacaguggcagcagcucaggauuauuccacagcagcuaugguuucagauuccauagccuucaauuuucuguaauucuggaauggauuggaaauaacugcccuuaauuugcaaugaagacaaauaaugacuggcggucaaaggaagaagaccaagaaaguauguuuccuugcuacagagucaguauaucacauacaaagucaaaugcacagacaagaacuggccuugcuuuuuaaaaccuauccacaaucaauguaacugcccacugaacaacacaggaaggagaagaaagauauuaccauggguuuggguuucuuuaaaaugugugagaucugugggaggccucauuuccugcacugcugcuucuggcucuaucucuggcuguggccuacugaggcuuccauccuccaguuuuuucuuuucaugcuccuccuuuucuuucucuucuuccucuuccucuuccuccuccucuucuacuucaggcucaucuuucauucucauuagaguuggagggaguucuggacgcuugggggguaacuucuaagagggaaacaaaaccaugaacaaguaguucuacuuaaugacaacaagagaaaaaucuuuucaaggaggucagucuaaauguacugaauguuuacucuuuuuagguugaugaacuccacagaagucugcuggaggugggacuuugacaugaaauuuuaccccucuauagacccuaaacaagugucuuuauuaguuccuagagucaaagauuacuaaauacaaaacacuugaaaauagcuuguaaggaacuaaaauaguuauuucagaugagugccagcuacaggaauucuggacuguuauaacucaugauauuaaaggauuucaauugauuacaaaaucuucuaaggaauaaaucagacaaucagaaauaagucauuugugcugcuuuuucauuuuagacuuagcguaauuucaaggaaacaaggcauguaaauccaucaaacagauccugaagaaaaggaggaagacauuucucaaagaauaaagcuaaauauucuaaucaaagccauucaauaaaaguauuuauuagaaaagguugaucacaguuauggaauagagggaaggaaccaaagcauaucuugguuauaucuuuuuuuuuuuuuuuuugagacagagucuugcucuguggcccaagcuggagugcaguggugcgaucucagcucacugaaaccucugccuccccgguucaagcgauucuccugccucagccuccugaguagcugggguuauaggugcgcaggccaccgugcucagcuaauuuuuguauuuuuaguagagacgggguuucaccauguugcccaggcuggucucgacuagugagcucaagcaauccacccaccucggccucccaaagugcugggauaacagguaugagccaccgcgcccggccuauauuaucuuuuaaauauaggacuuaguucuaaaauucucuaaggagggcuguuuaguaaaaaguuuucuauuuaaaaccuaaguccccaccgcaacagauugaaaagccuacuuguuagguaaaccauuacucauucagaauacauagugaggccgaggcaggugaaucaugaggucaggaguucgagaccagucuggccauggugaaaaacugucucuacuaaaaaaaaauacaaaaaauuaguugggcgugguggugggugccuguaaucccagcuacucgggaagcugaggcaggagaaucgcuugaacccgggaggaggagguugcagugagccgagauggccacugcacugcagccugggugacagugugagacugucucucaaugaaacaaacaaaaagaauacauagcuaggacuucagauuucugccaccagagggcaguauacccuaauucaggguguuuuggacgaauugugcccccugcugcccaaauucauguuugaagucccaagccccaguaccucagaauaugacuguaaauuaaauuaaacugaauuaaaaugacacuauuaggguggggcccuaacucaguaugacucauguccuuagaagaagaagaagagacaccaggagugcaagugcacagagggauggccaucugaagagccagcaagagggcagccauugguaagcagagaggccuuagaggaaaccaacccugcuggcaacugugaacaaauaaauuucuguuguuuaagcugcccaaucccuaguauuuuguuaugguggcccuagcaaacuaauacucaagguucagcucuuagggguaaugaaaaccuuuuaaaagcugaaucuaugaauaggaauauagauaaagcaaaaacauacagacagacauauauuguaggguagcagggaaaucauaaagcucaagagacagaccuggaucugauuaccagcuuaguuacauaacgcuggugugaucugguauuuaacuucucugacucuauuuccucauuuguaagaggcaauaauucccacacagcaaaagguguuggaaggauuaaaugaagaaaaaucauauggcagaggcaagugcacacacuauguucuuaaauguuggugagucugaacacuacaucuauccaccuggggaaaagcauuuaaugcaggagacccauucuuaaaugcaacauucaugagaaauuaauaaacuaugauucuaauuuacaaaccauuuacuugcaaauugauuggcauaaauuaauucaucaauucuugauaacccuaagcugagaaaaagaauccacaaacuggccaggcacaauggcucaugccuauaaacccagcauuuugggaggccaaggcagguggaucacgaggucaagagauggagaccauccuggccaacauggugaagucccauccuacuaaaaauacaaaaauuagcugggcaugguggagcacgccuguagucccagcuacucgagaggcugaggcaggagaauugcuugaacccgggaggcggaaguugcagucagccgagaucacgccacugcacuccagccuggugacagagugagacucugucuccaaaaaaaaaaaaaaaaaagaauccaagaaccaaguucugggaaagaugugaucauaccaagcccacagcccuuucucacauuacuauggaaugagucauuuguaguuucaaaaaagaaaagagaaaaauuagcucagggauaacucaagggcuaaaaguuuaacacccugacucacaacuuaccccuacuguuccaguuuuuaauuugaauuugcuuccuccuuucauggcaccaaauagaggcaauguaagcuuuuuagcuuuguuuucugcaccuguagucugaguuucaguccuaggaagaaagaauaauuauacacaucuauuccagggagucccaagguuuuaucuaaaaauaccaugauacugacaaagaaaccucuggcaaaauaaaaauuaccacaaaaugaauaucuaagcauauaacaauaagaaagagguauucagaccaacagauuuugaauggacaagaacaaugcugacugucacagacacagagcuaugaugaggcugcucccuuagucaaguaauuugccacaugcuacaugacuucacacccaugaaaugacuacaguacaaaggucacuggcaaaggagaacauauaagcagcaggagauugauccaugguguaaagcccuacuucccaccaaccucugaagagugucuuacuuaucuggagcucccacuuaagcgcaauagcucugagcacuuaaaaaaaaaagugugcauggggauggggguacaguaugcaggauacccaguguaguaaugacaaagauauagugagagacugcaacugcugagccugucaacauucucaacggcuggagauaguuagaaaagcuaagcccauuaggacaaagcugaggaaggguauaaagaagagauaguagaaauuagaaaggcagggggagaacagagcaaaaacaaaagggauagcaauucaguugacaagauacucagagcaggcagaggugacaaugagaauauggcaugaggagacagaggaaaccccagaauaagcauacuagacugaaaagaaagcccucuguuuucuucauauugaccaugggacagcccugaaaacuggaauauaaggacaguaauggcauucgacucacagugacccauaccagauguuagcuaccuggcccucccugaagccccacuugcuacuacugccuucuuuuaccuaagucuuauccccuuaguagcacucuuaaguccagccucaagccccuuucucccuaccagagauaaaacccauucccuugcuaaggccaccagaagaaugcugccugccuggccaugaaggacauuuugucaaaucauuauccuucacacccuuccccacaggccucaggaaggcucuggcauagaaagacagaagcaacagcaacacagauguuuucagcuacauuaaaaagccaggcuggccuagaggauaagcuaagacuggcucaaaggagaugaaaaagcagaagauggaaucacaaucaagauugcuugcagggguuaggguaggaggcagaaaguuuggaaguucaacccauaagugaaaagaggaggaagaagauacacaucuagaccaguauccaaaauaggaaagggaggaaaaaccaggcaagcacacagacugauagcaggagaggaggcucuggaggaagcugagacauauuucguuuucguuuuuuuuuuuuuuuaauucuucuugccccaaauguuguuguuguuguuguuguuguuguuguuguuuuccaaagcagagauuuguuuuuguuuuguuuuuguuuguuuguuuguuugagacagggucuugcaaccucacucucccagguucaagugauaccucagccucccaaguagcagggauuacagacaagcaccaccauacccagcuaaguuuuuaucuuuuguagagacagggucucacuauguugcccaggcuggucucaaacuccugaacucaagccauccucccaccucacucacucuccuaaaguucugggacuacaggugugagccaccguccccagccacuuuuauuaacaaauaguuuuacuguaacaaaauuauuauaugauucuuacuuuuuccaguuauuuguuauuuagaacuagaacugcaacuacauuacaguaaauuuggaccuaaagugguauggcuauuugguacaggauuuucuuuucaaauucaguauaucugaauagaauagaaaguauauucacauguucaaaacucaaguauaaagcacauauacugugaaaagucucccucccauugcugucccccagccacccaguugccuuccccauuggcaaucaauauuauuaauuuuuaacgaaucuuuccagagauacaguagcagaugcugucccucccagauucccuuuaucaggccaaacagcuacugcagacaucggcugcuaaaggcucacaccugcacccuucccagaauugcugugagccccucccaccccccagucaccggcagccuaugaccaaugaaggguuggggggacaggguaucgaaacccaagccccaugccuccauggcaucuguggugccauucaggcucuccugaaaccauaucuuagcccagcuucuucuccugcccucuccugcuucccucacucccauauagauuucuccugagagcacucucuuaauaaaucacuugcagaugaaucuccgauucagucuguuuuuagggaacccgaccuaaacagauauuauaaacauaaccauggccuacuuaucuauguauucuucccccaccaucauuuuuuacagacagcgccuguuauacacaccguucugcaccuugcuuuuguuacuuaucuugauaguguuucuguaucuuauauauaguugccuuuuuuuucaacagcuauaugguguucuauuguauaucuacaccauaauuuauuuauuuuuuugagauggagucucgcucugucgcccaggcuagagugcaguggcgcaaucucggcucacugccagcuccaccuuccugguucacgccauucuccugccucaggcucccaaguagcugggacuacaggcacccaccaccacaaccggcuaauuuuuuguauuuuuaguagagacaggguuucaccauguuagccaggauggucucgaucuccugaccucgugauccgcccagcucagccucccaaagugcugggauuacaggcguaagccgcagcaccuggccgcaauuuauuuaauccauccccuuugauaaacauuuaggggauuucuaauuuuuuacuacuauuaauacaaacaaugcuguacaucauuuccuaaguaugugagggacaaauuccuagaaaugaaauagaucaaagggcaugugcauuuguaaucaggauagagacugccaauuugucuuguagagaauguacuaauuuguccuucaaugacaauauaagaaagugccuuuuugucagccucaucagcacaguauaaaaucauaauuaaucuucaucaaauucauauauaaaaaugcuauuaagaccaggugugguggcucacaccuguaaucccagcacuuugggaggcugaggugggcagauaccuugaggccaggaguucaagaccagcuugggcaacauggcaagaccccaucucuacaaaaaauuaaaaauuagccagguaugguggagcaugcguguggucccagcuacuugggaggcugaggcaggaggaucacuugaucccaggaggucaaggcugcagugagcugucacugugccacugcacuccagccugggugacacagugagacccuaucucaaaaaaaaaaaaaaaagguauuagguuguaguauuuguauuucucuuaugaucaugaaguugagcaucuuuguauaaaagaugcuauuuguauuucuuuuccuguggccugugaguagacauccuuuacucauuuuucuccugggugguuggcugucuacuuaucauucagaggucuuuuuauuaauaauuuaauuuuuuuuuugagacaggaacuuccucugucacccaugcuggagugcaauggcacgaucacagcucacuguagccuggaacuccugggcucaagcgauccuccuaccucggcuucccaaguagcugggaccacaggugugcuccaacauggcuggcugauguuuuuauuuuuuguagagauaggguugugccauaucacccaggcuggucuugaaagugaucugccugcuucaaccucccaaaguucuaggauuacagguaugagccacuacgcccagccucagaggucuuuuuauauuagauaaauuagcuuuuugugcaugaugcuuuuuaaaggaguuuauucuacacuaaaagauuaaguaaaaaaaacuucggaaccuuccaaugaaucagaaaucaauauaguuuucucagaaaauccucuaucagucuauauuucacaaauaugaaacagguuuuuaguuacucuaugaaaccacugcuuucugugcuuuaaaggguuccuugcauuacauuuguauuauauaaugauuauuuaagaagauaaagcgauaauugaaaauguuaucuaugcuaccauacuuauuuagaauuccaaauauaacuaagacuuacuuuuuuaguucuggaaucucugcuggcuuuacaauuuuuauuaacccuuuaagucucuguuguucuuuccucaguucaaaaguucucaggugaaguuucuuccgggacacaccaucuaauguacugccugauuucauuucugacaugaacgcaucuaaagaauccugagauggagacucugauagaacuguccaagaaaagaauaacacauguuuagaaagaugauccugaauauuuuaaaauucagccaaaguuuccauauaaaagucacuaacauaaaaccggacagaggacaucacuaguaauaggaauaaggaacagguuauagccaugagaccuugggaagucauuuugucucaaugugcuucauuccccucaacaauuaaauaaagagguuaaaccaaaugauuuauaauguucuuucuaguucuaaaacgguauguugcuccuuuaaaaggcuccauauucuguaugguauuucuuauuaacuaauguagccccagugccuagcauagagcacuauaugugguauauuaauaaauauuugaugaaaaacuuaccuuggcuugaggcuuucaaucucucagaaauuucagaaaguucccuuucagcaucauuuaauuuugcaaccuguaacacccaaaucaacaggguuacaaaguuuuucuucuuucaaacuguuuuucauccuccuguuuuaauuauucuuacuagaaguuuuaagaagauuaauucaaaaguccaguuaaacugcuacuuauggaguuaacacuuuuuuuuuuguuuugagauagagccucauucuguugccaggguagagugcaguggugcaaucucggcucucugccaccuccgacucccggguucaagcgauucuccugccucagccucccaaguagcugggacuacaggugugcaccaccacacccagcuacuuuuuguauuuuuaguagagacaggguuucaccauguuggccaggauggucucaaucuccugaccucaugaucagccugccucagccucucaaagugcuaggauuacaggugugagccaccacaccuggccagaguuaauaguuuuuuuuuuuuuuuuuugagauggagucucgcacugucacccaggcugcagugcaauggcgugaucucgacucacugcaaccucugcuuccugcauucaagcaauucuccugucucagccuccagaguagcuaggacuacaggcacacaccaccacgccugucuaauuuuuguauuuuuuuuuuuuuaguagaggugggguuucaccacauuggucaggugggucucgaacuccugaccucaggugauccaccggccucagccucccaaugugcugggauuacaggcaugagccaccaugcccagccaggaguuaacacuuuuuauguguuaaauccaaauuuaauuuauuucugaauuaaaaaacacagaauuaaacagaaugaauaacucggacuucauuuuacucagaagaaagagcucaaggcauuuguuuucacauaaaucaaaaggauagauguuggguaauguuuuaagcucugaauccuacuauaaauuaauaccuguaacaaauuccuugaagugcaauugcugaaucaaugcauuuuuaauacugacagaugucguaggauugaucacuuaaaagguuguauuguacauucccaccaauugagagucuacuucuccauauucuggucaagcucugcauuauuaaucuuauguuuuuuucuagucuaauagguagccuauuaccugccuauuauugucuguuaccuacccauuaacacgucaccuugugauaauuuccugaagaacauacuguuucagacuacauauuaccauacuacauucuucaaaauuccuuugacuucucuugacugccagaaggcuaaagucaauuucaccucagaacgcccuaacuuggaacuuuuuccuuuccuuuugagagagguaauaucauauccaaagaauguuaauuaauggaucaauauccugaaggaaaggaucuagcagcaagccauauuuuuuucaaacaacuuggauaagacuaguugucuguuaccauuaaauuaacagaccacaaaaguuauacuucaguaucagauuucaaugcuacuacuuuaaaaauuaucauaaaacauauuuaaauaauacauuauguuauuaaaaauuaaacuauuaaauaccacagcuacuuccauaaauaaaacuugccaaugauucaaaggucucuggcuucucaucaaucuugccagccuucuucauucuguucagacgcuucuucucaaucaggccaguccuaucaagaaaugugucaucaucacuaucauaaaagucuucaucuucccaguucuuggcuuuccuuuuccgagauacuagagguagauaaaaugaugaauaaauaaguuuuuaaaaaagaaaagaaaaagaaagaaggcaaguaggcaaggagcuuaaaaugucaccaucaacuacugaaagagagguucuacaagcugccaaacuacguauaaaaacaaagggcuaaaccuugaagacauuauacuaagugaaauaagccauauauaaaaggacacuuacugcaucaugugagauaccuaaaguagucaaauucauagagacagaaaaguagaauggugguugccagaggcugggaaggagggagaaugaaguuaguguuuaacagauaccaauuucaguauggaaugauaaaaaaguuccaaaaugaacaguguugaugguuccauaauauugugaauguacuuaaugccacugagugauacucuuaaaaugcuuaaaaugguacacuuuucuguuauguauauuuucccacaauuucuuauuaaauaauuuuucauuaaagcaaauaguuaauuuauuuaaugagcaaacggcuuuuaaaaaucaaugaggauggccaggcaugguaaucccagcacuuugggaggcugaagggggauggaucgccugaggucaagaccagccucaccaacauggugaaaccccgucucuacuaaaaauacaaaaauuagaugggcauaguggcgggugccuguaaucccagcuacucaggaggcuaaggcaggagaauugcuugaaccugggagauagagguugcagugagccgagaaagcgccacugcacuccagccugggugacaagagugaaacucuaucucaaaaaaaaaaaaaaaucaaugaggaaaaaaggaaaaugaaaaaugagaaaaaggacaauaacccaaaagaaaauuugaaaaaggauaaugaaagcaguucacagaaaaauacaauaaauauuuuuaaauauguuacuuuaaaaaaaaauaaaguacaaauuuaaaaauuagauacuucucaucuauuagacuagaaaaacauaaaaagauuaauaauuggugggaauguacauugauacaaccuuuuugauggucaagccuacaauaucugccauuaaaaaugcauugauccagcaauuccacuucuaggaauuuauucuauaaauaucaaugcaauaguauuuauaacagugaauauguaaagaguccaucaauaagaaacuaugacagcuauuacuuuuuuguucacccuacaacauucuacucccuuuguucugauaaaaguaccucuuuccccuagaaaauuccucccccauuuuaucugguuuagggauagucauaggaccaaagccaaaucaguaagacucuuucccucauauuuauauuuagagauggggcaaagaggcucucuuuacaaugagguuauuaaagugagagacuguuaaguucagggcuguaagcaaucagcuuuucagcacaggguaagaaucugucugcaaaguuuaaaaaugcacucgugagacagacucacucacagacacacacacacacacacacacacacacacacacacacacaacuuguauauguccuggugaugcugagucuacuuugguaguacuaaguuaugguuucagaacuugagguucugguucaugcaguuguuccuucacuccuguuccuucauccugagcuauucuucccagcuucugcagccaaugaccuuuccccuaagcuaguuugaauuggacuucuauuauuugcaaggaaaauaguccuuauuaauauaagccuaauuugcagguuaagaugguacauuaaacacacauaucuaauuucccucuuucccuaaaucccaauaaaccauaguaaagagauguacccacgccugggcaacauagcaagaccuugccuuuacuaaaaauaaaucuaaaaaaaguagcugggcaugguggugugcaccuguagucccagcuacuuaggaggcugaggcgggaggaucgcuugagccccggaaguugaugcugcagugagcugugaucagaccacugcacuccaaucugggcagcauagaggaaagagaaggaaggaagggaggaaggaaagaaggaaggaaggaaggaagggagggagggagggagggagggagggagggagggagggagggaaaguaagggaaaggaaaggaaaaaagagaagggagggaaaggaggaaaagaaaaagaaagaaagaaagaaaagaaagagagagagagagagagagagaaagaaauucauaaagacccaaauuuuagaaaauuagaaaguagacagaugaguagaaacuaacuuagcagaauuuaaaaagauaaauccuaaacaguggggaaagcugagagccaaagugauuacacugcagaauccucaaacggaucugcaacuggggauggauacuaagguuauggaggacuaaguaaaaacugguugagaaauagaucuuccucccugccuacucaucuccuuuccaucugcaguagaaauccagagguuaaucucuggaaaggguaaaacagaaagccuuuggauuacgaguugacuaguaaaguugaaggcaugggcacuauaaucuaaaaauaguacuguccugaaaacagcugaaugagaagccacucagccaccuucuaccacuuagcucuaggaaugcuggcagccaguccuuucguuucaggcaggagauuggaagagcacucucuggggaaucucgcucacagacgaggaaaaccaaaaggauacuuaaaucaaggguuccccaacaaaaggcccacccacaucauucaauaguacugcucaaagucaacaaaccccaccuauauauuccaugcagaaaccccaccuauauauuccaaacugucaaucaccuuuuucauccccaaauaaaaaaacuacaaugaagaauuacaugacaccuaagaaaagccuuuaacaugcagaacagagaccacauaaaaagaaaaauaacauggagaaaacagagaggagauauuuacaacccaugaaacaagaggauauuauguuuuaaaaaggacaauucaaaaaccaaaaaugaacuuuuagaaauuaaaaccuuggagucucugagccuucucuggcaugaaagacugccugauuuuaaaaacuuuaaaaaaagagaaagaaauuaaaaccuugauggcaaaauagagaagacagaaagauaaaggugcagaaaucucucaagaaggaaaagacauacagaugaaaaaaagaagaaaaaaaacuuaaauggucuguccaagagguccaaugucugaauaauaaaauuccauagaaaacagagggacgaaacaauuaaugacauaauugcagaaaacuuccugaacagccaagguuucuagaucaaaaggauccaacaaguacccagaaaaaugaagaaaaauagacccacagaaaaguacuucauaguuuuagaaccuuuagaacaaagggaaacucuuacaagcucuggcaaggcggaaaaaaaagaugacauacaauaggaucaaaaucugaacaguuuaggauuucucaaaagcaacacugaauguaaaauaagaaaaauuguuuccaacuuagaauuguauucccagccaaacuauuaaucaggagugaagcuacaauaauuauauuuucagaagagaaggauuaauaaaauuuauuuccuauacacucuuucucugaaaucuacuagaggauguccaccaaaacaagagaguagaccaagaaaaggaaagaugugaaauucauugaagacuaucaucacccaugcccucuaguguuguaccagcuuuuuaaucugcuaaaaguacagaaggauguacuacugugcaaggaaauaaaccaagaaauaugagaauaugagaaucaagaaacagaaaagucaacccuggagaaaggacaaagaaaucuuaaggaugauaggaaaguuaagucccaggugacaguucuguagcagaucugcagagcaauaagcccugaaagaaaaauagugcucuucagaaaaagugucuccaaaacaaaucagaacugauaaauuacuuaaucauuaaguuguuugauguggugaggcuacugaaaggugugggaggaaugagcaagaaauacaaaaaagccccaaacacaugaaaagcaaacgcaauuauuacccuuaggaaaaacaaaaagaaauaaaacugcucaguuauaacuaauauuugcauaagcauaaucacguaaauacuaaauacuaauuuagcagagucgacagguaacgucuaaaauaagugacuaaaaauauaacaccauacucuuguucuuagaaauacagguguuuuuaggcugggcgcaguggcucacgccuguaaucccagcacuuugggaggccaaggcaggcggaucaugaggucaggaguucgacaccagccuggccaauaugguaaaacccugucucuacuaaaaauacaaaaauuagcuggguguggagcacgcaccuauagucccagcuacucaggaggcugaggcagaagaaucacuugaacccgagaagcagagguugcagugagccaagaucaugccacugcacuccagucugggugacagagugagacuccaucucaaaaaaaaaaaaaaaaaaagaaaagaaaagaaauacagguguuuguuguuuuuuuuuaaauuuaauuaauuauuuauuuuugagacggagucuugcucugucacccaggcugcagugcaguggcgcgaucucggcucaaugaaaacucugccuccuggguucacgccauucuccugccucagccucccaaguggccgggacuacaggcaccugccaccacacccaacugauuuuuuuuuuuguauuuuugguagagacgggguuucaccguguuagccaggauggucucgaucuccugaccucgugauccgccugccuuggccucccaaagugcugggauuacaggcgugagcaaccgcgcccggccaagaaauacagguguuuuuaaaugccagaauaaauaacugaaaaaacugaaagccuuuagggaagaagacugaggauggguagggcaaggaacaaguauauuuuauuauaagccuuuugguaguuuugaaccagacauaaguuacuuugcaauaauaaaaauauaauauaagccuuauuaauaaaugaugcucuacucagacuuuaaaaaaaaaaaagcaaaauacacaauuaauguauugauacauauuaauguauugauguaauauucgugauacggccaggcgcaguggcucaugccuguaaucccagcacuuugggaggccaaggcggguggaucaccugaggucaggaguucgagaccagccuggucaacacggugaaaccucgucucuaucaaaaauacaaaaauuggccaggugcgguggcucaugccuguaaucccagcacuuugggaggccgaggcagguggaucaccugagguugggaguucgagaccagccuaaccaacauggagaaaccccgucucuacuaaaaauacaaaaugagccaggcaugguggugcaugccuguaaucccagcuacuugggaggcugaggcaggagaaucgcuugaacccgggaggcagagguugcagugaggugagauugcgccauugcacucuagccugggcaacaagagugaaacuccaucucaaaauaaauaaauaaauacaaaaauuaguugugcaggguggugcaaccuauagacccagcuacuagggaagcugaggcaggaggauggcuugaaccugggagacggaaguugcagugagccgagaucaugcugcugcacuccagccugggugacagagugagacuccaucucaaaaauaauaauaauaacaacauccaugauacauucuuauguuaaaaaaguaagucacaaaagauuguaauuaauaugacuacauuuguguaugaguguuuuuuguuaaaggaucuaggucucagcacacaucuauauaugcauagaaaaugucugggagaauauaaacaguggcuaccuuaggguauugagaauuuuucucuuuucacuucaaaaaauuuuguacaauuuacauuuuccccccauaaagaaguuuuauuagcguuuguguugaguuuuccuuuuuuuaaaucuagaaaaaaagggcuccuauauacugaccugcuuccugccgaagcaaucccaaagugucaagaauccgacaagcuuccaaugagcacuggaucauugcuucuuuuuucuuuccugagugaauggccucagccaccaguuguuuuccaguugaaucguccacagguaaucuucauugauuuggugggaauuauagcacagcauuaagcuccaauucucaagaaaacaacuacuaugcuaugauaauagucauuuuuuuuuuagauggccuuucagucuuugaauccaucuuguucuaucuuuccaauguuggauuuaaaauauuuucuuucuauuucuuacccaucccaccccacucuccaauaauauaaggguuacuaaacgauaaaggcucaaauuuagaaauagcuuaaacuuagaugaaaguuacucuuuggguuguuaucuauaaccauacauuaaaccugaaauuggccauuuuccagaaaagaacauuaauaagaaaagagcauaccucacccugcagagccaagugcuaugucccuguucaucaaauucauauucuaauucuucuccugugggagaaagacagacaaaacaauuuuaauagaauccaaaaauuacuaguugauacaaugauaaaugagaacaaacguuaaauacgaacaaguuccuagcaguggcucacgccuguaauccuaacacuuugggaggcugaggcgggaugacagcuugaguuaaggagcgcgaaaccagucugugcaacauggcaaaaccccaucuguacaaaaaauacagaaauuagccgggcaugaugguacgugacuuuugucccagcuacuacgggggcuaaggccggagcauagcuuaaacccaggaggucaagguugcagugagccaagauugcgccauugcacuccggccugggcgacagagugagacccugucucaaaaaaagaacaaguucuggcugggcgcgguggcucacgcuuguaaucccagcacuuuggauggccgagaugggaggaucacgaggucaggagaucgagaccauucuggcuaacacagugaaaccccgucucuacuaaaaauacaaaaaaaauuagccgggcgugguggcgggcgccuguagucccagcuacucgggaggcugacgcaggagaauggcgugaauccggaaggcggagcuugcagugaggcgagaucgcaccacugcacuccagccugggcaacagagcgagacuccgucucaaaaaaaaaaaaagaacaaguucccauaccacacugaauaauaaauuucaaugcauuucacuucucauuccuagggauuauugucugauaauaaaauuagaguaagucugaggcagagaaaaaaacaaacucagaucaaaguaaccaauucuccauacauagcucuguucacuguauaguauguuucacuuuuauaaguuguagacuuuagugguuauuuuaacacaguugccugguuuuuagaagcacagauauuaagugcacagcuauuucauauauuauuuauauauacauauaaaauauauacagauauacauacauauacauagauauucucucaaaguauuccuaccaaaacaauccucuauggaaaaaaaauuuuaaaucauauaauauaaaaucaaaaccuauguuaggaauuacaaaagaucaggugaauucggaauuaaaaaacuacaggaaguuggcucaauuuccccaccaccaaaguccaggaucuuuugagaagaaugagaugagucaggaaaaaguacuuccuuuuuuuaagauaagaagaaagacuaacaagauuuuuaugauuuuuuuccccucugccauacuaaugaggaauaauuuucaaaauaaaccuaaagcaacugaccacaagaguaaaaagugaacaagaaggacagcaauaaaauuauagcauaucuuaguauaaagcucaacaugaagcucuagaaaaccacacugcucuggauauguuuuagugguagggucagaaucuguuuacauaccuucucggucaaaaaagccuuggagagccuuuuugggauccuuuauauaaaaggccucccuuuccugcugaaacucuaagacaauaggguucucuucagcaucauccucuacugcaucuucuccuacaggauauggaaaagaaagaaaagauaaucagacaugagaagagacuauuugaaugauacccacuauucucucaggcugcauaaagauauaguuuaggcugggcgcaguggcucaugccuguaaucccagcacuuugggaggccaaggcagguggaucacaaggucaggaguucaagaccagcuuggccaacauggugaaaccccaucucuacuaaaaauacaaaaaaaauuagcugggcacaguggcgggugucuguaaucccagcuacuugggaggcugaggcaggagaauugcuugaaccugggaggaagaaguuguagugagccaagaucgcgcuaccugcacuccaacccaagcaacacagugagaccgucucccaaaaaaaaaaaaauauauauauauauauaguuuaucugugaugaaaaauaauaaauacuugcagggacaggggguggaacaaccaccacaaaaccacuaguaugagcauauucagguuuucuaaauugugugacaagucaaaacuuguuuucauggcaccuuaauuuuuuuuucuccaucauuauauuuuaaaaguaaaauuaccuaccacauuguggaaaaaaaauuugagcuccucagccuggcauucuuguucucucacacucauaucuaacuuucguucccaauauaauuuccuaauacuucuuauaucugccaaauagacuggucuacucacaacuuccuuaaaaucaucaauuccuacccugaauaccaaucccaauacucagcuucauaaggcuuuuccuuuccuucaaguuccagcucaaaauccuuaugcucauaaagcuucccuguggagugcgaucgcucacgccuguaaucucuacacuuugggaggccggggggcgggguggggggggggggugggggguggaucacaaggucaggaguucaagaccagccuggccaauauggugaaaccccaucucuacuaaaauaaaaaaaauuaaguuucccaaagaucuaagucagugcuguccaacagaaauauaaugacagcuguaugcgucaucuuaaauuuucuauuagccacauuaaaaaauuaaaaggaaacagguaaaauuauugucauuucaacaugucaucaauauaaaaauaucaugaaagagauauuuuacauucuuuuuuucagacuaagucuuugaaauucaguguguauuuugcauuuacagcacacaucaauugcaacuagccacacugcaagugcucaguaaccacauguggcuaguggcuaccauaucagacaacacaggucuaaguccccagugacuguucucucuucuccaaacuuucacucuagcauacuuaugguuucuagcuuuuguuuggcacuuagcacaaguaauuucauaauuuuuccuaucuucccaacuauauauuaaugccaucuucuaccuuuuuauacucccaucuccugaauauccauuuucuaaaauaucugguguuaaagaaaguuuauuauuuuggcuaagggaccagcuuuaucugauuagauauuccacauuucaggauaucuucacaaaguacaaaaaauucaagagaauauccuauauugaauaacaucccauuuauuugauugaauagaguuccauccccuccaaugauaaucacauagcacaaggucaguacuuaauaaauauaaaauuuuagaauuguaaaaauaauaauuuuaugcuuaggacaaguuuugaacaagagagugcauuaaaaauaaauuuuuaaaaaauccaaagugccuauaagucaauuucuuuacaacaguaaagucagugaaucucucuggguuuugguuaccucaugugcaaauuguguuugcccuaucuaucucaaggagccaugaaaagcuguaugauuuaaaaaaacauuuaaggguaccacuuguaaugaacuuaaaauauuaaccuccggcagcaauuuuaauuucuuacccauuccccaggugcaacccaucucaucaucuuggcuaccagcauuuaucuuccuuucagagguauccauuuccucuucuucaucugagucuucuccuagcaucuucuucuccaacaauauuugcugcugcuugcgcaauuccuucaacuguguuacuguuaacucggauucugccucucggucuuccucuggucccugaugaaccaaggaaaaaaagguuauuuauuuauuuagagacagggucuugcucugucgccuaggcuggacuggagugcaguggcuguaauacaccucacugcagccuugaccuccugggcucaggugauccucccaccucagccuccugagcagcugggaccaugaugccuggcuaauuuuuuuuuuuuuuuuuaagagacagggucuugccauguugcccagccuccucucaaacuccugggcuaaagcgauccucccgccugggccucccaaaguguugggauuacaggcgcgagccaccgcgccuggccaaacaaguuauuuuagaguucgggauugugaacaugacuuucagaaauauagcaauguguacagccgucugaagaugauaggccagacuugauuccuucacuuucguaaucgcugagugggagauucuucuuccucauccaaagcuuaagaagcacaagaacgcaguccaaugaacccgaaauuucaauucuagguuuuucuaccuaccugcaggauaaagagccgggugcugccuccaaagcgaacaacaugcccaacguggacucgacaguaggugcgaggugggaugcgaguuuuguugagaaaagugccaugggugcuucccagaucguagagguagaagcccggcccguugcugucgcauucuccgucagggccggacgcccugugcugcagcacugcgugguaccgagacaccgaagggugcuccaggcacacgucgcagccagacagccucccgaaaaggcaguaacucgucccuuucaagcuacgggugccaaggauagugccgcccuucagggucucuaagcuguagggggcuguggcagggccaccccauggaggcucuugguaggggggagcccgggcuggaccgccaggggaagaaaccgcugucggggggcgcgacugcuccuccuguagacuccuaaaaucaccgcaguccggcugaggaggagggaugucgggcuccccagaauuggaguccugcaacgcagugggcccuuccuucuguaccuccucaggguuugaagaacugcuggccggggccuuacuccgcgccgcuggggacaccggcagagcuggcuucuugaaguccccacugaggucuugcgacgccagggucucugacugagagagaaugucagccauccucaaccggugcaacuucgaaauccgcuccuucgaaacccacccuucggucuuuacguuccuguccacgucccacucucccaagcucccaguggcgucuguaggcggcgauggugaaguugcuccuucacgaccuggagcguugcgaaguggugcuaacaugagaaggucauaauaugagaaaaacaaaacgguuaucgggaugcugugcagaacggggacauauuuagagguuacaacgggaucguaaugacuuccuguugcauagcuugauugagaagaagcgcuuccggcggucuuagaucacuaaucaacaaaccagcuuucggggucugacgcgauccuugccucaggccucucgagguccagacagccgcccagcccgcucugcgacgcagcagugaauagugugguaccuccuugucucgguucagguccagaccu

SEQ ID NO: 192991 - RNA, 11324 nt, Homo sapiens
uaugguacaaaaauaguuuauuacaaaagaaauccaaccaaaaugcuuaauaauuuacaucgugauccgugcccguuacggcccaccucuccccuccucaguuaucugguagagaguggaggggaguggcuguucccuggguccaccagcucugggaggggacauggaaauggaagauguggguggcauuccggacagggacuggugccugagaaugcuggggucagaguccugggagggagcgagaugggggaacaucugugcucagaagaggggguguauggguaggugcaugugcuucugugcaaauccuggucccgaagauggggggggggggcagagugagaucuucacaguuuccagaaggguugaccccacagggcaggggggccccuccucaugaguccaagaucugcccccccaucccccucagcugccuccuggagcuggggaggggggcaccggccggccagggccucggaggaccccagcaaagggcaggaaggcggguggagauggggaaggaaggaagaaauugggaggagccauggggaauccaggggggucccuggggggagacugggagggugaggaggauggugaugcggagagaagaccugaggaaggaagagagacagagggguggguggugagaggcuagacccagagagcaggggcuggggccugagaucugggucugagggaggaggggcugggggucuggacucgggucugagggaggaggggcuggggauuuaaacucccgggucugaggaaagaggcaucuggggaccuagacuccugggucugaaggaagaggggccgggggucagaaggaggaggggcugggggugugagggaggaggggcugaggucugagggaggagggucuggaaaucuggacuccugggucugagggaggaggggcugagguuugagauaagaggggcuggggguaugagggaggaggggcugaggucugagggaggaggggcuggggggucugaaggaggaggggcuggggucugagggaggaggggccaggggucugagggaggaggggcuauggguugggauuccugggucagagggaggaggcuaggggccuggacuccuggaucugagggaggaggggcuguggguugggauuccugggucugagggaggaggcgccagggcuggagguugggaacgguuucucaccauuggagcugaggcggcugcugcucucgggggagguguuggcgcuccggucaggggaggggucuggcugggagguggaagcaggccggguggccuucccccucaggaugucgaugaccuguaggaagaugggcgugaccauagagccacccaugccucacaguccucucucccaucccuccuagcucacuggauccaggugguggccucuccacuucucaguaugaaaagaugggcaaggcacuuuuuuucuuggugccagucucuccucauuucuggaacucacacccgcgcuuucagaggcucacccacuccccuccacgcaacggcacagacacccucacuccucugcgcucuggcacacucgccugcaaccagcccgcggacacacgugugcaaggggcauguccacagcugccccggcucacccugcggcugcgcgccaccaugagcggcgugucguuguggcaguucuugaggcugcugucagcgccgcugcggaccagcgugcgcaccagcgggaggagcccgcggccggacgcugagugcagggcggagcugccggaguacauuugcgcguucacguuggcgccgugcugcgggacgggagggccgggucaggagggcgcgcgggccacccgggguaagggaacagaggcuggaggcccggguggguggccggcacguggggcggcaccggaucgggguggggucacaggaagguaggagcgagagccaagggcaggccaagcgggacugcguuggcggcgaugaauuaaccggagcuggacaccgaggcccgcgccccaaggagucgggggagcuggaggggggaaggacaaugcguggacagggccuagcuggaaggcggggucagccaggccaucgcagggcggggccuaggccguugagguggcagaggaggaaugggacaaguucguagccaggggcguggagcccgagggucgagaaaacuaggccuuaaaggaucagagcuggacgcggagcaggagccggagccagaaguggaaggcggggucagagcuaggggcugaggccagagccggguuggggucagaggauagggugggcgcgaggcucaggggggcuguacgcaccugcagcagcagcugcaccaugcuaaggcuguuguuuuccacggcguggaugagcggggagcggccgcucuuaauguccugcggcggggagggaaggucuuaguuucuccaagcucugcuccagcagccggcgacccgcaucccguccacaucccauucgcgggguccagccucucucuugggucugauacuccaagccccaccccacccgggugcucucccacgccagccccacacuggccccgcccccgccaagaccccgccccugcuaaggccccgcucccucccagcuccuagugcacgcucaccacugcgucgaugucggcaccgcgcucuagcaagagcugcacgguuucuuggcacucgguguucacugccacgugcagggcggugagcccugagggagaggagggcucggugaaaccuaggcccgggcuuugcggccgcugauggacuccagguccgcuggacagcccagcggugccccgcgguaaaugcuuaccgucauaauugcgggccuccagguccaacgugcccggagcugcgcuguccagcagggcucgcaggcaggucgggcugcggugcucgcacgccaggugagcggccgucuggccauggcgguccagcgccauggggcuggcaccagcugucaccaggagccggaccacagacgguaauguggugaucacagccagguggagcggugucuggggaacagugacugugagggaccuguguccagcccugcucucuaguccugccucccccagguuuucugaacccuuauuccucauccugcagucuuccccaggaacagaaaccugagacaccuccugucucagauucaagaguccgggccccaugcuccuccuuccccaggacccagaagacugggccuccaaccuccucuuucccuaguaccugaauucuggguccccagcccccucccuccucacuaggaggucuuuaggcccccucccucucaggaacaaccaguccgaggccccagagcccuucuuccccaggaaccaggagccuggagcaccucgcuacuuagaguccagaccccagcccuccucccucagacccaggaguccagacccccagcccuccucccucagacccaggaguccagauccccagcccuccucccucagacucaggagcccaggacccagcccuccuccaucagaccccggaucccaggcccgcagcccuccuccaucagacccaggaguccaggcaccagucccuccucccucagacccagggguccaggccccagccccccucccucagacccaggaguucaggcccccagccccuccucugucagacccaggaguccaggccccagcccuccucccucagaccgagccucaccugccguagguuguuguagaugucgagcucccggccccccugcuggaagagguugaccagccggugcacagcuggcagguuacccugcaccacagcaauauggagaggccugggggugggggagugaaggaaucacaggcauuagggguuguucaccucucacccucaugcuguuggcaaugcuaacuccaauguguugaauacuuuggaaauguccccaguauucaaacacuucuccccacccacucccuccauccugauuuaccacccgcucccuccauccugcuuuagccaccacuggcucccugcuggucuaguacaguuccauccucauggcuucucugcuuccaccuaugcucuacugucugucccccacacaacagccagagggacccuuuuauuuuauuuuauuuuauuuguuugagacggaguguuguucuaucgcccaggcuggagugcaguggugcuaucuugugcucacugcaaucucugccucccagguucaagcgaucauccaaccucagccuccugaguagcugggauuacagaugugugccaucgcgcccagcuaacuuuuguauuuuuaguagagacaugguuucaccauguuggccaggcuggucucuaacugcuggguucaagugauccuccugccucagccucagccucccaaagugcugggauuacaggcgugagccaccacgcccagucuggaacaaaaguuuugacuaaaagggaggugaggacaaacugggauggggccauuguucuggaggcgguacaguccagaacccccuucuagacugaaggacucacucccucagcuucugggaagauugucagcuuucagaccauuugggaauuacccucaacucaagagagcugcuuguccaaggucacgccccaugugaaucaagggcagcugcccuucaauggcauccagucacugguuaaugccagcauagaaggccuagccuccugaccccaaugcugaaggccauuccagcuucaauauucccugugggacagcugaggccguguggaggcgacacagcagcucaacuucucccucugcccagaugggcuuccuucaucccacagguguugauggagagcauuuccaauaaacuuccugcucaguuuccagagaccccaaccuagaacagcuauucagagacuggugugugugcaugcgugcgugcuugugcacgccugugcuguuugcauggggugggggacagaguggaggacccaaggaggacugcguguacacaguggguggcaggaucuuuauuuaaaguuuacuaaguaauuccuuucucaccagcacccguuucucuuguggaaugugucucuagaauccaguuuaaacuagccucccaggugguucugauggagugcagaaaucccggggccagaguugcaaauugggccacaaccccuccuagcguagccgcgugcuagggcaaagccaugggggccuuucggagccucaguuuucucuuauguaaaguacagcguccacaugccagggugagaucacgcaggugaaucgcugaaccugacuccuaauccgugaaagccaaauuuaaaaauaaaauguugagggaggggccggggucccugggaaggguccccccuucucugcaucucccaggacgccuggccugggucccucucggggcggccaggguuaagugagggcagacgcagcgaaugauuucagagaaaccguccaggccugaguucccauaaacgcgcgggccgcaggggguggggcggggcuggaggaaguggggacgggaggggcgacccagcccucggacuuccaguaacaggucugcugggcggggcucugcuuccugcucccgggggagggaagccugucccgccggggaucuacccuggccaccccuggcaccccaacuuccauccucgaauggggcgggggaagggagugcccagcccaagaagaccuagcucccuugagguguguguguguagggggggcgcauaaucccgaguccucccgccugggggacccucuggaacuccaccccgcagagcucaggcuccagcuggcugcaaguccuccuuaucccggcauccacccccaacaucucuugggagccagaaauagcccuaacucuucuuuaagaauaaggacuucccccguccuucagagcuccaggaucccaaacuaccuugccaguccuuguccccucagagacccagaaauacagcgccucaaacccuggcccuuugggaacacagacuuucaggccccuuggcgugaccaguuucaccagcccaacguccugcugccgcugucgugaaauucuuaaguuuugaacaagggacucugcaaauuucuguaucugguccugcccguaaagccccucugagugccagguccccaagcugccaagcugcuccucauccccucggagauuaaggaauacaguuccccaacuucugccuucugagaaucagaacaucaccccccccccccgcccccgccuuccugcccccuccccagguuucuggcugcccagucccuaaccucuuggggguccaaaugccccaaggcucguacccgccugugaggagauggaagcccagccucccaaccuuuuggcuucugcggggacccagacuuagcgucccccgcccuccucgcccccacugcccucccccgcgggugugaagaggagccgguggcgcaggcuggggccgggccgcugcccguuccgguaaagucucagccccagcggaagggguuaagguuggaggaagcgccaggaggggggaggcugcgagugagugacgggugcugacgugggggaggcagagcagcuggguugcggucaaguucugcgggaagggauuucccccagcaggcagcugaggcagaaguguuugccuugggggagagucggagagggaggguguggggagggccuggggcuggagacuggugggccggguggccucuggcaagcacccugcuuuucaacagcauggacagcucaccacugggggcagagacugucugauuaagcccauuucauagaugaccccccagagguacccagaaggggagggaacuagguuuuauuagcucuuuauaaucuaggccacuuucuccugcuagggcucuggagauggccugcaaccacccugggagcucugcucaaacauuacccauuuccaugcauugagcacuuacuguuugcccagcccuguucugugcacuguauuaauacauguguacaagaucucacugaauccuaauugugauaggugcuauuaugagacccaguuuccaaauagggaaacugagacucagggacaugaaaucacucagugggccaguggcggagcagcccucugcuacuucucugcagaaacaggccuguucaucucuaccugugguuuccaggccccaaacuaauucucacagaagugcuuuguauaaaucaugucauuucuuccucccagagacccucacacgcgaugguuccuguuuuuacagagagggaaacugaggcacagagggaguagaacguggccacgcugagauuccaacccaggucaauagaauaauaagaaucaugaugaucaauugcagugagugcuuacuaugugcuaggcacagaccaaacccucccgugcaggacuucucagcagccucacaaacauguucuucagacugcaggugauaaaccauggggguugugaaaucaauuuaggggaucuucaaauuaauguagugggcugugaccaugaaacaaugaagucgacuagaauagaaaauggcaaaguaaagcuguaagcugggcucgguggcucacaucuguaaucucagcacuuugggaggcugaggugggaggaucacuuaagcccaggaguuugagaccagucugggcaacauagcaagacugcuguguuucuacaaaaaaaaaauacaaaaauuagccagguguggggguagcgucuguggucccagcuacucaggaggcugaggugggaggaucauuugagcccaagagaucaaggcugcagugagcuaugauugcaccacugcacuccagccugggugacagaucgagacccugucucagaaaaaaaaaaaagaaaaagaaaaaaagaaaaaaagaaaaugucacaguagaacccacauaguaagggcgaguauuguuucauuuugugcaauuuuaauuucaaguuugugugugugugugugugugugugugugugugcuggguuugagauaaaauaauaguaauauuaacaaacacuuacucaacauuuaugccagguccagugauaguuuuacauguauaauucauauaguaaguuaaucaaugaacugucuuucuuguuuuuagguugugacaaaauaucuaaagaccaccguuccaaaaauaguguucuaggggugggcuuggggcucaugccuguaaucccagcacuuugggaggccaaggcgaguggaucacuugaggucaggaguuugagaccaaccuggccaacauggugaaacccugucucuaccaaaaaauacaaaaauuagccaggcuuggcagugggcaccuguagucucagcuacucgggaggcuguggcaugagacucacuugaacuuggggggcagagguugcagugagcugagaucgugccacugcacuccagccugggcgacagagugagacccugucucaaaaaaacaaaaacaaaaaccaaacaaaaauaguggccuaggagguaaaugcucucaaggugcccauucuucagaggaggaaacugaggcucagagcagggaagggccuuacucaaggucacacagccugugguggagaccgaguucugacucagguccacugggagcugaguggcccuguguuauggacggcuggucuucccaaccaccccuccccuuaauaggggacugucacucacgugucuccguccucaucugcacggguggccauggcgaugucagcagaaaggggguguuccauggggcacaucaugggguauagggguguaggcagguucaccagaggaaacggggagcccauggcccgagugggguacaaaggcaguaaggcuccuggacaauggaggacagagaagggacaugggugaggccacacccacagacccucaacccgccccccacuucuaaaacuuugcuccuguggugucaccugcccuuucuccugggucccuuuugcaucccauacaggguccucagggccuaaaacaaacccccuuccacgucccuccucugggcucuggcagcuuccucucccucuagggcuggucacccucauugucacuuaucuucugaccucaaucuccaaucagacaaagggucccuuaagaacagagggugcacccaucaucaccuagcaggggaccccagggacugucugcagagugauuuuguggcugaugaauugcugggugcagggugugggauaaauguagaguggguuuggggagaguggaggcagagaggagguguuaccagaagccuguucaaauuguuuuugagauguagucucgcucuguugcccagacuggagugcaguggcacgaucuugccccacugcaaccucugccucccagguucaagcgauucuccugccucaaccucccagguagcugggauuacagaugcugaccaccacgcauggguaauuuuagaucaaacuguuuaaaaaggggccacggcaggccgggcgcuguggcucaugccucuaauaccaauacuuugggaggccgaggcgggcggaucaccugaggucaggaguucaauaccagucugggcaacauggugaaacccugucucuacuaaaaauacaaaaauuagccaggugugguggugcaugccuguaaucccagcuacucgggaggcugaggcacaagaauccccugaacuugggaggcggagguugcagugagccgagaucacgccaaugcacuccagccugggcgacagagcaaaacaaaacucugucucaaaaaacaaaaacaaaaacaaacaaaggcgaggggaccauggcagcaggcaaauccauaccaacccaucacacagacggggaaaacugaggccugcuuucucacucuuggaauaggaaagcugggaggccguggcagaacuccugaugcacauagcuugaggcucuccagcugucacgcugaugggguggagggugcagaaacuaccuaaaguuuuggggcucuguagaacggcucucugcagcuuugggggucaauuggggauggugacguggccacagcugugguagaggacaccccuucuugagaucagggauggagauaggauggagagaagaguguguggucuucgucaucugcugauccuugugggcccucuguucuugaacucccaaguuuccagguccucguaucuccaauaccaggccuugaggccuugaggcuuucugucuggagaccccugaaauuuucauccugccucuaaauuacccaaagucucagaauuacccaaucuuaggauccucaguccccugaucccuucugcccaccugaucuugaccucaaauaggacccugaucacuuguggccccacauaacugaguacccagaaacccgggucucuguucuccuggguccucaagacccccugguaucugggucccuggagcucugguucauuuccuuggauccuugugaucccagauauuggggugcucagaaccccaucucuguuuucauaaugcccaugucuccagauaucuugguuccugagauugugacauccugagauccucaguaucugucuccuuagaaccccagucucuguuacccugacucccuuugauucuaauaauaucaggauacagggaaccccaguuucuccagcccagcucagcuuccucauaacgcuacacaucuggcuuaagagcuuguacuuucuugccccuaggauaccaggcucugugcccugauucccugacacccccauauuuguaccacugggcauugucccuggcccccccccccccacgucacucagccccugggcuuugccccccaggguccccaaauccccagaucccaaggcacagcuuacuggcuccccgaugaucucauaucuauauccuuggaaccugggcuuauauccucuugucccccaggucccuggagagacaccgguuugugccucaagcucugccuccuggcucuggugacccuaugcucuguguggaucccacccggcccggacccucgggggccacucaccgggguaguaaagcgccuccggccgggccaggccgugggggggcccggggaccgccggcaggucgcagccgccgcgcagaggguccagggggacgacaaggcccgcagcgccgcggggagcggcgggcuccggggagggcgcgcgcagcgggcgcuugcggagcggcagcgcggcgcccgggaguccggcggccuugggccgggugcgcagguccacgggccccucguccauggcccccgcggggcaucggggcauggggccgccggggacggcggccggagagcggcugggcucggcugcacgggagggugguuucgccgggcgc

SEQ ID NO: 192992 - RNA, 86587 nt, Homo sapiens
ucuugugauaacagaucaauuuuaauucuagcaccugaagcuauacaaggguaugcucuauaaacuucaugggacuguuguacacacuugauaaagugacaacugugcaauaccacuuagcaucucaaaaucaggaacauacuauugaauugcuuaaacacaauccacagaauuaaaaacaaaaucagaugccauccacaguuauacuaauuauccauuaaaagcuuacacuuaauacuugaaauaacaaucaauaucuagcagggaauacugaaagugauuucagagucucauccuguuguacucuauugggaagguuucuugaguaguuaugugacuggccaaagauggguacaaccaagaccagaccagcaaguaaaaguucuaccacaguuucuguaguuuccacuuguuuuucuuugucaguuaaaagugaacagugagaauuaaauacuuaucuuuacauauacacaagguaugcuaugaaagcauaucugcuuacaaacauauaaaaauacuuguuaacuaguuugauaagaaaauaauguauaaaaguauauagcaaaaacauuaaucaucucugacccuggaaagaucaauuccauauuuuauauuacaaacaaaaacaguuuuaguuuuuugaaucccuuacccagaaauacuugaaaaggaagacagaaggaaauuauuccuuuuuacccuuagcguggcugugaaaaagaguuaaauuaaaaaaucaaguacacugaaauaucuaaguccuaaaugaguccaaauauuugaccacauagaauauuaucaucuccaagaguaggaguaguaacacaggguuuuauaagcaguuuuuaauccauaaauacaacaggcauuugguauuuuggccaucagaaaacaaaaguuguaguaucaguaaaggucugagaugguucacuuuuguagauucaauucaguguauuuaagguuaacaaaggcugacauugaaauguuuaaagauaggcaaaaauucacauuaaaaaaaacccuauauuucuauuuagaguaacaguaggcaguaugauuccaaaaguuaaaaauuauuucacaaccuguagcuucagcuuggcaaacagcuuagauuccaaaacugauucaucucuauuaaaauguaagcacuuaaaaaaagagcaugucuguguauauagacauauauuuuaaaggaaucagauaaucuuugaagcagccuuaguguuuccuuuaaauuugucuggaaaugaccauuguauuagcuucacagaaaggacuagccagcuucuucgucuaaggcuaacauggugaucauuugucuaaggcuagaaagguaccaacaagauguaaacugaggagagaaagagaagaugagggcuuuuccuggccguugguagcuaaaacugaagggauucuagaaaaugacacaauggcagccuuucuugucuuuuucuuuccguguugguucuggugaaggaggacauuccugcucuugaaauuuccuguaagauaaaaaauucuaaaauauaauugccuucuugguaaucuacuauuacaaacacagguuauuuuuuguacaaguucacuuuuaaguguguaugcuuuucaguguuaaacuucaacgagggaauuucucucuuuccuacccccaccaaaaaagggcacaaacgcgucaacaccagcacaagcagagcuaugaagcugcuuuaauggaugaguccugaaucagacgagauacuagacucaguaaucucuaaguucccaucccaauuugaaauuccaugacucuaagguauccuuaagaauaaagauucaucauuagagugcaauauaaaauuaaccuuaugagguaugcaggucuuaucuguguucugccauuuuuuaaauucaguauuagacaaaguuaguugaccuagucugagccccaguuuuuuuagaggggaauaauggaaaccuaccuuucacagcuguugugaggauuaaagaucuugugauguuagaauauaucuaauagcuccuggcauuaaaaacaaaacaaacaaaaaaccuccucuacuucuccccucauuccugaauuacugauggguaaggagagauccuaagaaccaaaacaaaggacaacauuucaaaacggcagucauaauuauuuuaagaaggcacugccucaucaguugcuuaacacuaaaauggaacuggaaugggaaagggggguaaaauacauauaacauaaaauuuuccaucuuaaucauuuuuaaguauacaauuugaugguaucaaguauaugcaugauguugugcaaccaucaucgccauccaucuccagaucucuuuuucaucuuauaaaaccgagacucuuaccauuaaaaaaaaaugggacugggauuuuuaacaaacuacuaaaaaagaaaaagcuauaaccuucacuuuuuuuuccuccacagaaagacaaugccuuggcaaggagcuaauaaguagaagaucaucgcucaggugucaauuuaccuuagauacaaaauaaauacgcagcccaggugcgguggcucacgcuguaaucccagcacuuugggaggcugaggcggguggaacacgaggucaggaguucgagaccagccuggccaauauggugaaaccccaucucuacuaaaaauacaaagauuagcuggaugugguggcaggcgccuguaaaucccagcuauucaggaggcugaggcagagaauugcuugaacccaggaggcggagguuguaaugagccgagaucacaccacugcacuccagccugggugacaaagagaaacucuguuuccaaaaaaaaaaaaaaaaaaaaaaaaaaaaaaagcagcccacuucacauuccuaucaaacugucuaacuagcagagaaucccagaucuacagagcagaguaugaaacaggggccaggcaucaagacccaaaauaauaaaucaaauccuacucacuaaagcaacuucaucuuucucacccacaaacguaccucguaauucuaucagaccucacccaacaccuuaagcuuccuggaacccguuaacacuuuuuaaaccaaaaggcccccuauggcaucuaacagaaaaauucucuguugugugggacauuauacuucacaccuuacaggauuauuuaaucucuacuaccugguuuacucuuagccugggaugagcuggauaaaaagaaagguaggagcacaggcucuggaaucagagguuugaauuaaagccccaguucugccauuuaauaugucuuaauuugaacaagcuauuuaacuucuuucucuguacccccauuuucuccucugaaagugaggauaaaacaguauuuaguuuauugggcgagggugaggauuacauguaauaauacacguaaaaacguuuagcacagaagcuggcagagacuaccaugcaaaaguuagcugcugucaucacuaucuucacaccaucacccccuuuggaagcagcauuuauucuuaucaaaauccuauguguacuuuauacuucauaauuaaauuauauuuuauauucuagaagugccuagaauauguacuuaaaaauuguaaugcaccaugugcauuaaucccuagaaaggaaucacuuccauauaaaauauccuuacuaaaaacauuuaauaguaauuuauuaaaacacacaucuagaauguguuuugcuuaccugauaacccggacaaguucauggaaagcuugaucuacauucauccuaaucuuugcugaugccuccauguauguuaccuuaagcugccgugcuaacuguuguccuucuuccuguguuaccugaaauuccaacaguuauguuuaugguacauuauuaacaacuggauuuguuccaucuaauccuggccacagauugugcuaauaauucagccaagaggccaaguuguuuuaucauaaggugaaacaacagacuuaacagcucaagauaaacuaaagcccaccucugcagaacaaugcagaagaacauaucugugauggaaauacuagccuacaacaauauuuccaaauacagaucacacaaaaaguauuaaauacaacaguaauacauucugggaagggaaaguguaaggugcuauuaaaguauacaacccugucagggagaugagcgaaagcuucccugaggaagugacauuuaagcccagaagauaacagaguauggaguugagggguggagggugggggugugaagaaguauccuugccagagaaaacugaaugugugaggccaugagagugaaugggcuuuccaagaacuaaaagaagcgucacauagcuggaauacauuaagcaaagagagaaaauggcaagaggugaggauggagaaaaguguaaguuucagaggccauaaggucucuucaucauugcauuccccaaaaccugguacacaggugacacucaucaauauguggggagaaaugaauuaugaaugcaaucacaggcccucacaaugccuuauauuuuggagaucaaggaaagguggcauagcugauugauguauaaaauggcaggucagaauaagaaaacauaaacugaauguaaguuccuacauguuuuaaauguaaggauuugaauagugauguuuacuaaaaauuauuaaacucuauuacauuuacauuuauauaguggggcuuaaaauuauauuucugaaaacaauaccuuuuauggcuauuauuacaaaaguaaacaccugaugaaaaauuagaaaagccaaauuggggggaaaaaaaaaaucaaagaaaauuuaagaaccuaucaaccauagagaaucauguucuuuuggucauuuuucaaugauacauaguuuuuaacacuauaaaaauaggaucauaauuuuuguauaucucauacucuggaagcauucugaacucauuuaucuaggaguucuuuuguaaauuccacaggcauuucuacauaaccaugucauuugcuaauaaagacaauuuuauuucuugcuuuuugauguggauaucuuuuaucuccuuuuccagccuuagugcacuaccuagaaccuccaguacaaugacauaaguggugacgggaauacucuugaccuauuuuggaucuuagaaacaaagcuaguuuuucaacauuaagugugcugucaguuagagaauuuuuuuguagauguccuuucucagguuaacaaaguucuccacuacucccuuugcauaaggcguuuaucaggaauggauggcggauuugccaaauguuuuuuccugcaucuuacugagaugauuauaugauuucuccuuuuuagacugcuaauaugaugaauuauauugacucacugucaaauaucaaaccaacaacccauugcaggaauaaacucuccuugagugauauauugcccuuuuuauauauuguuaaauucuauuuaauauuuuauuaagaaucuuuauaucuguguucaugagagauauuggacuguggauuucuuaugcuuuccucugguuuggguuucugagugcuaugcuggcuucacauaaguugcaaagaauuuucucuccucuucaauguucuggaacacuuuguacagaaucaguaguauuucuuccuuaaaugugugguauaauucaccggcaaaucuaucugggcuugaaguuuucuuugagguacguuuuuaaaacaaacucaauuuauuuuguagauaaaguacuacugauauuaucuuuuuuuuucccuugagugaauuuugguaguuugugccuuucaaguaauauguccauuucauuuaacuugcugaauuuauuggcauaaaguuguuuauaguauuuauuaucuuucaaacaucugaaggaucuaaagugaagauaccgcucucaauccugauauugugucuuuucucuuuuuuaucugaucauuccggcaagagucuugucaauuugacugaucuuccaaaaagccaguuuaggguuuuuauuuuuuauuuuuuuugguagagguggggucucacuauguuacccaggauggucuugaacugcucugcugggcucaagcaauccuccugccucagccucccaaaguguuggcauuacaggcauaagccacuacacucugccaguuuuucuuuccuuuaugguuuuacuauuuuccauuucauuggucuucauucucuuauuauuucccuucuacuuacuauggguuuuaauuuucucuuuuucuucuuauuucuuaaggaagaaacuaaaggucauugaauugagaccuuuguucuaauacaaauauuuagugcuacaaaugucucuauauauacuucuuuaguagcaugcuauaaauuuugauguuguguucuaauuuucauucaguucaugauacuuuguaauuucccuuuucauuuucuugacccaaggguuaguuggaauauguuaauuucccaauauuugaagauauccuagauaccucucuguuauuaauuuccaaguuaauucuacuguggucaggaaauuacacacuaucugacuaaaauccuuuuaaauuuauugaggcuuacuuuaugauccauucuucuuucaaaagaaggugcauucuacuguuguuggguaaaggguacacuuaaugucaauuaggauauguuguguucaguauuguuguucaagucaucuguauccuuacugauuuucuuucuaccuuccuaucaguuaucgagagggguauugaagucucugauuuuaagugugaauuugucuauuuuuccuuguaguucuuaacaucuugcuucaagauuuuugaagcuauuagaucacgaauguuugggacuguuauguccucuugaggaauuaaucucuuuaucauuauauaacacucuucuuuaucucugguaauagucuuggcucugaaaucuuuaucugauauucauauagcuacuuuaauuauuuucauuauugcuagccaggcaaucaugaaaauaauuaaaguagcuauauaaauaucuuacuccauccuuuuacuuuaaccuuugugucuucacauuuaaaguagauuucuuguagcaucuuguuuuuuuauucaaucuaacacaucugccuuuuaauugagacauuugggcaauuuacauuuaaugugcucauggauacaguugagucaucuugcuauuaguuuccuauccauauuaucuauucuuuguucuaguugucuucuuucucuaccuucuuuuggguuagcugaguuguuuuuaugauugcauuuuaccuccuuuguugguuaauuaacuauauaucuguuauuucaguggcugcuucagaauuuaugguauacauuuuuaauucaugacagucuaauucaaaugauaccauaccaauucaaguaugguuuaagaaucuuacaacagagccaggugcagugguguaugccuaaagucccagcuacuuggguggcugaggcaagaggaucacuugagcucaagaguucaaggccagucuggguaacacagugagaacccgucucucaagaaaaaaacaaacuaguuaacaacaauauuucucccuccugcucuuuuuuguuauuaacuuuuacuucauaaugcguuuauuuuugcuuuaaauauucaguuaugguaagaguaauuuauauuuauccacauaauuaccaucucugguacucuguauucauuuucagauuuccauuugguaucauuucccuucugccuaaggacaucuuuucacauuucuuguaaugcagaucugcugcggaugaauuaucucgcuuuuacaugucugggaaaagucuuuauuucaucuucauuucugaaauaaauuuuuaguagguaaugaauccuaguugauaguuuuugcuaucaguacuuaaaagauucugcaccacuaucuucuggcuucacuguucaaugagaugcaaugaugacuccugccauccuuaucuuuguucuuccauauguaaugugcucuuuuccccccgucuggcuauuuuucagauuuuuuucuuuaccacugauuuuaagugauuucauuauaauguaucuuauaauuuucuucauauuucuugugcuccggguuuguugagcuucuuggauguguguauuuuucaucaaauguggaaauuuucagcaaugacuucugcuguuaaucccauccagugcauuuuucaugucagacauuguaguuuuacuucugaaaguuugauuuggaucuguuuacaccuuucaugucucuaacauguuuucuugauugcauaaaauaacggucaaaauaacuguuuuaaugucucuguccacuaauucuauuaucuuugucauuucuggaucugcuccuauuaauuauuuguuuccuuauugugggucauauuuucuugcuucuuuauauguaugggaauuucugaguagaaggcugggacuuuuacguaucagguaucagauauuuuguauuccuaaacacauuccugagcuuucuucuaggaugcaguuauuuggaaauacauuauccuuucaggucaugcucuagguuuuguuacaggguaccagaacagcauuuaguguggcuaauuuugccccacuacugggacaaaacccuucugaguuauacuauccaauacuccaagaaauauaagguuuucuacuuugauugauuagaauaugaauuauuccuagcccuguuugagcucaagguauuguuccuucuaaacguuuuagguaauuuguucucccaguuuaauauucuauuccaaaaauuuagcagccucaauacaguaucauuaguuuaguacaccaauauacauauauccaacaacuacuucauaacuguuugugcccuguggcauuccaacaggauaacgggcagguucuacauagcacugguauaucuaaguuuaucuaacuuuuaaauuuaccuugucucucuucaaaauaacguaugugccacaaggcuaugcauuugaaauauaaacugaucaaguuacccgaacaauuaacgauaaggaaggaagccgaguaaacacagaaagcuucacagaaccaccaauuuuagacaggacaauuucuguuuuaggaaaauuugacaugugaaauuccuucauauaaaauaccccuaugccgucacaaauucuguuucuucuuccugggaugucaucccuucucucucaacucuacacucucaaauucuuccucacuaaccuuucaagcccugagcaaugaaacuucccccuaaguguuggugcuguuuuggaagcaccuucucagagcucccaucacaccaucugguuaccacugacaagucucuaacaauaccacaguaaaauuuuucguuguguuuucuuauucuuucaccacgucaucauguccucugaggcuaggaaguuaagacagguuugucuuuguacauccaaagcuuagaagcaugcuuagcagcuaaaaaaguaaacacauguuaaguaaaugguguacaacuaaccaaauagguacauccuuaaguuaaaauauauauauauacacaaaaaguaaaagaaaucucaauaaacuacuuacuuuguugggguaaauaugauugggggaaggaaauacacguacuuauuagaauuuuuccaguagcuuuccugcuccauuauuccucaaaaagauaccuuguccuacccaucaugcauaauguaauucacauaaacaggaauagcaacucaccuauccuuauauaggguaaaaaaaguuaggccaggcaugguggcucaugccuguaauccaaacacuuugggaggccgagguggguggaucaccuaaggucgggagcucaagacacgccuggccaacauggugaaacccuaucucuccuaaaaauacaaaaaguagccgggugugauggcacgggccuguaaucccagcuacucgggaggcugaggcaggagaauugcuugaacccgggagguggagguugcacugagccaagauugcgccacuguacucuagccugguugacagagcaagacucugucucaaaaaaaaaaaaaaaaaaagaagaagaaaaaaacgaaauguuaauuaauucauggucuacaugauaaaacaauccugcugcuaggguuaugugcuucacuuguuuuuguuuuguuuaguuugguuuugggacagggucucacucugucacccagguuggagugcaguggcauggccacagcucacugaagacucaaccucccagucucaggugaccuucccacaucagccucuugaguaguugggacuacaggcacgugccaccaugccuaauuuuuuuuuauuuuuaguagaggcaggguccugccacguuguccaggcuggucuugaacuucugggcucaagggaucugccugccuuggccucccaaagugcugggaucacagguguuugccaccaugcccagccauuuauuuguuuuuaaagcaugguuucacaucacugucuuccaggaaacaaagccaacaaauuuauacauacauuucuggugaagaaaucucuaaccacaugcuugugagcugacacagcauacuuuuaacuaaguagaaauagcauugccaucaccaaagcaaacaauaaaagacaaaaaggacaacauaccggaacagagccauagcacuguggaaguuagaaaucaaaagaaaacugaaaguuacaaaaguaaguacuuccuagagguuccucaacccagauaauuucauaaagauaccaaauaauauuaagccucaucuccuggauauucugauuugguagauuuuagcacuucccagacauguuuuguuuuaaauaaccagggcaaaucugaugcaacaaauucacagaacuacauuuggaagcuuccaguaagacucaguucaaaaacacagguagcagcagcaguucacaauaacauguaugagcucaucuaguacuacauauuuccaaauagaauaaacuacauuucagugcucagaguuaugucaaguuaaugaaguuuacagaagcaaaacuuguuuucacaaacaucuauuauguaaaaagaaucaucacauuaauacaacgucuuaacucacuggcacccagauucauccacccaacaaauacuuauuuagugcauaccucuguucuauaugcuaacgauaaagccugaacaaaauugaccugucaaaaccgagaaacccucauaguaccuacaccuacauucaccaucuaaacccuuuuagacgcacauaaggcacagauaacgccacaugugguaagauccucuacuauuugaggagggguucuuuuuccuaggaggcuguagggggcacacuggucaaaaguacugacagaugggagucuggauugauauacuuagcuaucuauuauuuuaaguauaauaaguuauuuucucaaauuaauaguaacgauuaauaauuaagcaacuaaaaggaggggaaaaagagggaacaaccaagguaagccaggagaaagaugguaaagacaaaaaagcaaagacaguugaucucuagacagggcugaguugaggacaaggaacuugaaaucagauauaucaugaaauuccacugucuaagccaacauacugugcuauuuaauuucagauucaaguguuguuauauuuaccuacuuucauauuuuagcaaaguuaagcaaaucauuuaccuauguuuucuuccuacaccuuuagcagaauaaacaaaaugacuggcauaucuuaagggaccagauggcugguaauacuaaacaaccacucaaauucuacagauaucuuuuuaucucacguaaaccucagugacuauucugucuacugcugcaucaucacugccuagaaaagguguucaauaaauacuggaugaauggauggaaggaugaaagaagcaacccaguccacagauacagaggccauaagcaagcaagcaaagccucuucuggaugauaucccugaacccuggugggguucagaaucucaggagccagugguagaaauggccagugcugacccacaaauucaaagaacaaggagaaauggcauuuauuaucuacaagaaaauaggcuagaagguaaagaaacuacaaaugaucaagucuaagacaaagguagaaaaaaacaagcugugucggcaacagagagcaagccagacugguuacucagaaccuacagaugacaaaaaacuaaacaucucugaacaggcggaaagaagcuuuuacagcauccccguggccuguccaaguugacuugguagaacaacguaagugugucaagacauuauagacggacaccuuuaauugugaagagauguuaaaaagguaaaaaccggcugggcgcagaggcucacaccuguaaucccaucacuuugggaggccaaggcggcagaucacaagaucaggaguuugagaccagccuggccaacauggugaaacccuaucucuacuaaaaauauaaaaaauuagcugggcaugguggcccaugccuguaagcccagcuacucaggaggcugaggcaggagaaucgcuugaacccgggagguggauguugcagugagcggagaucgugccauugcacuccagccugggagacaaagcaagacccguuucaggggggaaaaaaaagguaaaaaccucuacuauagcaucucaauuucaugcuauaguaucucaauuucaauagcaugcccccuaagggugggagauaaggcauguuugucuuugcacauccagagcccaagacacuuuagagagacacggagacaaaguaguaccaacaaaggacacuggggaggcuggaggagcaggaaauacuaucucagagcuaaguaaagaaugugcuucaaaaaggaagugaucaaccaugucaaaugucacugacauuuguccaauuagugauacugacaguggcacugaaugccugaugucuguagaaucaagaacggcaggagaaaaaguagagaaaguaaguuucaggaguuuugcuauuaaagaggggcagaaaaaauauacucagaggggaaugugagauuaaaaguuuaugcuguaguuuuuuuguuuuaaagauaagagacauuguagcauguuguaugcugaugggaaugaucaugcagaaauguucaucugaaauagaacaauugcugggguaauguccaugaguuggugagaaggaacaggauccagugucugguggagaaguugaucauagacagaugaacaguuuauccauguaaguggagggaagugaacuugaugggguaccugugcacucauguuaguagauauggagguaaggacauguagaaauuucucacagaaacaggaaaacauacacauuaucagcugagagugaggaaagagaagaaaguguuacagguugaagaaaaugagaaaguauguaaaaauuauccaaacaaaugggaaauagguggacuagggaaauguaggauucccagucagcacuaaaggcccauaaagauuaguggucaugacuuuaaaagugagaguagucaacaugccugaguacaggugcaaaggaagaaaaagcauaaggaggaauaaaacuuuucuuugugucuauccuucagagaguagacgccauauaaaugagcagaaaacuaagcaaucagauuucaggcacuugcuuuucucccuuggauauauauacaucuaagcuuuucaagauauacauaauuuaugucuauuuauaugguuuagauggaaaaauaaauaaaaauaacuuacugcaagcuaacacuacguaucuuuagggugacugaaauaaggaaaucauuuccuauauuguucucucacuuuuuuacccugagaaucuauuacuuuuacaaaaaguaaaaaaaaaaacuuccacgaaaaaaauuauaauccaaugauauacaaacaaagccagugccacaauauguugacugucugcagacagauggaaacugcauaccacauucuggcaaucuucaguacagguugaauaccccuuauccaaaaugcaugggaccagaaguguuugggauuuuggaauuuuuuugauuuuagaauacuguauuugcauauacauaaugauguuucuugggaaugggacccaagccuaaacacaaaauuuacuuuuuauauacacuuuacacacauagccuaaagauaauuuuauacaauauuuuaaguaauuuugugcaugaaacaaagcuuucacugugacaucacaugacaucaggugugaaauuuuccacuuguggaaucauguuggcucucaaaaaguuucagauuuuggagcauuucagauuucagauuuuugggcuagggauccucaaucugguguauagacaacuuaaaaauaacucauauagacccaagcugauaauggcagagccucuuugggguucuagugggcauacacccuccucccuucccuaaucugccacugccuacccuacaggagaucuccaccuauccuaggucuccuaccuauuccuuuacuggagcuaccaccaugagaagguuugagaaagauccuauuucuauauucaggacaggaagcauauaggggugaggcaaaagucagcgagagauaggaagagaacuccuucaaugcacaucuacuuugccauuauuucccagaugcaaugacauauagaguuucuaguacuagaaagaacugagaagagccacaggcaggguccacugggcaacaucaauaaauauaaucagguuuagaaaccucaaggaaauggucuuaaaaaaaaacaaaauuaaaucuaaaaaaaauagaugaacugucuaugcuagguuuauaauguaagcaaugccauauucuuaauuauuucaaacaguuuauauugauuugaaaugaagaacaaauuuuuucacucuaacuuuauaaccagauuugaacgagauuuagcaggaaaauuuauucuauaccaaguuucaucaguggacauuuccaaaucuuagcauuaagauaauauaucauuuucuugggccaggcauuguggcucaugccuguaaucccagcacuuugggaggccgagguggguggaucacaaguucaggagaucgagaccauccuggcuaacauggugaaaccccguaucuacuaaaaauauaaaaaauuagccgggcaugcuggcaggcgccuguagucccaagcuacuugggaggcugaggcaggagaauggcgugaacccgggaggcagagcuugcagugagccaagaucacgccacugcacuccagccugggcgacagaacgagacuccgucucaaaacaaaacaaaacaaauauauauauauauauauauauauauauauauauauaucauuuucucuuaagucaguguuugaaauuggguaugccgccaauaaaauuuuauguacacagcuaaaaucagagacaguuacaaaauagaaagcugcccucaaagcuguuuaucaaccaauuuuuccugauguuuacacuuuuccaacaaaauccuaagaaucuguaaacacaacauaauauaaaaacaagaauacuuaaauaccagcaaaauaaacaauuuaaacaauacauuucagaugugggguagagacaaaagaccuuuaaaaaaagccauauaacauugauauuguuuggcuguguucccauccaaaucucaucuuuuuuaacugcaguucccauaacccccacgugucaugggagggaccagguggacauaauugaaucauccgcgguuucccccauccuguucucggagaucugaugguuuuauaaagggcgguuucccugcacacucucucuugccugccgucauguaagacgugucuuugcuccuccuucgccuuccgccaugacugugaagucuccccagccaugugaaacugugaguccauuaaaccucuuuuucuuuauaaauuacccagucuuggguauguccuuuuagcagcaugagaauggacuaauacaaaugaacagccggcauuaauauacaacugaccuuguuccccuccccuacaaaaaagaugaaugugcaauguuaccaaaaaauuguuuuaacuaauaaaauuucaguaaguggguaaagaaacaagugagaauaaauuagccugcaaacuaaauacuaaaaauauuauuuuauuaaauguuacugaaguguuagagcuagccaauguaaagaauuaacagaaaauucagucauuaaagugacuuagaaaaaaauccaaauacugcaauuuaaaugaaagccauucucuacaugaaguuaauuuaguauuaacaccgaauaacuuaggccuuuagugguaacuuugaaauuauccaacuaaguuagaguuuuggauguaauccaagaaauuauuacaugcgaauaaagcuaguuuaaacacuugcaggcuuauaaagucuuauaaaauuuuaugaaaaacuauuugaaaauaaggaauuuuaauuuccccaaaucuacuuccuuuuuauuuuucacccgcugugacuucuguaaauacagugugccagacucagcuauaaacacuuaaguggcauggagcaccguauuuuuuuuuuacuagacuuucaauuauuuccuuaaaucuaucaguucacucacaugauuauaaacaauugguuucccaacagugaaauuccuucucaccugucuuugaugauccagaucugcuuuauuaccaauuaaaaucauugggaacucaucacgauccuuuacucugagaaucugucuuugaaacuuauagauuucuucaaaacuuaaaaaaaaaaaaucaaaaacaaauuaaucaauuuggucaaguaucagaauucagcaagucucaugccccaauuaguacuuuauuuuuccuuuuucuauaaaaacaaaaaguccaaacucaauaaagucuagugaucuugacaagaacaguggaucuacauucuaauaugguacaaaccugccucuaucugugacugaaaagaccaacaggaagccuucgccaguccucauauacuguucucucauggcuccaaacucuucuuguccugcuguauccaaaacuaaagaaaaaacaacaaauguaauuauacuuguuuuuuauaaacugcuuccccacaagggcaagaccaauuaaugugaguccucuagagagccucauacuugguauaauacagaaauggcauuccuuucuuaguacuuuauucuuaauacuaaaggcaaauauauucuaauggcagacaguuacagaguuuaucuucaucaguauggguugacuuugugguuagaauauauuagcacacuaauuagaagcuuaaaaauaucaaacacauuuaaucagauggagucaggugaccucuaaaaucacuugaauguuuuauccccuccauggaaaaaacugaaaaagauaccuguaaauucaagaaagaaaucugaguuauaaccacuaucccccaauaccauacuuagugcaggugcuaauguaacuuuugaucucuguaaauaaaagaaucauacauauuagaagaauagagcuuucuuuguggagaggggggauguuuagacacaaaacaguacuugcuaaagucucugugcuauaaauucuaaguaacaguaucaaacuuuuucuauauucacuucauccauuuuaaccuuugccaaaagguaggaagaguugagaccugacagguuuuuuccaguugucccaauaaaaucaacuucaacaaacugcaaugagaccaguuucacuagaacaagaucaauacaaauaucguuuuacuuuucauuuauugaggaauauuuaaauuacccauuaugcagacucuucaaucaaaacuuauaaaugacaugggcuaauauuccagaucaucuaauauuucaaauauauuauuuaacauagcaaaacaucagcgcuuacuuuuuuaaaaaauaugauaugcaaauuaucaaacaaaggaaguuuacuuacuaucuagccgggcugcucugucaucuaucacacacugcuuuguguaagaaucuucaaugguuggaucauaauccguuacaaaauaggacugcaagaaaagaaaaaacuuuauuuuaaaauucauggccaggcaugguagcucacaccuguaauccuaugcucugggaggccgagggagaaggaucacuugaggccaggaguuugagaccagccugggcaacacagcaagacucuuaucucuuaaaaaaaaauuaaaaaauuaaaaaauuagccgacgugguguguaccuguggucucuguuacuugggaggcugaugugggaggaucacuugagcccaggugguuggggcugcaaugaaccaugauugugccacuguacuccagccugggagacaggacaagacccugucucaaaaauaaaaauaaauaaaauaaauagaauaaaaaauaaaauaaaauuuaugauuaccugccuaccaauguaccaauguaacuuugcuuaacaaauuccacuuauccagaacuaaucaaaacauuuucacuguacuaggguuuacccucuaugacaauuccccaccaaauguucuuaugagcaccuucacgugaagaaaagguacuagguaucucuaaauuuucauaucugaaauaugcaagacuguaaaagaucuacaacuuuuuucauaauuauuuaagguuaagaaucuagaucucaaacucuagaaaaauuagaaaacacaguaaguuauaauucagaccuauuugaauuagcaaccugauuauaaucaucaguccuaagaagucaaguaucuggaaaaaauggagacaacacaaagaggccuggaacauuucaucuuauaccuuucuuuucucacacuuugucuuauuccccuuucaacugccuuauguacuacaagaaaauaucauuuugaaauuuuuucauuaguaggaaccucaaacuuacucuuucacugacaucuuuuguuguuuuuuuaucuuaaauucuauuccucucuucucugaucaaacccucccaacuaccgaagucauuaccauaaaaaaaaggggggggacaguuaaaguauccaaguaagaagggaagaaucucagccuacauuucaguuuuauuuaaaaggguuuuaaaaaaucagcuacucaggaggcugaggugaaaggaucaccugagcccagaaggucaaggcugcagugagccaugaucauaccacucugcacucuagccuuggugacaggaugagacccugucuccaaaaaagaaaaagguuuaaaaaagauaacaacaauaaucugagagagugcauuucccucuucuuacagaagggcacuaaccaggacaccaacaucauccuccauuuguucugaguaucuccuuugaucuacuuuggacugacuuccucaaagcccauuuucccacuggcucauuacaaaaucugaaggaaugauuuggaaggagacagcuuaaugcuaggaaccagcaucaagaguauuuagccuucuucaggcaaggguuccuggcucuugggacccaacauucguggcgaccuaugcaaacaccagagagcuacucagaaacaagcacucuugaagaggacagaaaagaauccccugguuuugggaggagauauauuaaucugccugauaccaugacuuuacauauuuuuuuugaaggacacuuuccacauuuuauuuaagucuuaagaauaacuuuaaagccaggcaugguggcucaugccuguaauccuaacacuuugugaaaauuacuugagcccaggaguuccagacuagccugggcaacaaggugagaccgcaucuccacgaaaaauuuaagacuuagccagauguggugguguacaccuguaguccuaguuacuccggaggcugagacagaagaacugcuugagcccaggaguucgagguuacagugagguaugaucaugccacacugcgcuccagccuggaagacagaauaacacccugucucuuaaaaaaauuuuuuuuaaauuaaaauuaaaauguuuaacuuuaaucacagaauuccauaucuauaauccuauuuguuuuuugauguuucacuucaaugcaugauguauugaacaaagucuguaaaagaaauguucaccaacagcaguaacuuuuaguaggaagccaucuccuccaccacuccaucaccauuuaaaaauaaacagguaucaauucacuuaacuagccuuaaaaaaaaaaaaaagcagguaucaaaacaaucaugaacuuacuuuuuggcacccaugccacuucaaaaaguaaauaaauuuuacuggcaacaauauucucuacacccacuauuuuaaacaacaggaaucagcagucuuucacaagcaaauuggauaaagcaugcgcuguacuuuuuaagauucauuucuugaaacauguuuccccauaugccaugcuuuuauaucuuguaaaaccugaauuucacugacuacucccagcugaugccuaaaagugcuacacugucccuacugauuuggccuaaaauauaauaaacaaauguuaaauacauuuuuuacaaaugccaagccaugcacaauagcuagaauucuuuaaaugugacaguucuuggcguugugagauuaagauauuaacaugcacaaaagauuguugguuugauuguuauauaaaagauuguugcaacuuugaaguccaguauaauaaacuguuuuaccucuacucgcuauggacauuucuuuggaugucuuaacucuugaaacacaaucuuaguauuacaagaauuuugccauacugcuacaugcauuuauuuccacucauauuaauuuuuaagacaaauucauuguugggauuuuuggauauuuagguucacacccaaucuuugcuguguccuaucuucauacuuugucuacagagaccaucaucuacuggcuacacguaaauuguaaagagccauccacauugaaacaauccuccuccaacgaaacaucacucugggaacugccuaucauagaaucaaaaaccucuuucccucucaaaauucuaagaauccauaggucagaauaucccuaagagcauucacugugugcagguaacaaauacaggcaucaccucucaccaaaaaggcaacauuuuuguuaaacuuggguaccagauauuugaggcaacagaucaccaauaaguaaucaguccccgugaugaagugucguggguuuaauucuaacucugcuauucccuagcugugggaccuaaggcaaaucacuuuacaugucuaaucuucagcaucuguaaaacagagacaggaacaaaauccugugaagcagguaaaaugaaauaaugcauaugaagugccaaggcaugcugauuaauaaaugucaaccauaauaauaacuauuguuuuugucaugcaguuaaauggucugaauuaguguuuuuuacucaaguauaaagauuugcuaagcucaggaguagcuguaauaauuccaguccuaguuacacuucagaccaaccacacgaccucugggauuugguauccaaacguugugaaucaagacaaaagcugggguucuggaaauagucucuggaucugagcagcaacuacacaguuaauuuacauaaguaaaaacccaucaggcuguacacuuaagaucuguacacuuuuuuguacauauaugaauuauaccucuagagaacauauaaauuaaauggcucccugcugcuuacaggauuccauaguuucuuuacaugcuaugcaaagcccuccagguuuuauguaguaugcaaagccauccaguuugaucuguguuguucaccaugcaaagccucauucccacuacuugaaacccuucagccaauuguccuugcucucuugauuucacucacucauuuguucagugaucauguaugaagcaccuacuaaguacuccauaaagauacuccauaaagacaaggucucuaucuucagaguccagugccuuuuauacaaccaccaguaguugagguauuacugggggcaagagaaggauuggggcauuuuaagucuauacccaagccaaaaaacaaacagcaugaagugccaauaccaugcuuguucagaaggcaagagaaguuagacaguuaauacuacaguuauguacagaacuauguaugcguucacuuaucaacacagccucagcaauuugccagaaaagaaaacagucucucuccugaaauuauaaaaaguuaccaaccacagcccagaaaggauguucuguagcagaaagagaaaaaaagaggaaaaaaaagcaagcacaguauugcacugagcuagacaguaaagguucaggcaaggauagggaagaaggguggacccaagggcucaaaagaguacacugaggggaaaggaaggguggaggauggagagagcacauguuuccugauagacaugaaaggaugugugcagaagaauccuagucaaaagacaaggaauacccucccauucaaagggcagcaugccuucccgguaguauggaugggcaaaugaacuucaguuucuuuaacauugucaggagauguggagaaacauuuaggauuagggaagcuaucacauucagacagagauaaaaucgggucuggcaagccugggcaacccccaucucuacaaaaaauaaauuagccaggcaugguggcacgcgccuauagucccagcuacucaggaggcugaggcaggagacugaggucaggggauugcuugagcccagaaagaugagguugcagugagccaugauggcaccacugcacuccagccugagcaacaaagcaagacccuguuuccacccccgccucaaaaaaaauugaucuggguaaguuugucagaagccccuaauaaugccaaaguauaauauuaugcugggauaagcaggauaauccugcuuacaugccacuagauugcauaacaggagcucgggcuggccuccuaaggagaacugccaacucaguaucuccccauucaaagaagccacguuaaggaggaaaagaagaaggaaggagagaaaaaggggugaguugcccuuccgccuucagugguaaggagugacaacacacuuucuucugacaccaagcuauuggugaaaguguaguucccaaacacugccacagaguggugccuggucuacacccugggacugguaauuuacuggaaauucuaggaaacucagugaauccagcacacugguuaagucuaccacccuugcauagaaaaaggauaggcuagcucuaagguaccacuggggaguuguaaacaaauggagggcaguucugagcacagcaucauucucaggaaagucguaggaguucucuaaaaccauaggguauagaaaggggaagggaaaaggaaaggagagaacggaaacaauaaacaaguguaggaaaacccugaaaaauacugaaucugggcaacguguauaugguuguagguucucuggacuuuuguauauauuugacaguuuucauauuaaaauuaauuuuuucuaaaucuggugguagcacauaaggaaagagacagugauccuuuuuuaacccugagcuuucaccucauucuacucaagacuacacaucauguagaaggcugauguuuuuucuugcucagaauauuuuccagguuuuuuucucuuuucccccucccucuuuucucccuuccuccuuuucucucaacaccacauauaucuuaucuacuucgucuuuuauuuuuuacuuuuauuguccauuucuuccccgaccgaacuagaaaggaacuccaugagggcagggacuuugucagagaaguaaagugaccugcuuagugcuuaaacaucaaauaacuuugcuaaucugccucucugaaaguaaaacacacucacacucaucuuccauuccugcuuccacugaucccaucgaaagugacauauccauaggccaggcaugguggcucaggccuauaaucccagcacuuugggaggccgaggcaaguggaucaccugaggucaggaguucgagaccagccuggccaacauggugaaaccccgugucuacuaaaaauauaaaaauuagcugggcgugauagcgggcaccuguagucccagcuauucaggaggcuaagaaaggcaggagaaucgcuugaacccagguggcagagguugcaguaagccaagaucaugccacugcacuccagccugggcaacagagcgagacucuuucaaaaauuaaaauaaauaaauaaaauucauaaaauuucaaauuucucauucccuuauuggccuauaaaacaaggaguaaauguaccacacacauacacacacacacacacacacacacacacacacacacaccaaaaaccaagacuaacaaauuuucuuucuuuucuucuccuucuugagcuccugcucagcucaccccuuacccccacacuacacacagauaucaggucaugaaacauucuagaagcaaaauucugugauucucugcucccuuccaguuuaagacagcauuucccuauuauuacuucuauccauaaaacacguacuauguuuuuuaaauuaugauaaaccaaaaugagauuucauuaacuugcuuccuauuaauagaugcauuuauaucuuuacuggagacaacaugaugagaagaaaacacaagggcucuggagucggagagccugaaauccaaauccagaagccauccuacuugcuagcuguuugaguccuuggguaaacuaacacaucucuaacuccauuuccucaacagaaaagggcaagaacagcuaguuuagggaaggcauauuccaaugcccacuucagauguggcagcaaagaaguuguaagagaaaaggaaaagcuucccagggagcugcucccacucccagggaguagggggaagcucacaaaguugccccucgggaucuaauaagggccacagguccccagugacuguuauguagccuccacucuccucuuccaggacagaagcgcuggcugaagccauccugucccuagucccaccacuguaucucugguguguggggcugccuagggaggcagcagaauugagggagucugagauguaagucaaauagacccggacacaguucuaucaguuugccagcugugggaaacuagaguagcucacuuaaccuguuugaaccucaguuuccuugucuaugaaaugaaaaucacaccaacuuugcaggauuguugugaaaaguuaaaaauacucuaugucuauguagaguacaaagcccaacagaugacacacaguaggcccuuaauaaauuauagcugauaaagcccaaaucacaucuugcuuucuuugcaaugcuuucaacacuccaaccagaaaacaaucucaauauucucuuacccuuaaagugacaacaguuuggauuuuucucaacuucugucuuauuaguaauaaguugugauuuggaaaauacauauaccaagcuuaauguauacuauauaauugcuacuuacaauuuccuuuuacaauugcuuauccuuucauguaugugucuaagugaauguaugaauaacugauauacugaguuaaacucaauggguauaagcauaaaacuuucccuccaagccccucugugggaaaguuuuuccuuguuccugaaugaaaucuaaggcaagucucauaauuuuuuaaaaucauucuuugacuauaaauauauuuaggccaaacacaacaguucaugccuguaaucccagcccuuugggaggcagaggcaggaggacugcuugagcccaggaguuugagaccggccucagcgacagagagagacccccaucuccacaaaaaggggggaaaaaaguuuaaauauccuucagccccaagaacaccauaguuucaauaacugucuuaacugcaguaaucaauacucaucuaaauuaaagcuucuccccuuccuugguggagcugagaagucuaguugggcugggggaugugagggguccugucaucaucucucucucccugcucugcaucucuucuacccacaacaaggcugucucuggcuccuucagagugggaacugaagcagugggaaaagcuaugggggugucaaaaggccacaccaauuaagugugauguucauaccaacuuuuucaugagggcccuccauacucaauucccagaacuuaagugagaccuggccauuuacaacuccaacccuccaccucugggguuuccauggguaccuuccuccugguucaugucaccuucuagguggccgagcacagugucccuuucuagauggcuuuaagcugguuucacccagcagccugaggaaacacuaacgucuuucuaaguacaaagugcuaacauacagcccucucugugcucugcugccucagggcuacugauccauagauuuguauacuaaaccuuucauuccccaaacucgaggggauacaugucaaauucucagaaugacuccauuggagccucccucaucauuuggcuuaaaugaaaggggcuuaaggagaagcaucuuucuccucuccuccacuacguguggaagcaggaaaggacaccaaacauacaacauacuaauagcucuuuccaaaaacauugucuuagaacccuuaauaaucucaacacuuuuauucccuagagguagguaugggcuacaugugcaaaaccaguuuaaggcuacccacuaugcaaguucuuggaauaugaggauaacuuggcaccuacuguuuuauucugucuuuuggguuucaaaagaagcuaaaaugaauuagaguuccaguuaaaauuguguuauauguaugucccaggacauauaaaacucgauuuacaugcucaagguuuuuaaaacuuuccugaagcuaaguaauauacuugcacacagaucucaaaguaggggaggacugcaguggggaaagaagaauuaauuuccccaagcacaauaaggaccuaguuagccauugguagccuccauuuucuaaaacaagagcagagcaaauuccucugguaacacuagagaagacugcagcaacuucaggcagcugugagccagagcugggcuccuccuugugucacuuuuuagcagcagcugucaugucacagagaaccuuuguucccugcaacauccucccuuauuuuuuuugucaaauguuuccaauaugcuugauauuccuucacugaaguauagcuuuugacugaaauuaguauuucauuuaaucuaacauguacaauuauauaugucuauaauuuaauccccagaacucuaaugcagaauaauaaaagcuacacuaaauccaguaauccuuuuaguuccuuuuuaacaaaauuuagugaggucuucaguguugccaguugucucagacugccuaaagcaaccaugugccuucauuugccuuccauacauuuucagcuaauauauauguauuaccucacauauaguauuuaguugcaaaugaaugggccugguaugugccagcagaaaguacaguacaaagucagcuuacaaacugguucuaugacaaaagucuguuuauaaguuauuuggaguuuuuuccuaaauugcagguauauucggaggccaaaccacaaaagcuacuacuggauauggcccugccaguaucagccccaaguuccaaccuccaaagcacgguaauuuuuccuaagaagaaaugggaagagaauuucuuuuccuuuuccagaggacagagccaggccuaaacaaaacuuguauagagggaaagcuugucuuugggguaccacuuguauaccccagccuucucagccugaccuaacuccccacuccaauagcuuucccuggguuuagccuucuucugaaaacauucuaaguacaaaaacacuguaucucucuucccacuguccucaaauuaaaacccucaagagauauuccuugaauucccaaauuaaaacccacagacacauucccacuagcaguguuuggggguuccaauuuuucaauauccucaccuagaccuguuauuaaacucagucuuggccgugcgcgauggcucacaccuguaaucccaauacuuuggaaggcuaaggcaagaggaucacuugagcccaggaauucgagaccagcugggcaacacagugagacccccaucucuacaaaauauuuaaaaauuagucagaugugguggugcguaacuguagucccagcuaugugagaggcugagguaggaggaucacuugagcccaggaguuagaggcugcagugagcugcgaccgcaccacugcauuccaaccugggcuacagacugagauccuaucccccaccgccgcccccaccccaacaaaaaaagaauuuuuuuuuuuacaacagacacccuacggauguaaaauagucucucacugcaguuuuaaugugcauuucccuagugggauguugaguaccuuuuugugugcuuauuggccauuuguauaucuucuuugcagaaauggcuacucaaaucguugccccuuauuaaauuuuaucuuaucauugaauguaagaguacuauauucuggauauaaaucccuuaucagaaauaugauuuacaaauauuuuuucaaugguuuucauucauuccuucauuuauagagaugugaucccacuauguuguccaggcuggugucgaacucuaggcuuaagggauccugccaucucagccuccugaguagcugggacuacaggcaugcaucacugugcccagaugauuugcaaauauuuucucucauagcccccuucuuauaaagccuuccugccauaagugaguacauaguuccuaaaucucaacuguggggcgaagucuuauuacccaccaacaacucuccacaauuccaauuccacauacccaggauuuugggcaauaccugcuccugagccaucaaucaguuguacuagccucccacuagguggcuguucuacugggcugacugcugaucuagaaugaaacuucccucacuguaacuaucccucuaacaccccauucccuacccugagcuuuuccuaucacacugagcuucagccuauaccaugcccuagcauaguucacuugucccaguaugugaauuuacccuuuuucaucaaaucuaagaugacacugauuguaagaccaucauuauuuuaugugccaagauaaaaaaaaaaaaaaaaaggccgggcgcaguggcucacgcuuauaauccuaguacuuuggaaggccaagguggguggaucacuugaggucaggaguucaagaccagccugggaaacauggugaaacccagugucuacccaaaauacaaaaauuagcagggcaugauggcacaugccugugguccuagcuaugugggaaguugaagugggaggaucaugggagcucgggaagucaaggcugcagugagcagugauugugccacugcacuccagccuggguaacagaggagacccugcccccucccccaaaccaaaaaaaacaaaaaaaaacaaaaaacaacaacaacaaaaaaaaagcagaaaaaggaagagggaaaaaaaaacugcuaccaauacacucaugacaugccuuugacuaugaagcaucucaauuucagauauacuaaaauguacggggggaaaugugaugaaauacaauaguucaagacaaccguauugguaaggcuaguuuuugagacagaauaucucauuuugucgcccaggcuggagagcaguggugcaaucucggcucaaugcaaccuccgucucucccugguucaagugauucuccugccucagccucccgagaagcugggauaacagcgcccaccauuuuacagaugagaccauugaggcucagcaguuaaauaaccugccaaaggucacaaaguggaacugggauuccaaucaggucuaacuccaaugcaauacuccuuccauuauacuuucuuuaaccugccauacuaacauagcacauagccugcgacaguuuaaaaaaaaaaauccugguaccccuuaaaauaagugauucauuauuuuuuuaaauuauaaacugcuacugccaaauagaaaaguaaagucguuucauuaaaaauggaaacgccccauuuguaaguuacgaguaaagguguaaguaggucauuuuuuuuuaaauacacaaagauacuguuugacccagcaauuucaauuccagaaacuuauccugccgauaggucugcacauauaagaaaugauauguacaagguuguucauagugaaaugucuuuaaaagacuggaaacacaaugugcuucagcaaggacaaugucauucagcaaaugccugguuaaauuacgaaagguucauucaauaugaauauaaccauuaaaaaaaggaaugacuucaugcauuaauauacagcaaucugcaagauauguuguuaaauacccacaguuuauguauuugcuuuaugugcacaaaauaucucuggaaagauacacaagaaacugauuaacuuuaccuguggguuuaacuggguugcuaggagauauggauggaaggaaaacaauucuuguagcuuucaaauuugaaauacaugaaugaaagaaggaacccaagaguuucgaaagaccuagacagauuaaacauaaacucuuuaguaauaaaagcuagauucuagucccagcuauacaaacaacuagcucagugcuccuagaugaguaaaucucuuaaaccucuuuccuggcucucaccuauaaaugagggguuugcccuucaugaccucuuuaagacucuuuccagcuauauaauuuuauuaugacacguuuagcuccuacaauaugccaaauauaauuuauaggugcuaucgaggacuuccuuguuuuaaauuuguggaauacagcaaaauaucauauuuuaaaagaggaagauuugcuugaagcccuaccucugcuacuuuauagcuguaggauuugcaguaagucacuccucacugacaccaaauuuaauuacuugcaaagcugagagacacuuucaagaguuuuuuacaaggaguaaaacgugaacauuuucuguacuuuacagcuccacaugaaaugugaacuacugcacacagacucccccuucaggugcuaugaaguaaagagcauguauuuuagaggcagucagaccuacauaccccgcuuaauugcuguaucaucuugggaaaguuauuuaaucucuuaagucucaauuuccucaccuaaaagaugaucauaaugauucuuacuugaaagggcuauugugaagauuaaaugauauuguuaaguacucaguacacugcuuaacuaaaacugaguauucaaaaauuggcucuuuuccuuuccaaacuuagaaauggaagggugccccauaaacagguagguaaccaacucacuucuaguuguaacuuuugcuucccagagucuagacuguuacuuccauuuucacuuccucuccccucuaucccguuaccuaccaauauccuaaaccccaauuucauuucucaccucuucuagaacagagaauggucuguagaagcaaaacuagaauuaaagggggugauuuccacagcacauguucuauuacuaaacugcuaaaacugccacaagaaucuucccuaggcucacucaccaccccacuuaaucuacaaauacuaacugaacaccuauaaugugccaagcauugugucaggagcugaggaucuaauccccaggcucuuagagggcuggcaguuucuugaaguauugaccaucaauaaauaagcaaacauaauacaucagaggugauaggaacucugaagaaaaaugaagggggcuggcaacagcaggaguuggaggggaggauaugauacugcauaagauagccagagaaggcuccacgcacaaugugacacuggagaagggaauccuggaucaacugaaggagugagccaugcugugaucuagaguaucauuccaggcagagggaacauuaaguuaaaggcagugcggugagaguacuguaacaugucugaagaacagcaagacagccaguguagcuacaacaacaaacaugagagagugguuaaugaguucagaaaauuaacagggaggcaggcggagacuugcaggccagagugaggacuucagauuuuauucaaagugaaaugaaaaccacuagagggucugaggcagaugaauaaaauguucugacuuucauaugaaaaguaauacuggcugcagucagaagacuggauuauaggucaagggugaaaucagagacuacuuaagaagcuauuacaauaaaucaugaaaagaaaauugcagcuugaagggaggugacuggaauggagguguaaaguggccagauccguguuuacuuccaaaggagggccaacagcauuugcagauaaacuggauguagauacagagucugucagaaaagacucaaagaugaugccaaguuuuucugccuaauuaacuguaagaauggugguaccauuuauugggcugcaacaggcuggugggguagagaauggaggaagaauacagagugguuuuguacauguucuguuaagacacuuauuagacaccuacagaaaugagucugggauucacugagaagguggggcugaagacaaauuugggagucaggagauagaugguauugucacaagacgaaucagacagagaaaacaacagagacugggaccugggguacuucacuguugggaggucaggaaaaugagaaagaucuaggcaaggaaacugagaaggagcagcuaaaaguaggaagagaacaaagaaaaugguagccaggaggccaagagaagaaaauaauuuaagaaggagcgaaagauaaggguugcugauaggucaaguaaucauaauaacagugacagcaagcacuuacaugacauuuacuauauaccaggcacugcucucucucuacagauaaggaaaaaaagaacugaaagauuaaguagggugaccauauaaguuacugauaaacugggacucaaagaggaugcuaauaauaauuacaucaggacaacaggcauaaaccaggacuuuccuaggcaaguagacauauggucacccuaagguuaugcaucucucuuaggcauggaaggaauucuuccuuguuucuuauucaguguucuaauuguaaccuauuguguggcuacugcuuuccuucccagccuugcaugcaauggacagacagguucugauacuuccuuucaaagggauuagccaagaaccaucccacagaggaaaucaaaacagugugugcauacacacugcuucugauacuuuuuucaaaacucuguggcaaaggauuuuucacugauucgaggagaaacaaauuuaaaagcauuuuaggccagaagcaguggcucaugccuauaaugccaacacuuugggaggucaaggugagaggaucgcuugaagcuaggaguuugagaccagccuaggcaacauagcaagaccuauaaaaaaauaaccuaaaaauugacccgguguggugggguacaccuauaauccagcuacucuggaggcugaggcaggaggaccacuugagcccagcaguuucaggcuacagugagcuaucaucaucagaccacugcacuccagcuugggcaacagagcgagaaucugucuuuaaaaaauaaaaauaaaauaaaaaaguacuuuauuuuauuuugagacagagucucuccagcccaggcuggagugcaguggcacaaucucggcucacugcaaccucugccucccugguucaagcaauuuuccugccucagccucccaaguagcugggauuacaggcacgugccaacacgccaagcuaauuuuuguauuuucaguagagacgggguuucaccauguuggccaggcuggucuugaauuccugaucucgggugauccgcccaccucagccucccaaaguguugggauuacaggcacgagccacugcgccuggcaacauaaaaguacuuuaaauguauuuaagaaaauauaggucaguuauacuggaaaauuauuucaauaauauauuuuaaaaugugcuuguuucacaagaacauagccaugaaugaaggaaauuaacacugcaaacuacgaaaguuacauaaacauacacacacaaacaagauaugucaugguagcuuuguuacugugaaaaacuuuuuuuuuuuucuugagauagagucucacucuguugcccaggcuggagugcaauggcucagucucggcucacugcaaccuccgccucccagguucaagcaauucuccugcuucagccugcugaguagcugggauuacaggcaccugccaccacaccuggcuaauuuuuguauuuuuaguagagaugggguuuccccauguuggccaggcuggucucaaacuccugaccucaagugauccacccaccucggccuuccaaagugcugggauuacaggugugagccacugugcccggccugaaaaacucuuaauagccuaaauaucccuaaggggagaacacggacuaguuacaugaauuacagcauaucuaucacagcauagcaaacagccauugaaaagaauaagacacgucuugaaaugccacauagauuucaagagcaucuaugauauacuauucauuugacaaauaguuguuguguacuuaauaccuacaagcuaggauaugguucugaauaagaauaaaaccagcauaauucaggcacuuguuuuuuguuuguuuuuuguuauuuuuagagacaaucuugcucuguugcccgcacugaagugcaguggcccgaucacggcuuacugcuggcuugaacuccugggcucaagugcuccucccaccucagccuccugaguagcugggacuguaggugcaugccaccacgccuggcuaauuuuuucauuuuuuuguagauaugaggucucacuauauuccccaggcuggucaucaacuccuggccucaaguaauccuaccaccuaggacucccaaaguguugggauuacaggugugagccacugcacccagccaguucuggcacuuguggagcuauguuuuagugaagacauauaggucuauggcacaauaaaauucaaaaaagcaaucucacaccuguaucacuguuguuuuacuuuccuaauaauacgaagaacuaaauuccucaucaaguucaucucaaaaugggaaagcagcagcagcaaauguucucaaccagagauucccuccaaaccacaugccuggaggccgggccagcacuucucugaaaguggcugucuauucacaccaaggacaaccagucuuacuuuugauuacuuaaccucauucuaccagcaauucuguuuuuauaaaauaucuuauggcacacaaauuuaaaucagacuaggucgcuagggauaauuuuaaacuuuuauguggagacaaacaugauucauaucaaaaggaacuauaaacauuuaucuuauaaaaauacccaaguacguagguuuaaaaagucaagagcuaaacagcacauguucacagaauuuaagacccugcucacaccauuuagagacacaaauuauagcuugucuguaugugcucagccuaauucauaguaaaagaaugccacaucaauuguaaaccacaugaaaagaaaguaaacauguaacucugaaucacauuuauaugcauauaauauaggucagauucuauagcuauuauugcauuuaguaaaaguacuuucauagugcuuauuugcaaaugcaggaagaggcuugcucacuguaguggccugaaugguggcauccaaaaaagauauauccaacuccuaaugccugguaccuaugaauaugaccguauuuggaaauagggucuuuacaguuauuaaagugagauggcccuggaccuaaauccaaccacuguuguccuuauaagagaaaggagggugagaugcaaaacacagaaaauaacccagagaggaaggccacaugaaggcagaggcagagauuggagggaugcauccacaagcaagccaaggagcacaaagggcugcugauaagcaccagaagccaggacagaggcauggaaaugauucuuccucagacuccagaaucaaccagcacgacaacaacuugauuuuggaguucugaccuaugaaaaaauaaauuucccuuguuuauaccaccaaguuugaggugguuuguuacagcagaccuaggaaauuaauauacacaucuaaaauagucauuuguuuacaaugcaguaagucucaagagcaaucaguaaagaaaaaagaauuuagcaaguauuuuuaauuuauuauguuauaaaacaacacaucuucauuguagaaaaucuggaaaaucauuagaaaaaacuauaaaauucaccuuuagaaccaaagcccaucuucacaaucucucaacuuuaaaaugugaaacuagacauguauuuucuagccugugagcuaaauaaccugaucuuaaauuguucaaauaauguccaucauuaaaugccuuuguuuacaauuagguuuauauggcacuuacacaacuaugaaauugagagucuaugauggaaauucugaucuaauuuuaacauaagccuuauaauugaaacauacaaaugggaacuacaaggagaguuuuauugucauggggguuuccagcgaggugcuuucccuugaucauuuuggguccuaaacuguucuggucucuaaucauaauuuacauaucaaccaaauccucaauuuuagaaauaauauaugcagaaauaagaagugcagaaaagcaauaaaugcagaacaaaauauuaacgaauuuuauucaagagcucuugacuaauguucuuccacauuuccauuacauuuuuuucaaaaaauaauuaucaauuagaugccauaaaauaaagaggaacaucuaacagcugccauguaauagcaaauguugaaauacugagaaugaaaaauagcuugaaaauuauugccaaaccaaaucuuugaaugcaggcacaugguuuuuuuguaguuuuuguuuuguugagauggagucucacucugucgcccaugcuggagugcaguggugcgaucucggcucacugcaaccuccgccuccagguucaagugauucuccugccucagccuccagaguagcugggacuacaggcacacgccacuaugccuggcuaauuuuuguauuuuuaguagaccagguuucaccauguuggccaggcuggucucaaacucuuggccucaagugauccgcccgccucagccucccaaagugcugggauuacaggagccaccaugcccagccaaaugcaagcacauguuuuaauauuucauuuaaauagccaugguuuuuguuauaaaaagcaaaagucucacuaacuccagguaaauuuuuaaacuaagccucuacuauuuaaauguuuauucaaaauuagacagcauccucauuccguaagugugagcugcacauaaggacuuccuuccaaagaauacaauauggaaaaggguuggggcagggagcaacuucauaguagagaaaccagacaaacauuaccucagccagaugaucagggucagcaucaacaguuacaaaucacgcugacagcauguacucuugauauaaugugaugaaaacgguacuucaccucuguggucuuccuaacccaaaacccauaacccuacaccugucaugagaagaacacuagacacauucuaauagaggggcacucuacaaaauacuuaaugaguacucuucaaaauaguugggucaucaaaaacaaggaaagucagccaagaggagccuaagaaggcaugacaacuaaauguaauguguuaucuugaugggauccuggaucagaaaaaggacauuagguaaaaacuauggaaaccugaauaaaguauagacuuuagcuaauaauaauguauccacauugguucauuaauucuaacaaauguaccauacguguuaacaauagaggaacuaggugacagauauaugggaaguuccuauacuaucuucucagguuuucuguaacucuaaaguucuuaaagucuacuaaaaaaaaacuacauggcagucauuucuaaaaaaugccaacugagguucuggauaagacuuuucuaaucacccacauguaaaagcuuaaauuuaauuaaggaaaacaacuagacccacuaaacaguuucuagcacuaaaauuaaauccacauuuuaggguacucagaggcaagauaaagggagaccagaucaacuccaccuuuuuaagcaaacauuuacugugauaagaauguaaaaauucagucucaaaaccacagagcuauuaaaaacauuaauuuuaaacuaauaaaaagacaaaaaaaacguaguucagaagagauuuuaaagcagaaagcccagaucagaaacccauaacaggaaguuugguccuucuuccaccaucuuggacuaaaauuuuacgucucugaacauauuugacuguuuccucauuuacauaauggaaagugacaaucgcacagugcaauauccaaaagaugcucaaaaaauagccugucauaaauaaaaauauaaaauucuuagucuuuuuacuucacucacaucugcuaaaaccaaugcuuucuuggugagguaugcaucagucugaagagaaucaaccaaaagagaaagacagaagggguacaaaggagggaaaaguaggaauagcauuuaacuauguauauuagcauuuuccaggcccuccuuuuuacaguuuuuacaucucccccugcaaaaguauccugaugaggccagguacagcaauccaugccuauaaucccagaacuuggggagguuaaggcaggaagauugcuugagcccaggaguucaagacuggccuaggcaacauagcaagacccugucucuaccuacuaaauaaauaaauaaagccaggcacggugguacaccucuguaguccuagcuaauugggagguugaagcaggaggauugcuuaagcccaggaggucaaggcugcagugagcuaugaucgcaccacugcacuuagccugggugacaaaauaagacccuguuucaaaacaauccaaaaacaguguccuaaugaaacucucauuucaacuaacacuuauuaagauaucccgaaaauuguuacauuguaauucaccaaacuuuggguucuacugcaaaugagacauuggaaauaacaaaaauaaaugacuaucaguuccugccuucaaggagucuacuuauagucaaguaggaggcaagacaagagaacaaauaaccaccuuuuguugacaggaggaugacaucaauuagaaaaugcaccuaauuacagagguguuaaaauaagaaauuuuuuaaugugugccuuagaaugaaggagauacuauaguuucugugugguaagaguaaauuuagaaaaagguacuauggaggcauagauguuaauguacugccauuuaacacugcuacccuuauagguguuggguggaguuccacagauucucaaucauccaaguuauggaagaagagaauucaaaacguauacaccuuaccaagaacagacguguuugcaaaaugcaagacagaccuguaaagaugcagaauaucuguauuaauaaaaucuuaggccgggcaugguggcucacaccuguaaucccagcacuuugggaggcugaggcagguggaucaccugaggucaggaguucaagaccagccuggccaacauggugaaaccccaucuuuacuaaaaauacaaaaauuagccaggugugguggugggugccuguaaucucagcuacucaggaggcugaggcaggagaaucgcuugaacccggaaggcagagguuguagugagccaagaccgugccauugcacuccagccugggcaacaaaagcgaaacuccaucccaaaauaaaauaaaaucuuaaaaggcaagaugaauucauauugacauuucacuaaauuauuugggaaacaaaauucaaagguaauuacuuuuaagaaacguagccucuaucaacaagaagcagaugaugaaugaacuuacuaguuuuuccucuugaucuuucccuacaaaacaaaucauugcaaacucuaaauguacaaaggggagcugagcacaguggcucauaccuguaaucucagcaagucaggaagccaaggcuggaggaucaauucagcccaggagugcaaggcugaggugagcuacgauugcaccacugcccuccagucugggcaacagagugagagaaugucucuaaauaaguaaauaaauguaugaagaggacaacuguaaaauaagccacauuucuaaaagagaaucaggucauuuucaaacggagcaggaagaauaaaggaaucauuuucaugauauuuccccucacuguuaggacuaaagcuguccuuuauacaggaaaaggaaacccugucuucgcaaaauccugaaggcuuuucuauguguaaacccuagagaaauaccugucaaaugaguaacuauccuaauaaauccuauauggauguucacuucuuuuaauacuugagugcagccgggcgugguggcucauaucuguaaucccagcacuuugggaggccaaagcggguggaucaccugaagucagggguucaagaccagucuggccaacauggaaaagccccaucucuaccuacuaaaagcacaaaaauuagcagggcguaguugcgcaugccuguaguacuagcuacuugggaggcugaggcaggauaaucacuugaaccugagaggcagagguugcagugagcugagaccaugccacugcacuccagccugggugacagagagagaaucugucucaaaacaaacaaacaaacaaaaaaaaaaaccuugagugcccagggaugagauggcaccuauucaauuaaccauccugauaagaaaagcaaaacccuucucucacaggaaggcuccugagcccagccaggugcagcacuaccugugucucccagugcuguagucauuccagcucagcagggcaguggaacagcugagacagaagaaauguuuccugaggaaggcagaguguuuaggaaagauaacccaaacacggacauuuuguacauucuuucaguccccacuuuggacuauugaaaaguaaauauaaaucagacuuuuacaaaacuuaaguauuaaacuucaaauuccuucagggaaacauaucuguauacuuugacucacacuuacugacuuggcaacaauacagcuaucauuuacuaugugucaggcacuaagugcuuuaccauauuaauucauugaaaccucacaguccaugaaguagguggucuuauuaucgucuccaucauacaggugaggaaagacuuuaaguaacuugcccagucacgaggcuaguaagcauggagcagaaauugauucccagcagucuggcucaauucugugccccaaauuacaucauuacaaugagagcuaccuucagaaaacaaaaauaaauguauugccccugcuuucucuagauucauggaguaacauguccagauuuucucaaauccaucuccccauacaccuccgucaauccugacauuuggcaauaaugccaagcaggaaaagaagcuuuucccaagguaugugaguaaaaccuguacuacaauaaaaauuauauuaacuauucagguucccucugucuuuuuuuuuuuuuuuuuuuuuuuugagacggagucucgcucugucgcccaggccggacugcggacugcaguggcgcaaucucggcucagugcaagcuccacuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucagccucccaaagugcugggauuacaggcgugagccaccgcgcccggccgguucccucugucuucuaagagcacagauaacugcaaguuuaccauacaugauggagaauuucugcuacuuccccuguaaaauauuuucaaaauaucuuacucacucaacugauaaaaggugauaaaccuaccuaaaagacuuuuggugaagagaaguaaguaucaguuguauuuuucagagcgcagaaaaguugugugaucaaaacaacaaaaauaagauuauaauuccaguuuacugauggacucgaaaaacauauacguuauaaaacaacuaaacaacucaacuguagcuauguuacauguuuaaaaugaacuaaucauuguaaaaauguuuaaagaaugggaaugauagcagaagaaaaaugucaccaugagagaguauaaagauggguuaaagguuuucuuccugcaaaacucaauuuguuuauuaaguuguagcacugcccacccaccgcaccccacaaaaaaagccacauucauuugaggucacuuuaccuccugcuauuuccuuugcagugagucugcaaaguucuaaugcacggugcugauuuuauucauugaacagaaagcaauugagugaaacauacaagcaacuaaaccuuuggcauccugugaaaccacaagagagcaagauauuuuuucccagguucuaacaucuuuuuaaagcuguuuuuucaaauagcaguaugccuagaaugacugcaugcuugucuagagucaugugcucaguaccaaaagccagaucaauugacucugagacgggaaaguaaucaagacaaaaaauuuuaauggaugucuuaauuuaagcagcucucauuuacuuauucuuucauuuagcuaauuucaaucuauaaacaaaauaaaagcaguagacaguuuuuccuauggaaacucauuaacacagcuuucagaguuaagcuucagcuuagcccagauuccccuuaaucaauuauuuguugcuuuuagaaaagguugugcaaaaacauuagcuaaaacugguuaaaauuaaagcacagggaaagaacuuuucugaaagauauuaaacauacuauuaauuuauuuuaaauaggauggauugguaaaaauaaaaauauaaaagaacuuaagucaaaauucauuguuuaagaaccuaacaaucauaaagucauauaaaguaguaugcaguaaaaugugggaaaacuauaaaaauguuaauuuuuauaguaacuuaacacaacaauuuaaaaaaaugguugcaaauggcugggcauaguggcucacgccuauaaucccagcacuuugggaggcugaggugggcugaucuccugaggucaggaguucgagaccagccuggccaacaugguaaaccccgucucuacuaaaaauacaacaauuagcugggugugguggcaggcgccuguaaucccagcuacuugggaggcugaggcaggagaaucacuugaaccugggaggcagagguugcagugagccgagaucggccagugcacuccacccuagacaacagaccaagacuccaucucaaaaaaaaaaaaaagauugcaaauaaguaaacacacgacgcacgucaauauuuuaaaaucuuaugucuauaccauuccuccuuccccuaacaugacuagucaacagcaaauuuuagguguucucaauaaauuucccuuggugaaaugguggugggacagggaagggaacuaacucuacaaggauggcacgaaagucccucauucuuuauacucacuuaaaagaaugaucaaaaauugucaaaacuucugaaguucuuguauagggguuggggguugggggcuacauuuguuauuauuuuugccaugucuuguguuuuguguuugaucauccaggagcaagugggaguggggagagcagggaagcuguuuaccuauuaagaccacuuuagccuaccuaugaucacuucuagccagguuggauggauccuucuuaauaaaggaaauaccagauuuagcucccuuuccacuaucccuggcuuguugcuggcugaaaauucagucucuaauugaaagucugacccauuucugaaauuuugccuguucuguguuuuuaucacuaaaugcuccccugcuuccauuuaagcucacccuuguuugagugaggugaagacaacauuugaaaauguguuugguuuuuuugaacccaauaaugcauuuaaaagguauauuuaauccagaucuaguuauuaguggcuucugguauaauuccucguacuguaaucauaugacaaugauuaguucauuauaauuaacuacaauugaacuuuguuuaguacuuuuaaaaucccaucuaccuagcuauaauaaaucuauugacuauauacuauuuaacaguuacuaugcuagacacuguauaaaaaacaaaacaccaccaauaaaaguguuugccccaaaagagaucacaaucuaacugucaagacaaauauacccaacaaaauaggugauaacugcuaucaggaaauaucaaauaugcugggcacaguggcucacaccuguaauccuagcacuuugggaggcaggggcaggugugucacuuggacucaggaauuugagaccagccugggcaacauggugaaaccccaucucuaccaaaaauacaaaaaaaaaaaaaaugagcccagcaugguggugcacaccuguagucccaucuacuugggaggcuaaacuacgaggaucacuugagugcaggagguugagacugcagugagcugagacagcgucacugcacuccagccugggugacaaugugaggagacucugucucaaaaaaaaaaacacaaagaaauaucaaaugcuauacaaacacauuccaucuaggaagacacagcuagcaacauuuccugcuucucuuccuugauguuuaauuucuuucuuccuauauuucccacaaauaacauuuuuuccaaauuauuuaccuaagaaaaccuuaaucauccaacaaguaauuccucuguaauacguauguuauuggcuaaauacagcaauccagaucuauaucuauguguuaaaguagucacagucuaauuuaucuugaacuuauuagggaaguacauaacaaccauuguuaaaauuuuaucagccauacccaucaagauuccggauuaaauguuaaaaauaaaugaaaucacaaacaagugagcaagaggcuauaaaaaaugaccaucaauccaaucaagacaaaugugaauuuaaaaaauaaaaaguuaaagaaugaccacuaagaucuuaagaggaaacacacagaacuuauggaaauaaaaaauauaaccuaaugguaaaaauucaauagauggacuaaaaagcguaucucuucaaacacugcuaaggagaacuaaaggacagacuauagugaacauaacuacagcuagaggagacauuuaaaagagaauacuaugaacaacuuuaugcaauaaauaugaagcacagacaaaauggacauacgccuagaaaaauacaaacucaaaauugauucaagaauaauuagaaggcuggguacaguggcucacaccuguaaugccaacacuuugggaggcugagaugagaggaucacuuaagcccaggaguuugagaucaaccugggcaacauagugagacuucaucucuacaaaaacaaaacaacaacaaaaaaacuaggccaagcauagcggcaugcgccuauagucccaacagcuuggaaggcuaagguaggaggauugcuugagccugggagguggauggugcagcaaagugagaucacaccacugcacuccgaccugggugacagagcgagacccugucucaaaaaaaaaaggauaaucagaaagccugaacagcacuaugacuaauaaaggaagaaaaaauaaaauaaacuucccccucuuccccccaccggcacacacacaaacuaggucuaaaaguuguaaaagcaaggucuaccaaacuuucaggaaacaaguaaauccaguaucacacaaauucuuccagagaauagaaaaggaggaaauacaccccccaagucauuuuaugaggccaguauaaucuggauaccaaaaccagacaagaacauuauuaaaaaaugaaaauuacaggccaauuucacuaauaaacauacaugaaaagaguccauaugcaaaauauuaacaaacagaauccagaauccaacaguauauaaaaauauacauuaugaccaauaugucccagaaauucaggaacagaauauauagacuuuuuuaaaauuauaaauauaauucaccauaugaacagacuaaagaaaaacacuauaagagauauggaaaaaggauaagaaaaugucacauuugucuuaaaaaaaaaaaaacuauagcaaacaacacuuuuuacagugaaacucauuaaaaucaagaacaaguauguaugucuacuauuaccauauuuauucaacauuacauuggagguccuaguuaauuuaauaagaaaauaaagugguauacaaauuuuuaagaauauauuugauaugauuaucugcacaggaaacaauauacauaauaauuauuggaauuagaauucagcaagguauuuggauauaaaagucuacauaguccccucaaccugucgaaaaaauaaacagcaaaaaaaaauaccacuucuguauaaagcuauuagaaagcuuaagucaaauaaaagacaccauuuacaacagcaacagcaaauauaugauaugcaggacuaacucuaguaaaaauauauucuagaccuuuagggaaagaaauaauuaagcuuuaaacagaggccaaaaaaaaaaaaaaaaaggaaaacguauaugaguguaaaagcauucucuucauggauagaauugucaagguaucagugcucccuuaacugacccaauuuaaauuuguuuuaacauuacuggguuuuucauagaauuugacaagcugaaccuaaaauuuauaagcaagaaaauagccaagaaauuguuuauaaguguaagagucaugagaauuuuuuuguuuugcucaaugccauuuucccagcaccuaaaaaguuccuggcacauagcaguugucuccaauauaugugcugaaugaauuuuugaaugaacacagcagggaaacuuauccuacccucuacgaaauuuagaauggaaaugacacaagaauaggcaaaaaagacaaauggaacaaaacagaaggccuaaaaauaaauccacaugaaugaaauucgauauauaaauagaagagcagaucauaggggaagcauagaacaguacucaaaaagugaugcugggauaacuaguuuaugcauguggaaaaaagcgagauugaggggagagauuauaaaggguucauaaaucucuaagcacagccuguauuaucucuagauucuuccuagcaaagccucacaaguuuuacauuaagaugcuauucuaauugagaaaauauauaguaccucaccuggaaugguaaugcacaauaauauaaacacuuacugcauguuagcuaucaucguaucugagcccucaaacuuacccugaugugaagccuugcuucaccacuucccagcuuugucauuggagaaguuacuugaauucaccuugucuuaccacaaaaugagcuugcacuagcacuuaccucagcaagaguacuguugggaguuucuuuuaauccuuuuaguauuuuuuuuuuuuuuuuuuugagacagagucucgcucugucgcccacgcuggagugcaguggcgcgaucuuggcucacugcaagcucugccucccggguucaugccauucuccugccucagccuccugggacuacaggcgccugccacgacgccuggcuuuuuguauuuuuagcagagaggggguuucaccuuguuagccagaauggucucgaucuccugaccucgugauccucccgccuuggccucccaaagugcugggauuacaggcgugagccaccgugcccggcuuccuuucaauauuuuuauuuuagaauggcauuaaguuuguagauuaacaauuagaauugacacuguuaagaaucugaauuuucagaucuggaaauauaguaugcuuuucuguuuaagucuuugucuuaaaaaaauuuaauguuugcuuuaaaauuuuguauggaagacuguaaaaaaaaauuuaacacacauuuuuuaaguguguagaaguagucuuuuuguuugcuauucuaaaaggggugucuucuuccauuguaucuucuacuugauuuguaaaaacucuaaguauuacauaaaauacuguccaauuguggaaugcaguagaggcuggggaaugagcagcaacugauagcauuuugaaggaggaucaagucuggaaucucacuaugcuucucucaucuccuuccuugaauuuaagauguuuuuuaagaauauuacagaauagcauucagcaaaacauggacguguacuagaaccccuuugagagaacuugguuuuuuauucuugaauggugcuaaaaagugaccuuauuaucccauagcauggaauccaaaaauaguaguaaagaaggcuuccacagaauaugugcaaaucugaaaaucucagggcauguaccuaaugcuauauuuauuuuucacaaaaccggaaauagugacagcuuaaaacaaguaacuagacuguuauauagcuuuuaaaaugcugcugcuauuguguaauuuuuagcauuuuguauauugaauuucuaugccaggaaguaugccacuguuaacuauuuuacaugaugccuaaauuuuauuuuaaauaaaaaguuaucacacauaucaaacucaacuacacaaauuguuauacuaaaacauuucaggaaauaugugcuuucuaacgcuaaugaaguuuuagaaaagauuguaaauauacaaacauaaaauaaacaaguaucaccaauucugaaauuuguuaaaucaguaaaagaauuuuaagggguaaaaguucuauaucuuuauaccagcugacuugacaaaauuaagaguuccaguaagagcaaaauguuguccucuauuugggagggggaggggacagggcacugagcaaucaagcaguuaaaacuccuaugucguaucuuaaaucacuuauaacaucaaaaagaaaguaaacauuucaauccuauuaagaauaugauuuuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuuggcaggcugaggcaggagaauggcgugaacccgggaggcggagcuugcagugagccgagaucccgccacugcacuccagccugggcaacagagcgagacucugucucaaaaaaaaaaaaaaaaaaaaaagaauaugauuuugcuauucuguucugcuguggaaaacuaaguagucacuuguuuaaaaacuaagaugaagcagacauagcauaaaccaauuaaaauuaaaucaaaacaacaguuuuaagaugcaauaugcauacaugaauuucuuaacagauuauuauaguuaaaauaccacugaguguacucacuucaagugguguguaaaaauaaaaauagcugaagagaggauggucaaaccucaaaacaaguacuauaaccaccacccaaaaaugcaaaauaaaggaaguugucuucuucagaguuaagaggaggggaaaaaaucuuucuacuuacacauugggaggaaguggggauggagagaaagaaaaacaauuccaugcccuuccuaaauguuuaagaacaaaugcaauuuauguuaccuucagaagcauuuuaucaguacccacaaaauugccuuuuaauuuguacuaguaaacuuacauugccugagcaucuuucucuaccccccuuucucuucacuugauuucaugugaaagucaaauuauuuguaugacugcuaccagaauuuuaauaaaaauugacacaacauaacccaaacaauauaaauuuuccccuauuuagccagacucuaaaugcuuuagggaaaaagaaaaacgugcaguacauaauuuaauuagguuccaacaacucuucacagauucauauauacuucucaccuguaacaacucaauagagaaaaaaaauucaaggaugaaaagguuuuauuuacuucuuuccauacggcagguaaugagaauggauguugucucuuacaagacacaggucaaacauaggaaagcauggaggaaaaaacacaaagaagccaaacuuagaccaaauguagcugugacaaaguuaaauggcuucauuagagaaaaaaaagucuugacaggauuuucuaaaaauaaaaucuaccacuguagugcuuacaaaguacauaaggcuaacaguaaagagugagaaaaauggccaggcgcgguggcucaugccuauaauucucgcacuuuuggaggccgaggcaggcggaucaccugaggucaggaguucgagaccagccugaccaacauggagaaacccaucucuacuaaaaauacaaaauuagccaggugugguggugcaugccuguaaucccagcuacucgggaggcugaggcaggagaaucacuugaacccaggagguggagguugcagugagccaagaucgcaccauuguacuccagccugggcaagaagagcaaaacuccaacucaaaaaaaaaaaaaaaaaaaaagagugagaaaaaauaauguagcaaauuuagucaagccaggaagacacguguaaaaacaauaucaaacaugguaaaauuuauuuggcaagagcuauaguaaaauuuuaagaugccauuaggcaacaguaaaaauaauauuuaggcaacaaaaaaguauaaaucaauguaaaagcuuagaaacacuagaagaaaaacagcuauaguauguaaaguaguaaaaaauauauacaugacacaaaguaaugacuaaaauuaaugcagaugcaauacacauacaccaauuuuuuuuuuuuucaacaagaguuucgcucuuguugcccagacuggagugcaauggcgugaccucugcucaccgcaaccuccaccuucuggguucaagcaauccuccuggcucagccuccccaguagcugggauuagaggcaugcgccacuaugcccagcuaacuuuguauuuuuaguagagacaggguuucuccauguuggucaggcuggucucaaacugccaaccucaggugauccaccggccucggccucccaaagugcugggauuacaagugugagcaacuaugcccggcacauacaccaaauuuuauauauauguguguguguguguguguguguguguauauauauauauauauacacacacacauauauauguauauacacacacauauacauacacacacacacacacacacacacacacacgcauauacauauauauauauauuuuuuuugagauggaguuucacuccuguuguccaggcuggaguccaauggcgcgaucucagcucacugcaaccucccuucgccucccagguucaagggauucuccugccucagccucccaaguagcugggauuauaggcaugagcccccacacccagcuaauuuuguauuuuuaguaaagaugggguuucaccauguuggucaggcuggucucaaacuccugaccucaagugauccacccgccucagcuucccaaagugcuaagauuacaggcacaagccaccacguggggccaaaauuauauauuuuaaagcagagauagaucaaacacaaaaugaaucaaguuaggcuuuuagaccccucgcauacacagauaccuuuucuuauucuaaacaaauauucacaugugcauaaucuuguauuuucuuuccuaaagaggguccucaaaauuauauaagcuguagguccccucaacaccuggaucugauuccugcaguaaacagcaaaaacauaccuuuucuaaugucuaaaacuugccaauuucuggccaugaugccaaaaguaaaauagaacaaaaaagcagaaaucaacaaagacuuaaauuuuaaauauauaauaaaaauucacaugaugaaaggacacauuuuaaauuaggaaauuaaaaacagggccaggcacaguggcccaugccuguaaucccugcacuucaggaggccaaggugagacagucaccugagcccaggaauuugaggucagccugagcaacauagugagacuucaucucuauaaauaaaaauaaaaauaaauuagccaggcguggugacacaugcuuguaguccuagcucuucaaggggcugaagcagauggacugcuucagcccaagaguucgagccuauaguaagcuaugauugugccacugcaccccaggcugggccacagacuaagacccuaucucuuagaaacaaugaaaaagaaaauuaaaaaauauccaaaugacucaauguaguauucacgguguaaugugaauguguucauuaaaagauguaaaaacacagcaaugaauucuaagauuuuagaaaacaaacccaaaggaaaacagaacaaaauaauuuaaggaaaaauacaaggaucuauucauugguaguccugauaauuuaagaacugcuuccuggccaggcucagcagcuuacaucuuguaaucccagcacuuugggaggcccaaucuauauaaaaaauuuaaaaauuagccgggcaugguggcacacgccuguagucccagcuacucaggaggcugagguaggaagaucccuucaaccugggaggucgaggcugcagugagccaugauugugcuacugcacuccagccuggaggacagagacccuguuucaauuaaaaaacaaaaaacugguuccuugggguugggggaacaccauacucagaaacuuaaaugaguaccacugaugagggggacgucuuuaucauuucagauucccugaaaaagcagaggcauuaugaugacauguaguuaacauuaaaaaaaauuuuuuuuucagaugauauaaauauucaaacgaaaaaggcuguaacaaaaauaagauacuuuuaaccacagcuauauguugagaaauuuaauuaaggcaauguuuucacaccaaauuuuuaagaagaaaaauguauuuacacauaaagcuuacauuucaagagguagaaaacugaaucaacaggaugaaauagacaaaauuguuuaucaacaauaggaguaacuauaguuaauaacaguggcaaauuucauuuguuuuuuguuuguuugcuuguuuuagagacaguucacuguugcucaggguggugugcacuggcgugaucauaguucacugcagccucaaacugcugggcucaagcaauccugcugccugagacuucuaaagugcugggauuacaggcaugagccacugcgccugacccuaaauccagauuuuuaaagaacauaaaauuuaaagcccugggagaauaugaagaugaacauacuacccaauucaucuuucaagucaaauauauucuuggucacaaguuucugugaaccuagaaacuggaaacaagaaacacaacacccauacaacuuaauaaaauaaacaagaaacugggguaaaaugaugguguauaaaaccccucaguguacuaaguaaauauauucuaaugaucuaacauaucacaguaauggcuuaacaaaaacaaagaggauccauuucuacagauaucaaaacagcaucugguaaaauuacauugcaaauaacauuaaaggaaaacacuaauaggauacuuauauaacuuauccaaaaaauuuuaaaaccauuguacacgauguagaaaaaaauaguuaacaaaacaagguuaucuacuguguucauuuuguuugaacuauuuuguuauaagguucuggccugggcaugguggcgcacaucuauagucccagcuauucaggagacuggcgggaggaucacuugagcccagaaguucaaguccagcguaggcaacauagggagauccccaacucuuaaaaaaaaaaaaaaaaaaaaaaaaguucuggcaagucuacuacagaaagaggauguaaguauuaaaagggaaggaacaaaugaaaaggcaagauauggacuagaagaaacuaucuguaauacacagcugacaaaggauuuguguuccaaauauauuaagaaacuuuacaacucaguaacacaaagcaauccaauuuucaaaagagacaaaagacauacagacacacaaaaggagcuauaccaauggccaauaggcacauaaaaagaugcugaauaucauuagucgucaaggaaaagcuauuuaaaaccacaaugagauaccacagcacagccauuagauuggcuaaaauacccaguaucgguaaagacccagaguaacuggaauuuccauacccaguugcugggaauguaaaaugguacaaccauuuuauaagaaaccaccuguuucccaaaguuaaacauccacuuaccauacgacccaauaaucacaacuugguauuuauccaagcaauaugaaaauguaaguccaaacaaugacuuguacaucaaugucuggggcagcuuuauucacaguuaaugaacauuggaaacaacccaaauguucuaucaauaagcagacaaguaaauugugguauaucauacaaugaaauacuaccaaacaauaaaaaagaacuaacuacuagccaggcgugguggcgugugccuguagucccagcuacuugggaggcugaggcaggaggcccacuugagccuggggagguugaggcugcagugagccaugauggcaccacugcacucaagccucagcaacagaaugagaccuugucucaaaaauaguaauaauaauaauaaaauaaagaaccauagaaacaagcaauaucauagaugaaugucaaaaucaucaugccaagcaaaaacaucccagacacaaaaagaguacauacuguauauuucuauuauauaaagucuagaaacaggcaaaacugaacaaugggaauaaaaagucagaagggagacaagggaccuucuuggagagauagaaauguccuauaugugcuuguaaugaugguuacacaagguguguaauuuuucaaaacucacaugacaggcuuuuccaaguaaaguaacagauaaugggcaaagacaugaacaaaucauacaaggaaaaaaaaugcaacaguaaaaauaagaaucagaguucccuggaaacaauaacaauauaaaccaaaaaaaguuuaaauaucauuuuauaucaauuagcaaauuaauuuacaacuuuuuucuuauaaaauaauuacaccauuguaaaaacuuuaugaaaguauaaagaaaaagauaacucaacauuugggucaauuucuauuucuucccauuguuuuaucuauuauuuuaaagauuaaaaaauaacacaaaaaguauuuuuucuucagguaaaucauaguauaagcaacuuaugucaucauauauauuucuuaaauaauuuuuauaagcuacaccgaucugcuuuaaguccacuagaaaaaagaguuauauuuaaccauuggucuauuuaagacaauucuaguauaucacuauuauaagucaugucaugauaaauaucacuguagauagauauuuaugguucuuaucccuggagguguauuuaucaagucaaaggaaaaggcgaggcuauugauaaauaacacuaaacuauacucuagaaaacuacaccaauuauauucccuuaagcuuauaaacucaaguuuuaaaaauuccuuuuccuuauaaacauauugcauguucaauaaagaaaauccagacacagaaaagaaaaaaacaaaaauaauuaaaaucauccauaauuccaccaucuaaggaugcccacucuuagcuuguguccuguuuuccuaugcauauauaauuaaaucuaugcuguacugugaauuucauuuuauaaucuguuuucauuuuauaaucuguuuuccccacccccacccugccccuuuuuuuuuggagacaggucucugucgcccaggcuggagugcaguggcagcgaucacagcucacugcaaccucgacuucccuaggcucaggugauccuuuaaccucuguuucccaaguagcugcaaccacgggcacgugccagcaugccuggcuaaauuuuuuagagacggguuuucgccauguugcccaggcuggucuugaaccccuggacucaagcaauccaccucccuccacaaagugcuggaauuacaggcgucagccaucucacacagccccgcccuuacuuuuaaugagcauuagcuuaccagucuuuuaaaaguaauuuuaaugacauggaccauauuuaauccaucuucauuauugaccacauaggugauuucuaauuuuuuuagauuaagcaacagucaaaucauugcacauauaggaaauuacuucaucagaaaaaguuaccuggaaaauaacuacugggucgaaauuuaugaaauuuaagauuuaauucagcuuguugauuuccaaucucaauagcagcacgagagugcccauuucccauaacuuuaccuauaacagguaguauuuuacuaaccugugucaauuugauaauuuaaaaaucguuuauuguuuuacuuuguccugguuuuuuuuuccuauucagugagggcuaacaauuuaaaauguuuauugauuuguuuuucaacugcucaccuugcugucauuuuaagauaugagaauuauuuguaucaucagcaaauuuauuuuaaaaaugcaguucuuguuguugaucauauccauuaaguuauauauauaauucugauauauccauguaaccuauucaauuacugauggaggguaaaacuuuuuugaaaagcauccauacauacacacacacacacacacacacacacacauaauggauuagucugucuccuacaucaaagaaaauuaucuagcugggacucccaucaaguucuuccuuguuucuaaaaacucuccugcauccauaaacauagccauauaaauauccuucccacccuucuagcgaguguuaaaaaaaaaaaguauauuauucugcccaucuuuuauccuucaguuagaaaucaaaucuccuccaaccuucucaaagguccuugccaucaacaacugucccuccuccaacaucuucccuauuguacuagcuuuuuccucagcauauaaacaagacaccuucuuuuucuaaaaacacucacaugcaccacugcacuaccaccaaccuagccccaaccucugcucuuaccuuccuucuuucuccuccaucaacauuuuucuugacugcccauccagcggucuggcuucuagucccacacugcucucuguguccuguucauugcugaauccaaacuuacaauuuucaccaucagauuauuuaccaaucuaagaccugugacccugcugaacacucaaagccauuccugaaacugucuucucuugguuucuguaauaccuaacaugauuugugucucuaguucuccaguggguucuguucagucaucuuguuccuuuucuucuuccagagucccuuuuaauggcaggcuuccagagucccaccuugagccggcagaccuccuuaacaugaaugauccucaucuacaccaacuagcuucaaaaauccuuacuuuacauucccaaaucuaccucugcaccuaaaucucuuaccuacacuucucuucugauuauaaaaagggauauauaccuucauauggcagccccugaagcaucucaaacucaacagguucagaacugaacucaucauaaauuaagaugaaugacaaaaugacuugcaauuugaaugaggcauaaaaauaucaaucuauuuuuugagcuagcagagaaguaaaaauagaaacaaaaucaaaacuucagaagaaaacaucaauuacaacauuacuuaauaaaccaaaaagcccuuaaaauaacuuuuucuucugaaaagauagaguagacauacuuuucccuauuucuccugcuaaaaacuaaaaauccuugacaaacauaagacucugaaaguuugagggaaggcauauagaccaacacuuuggaauccaagaaaccaacacuguggugaguuuccuggguuuucuuuuuacaacauauaucccagaguuggaguugaaaaagccagcaacauggaaaugccaacagacacagacaaaaaaaguacuaacaaaagaaugcucucucuagcuaaaggaccagaacaggacgucccagcaagacagaaaacuuuuagaugacagcugcucuacucccaacagacaccaaagaaaaaaccucugcccacaccagggaaggucaaguggggauccuagaaucccacacucaaaaggcuguaaaggggcaccccaacaccccacugcaguggugucagggaagaccaaguggggagcuaagacuuucaucccaacuggccagcaugaaccuccuucucccagcagugucaauggacuuccauccccaccaggcaguaauaaagagcguccccacauuuuggacuuaauguaagcugaguagggaaucuagacaccugccucaccucacaguaacaaggcagcacuucccuuucuccugccagagugguauccaaaaaagccagcuaacccagucuaaaaaaauacagagccacacaacaaaauaugaaaaugugcagauuucaaaagaaaaacccaaggaacaggaagaucccaaaccaaaugacaaaaagacaaucgacagacaccaacaucgagauaacaaagaugucagaauuaucuggcaaacauauuaaggcagucuccauaaaaauguuucaacagcuugaaacaaaugaaaaaaaagucucagcaaagaaaugaaagucucaguaaagacacagaaguacaaagaaacaaaugggagcuuaaaacuaaaaaauacaauaaucaaaauaaagagcucaguggauggucuuaacaguaaaauggaagggacagaagaaucaacaaacuagaaugcacaacaguagaaacuaccaaaucugaaaaacagaaaacacacugaagaaaagaaagcaaugaacagagccucaauagccuuugggaauguuacaaaagaucuaacuuccauguuaucagaggaucacaaugagaagacaaggagaauagagcugaaaaaguacaugaaauaacagcugaaaacuucccaaaugugguaagacauaaaccuacacauucaagaaguugaauaaaccccaaagaggaaaaacccaaugaaaucuacaccaagacacaucauaauuaaacuucuaaaaacaaaagacaaaaaaauauugaaagcagccuaggaaaaacaucuuaccuacaggagaaaaacagcagauuucucaucagaaaccauggggaucagaagaaguggcacaguaucuuucaggugcugaucaaagaaaacuacaguaccuugcuuauccccaguuucacuuuccuugguuucaguuacccacagucaaccacaguucaaaaauauuaaauggaaaauuucagaaauaaaguuucaaauuguuuaccauucugaguagccugaugaaaucucacaccaucucacccaggacaaugaaucaucccuuuguccagaguauccacacuguauaugcuacucaaccguuagucaucaacacugacacugucugcucugaacauucaacuguugacauuaucaugccucaacaagccauaucaucaugccucaacgauccaggaucauccaaagcagaugauucugaccauacaucagaaggucaauaguaacaaugcaacaucacaaugccuacaucauuuaccucacugcuucucaucaaguaggcauuaucucauaucaucauaagaauauagaacaaaaagauauuuugagaaagaccgcauucagauaacuucuauuguaguauaugguuguaauuuuucuauuuuauuaauaaucuaaucuccuacugugccuaauuuauaaauuaaacuuuaucguagguaucuaucuccuuauuggaaaaacaggauauguaggguucaauacuauccacaguuucaggcaucugcggggguugaaauauauagcccuugcagguaaggggggacuacuguauuaacucagaaucuuauguacaguaaauuuuuuaaaaauuguucugggaugaaggagaaaucaagaccuucucagauaaggaaaaccaaagagaauguauugccagaagggccacccuaaaagaauggcuaaagaaaguuccuuaaacaauaaaaggaaccuugaaacaucagaaaggaaaaaacaugguuagcaaaaauauggacaaacuccauagcuuuccuucucgaguuuucuauaguaugcuugacaguucaaaaaaaaaguuaauacuguaaaauguauauagugagaauauuuaaaaguuauauuauaaacaggaaaauaaagggacauaaagguuuccauacuuuauucaaacuggcaaaaugacaguaucaguagguugcaauaaauuauacauaaauaauguaauaccuagaguacccacauaaaaagcuaaaauccuauaagguaaguacuauuaucauccccauuauauugaugaggaaauuaaggcucagaguugcauaaggacgcagauacuaguaaguacaggcugaguaucccuuaucugaaauacuugggacuagaaguguuucagaucugaaauuauuuuggauuuuggaauaucugcauauacaugaguuauccugggggaugggacccaagucuaaacaugagauuuauuuauguuucuauacacuuuuuacacauaucuacaagguagcuugacacauauuuuuaauaauucuguucaugaaacaaaguuuguguacuuuguuucaaggucaagagcaaaacugaggucaaguuuuaaauuuuccacuuguggcaucauaucaugacucaaaaaguuucagauuuuggaguauucuggauuucagauuuuugaauuaggaaugcacaacauguaaagaugagacucaaucccgaagucaaauggcuccaaauccuaauuuuuuuuaaaccacauuaaaaagggguuuuggggauuuaaagcucagaguuacagaaggauacagauacuacaaaacagugaauaugggacucaaucccaaauucugauuuuuuuuuuccaccacaauagaaagggguucuugggauuuaaaacuucaaaacaugauggggaaacgguuuuucacuaaccucuguuaaaccaaacuuaugugacgccaucuguuuggacugagcuucuguacuacgcccaaaagaccaaaccaaaaugaaguuacccaugcugaaugaaguuccacaccaccacgccauuuaucugaccuucuagaaaucaggagaaugagagaugacagccaaauacccaaacaggccaauuuuagcuggcacaauaaggaagucccaucugcuuuaaccuuuacaaggaaaauaacuuuaaaaauaucagcuggcccgggcucaguggcccacaccuguaaucccaguacuuugggaagccgaggugggaaaaaucacuugaggccaguuguucgagaccagccugggcaacacaaugagacugucucuaccaaaaaaaaaaaaaaaaggggggggggggaagaaaaaaucuauaauaaaaaaauaaaaagaccgauccauuuuuuguuuuguuuuugcuuucuucagcccuuuucugucuauaaagccaaacugcugugcucaguucaucagaacagucauucuauuuuauaaaaugagauguugccagauucuaggaucaaaaagccaauuagaucuuucaauuaaauuuguuguaauuuuguuuucugauaccuccaacugaaacuuagcacuuccucuauaaagcacucuagcaauaccugcugauugucaacaacagacgucagauauuuucauguaauagcuacugcagguaagucagaauagcauuuacacuacuaaaguuaaaaagaaagaaagaaaauagaaaguuaaaguuaaaaaagaaaguuauuaaaguuaaaaagaauuuuuuuaaaaaguuaaauaauuuugcuucuaacauuuugauauuugaauuuaaauguacugguuccccuuauaaucauauacauuuuauuuuauacauuuaaaaauaguauucuggcugggagcaguggcucaugccuguaaucccaccaccuugggaggcugaggugggcagauggcuugagcucaggaguucgagaccagccugggcaauauggagagaccccgucccuacuaagaacacacacaaaaaaauagccgggugugguggugcaggccaguggucccagcuauucaggaggcugaggugggagguuugcuugagccaggguuuggggguugugggggagguugcagugagccgaggucgcgccacuacacuccagccugggagacagggcaacagagucugucccucugucucccaggcuggaguguaguggcgcgaccucggcucacugcaaccuucgccuccaagguucaagcgauuucugccucagccucccaaguagcugggauuacaggcgcaccccaccaugcccagcuaauuuuuuguauuuuuuuaagcagaaaugggguuuugccacauaggccaggauggucccaaacuccugaccucaagugauccagcugccucggccucccaaagugcuggaauuacaggagugagccaccgcacucagccaaaaaaaaguauucugagaaucccacaggcuuuaccaaacuaccaagagcccuuuacacaaaaaaguuuaagaaucccuacauuaagaaccauuuccaauuuauuaaaaagucuuaacagaccacagcuucuacuugucacuggaaugagaagaauggcucugcuagaagacaccgaaagaaaaauaccuacaaaacuaaaccaugcuagaagcaaaugcuuuuucaaguucucaaaaaucaauaccguaagaguuagacccuuaguucaguaaaaaucuauccacaaucaucaaaggauccccaauuuacaccaugaguuaauuccuagguaauucccaaaaaggauauaauccaaaccucuaaacucaagaacaagagcacuuuuuccaccuuccccaaccuuccaccucuuaccuaccccuacccauuuccucuugaacauuauaaucuguaaaucuaaagauggagaguuccuuucuugaggaaauuagcaacauucaaauguauauacuuucacauucuuguuccaagaacacagaauuccuuuucucucccccaucccaccucucucaaaggcauaaguacccaaaucaggcaaagccuuuaagaugaacaaugaccacggcauuuuuucuaaucccaugaugaaaauaagauuccugucauacgcaaagccaccaaaagaguggcagcacauuuuuuacauaaauaauccuaucccucccccugaaaauucaacacuugaugaaaaucuucucgguccaaaaguaauccauuuucuaaaggaauaaauuucaugagcaaaaaaagucaacagcauagcacagagcacaggucuaguaugauacuccagguuuucuuucaaucgguaaaccuaccucaaacuacauuaugugggcauuuguuuuguauaccuacaaauaguguuaugaauucggugcugagaaaaguuaaaggcauuucuguauauaggaaacuaaaggcaaaauuaaucaucaguuccuguaacuaccaagacaaaaauuagauacugugcuuuggagaaaucuucagaaaccauguauaguaauucuuaaagcaaaucauaacacacacauucacguacaaguuuuauccacaaauugaaauaugaauuucuuacuguaauaagaauguacucaaguuuuauuuguuguuugagaaggaccaaaaaaaaaauaaaaauaaaaauaguuuccuacucugaaggaaaaccccugaagaaaacacuugugucucgucaaacaagucaugauaccuuuaacaccaaauuaacagcuaaaaauuuccauuugacuacacaguuaagucagaguacauucucuguucuuaauuaacuauaaaauaccucagaaaauguuaugaaaaaauauaaauacgcauacucaccucccgacuuaggaaacaaaacauuuguaauaugauugaagacucuugcaugccuccucaauaauauuccccucucuccucccccaacaccaagagguaaucaauauccugaauuugguaucugucauucucaugcauuuauacaacauuaguaaucauaugauaguauuccuaaacuacguuuuggagaggacaccacugcaaaucuucagcucuauacuagcuuuuaucaguagccaucaauugcaguuuuaauagaaauacaaauacaucaagugugcuuuugggugaaaccucacccuucccucuccuccuaccccacugcuccucccagauucaaauuguuaacacagucacaugaccaagaacuucagaaagaguaucuaucacucuuuucagcuccccucuaguaaguguuggcacuuuuauuccaacuuaacguuaauaguucuguagugagaagaggaucauauuuagaaauacaaaaaccaacuuaaaucccagcuucgcuuuuuacuugcuacaggaccuugggcaaaucccuucuucccaagccugcauuuccucaucuguaggauggaaauaaugaccaugacgaugccaugcugccuuccaaucauaaaggguuguaacugguagaaaaugaaauagucauaauuacuucaauguauuuuucauagguaccugcuccuaauuaaaaaacaaaacuugaaacccuuaguaauauaauucaguuaccgcauuguauaggaaaaugaaguccaaccaaccaaccagcuuaucaaaaauacaaaccaaaguucaucaauacagguucuauacaagcuauagaacaugauauuauaccuuuucauuucauaauucuauugaaauuaaugcaaacucaagguuaauauuaagaaaauagaagaugccuaguuucauuaucuagauacuagcuacuuauuugggggacauaauuaauguauggugccuuuuucaauguuaaucacuuaacuugucucauauacauauuucacaacugcaacuuuaauuuucaaagaauuaaaaauaugacaaggcugaaaucuaugucacauaauucauuuuggcacuacucuaaguaaacagcuauugauaggaguaaaaacgaagaaaagucacuaauuacuagauccauuuuaaguaauaauguauagaauauuacaagagguucuguuuuuaaaagaaaaggaaugugggguauuuugugacaggccaguaagacagcuggaacaaagcuguuugagcaacagcugugcaccauguacuguucaucuaaaaccacaaacuaaaguaacucaugucagacaacuucauuggauaaucagcucagccaauggcuucuuucugaaacucucacuacaaagaaauagacacuaaauauauacuuugcaaugauuugaggaaggagacaaaauaaacaauugucucuaaauauaaaauuaaaaacuaaaaauuacagacuaauagugaaacagaagacaaaguuuuccauacuauuuucacaccucuuaggcuucauaauaguaaggaaauaacccaaagacucaaaacuuaaauuugaauuacuaauaugcaaccucaccauuccuacuccauucuuaauuaacuuucaaaugaaucaaagugcuucgucauaaaacaucuucgcagugguuaucagaaauuuuucacauuaagucacuugauaauuuuaaaguaguucccuguaggccaggcgugguggcucacgccuguaaucccaucacuuugggaggccaaggcacgcaggcagaucgcuugagcucagccugaguuugacaacagccugggcagcacggcgaaaccccgucucuaccaaaaaaaauacaaaaauuagcggggcaugauggugcacgccuguagucccagcuacuuccggggcugagguggaaggaucgccucuacccggcagaaggagguagcagugagccgagaucgcgccaaugcacuccagccugggugacagagugagacccugucucaaaaauaaauaaaauaaaauaaaauaaaacaaaaauaaaguaguccccuguaaucccagcacuucgggaggccaaggugggcagaucacuugaguccaggaguucgagagcagccugggcaacaaggcgaaacccccaucuuuacaaaaaaauacaaaaaucagccgggcaugguggcgcacgccuguacucccaguuacuggagaggcugagguagaagaaucacuuaagccggggacaucaaggcugcagugagccaugauugugccauugcacucaagccugggagacccugucucaaacaaaauaauuuaaaaaaaaaauuuuaaguaguucacuuaaaccaacuuguuggcauggaaauuccaugccauuaucugaaaauaauaauucauguaguacucaagcuacuacaaucauuaauuuaaacaucugcaacucgucauuaaauuaucagacuuaacuuuuguuucacauuuccacuuuuuuauuccaaaaacccacaaaccucucucuaaccuuaaauucacuccuuccucaaguaaaauguaugccucuguguaccugcacacaagccuacuugcauggggcaaauuucccuuaguugacacaccuuaauuuuagaggcaaaaaggacaaaauuacaaauuuaauagccacauaucuuuuccaugugauuucugaaacuuaaacauuaaaucuaccacaaaucuuccucugcaguuugacuugacuaccugcuuagcuuuccuuucagcucgcaucuuuugacuacugaaacgucaaccacaucgucauuaaccaaaaacaggcauuaagagaaaauucaucaggaaauaaaacaaaaguuacaacuuuuaagaccuuacucucagacuguuguauacuucccaagucagaauugccagacagaaauuaagaaaggacuaucuucuccaaagacuauuuuggcuaaaaccgaaugcuacggaucaacuucuaaaacucaagauucaacguguauaugccacacaugauuucugaaauccaaaaugauagccagcucuuucucuucuucaguaacuagaugcuauggaaccauaauagauacaacucaucuuuccaaaagccucuuuuuuccacuauuuauuuccugugcccuacucaagacuuuauuuuuuuuuuuuuuuuuuuugagacagucucacucugucacccagacuggagugcaguggugugaucucagcucacugcaaccuccacuccuggguucaagagauucuucugccuuagcuucucaaguagcugggauuauuggcgcgugucacuaugcccagcuaauuuuguauuuuuaguagagacgagguuucaccaugucagccaggcuggucuggaacuccugaccucaagugaucugcccuacucagccucccaaagugcugggauuacaggagugagccaccgcaccuggccuccacucaaaacuugauacuagcaaauagcaacaaauauuuuguugugcuuaguucuguguaacaaagguauuccuagucuacgauucugaaaaugcaaauaugaauaaaauguacaaauauaacuaagagacauagauacagacaaagcacaccaaauauauaaaguccucuacuaaaauacuuauagucuagugcuuacaggguuuaagauaaugucaaggugaaccagacacagaucguuguucaaggucugagcuacagaagaacaaaagaaggaaaaagggaucguuuucuaauccauaaccuucuuuuaagaauacacacacucuuccacuugccucacugcagaaagcugugguaugaaggauuuaaaaacuugaaaacuaucccuuuuaaacaucucuaauucuacaaaaguauaccucucagccaaaagcccauauuuggagauuaagauuuagaggguguaguaaaauuuuguauuuguugaaauucugcuacugauaaucuccaagaaacugaagcucuccaacgucaacuugcuguuuagcaccaaaacaaagcagaaaucucaguaccccaaggcaauucugagagaugaccagcucuuaacuuccuaaaccaaaaauagcuaugagcaacucuucaugaauaaacaagaaaaacaaauauauucuuccacacaaagaaaaaucacuucccuguaaguuguuucauuaaauaguaucaagcuuuacaaaaauaccaguuuuguggccuucugaaaagacaagagaacauuaccguuguuuaauaucagaccgagaaaucaagggcacuaaauauguuuuggagacaguaauuaugugugacauccagaaaauuucaucaaggauggagaagacaaauuugauaaaucuuccuagaauagagaggaucuuauccuuuucauuagcuaacuuaaaacaauguacuauaaaguuacagaaaaucaauguguaaauaauagguacuuaagaagauaacugaaaaaaaugaauacaaaaauggagaagucuucccagaccugagaguguuucaucauuucccugagaauacuagugacagagaaaaacuucuagucauauccugauaaauguguccauuuccaaugauaagagaaugcugcaagcauacaccuagugaaguuauuucuacagaaacuugaggccagacaaagauaacaaauaaagcaggaccucuacuguuauaacacaaaaauguugggacccaauaauuuuauacccagccaaaucaucauuuaucaugcaaaaguaaauuuaaucuuagauauguuuucaguaaaaaguacuuggaaauguucuuuaaaucacaauucaaaauaaaaaguagcuguaaagcauaguaacuauaguuaauaacaauauauuguacucuuguaaaaagcugaguggauguuacauguucucaccacaaaaaugacaacuaugugacauaguacguauguuagcuauauuuagucauuccacaauguauauauacuucaaaacacccuguuguacauaauaaauacauacaauuuuaucugucaauuuaaaaauaaaaaggccaggcacagugguucacgccuauaauaccagcccugugggaggccaaggugggaggauugcuugaggccaggaguuuaagacuagcuugggcaacaaaaugagaccccaucucuaaaaaauaaaaauaaaaaaguuagacgggcaugguggcauaugccuguaguccuagcuacucagagggcuaagacaggaggaggguuacuaaagccuaggaguuucaauguugcaguaagcuaugaucaugccacugcacucccgcuuggacaacagagcaagacccugucucuaaauaaagacaauuuuaaaaauaauuaauuaaaacuagcuguucaugaggauuguuuguaaacacuaaaaccagguagaaugauagaaauggcaaauaaaagcaauaacccuuaaugacaaacggauuaaugccaauggguauuaacuauuguaauuguaauaacaaaacagaaugcagaagauuuuugaaaucuuuuaaaaauacugaaucugacacaauuuugguuguuguaaauaaggacaaaaaauguacgaaaggaguggguagaaacaggguuaacaaaagugcuuaauucucauuuucuguaacugggaauaagacacuauuuucugauucccuaauuauguauguuuaaaaauauaaaucauuuuauacagggacagauggcucacaccuguaaucccagcgcuuugggaggccaagacaggaggaucacuugaggccagaaguucaagaccagccugggcaacauagcgagaccucgucgcuacaaaaaaucaaaaacuuagguacaguggcucacaccuguagugcccgcgcuuuggcaggcagaggcaggaagaucauuucagcccaggaguuccgagggugcagugaccugucaucacaccacuacacuacagccugaccugggcaccagagcaagacccugucuuuaaaauuuuuaaaagaauauaaauaauuuuuaagauaaauuccaguagaaaaaaaaaaaucuacuuuccaaaaaccaccacagaacacagaaaaaaacaaaaacaguuguacagcaaaagacacacuuggugcaaagggaggaaguuauuaugcuaaauaaagauuagaguuuauggacaaaaccuuacuggccuaaccuaaauuuaucaaccuuucccucccaagacaucuggcuacaaaauuaagaagauauauuuuuuaaacagaaaaaaaccugguccccuuuaugcucugcuugguuccuuuaggcuuaauuucauucaaugccucgcugaacaaauuauaaagacaagaucucauuagcauaacaaaguaaaacaaacucugcucauuauuauuauguagaguaacaucaaagauguugacuuucaucacaugggcaaguuggugucagauuucccccuguaaaguuguuauuuucccccuguaaaauuaacaauaacuuaugagaacauacuuugagacuauauuaacaucuacuacucucaaacuuucacauacuaguuuuaacauccauuuuuacccacuuaguuuuaagauccauuuaugguucuuacuuaaaucaacuguuauaauugccaaaaggcaacuuacuaauuccaccuuuuccuuuauguucauucauuagucagaauucuacauuaaggacuucuagaucauuuauuuaucauagauccuuacucuauuuauggguaauaaacaaguacugccuuauuuauuucaaugauuaaauugcccuauagucagucaaugggaguuuugccaggcuggcuccugugucucuuucaaauauccccaucauuuuaccuuuuugagcacucccuuaugagacuacaagaugcuccaagcauauuuuguauuuuuuccuuccccuauucuggaauccuccauuucucuaagguuccuuccaguagagaauaguauuaaugguauuuagaaaccaagaucuagugcuaggugaucucauugcuaaagggguaucacugcuuccuggccaucuuagcagacagaaguggaaaaagauguacagauguacgcauguguauccauaaugagaucuauuucuauaucuacauacuucuuuuuuuguuucuuguuuuugagauagagucucgcucuguugcccaggcuggagugcaguggcgcgaucucggcucacugcaagcuccgccucccagguucacgccauucuccugccucagccucccaaguagcugggacuauaggcacccgcgaccacgcccggcuaauuuuuuguauucauuuuuuauuuuuauuauuuuuuuuagagacagagucuugcucugucacccaagcuggacugcaguggcgcgacuuggcucacugcaaccuccaccucccagguucacaccauucuccugccucagccuucugaguagcuaggacuauaggcacccgccaccacacccggcuaauuuuuuuuuuuuuuuuguauuuuuaguaaagagggggguuucacuguguuagccaggauggucucgaucugcugaccucgugauacacccgccucagccucccaaagugcugggauuacaggugucagccaccacacccggccuauaucuacauacuucuaaaacuaugaauuuaugccacuaucugcaauuccaaucaaacaucagaguucauuuuaaccuucacauuuuucaccuuuguaacucccuucuccaacagugagaaacuggcucccauuuuccacaauauauuuacuuauuugcuuauaacaguauagacaauugcuucaaaauugcaaacccaugccuuuaugacaacaacaaaaaccaaaaauucuaguuaacucuauuaacuagaguucaauguuucuuucaaucuuuuugucuuuauccugaggacagaguucaaauacuaggaucaaaaguuaccuaaauuaguuguuuuucacuccuucaguguaguuaaguuacucauuugaaauacgguucaguucauuuguuucuauuuguacucccuguuaagguguuuuuauuugucaucaguugauuugguugguguguuugcugcuuauauacucaguaugugaaacauuaacaugguuucaaaagucagaaagguauccucagaagggucccugcccccauucccucuauccuuuccaccauauaccuuuuuacccauccucuaggaaaucaaucuuaucaaccuccaauuuaucuuuguguuuuguuuuugccccaaugaacaaauacauacguauuuucuuauuucuccuucuuucuuacacaaaagguaguauacacacaguaguagauacuuuugcacuuuuuuuucacugacuguaaguuugguuugugcgauuccuccaaaucucauauugaaaucugauccccaaaguuggagguggggcuuaaugggagguguuugggucauggggaugaaucccucaugaauagauuaaugcccucccugggacuggggugugagugagcucuuacuuauuaguuccaccacagcagguuguuaaaaagagccuggcgccucccccacuggcuugcuuccucucaccaugugaucucugcacaugccacuccccuucaucuucugucaugaauggaagcuuccuuacacccucaccagaagcagaugcuaguacugugcuucuuguacagccugcaaaaacucuaagccaacaaaaccucuuuucuuuauaaauuacccagccucagguauuccuuuagggcagggguguccaaucuuucgauuucccugagccacacuggaagaacugucuugggccacacauaaaauacgcuaaacuaacgauagcugacgagguuaaaaaaaaaauugcaaaaaaaaaaucucauguuuuaagaaauuuuaugaauuugucuugggccacauucaaagguguccugagccgcaugccacucgcaggcugaguguuggacaagcuuguuugaaagcaagacaaaccaagacaagugaacaacauauccaagaaagcacuccauaucaguuaaucaugcccucagucuuuuucacaggugcauaaugcuccauuggauauuccuaccacguagacugcuuguuaauuuuuguaauuaagaaaugcugcaaccuuguacauguguauuuucauacugugggaagugcaucuucuggguaaauucugagauuugggacugcugagucaaaaggcauguauguggucaaauaaacacaucuuauguugccuaauaacacauaauuucuguauuauuucugccccccaaaaaaugcauaaccugaaucuaaucaugaagaaacaucagccaaacccaaacugaggggacucuauaaguaacuaauuuguacucuuuaaaaauaucaaugucauaaaacacagagacuaaagaacuguuccaaaguaagacauggaaauaaugaauuggauaaucugagauuuucuuuugcuauaaaaggcguaacuggaacaacuggcaaauuucaaacaaauucuacacaucagguaauaguauaauaacaaaucaauguuaauuucugaguuagguuaguauauuuuauucaugaaagcaaaugcagccaggcacaguggcucacaccuguaauccuagcauuuugggaggccaaggcagguggaucacauaaggucaggaguucaagaauagccuggccaacacggugaaacuccgucucuacuaaaaauacaaaaauuaguagccgggcaugguggcaagcgccuguaaucccagcuacucgggaggcugaggcaggagaauggcuugagcccgggagguggagguugcagugagccaagaucgcaccacugaacuccagccugggcaacaaaagugaaacuccaucucaaaaaaaaaaaaaaauuagccaggugugguggugggcgccuguaaucucagcuacucgggaggcugaggcaggagaaugccuugaacccaggaggcggagguugcaaugagccgagauugugccacugcacuccagccugggugacagagugagacuccgucucaaaaaaaaaaaaaaaaaagaagacagcaaaugcccugguuuuucggaaauacacaaagagauauuuaaggauaaggguggcaucaugucuucaacuuacauucaaaugauuuuaaaaaccauauauugcagggaauaagcaaauauaguaaaauguuaccauuugggaaaucugguuaaagucaaaaaagaaagcaacaucggaugucuuuuuaacacuuauauucuuauuucuacugcugaauuuuacuuacauggauaaagagcuuucucccagaaaaaagaaucauuguauaaggugacaguaaguuaaagacggcaauauuaaacuguuaguauauaccgacaauaaacugacugcauuuuuaauuaaacuauaaguuaaagcuguucagugcuaugcaacaaauaaucacauggccuuuauaaaacacuaaaaauaaaauauaauuuauaagacaucaaggagcucaguccaauuauucucaaguacaauuuaagacaauuuauauuucuuugcaucuuugaaacacauuuuucuuugcaaaagaaauaaaucuaaggccuaccaacuacaaguuuaaguuucaaucucaaacagacucagcagcucugcccaaaguaauucaagaucaaggccuuucaacaaaauucaugacuauuaacuccauacugucuacacgcaaagugaaaauccuuuacucauuaucacuuuucauuaaggaaggcacgguggaauuaauauccuaaagaccauuuuccccaaccagaaaaaaaggcgugucaaguggcaucacaaaaucuguuucaauuuuaaagaccaacuuuaauuugaaaaagaaacuuuuaaaauauauauauauagagagagagagagagagagagagggagagagagagagagagacauuuuuuuuuuuugagauauagucuugcuguguugcccaggcuggagugcaguggcaugaucuccgcccacuacaacccuccgacucccagguucaagcaguucuccugccucagcuccugaguaguagcugggauugcaggcgcccgccaccacacccagcuaauuuuuguauuuuuaguagagacaggguuucaccauguuggccacgcuggucucaaacuccugacuucaagugauccgcccgccucagccucucaaagugcugggauuacaggcaugagccaccgugcccagcuaaaauuuuuuuuaauagcuuuaagaaagucucuucccacucuacucccccaauuuaaaguuaucaauuuauuuuccuaacugaauggagcagacuauuuuuauucaaagcuuaggaaagaccaugauauuucagcaaucagaugaauuaaaaucccaucccgguaagcaguagccuguuaucuaccaagggaaagcaguauucuugaccuacucaacaaaagugcucccacucggccaggcauggugcaggcccaggcggguggaucaccugaggucaggaguucaugaccacccuggccaacauggugaaacuccaccucuacuaaaaauacaaaauuagcugaguguuguggcacaugccugucuauaaucccagcuacuugggaggcugaggcuggagaaucgcuugaaccuaggauguggaggcugcagauagccaagaucacgccauugcaccacugcacucuagccugaacaagagcgaaacuucgucucaaaaaaaaaaaaaaaguguccccacucaauuccuacaacuuccuuaucccaaaacagggguacgcaugcacacaaacacacacacacagagacagacacaaagagaaagagaaugaacaaaacaagaauaagacguaaguuaagaaacugcagguuaaaauuuccuucuucuccaaaggcagucauccucuauaagaaaauguucuuccuuggguguacagaaauuuuaucuaggaauugccugcaggaccauuucaacuguuccccaaacaagaaaaccuuuaguaugguaccacuuugggggcaggugucuuauuucucaaugcuaacaauucauuuguacauuaauguuaaaaaaguuuaaacacuaaaaaugucuaguuucaaaauaauagauaaaaguuaacaguuuaaguaguuucuaauugcaggaaaaaucuucgagauguagcaauggaacagcaaauugggaauuuaaacucacaaccuucacauguggaucaauuaacuauuaacacaaaucuccugaaaucucuucucggcucucugccccaggaaaaagcaaugaaaaaguacucagcaaaagacaaacuuuuaaaaagcaaugcuggguccagacuaacaggucauaggacugacugaaauucaagacgugagaaaucagcuaaccccuaccuaccucaaaaucuggcaaauuguugaauaaaaaguuaauaugcuaaaaaaaauauauaaaccucccuguaaauuuuuaaaacauauauggccuuuucucagaguuaccagauaaagcacuaaccccaaaauuaaaugcuuaccucauuauuucuuaaaauuaaauccaaacugacaaaaagaaauuucuccaacucaaaacggaauccacauucaucaccugaauaccacacagaaguaaggaggggaguauaggguugagccaggaaggagagggcaaugaagacuuaaaguaauagaccagauuaugugucaaagaaaaaugaaaaaauuacaaauuuuguuuuggaggaacaccaagauacagaacuaacagcagcaaauaaaaccaaguaacaauuucuuuuuuuuuuuuuuuuuuuuugagacaagagucucacucugcugcccaggcuggagugcaguggcgcaaccuugacucacugcgaccuccaccucccagguucaagugauucucuugacucagccucccgaguaacugggauuacaagcacgcaccaacacgcccggcuaauuuuuguauuuuuaguagaggugggguuucaccauguuggccagacuggucucaaacuccugaccucaagugauccacccaccuuggccucccaaaaugcugggauuacaggugugagccaccacgcccagccaacaauucuuauuugcuuacucuguagauggcacggugcuggaugauuuaccugcauuauuuuauuuacuccaaaaacccuaaggguacuauuauuuaauguuauucucccuucucaaauggugaaacuuggguuuagagaaccuaagaaacuugacuaaacacacagcuaguuaaaugaauaaaaaaaaaaaaacacuccuagaauuucaaaagugcagaaauuuguucaaccaaacccaacauuucauggggaagaaagagaagcucagucgagauaaaggcagauuaagaaacuacucaaagucaccuggguagagagacauagaccccacacacccagcagucucuccuaaccacucuguaccauccugaagucauuuccuaccuagaguuuacuuaacauuuagguguucuaccuaccaacagaacuuuacacauuuuucaaagaaauaugagcaacagaaaggaggagguaauguacacacacauauucauuaaauaacauaauacuuuacauuuuaucauggcuacuuuaugauuuguuauauuuauuuuuaaaaaggaaaagguaucucaauuuaauuaucuuaguucccuaauuuugcaacucuucauaugaacagaagguaacaacuaaaucuaagucaaagaaaguuaggguaaaaggcauuguuuuuaaauucuccguucccaauuuuauauuuuuuucugcucaaaaucacauaguagaaaauauauauacugaaaauuguaaaaacagucugguguuucaggagucuuaaaaaaguaaguccaauuugugccauucuaaucuccuaccaagagaacugacuucugcuuauuaaaaugauuagucugcuguguucucucccuccaguuacuacugcuaaacaaucaugguggaaugaauuuuaacauuccaggagucaggcaaugaauagcuacccuauuaaguguaaauauaaaaaaaucgcuuuagcuccauaaucuaaaauuaauauaaaaauguaugcagcuuuacuacagacuguacuagacacuguucuaagcccuugacauguuaacucauuuaauuucacagcuauaugugguccaccauauuuccccaguuuacagauggggaaaacuaagguacagagaaguuaaguaaccugccuaaaauuacacaugcagcaagugguagagcugagacugcauccagguggucggguuccugucucuccaaaaaggcuccuuuuugcagagaccagaucacaggucccaaaucaacuaucaaucccacuuccccacuugccaccuccucucuccaaacuagcauaugacucccacauaugacauuuccauucuccccaccaccaagccuacauaaugcuuucaucaauuuuuuccacagacuucucugagucugaauucccuuugcauuuaaacauguuacagaacuguaggcauaaacacugauaacaccuaccauuacugagcacauacaacaugcuggauacaaugcuaccaucuuugucauaaaaguuauaaagaauguguaaucagacccauuuuacuggcgagaaaacugaggcucagagaggcugaguauuuuggccauguucucacagccgauaaaugacagagcuuuaaaagacacacaugcucaagucuguaagacucaagguucauacucuuuauguacacauaugucuuccucauacauaccugcuuccuuuacuucuuuaauaucaucuagagcauccagguacuauacuauucacaguggagguauuucuucaacaaaugauucuauaaauuauuaggaaaacggcaauuaaugcuuuuuuuuuuuuuuuuuugaggcagagucucgcucuguugcccaggcacaaucucggcucacuacaaucuccgccucccggguucaagcgauucuacugccucagccuccagaguagcugggacuacaggcgcgcgccaccaugcccggcuaauuuuuguauuuuuaguagagacgggguuucacuauauuggccaggcuggucuggaacuccugaccucgugauucacccgccucggccucccaaagugcugggauuacaggugugagccacgacgccaggcccaauuaccgcuuucuuaaugguuuaauaccauuacuuccccaaaacaaaaaggcccaacaccuuaauuaauuaacaugggcucaaauaauucagauggccccuuccucaaaaaaacguaaauauuugugguucaaaucuuuuaaauaacacuaccaauauuguaacccaagauuauucucccacuccuagacuucuccuccacuuauccccucacccccacccucccucagccaucagacuaguccccaaaggguuagcuauaaauuguuuugcuuugccauuagauacguacaaucucucugcgcccuagggaaauagcaaccugacagcaucccugauucuguagccugcuaaacuuaaaccaaucucaccccuuacucagugauuuuuuuaacccacuaauaagcauacuguaaaugcucauuacauaaaacauccuuucuuccuggauucaaagguuuuagcagcaguaauccagggaauauuauagcagcaauuauugcucauuuacucaaugugaaaggugacaaucacauuuguuacaguacucaauauuuuaaugucacuauaaacacuaagugaaauaagcuauucagguaucccaauuaaugacaaaugggugaaaaggaaaccagacaaaaauauuucaccguucauacucuagauacugugaaaaauauccuuguuuccuguuauaacaggguaccuucguucucucccagcauaugccacaccuuuuagguugacaaaagcagaaagacaucggggcuuuguguuuuaaaaaucccaaaaaagacuacucaaaccucuccccaagagcaaauucuaagaaggaagaauaccaccucccuuuucuuuaccacaaaccccugacuuaccgucucuagcaaccagagagggcuggggguaggggagagggugguuagaaaacagaacgcacgacucggucauauccuagcccggcccaucccaaacuucaccuaggcacggcgagaagcaggacggcaucaggaauuccuaggaaauggucucaccccaucagagaacauuuuuaacuuccuagaagccaccauuuccccggggcauuaucacacacucccacccggacauauuaccuaagagaguacuuauaaaaagagcguaacacacacacaaagaaauacacaguacuugaagcgggcagcuccggcucaggcggcgcggggaagcccggagaccacgcggagccgcggccaaguugccaccgcuaucgccccgacggugaaggcgcggccgcaggcggcuggaaaagcagcgcgcggggcuccagcuccagccccacgcccggacccucggagcaguaaagcccggcucgguggcccagccucucccggaggucucuggccucggccagagcaauaagguggaucggugcuucccacccuuccagcuccgcccucccgaccacauuccugagaagcccuacucccgcgacgccgcgcccgggaggaggcaggagcgcgacgcugcggccgcagggcaggagcguagucggccccgcgcccucccgcccccuggccccggcccgggcccgcgaggcgccucuggggcgaggucgcggcggccgccccgccacagguagcgccagcccccgcccgccgccgcuccggcgccccgggcaggcccgcuccagguaccuggaugaacuggauggugagcgccgacuugcccacgccgcccccgccgaccaccacgagccgguacuucuccuggccggagccgucccgccagccggccgcggccauggggacgcuacagagcccagccugacugcgccgagccgccgcugccgcccgcccuaggcccggcuccggggacgugugcggccggcgggcugcgggcgagcggccgggcuggggucccggguaccgggaggcgucuggagggccggucagcgcgguagcgcggcgcuggggacuggcuggguaccgcccgaggcgcggagaagcggggugacggcacgggccaggggcggcagcggccggggggcgcgcuccucuacgcgucuccgcagcgccugccgaacgcagccuccagcgccgccacaaauggccgucugggggccgggcugccaggcugaggugcugcauaugcaugagggggcggggaggggcggggccgcgccgcuuggggcugagguucgggagguaacccgggcuucagacccccacggacacaccgcucuaaucccuagccagugagcgagugcgugagagugugggagugggugucaguugggagugggacgaaggcagaaagagugugucacccuaauugucuauguaagggauuguguggaugaaaaauacaauaugugacggcgugugcgaaaaauagggcuguuggcauauuaacucaauuuuauaggagaguacauacccugcuuuaagaguacagauggugaccauauuugugugaaaaacaguaugugacagugauugaggauuagagcugugucacaguaauugagugugugaugggcuggugguugugacagugugaagaaugggacaguggcugagcauggagaauaagucagugauugagcuugcaugggcaagacggaaugugacagauuuuguaugugucaguacagugucauaguggcuauguuuaugugugacaaaugugcaguaauuggauaugaggagugugagugcgagggguugaacuccuggccucaagcaauccucccgccucggccucccaaagugcuggaauuacaggugugagucacugcacccggccucaugggguuuuuaauaagaauuaaaugagcacauaaaacagugcugcuacacaggaagcauuuacagcaaucuuggaacaugacugcaaguucuuggacuucacuugguaacucauuuggaaccaguagaaugcagcagaagagaugcugccuaauuucccaggcuagaucagaagaggccaugcagcuguucucuugguauucucacuccgggaggaacaaagucagaaguuugacuaucauaagacugccaugcuaaagaggcuacauguaggcaugccagucgaagucugauugauggccaggagcaacaugccauuuaaaaaaaaaaaaaaaaagucccacugagcucccaccagaucaccagcaucaccugccagccaucuaagugagacaucuuggacacucagccuaaucgagccuuccaaugacggcauccccuguuagcaucugaaugcaacugcgugagagaccccaagcaaaaauacccauccaggccagcccauccugaauuccuuuuuuaaaaaucuuuuuuuuuucuuuuuugagacaagaucccucugucacccaggcugaaguguaguggcacaaucauggcccacugcaaccuccaacuucuggacucaagugauccuuccaccucagccucccuagcagcugggacuacaggcacaugccaucaagaucagguaauuuuuuuuuuuuuaagagacaaggucucucuauguuacccaggcuagucucgaacucccaaagugcugggauggcugggcgcaauggcucaugccuguaaucccagcacuuuggaaggccaaggcgggcggaucgcuugagcccaggaguuccagaccaaccuggccaacauggcuaaacgcaucucuacuaaaaauacaaaaauuaguccggagugguggcgugcacuuguacucuccgcuacuccggaggcugaggugggaggaucacuugagccugggacgcggaagugacagugagccaaguucacgccacugcacccacgccugggcgacaaugcgggcucaaaaaaaaaaaaaaaaagugcugggauuacaggcaugaaccaucacucccggcccuucuugaauauuugacccacaaaaucaugagcaaaauaaaauuguaguggcucacgccuguaaucccaacacuucgggaggccgagggaggcggauugcucgcuugagcccaggaguuccagaccagccuggccaacaugccaaaacccgucucuacaaaaaauuacaaaaauuagcugggcgugguacacgccuauagucccagccacuccggaggcugaggugggagaauugcuugaacgcuggaagcggaaguuacagugagccaagaucgugagaucacgagaucacaccacugcacucccgccugggcgacagagccgucucaaaaaaaaaaaauguacugggauuacaggcaugagccaucacucccgacccuuauugaauacuugacccacaaaaucauaagcaaaacaaaauuguuguggcucaugucuguauucccugcacuuugggaggccaaggcaggaggaucgcuggaaccugggaggcggagguuucagugagccgagcucggggccaccgcacuccagccugggcaacagagcgagacccugucucaaaaaaaaguacaucgaaauacugcuucacacacacgaggaugacuaaaauuaaaaagacagguaaguguugacaaagaugugaagaaacuggagcccucauacacugcugguagguguguuaaaugaugccacugcuuuggaaaacuguaugugucaguuccucaaaagauuaaauguagaguuaccaacaaccugacaauuacaccccuacuuaucuguaccugagagaaaugaagacauauauucacaugaaaacuuguuugugaauguuauauauaauagccaaaaaguggaaacaacucaguugucccucagcugaugaguggauaaacaaaaaaaugucguauagccacgcaauagaauauuauuuggcaauaaaaaggaaugaaguccugauacaugcuacagcauggauaaaccuugaaaacauuaugcuaaaugaaagaagacagacacaaaagaccacauauuauauaauuccauuuauauaaaagguccagaauaggcaaaucuauagauacaggaagcagauuugugguugcaggauuacagcaaccaauaguagguauugaguuucuuuuugaggaguugaaaauguuuugaaauuagauagugguguugauugcacaacucuguaaauauacuaaaaacauuggauuguaugcuuuauaugggugaauuuuauugugucuguauuaugucucagugaagcuacaaggaaaaaagauucaauugcaagguuucauuugaacugugaaguucaaggaaguggcuuuauacuucagaauguucccuauauuaacucuauuccuuuauuuuuuuuauuugacucaaacguaguauucagcaaaugagaaguccauaugcucaaccccgcccagacuuucuaugccaaaaugagcucuuucccuuagaaaauacccccaaaagcauacagcagaaagaaacuuccaugcaaacacaaaucacugaagacacaggagaauaugggagaggaagaacuaguugucacucaagccaauuaaaggugaauuuucaacuuaaucugaaaaguuuccuuuucaaguagcugacagauaauaaguacauacauuuucaugaaaaagaaugaucuagaaccuuggaaagaacaauagagaucaucccccuuacuuuauagaaagaaauccugugacaagggagagaauuucuuucccaaugucaccuagcaaguuguuagcagggauuaggaaacaggucuccugacuccccugcucagagcacuuugcuccaugccaagcuggguguuauccagaaccccggagagccucacaucgcagaagcagugugaugcugccagucaagagagcuguugacugcaucauuuugacuuaaaucaagcuuuuguuuggcuaaaguguugucaagagauuucaacaggcagauucagagccagaucuagccagcgcauauguuuuggccuacaauucaaauuuuuuguguaaauuuugaauugguugccgauauuuaaaaauaggguaugucacaaauaaaucaguauuucuaacucuucuuggaaaaauuaaguggaauaucuagcaacacuggacuggcguuaucuggcaacaacuagcuaaagcuaaauacugacugcguuuuagaaaacuuaagauccuccuguucaucagggucaccagcacucuucuaucacacaccacccauuuguuaccugccuggcuuuagugggcuuuaagagcuugcaaauccuacuaugacaauguucuccacgaaggaugugcuuccaaauccccuguaguguauuuuauuuauuuauuuuuuuccuauucaaacauaaaaggcagccuguagugucuuuuaaaaugaagaaacugggcuccuccccagaccugcuaaaugagaaccucugaggacacggacuuagaaucugaauuuguauauuaaauaucuaaagugauggccgggcgcaguggcucacgcuuguaaucccagcacuuugggaggccgaggcagguggaucaccugaggucaggaguucaagaccagccuggccaacauggcgaaacccugucucuacuaaaaguacaaaaaaauuagcugggcaugguggugugugccuguaauccuagcuaccugggaggcugaggcaggagaaucacucgaaccggggaggcggagguugcagugagcagagaucgugccacugcacuccagucugggcaacagagcaggacuccgucucaaaaaauaaaauaaaauaggccaggcaugguggcucaugccuguaaucccagaacuuugggaggccgaggcagguggaucaccugcgguugggaguuugagaccagccugaccaacauggagaaaccccaucucuacuaaaaauacaaaauuagcugggcaugguggcacaugccuguaaucccagcuacucgggaggcuaaggcaguagaaucgcuugaacccgggaggcggagguugcagugagccgaaaucacaccauugcacuccagccugggcaacaagagcgaaacucugucuaaaaauaaaauaaaauaaagugacccugagacaccaccacagcaagaacucuuagaggagggugcucaucccuguccacucuuuauuucaggacaaacaaugaccaucucaucuggacuguugguuauucauaaucuuuacaaaccaauauugaccaaacagcaucccuggcccaucccagagacaggaucugaggguagaguggagagggagaugcuagaaucaagauuccucuaaccucaucuguagcuacaacagacagagccaagaccuguuggccaaagaaggccaagcccccagaucagagccugcaauacuuaccaugggugauggaggagcaucauccacuuauuuccuuaaugggccauugcuuuuaaugugaaugaauggcuggcagagaaugaaaccgcccagcaggagcugcaugcaucugagau

SEQ ID NO: 192993 - RNA, 38659 nt, Homo sapiens
uaaguuguuccaaaaauccucuuuaauaauacauguagccaacauugcugcaaucaguauaaaaacaaaguuauuccugauuuuguauaaaugaacacgucgagagucaggauuauaaagcaucaagauacaaguaccaagugggaggaccaaagacaacucacagugaagagaaacgcuugagaacaagaaaugucagaguuguaggacgugguaacaacccagggugcugaaacggucagaggugcaggugcagacgcaggcuucugccucugcaagggcaagggggccguugguggcuggcugcaaaggaccagugccaggcagcggggcagagagcaccaggggucucgacucugcagauugggcuuugcagaggauuccuguuucccaccuccccaccccucugacagagacugaggagaccacacacguugaccuccucuucauagccagccaucauuuccacuccaacauucugcugcgggugucauucuggaaaauaauuccuugcuguuccuugcuccuuucagaucacagcuugccuggucagaccccuucccaacaugcacagucugaguccaggaggcccucgaaagucaggcacaacacccagaucugguccucuuggguggcuuaugacuggauauauccacugugugugacggccucucagcucucugcuguaagaucauuggcaccaccaggucaaagagggucucaaacaggagguccacauuguagccggucuuggcgcuggucucaaagcacauuugcucagcggccggcacauccugcucauccagcaucuuguacuugaggaucuuuuuauaaagggccaccgcauccuccagcugcaccugcuuaggugcccuuggggagacacgguccccagcguccauauugggacugcacucuuccuucuccuggcccgccaaggcccccuccucagugagguccacuuuguuccccacgauggcaaagaggcagucuuugcuggcugugucugucaggcccaggaaccgguccuccagcuccaccaggcucugccggugauucacaucauaggugaggaugauggcggccgccccccggcaguacauggagcccaggccguggaacugcucccgcccuggugggaagagagggacagaaagagugguuaucucucaucucagaacauagccaccagccacacugcaagggaacgucccacagggauguuuauuuuuagggcaacacacacaggaugaaaugcuuaaacauaguugauggagaaugugccacccaugggcaccauccccaaagcaggcagccccucgagaaaacaagcuguugggugcccagacuagaugggaaacagaauccaagaauguucaggaagaacgggccucaggcauucacacagcccucccugccuucaagcaccaacuccaaaggaguccuggccccagccauggcuggagauggaaggaaucaagaacugauguccagaaaaaagcagcgacugccaaggcccuugcugagauagaagcugacucgggaaugcagacuccggaagcaaagugugcccaugucccuucacccuccuccuuuacacccccugggugcucccagcugcccugugcugcccugcccaggaagugcugcggggagggcuucugaguucauaacagcaguuguaaaccacaccugcccuuaucugcccagaaucacacagcacccugcggugcucacgauauuuuuaggacacaguggacaucuccccucccacgcuggaaucggaaucccugaggagccaggccccagcauucgcacuucuugugggugccgcagccccgccugcccuccagguuuaaaacagacagaggugcgggcaauugcaggcaagccgggaaccugcucccaaaacauuuccagguugagaucaaacccucgggacacagcucaacgucaacacauuggcuacugacaaggugcugucugucacugggucuggcggggaacagggccagcuggcaugcaccccugcagugccuggagugugggcaucugcucuccccgugcccccagcacuucagccucacgaggucgaugugggcacacacacuuuccaugaggaaacugaagugugggggagucaggcauagcagcgcuagagggaggcugggccagggcacuggaacacccgccaccguccuacauuuaaacgcagagacccccgaacugauggcuaaaaaggaagauuaaaagguccccagcucuguguacuuuuacaaugcagucaucuaaucaaaucaacccgggucagaauacacuccccacagguaacaccugcacauccguacuguucuguucccaacgucugccccaggaccaccuuucuaucccaccaacagugcacagauccccaagggggcccgcucaccuccccaccagcaggcggcucccugccaguccacucaagggcuaccuaggaacuuucuggcagaauucugaaccccugucuguagcacaagcuuucugcauacucagauguggaggacagacucccacaaggggagcagaucuggccaaggcagguguuccugggacaggugcagugcacgcagcaggugagagcccccagcagggagggccgagccgagcacgccugcugguauguccucccagccuuggcgugcuuuucaucguuggacacaucugccgcacuggggggacgagcucucaggaagcagcugugggagaggcagcagcaugcaccuuggcccccaccugccucucgaggaccgagcaggcugugcauggcaugggcccucccugcuggcaggaaggggcuucacagacgcuccuggugaugcauuuguuucaaucaccaacaagcaaaccccaagugagaucuuccaaccacaaagcaccugcucccaaccacaccugccgggggcacgcuuucgaagaggaaugagacugagaccugugcucagacgccaucccaaggagccucugcagacaggccuggaagcucccauagcaccugcugcaggccagcucauccccuccucccuggggcauguguggccucccgggccaugcccuuaggccaagaggagggagagcugggaacgacugacagcacuggccuccacucucgagcucagaacgccaaggucaagugccucugaacaaggaugaggcugcuggggcacuggcgcagagagagguggcacccagggaguguccaggccccauuccaaucccucgccugggagaaguaagccugguucugauuuuuuaaaaagaagcuaacaauguggauuuuaaucucccaaguuuuaagcacucaaaacuaauucaaaauuuucuaaagaucacauuuaggcaaaccaaaaugcaacaguggcccaucauuggcagcuucuaaauuauaaauggucccaugucacucugagggcaacuuccccugaguguguggacagugucgaccacuagcaagggcucuuaaccacuggggucauaaaccaaauucacaggguccaugaccuugaaugagggagaaaacaucaucuuuguuuucaccacccucuaccugaaauuuaccauuuccuuucaccacaaauauuggcagcaaacugcagaaauggcaguaaggggcacucaucaccaacagggccagcaggugcuuccauccgcaugccagaugccucagacacuccagcgugaugcccacgacccuucagaccugccaugccuucauucauuaauauguggaccaugaaccacauaucaaucauaauuuaaaaaggcucaagacgacuguacuuaaggacagcugguuaccuuuguaugugacugcacgcacuugggcauaguguucugagaagggguccugggcuuguaccccucgggggccgaggggucuugacacaaaugaaguuaaggccccuuggucuguggggcuuuggagcauggacugaacgcaugacaccugcacacauguggcucucuaaggcagacuguccuuugccaauaaaccacuguuuagagccaaauagccaagaagcacaaccaaauuucaucccauucccauccccaaucuuucugaaauggccacacauucugaugacgccaaguccucaaaccuugcugggcgaugcugccuggauuuugaggcaggcuggucaccccuugggcaacccuggagagaggcgcccacagagacacacacucauguccugugagaagagccagacagaccugucuacugaccacuguggucucccaggccccgagcguggacuccagcucccccuucagcaaagccgacagugugcccuuuggggauguggagggaaagcgagcugggagcugagcccagaccagcuccgguaggagucagaagaaugugcccugcugccagucugagggucaaagugcgagagcuacccgggucaccucccucuucugggaaaagccagccugggaaugcuguuguuugggcgacagagccacccuguuggcaagcagcuugugcucuggaauucagcaccugaagggcaacauuccucccuuccgcacgccuaccaggggucagcuucagacugagaagucaauccguuuccagucaagcuggacuggaccccagcaggcagaaaucagacaguguccccggaauccacagucauucucccacuacagaagaugaugaucaaaagccuuuaaaacccaauacagcaggcauuagcuucaaaaagaacaggcuagggcaggaggauugcuugaggccaggaguuggagcccagcuugggcagcauagcaaggcuccuaucucuacaaauacacacacacacacacacacacacacacacacacacacacacauacacuuuaauuagccaggcauggugacgcaugccuguagucccagcuacucgggaggcugaggagggaagacugcuugagccaaggaguucgaggcugcaauaagcuaugaucaugccacugcacuccagccugagcaacagugagaccccauaucuaaaauaaauuuaaaaugguaauaauaaaggaaagaaaaaggccggagacucaugccuggaaucccagcacuuugggacgccggggugggcggaucaccugaguucgggaguucgagaccagccugaccaacgcagagaaaacccaucucuacuaaaaauacaaaauuagccaggcaugguggcaugugccuauaaucccagcuacuugggaggcugaggcaggagaacugcuugaaccugggaggcggagguugcggugagcugagauagcgccacugcacuccagccugggcaagagugaaacuccaucucaaaaaaaaaaaaaacaaaaaacagaaaagaaagaaaaaugcuucuucgucauuaccacaguacuaagacuuuuguuucagggacacuaaucccauagauaacaguccaggcaucaugagguuuuuacaugagcuaaaaacgucaucagcuucuacccaccagauuucacaagagugugacuaugggaaugcggagucaggggcacuccagcuacccuggaagaaugguuuucaagucucuguuacauaguucacuagggccaaagggagaaccguguugaugccuaugccuaaaauaguuuuccauuccagauaaaaaugccugauuugccuuuaaaaaacuaaaaaaggaaauaauaauauaaaaggaaagaucuuaguaaugaaaggaaacaggaacugaagaaucacaaaugcuagccagaaaaaaguaagaauuguugcuugaacccuauaaucuguuaucuacccauuaaugaaugcaaaccaauuaaaugcaguugccccagcuaaagaauuuacaagcaagcaguuuucauauuugaaauucuaaaauacugcuuuggagauaauguauagcuuuuaggauugcuaauggaagagucaggcugcucucaaugagcgcauuguccacaccaagaagggccagucccgcagggaacagaaguucugaauuuaauccuaauugaauuugaguaggggcucugguauguaaggcaugagagugaacauaagacaaugaaaauaaaauggugucacuacaacuugaccuuuugcacuuggcuuugacagauucacaguguauuugaauccaaggacccucacgcguuuucuggaaguuugugaaugugcucugagccgggccgucagcccccugcugccaaccccauacacaugucagccccuguaucucucagaauauugauuuccugucuacaaguaugggcuuaaacugaguacuucaaagucccucucccuggaaacaggaucaggcaucucuaucucuauugccuucucccccagaccggaguccgucaguaccaaucgugaagccaaagcacugagaguucuggugguuuaccuggacuuuccuggagaaauaaacagccucagguccaauucuggggaugccagagccccaggcugccccagaaacagggcaaaagagaaaaaucacaaauugguucaaauucaaccaaugcagccaagggucagugagcugccaacccuggucuggugaacggagccaggcugccgagccuguguggccacuaccaacacgggccugacaucaucagggcugggggcacggguucaagccugaggaaggagcccagccuuccgccagacucucccgccuuuuugccugggcugucuccaggccaagcagacgggaggaugggugagugaccggagccuggggcucuagguucgacuuguccaggaauuauuacucgucuauguagcaaauccguaagugaucugcucagcuuuaugucaccaacacauacagacgaagaggucaauuaccccugguggugagggaaaccugaaucuguaagaacgccuccaaugucugaucagccacacuguuggacaaacuacugaaaugcagcaaaacugaccaggacuuuaaccgugaguucagagcagccagaaaugaagacgcccugcucacugcagacagggcccuggggaggcaggucccaccaccccaccucuacacagacacagggccccggggaggcaggucccaccaccccaccucuacacagacacagggccccggggaggcaggucccacccgccccaccucuacgcagacacagggccccggggaggcaggucccacccgccccaccucuacgcagacacagggccccggggaggcaggucccacccgccccaccucuacgcagacacagggccccggggaggcaggucccacccgccccaccucuacgcagacacagggccccggggaggcaggucccacccgccccaccucuacgcagacacagggcccuagggaaguaggucccacccgccccaccucuacacagacacaggacccuggggaaguaggucccacccgccccaccucuacacagacacaggacccuggggaaguaggucccacccgccccaccucuacacagacacaggacccuggggaaguaggucccacccgccccaccucuacagacacaggacccuggggaaguaggucccacccgccccaccucuacacagacacaggacccuggggaaguaggucccacccgccccaccucuacgcagacacagggcccuagggaaguaggucccacccgcuccaccucuacacagacacaggacccuggggaaguaggucccacccaccccaccucuacacagacacagggcccucaggaggcaggucccaccagguuuguuucucgaauuuacagaucuaaaaacacaauugugucuguucaccuaaagagcuaauuccacucacuuuaugagguuuaaguucugucuaaacaagagaaauggaagccagaacaggacuucguaauuuauagcagggaaugagcuguuaacuuccacgaucccguccuguaucaaggauaggaagcgcugcauuagcuaugggaagaagcauggccagcacagugugaguccucaggguuuauuaugcucgugcaggcuucccuuucccauguuuuacaggaggaggaacugaggcacagauggagaaggaggugggcaacagacacaggagcgguggagcccugagaagcacgcuggcaacaggcaccccagggagucuggucuaaccacccccagaggcagaggaaggggccuagggccccuuugaggugggcugcugggcaggagaaaagccugccuccacccugugaucccacagagcacaggcauuugcagaaugcagccaccuucccaggagcuccaaauuuuacgcagagaacuauccuggaagugccggcuaauucgcugggcagggacugcagagcguucugguaaacagcccccacucuagagacagacuacauucaaauccccaccgugugaccuugggcaagucacuuagacaugcgguaccucaguuuccccgucacuaaaauguggguuacaccugccaaaggguggcugagaaagcagaaucugcacacaggugaacuggcuggagcugcacccagcacauuaggcccuguaauagaagugcuuguuccauaaaucgugagauuccucccaaaccuaaggauggaugccaccgucccagggcugcccaugucccgggucucaucaucccuccauuuacacaccaccuccuggggccgacugggcgcuuuugcaguggaccaaucuucuacguuucuuauucucagaugaugaccuucucccugguccugggggugcuccggauguugccagaucaguggagcugacauggcccaggguucaggcagaaggggaagggaagucagcacccacaguaauccugauucacuguugcggaaccaaaaacugcccaagugcuuuccauuucacucuucagccuucccaaagccaaacacagccaggcuucuaccccaaguguugugucguuuucacuauugguuuaaauaagaguggguugagauagccaucagaagccacggacacccuuggcucacaucuuaagcaugggguggggagacuuaaaaaauacugaugcucagacccugacccagcugccagggcaagaguggggcuggcauuuguaucagcuuuaaaagcgccccaggugaauaccaggugcaccaggagugaaaaucagcaauuuacccagugaaagugggaaauaaaagggcagcuauugaaauguaagaauuagaaagcuugguauuucaauucauugaaaagugagcccuaccaggaaaugcaaacacugagacaacaggaacuuucauuauuuauuuauuuacuuuuucuugagacagagucuugcucuguugcccaggcuggagugcagugaugcaaucucagcucacugcaaacuccacguccaggguucaagcaauucuccugccuaagccucccuaguagcugggauuacaggcacacaccaccaagcccagcuaauuuuuguacuauuaguagggacaggguuucaccauguuggccaggcuggucucaaacuccugaccucaagugauccacccaccuuggacucccaaaaugcugggauuacaggcgcgaggcaccacgcccagccuauuuaauuauuauuuuuuugagacagagucuugcucugucacccaggcugaagugcagugguacgaucauggcucaaugcagccuccaucuucugggcuuaaguguuccucccaacucagccucccgaguagcugggaccacaggugcauaccacuacacccagcuaauuucuuuuauguuuguguagagauggggacuuacuaugcuacccaggcuggucuugaacuccuggguucaugcuauauucccaacuuggccucccaaagugcuggggucacaggcaugagccacugugcccagcggagaacagaaacuuuuaagaugaguucucugccuugccagaucggacagcccccuggcagggagcucacaaaacaucgaugugacaaccugaggaaaggaaaagugcauauucccagaccagagaugggagcaaaauaagcaacuccagcaauggcaccagcagcagcgcagccuagaggagcugugacacacuucccaucagagauuguucaaaaacaccacgacaugcuuucuccaguguuugcagguugcauccacaaauacgagccaaaagguuauuuuaguucuauuuuguaaaguugaugaguuuuggcuaaaguugagagucaugggaccaucuccacaggcaugaucuacauucccucuagguuuguuuuuuuaaaaccgauagugaacuugguuaaauaauggugcguggaggccaggcacagugguucauaccuguaauccuagcacuucagaaggcugaugugggaggaucccuugagccccugaguuugagaccagccugggugacacagugagucccuaucucuacaaaaaaaaauuuaaaaaugagcuggguaugaugguaugugccuguagucccagcuacucugaggaggcugaggcaggaggaucgcuuaagcccaggagguugggcugcagugagcugggauacugccacugcacucuagcccgggcagcagagcaagacccuaucucaaaaagagagaaugggauguggaagcaaccauccccucaggagcauuagaaaagaauaaauaauugacuacuauaaccaacacuguauucaauuguuuguugauuuuagugcaguaaggaaggcccacaagagucccugggugcaugaauggagcugggcugccuggagccagcacagggccuggcuggacacaccugcccccaccaguacguggaaaguggagagcuagcaggcaagggccccacgcagugggcaggcccuccccccagaacccacaugcaccaaagccuccagagagccaauggcuugccagccuccacccaccgugauggggaacuguaucuggucgggccccggugcccagcaguuugguccugcacuagccuggacauggcugggaagguguuuuuuaggugggaucagcauuuacaucaguggaugugagaaagcagacagugcucugugaugugguaggccucgucuaaucagcugauggccugagaaguaaagacugagcucuuccagacacgaaggaauucagcccccagacagcaacaaagcaaccuugccugagcucacacacccucugucaggucuguuucucuggggaagccuggcugccuuauucacguggacugcucacuugcuucccugggauggaggcugucugcaaagcugaggcucuccagagaggccuguacagcucccccauuuucaggcuguccccugaggccgagccccuacaaagaggugcugccaccgugauguacgagugugccggucaagggugccgaccacgccccgaccccugccuugccccucagccaaacaaauguccagggcaggggaaguggcaugacaggggcuuuucagaaaacugcaaggaucacuuugacccaaacuggucacuucuucauugaggguuccuugcccgggcaguuaucuuuccaaaugcugauccaauaugaacacccucuacugugcaccccagggggcuuccuagcaggcuucaaaagagugugaacuccacaaaacuggaccucaucauaaaugcacaaguccucuccugccagcuguucagcaacuaaacaguaaaauaggaaaaauaugauuuccaaaacgaagagcagaagacauauccagcaauauuuuuuuguggaaacagagacagggucucgcucugucacccaggcuggagugcaguggcucaaucauggcucacugcaaccucauccuccugggcucaagcgauccucccaccucagccucccaagcaggugggacuacagguguguaccaccacgccuggcuaauuuuuuaauuuuuaguagagaugaggucucacuaaguugcccagccuggucucaaacuccugagcucaagugauccccccgcuuugcccuucuaaagugcugggauuacaggccugagccaccacgcccagcccaggaacaucuuuuacuggcagagauggagaauguagugagaaauuuaaauucagaauucuuccucauuuugaaaagcacacaucucaccuagaacuagccacaucucuaaguccaagccacguguggccaguggcuaccaugcuggauggcacagagcagacucugcucagagccggagacccccaacccgaacccacccugaacaccagguacaguuccuggaccacagcagacacucacgggcugcuuggaacaggcaugaaggaggcgugaaguuacagaaacgaauaaauaacacaugaggcuaauucauacaaccacuucgugggucacgucuucauggauccuuaaaccacucugggaagucucuguuuuccauuuucgcagaucuacaagucaaggcucagagacucuacuggcgagauuggaacccauucccuagauuccaccucuccuccuccugccugcucugagugccucacagcuugggcccuuccauuaaaugccugugcagugacuaacuuuucacaggcagccgugaagcaccgcacacacccggcacgcugggcccaggccuuccacgcaguggcuggcccagcgccucugagcgcccacuggaccacaccaugcucucagcccagcagcaguacccaaagcuccggccgcgcaaggccuuccaacacagaaauggauuucauuucucuccuugaaggugaaccagagggcaggaaacagcacuuucuguuuaaaaauggaaucauaaauguauuauuauggguucaaaaauauacauucaagucuucaucucuggcacccaugaauguggccucauuuggaaacagggucucugcagaagugauuagcuaaaaugugaccacauggaguacggcagacccuuaaucacaucuaacugguguccuuauuagagaagacacccggagacacaggggcaaagacgaugugaaggcagacccccggggaggagaccauggggaaacagaggcagagaugagagccacagcuccgcaggcaaggacggccagcaccagucaggagcuggacaguggcgggaacagccucucccuggagccuccugaggugcacggcccugccgacgccaguucagacccuaccuccaggauggggagaggaugagcuucugcuguuugaagcccucccacuuuguggaacuuggugacucagaccccuacuaaagcauggacugggcggcagguggauggccucccccuagacaggcaccgaaagucaggaagaaugauaucuccucucaccaagguccaugugacagucaggcagccaagagaagcuucugcuuccguugccuccccacuuccucuccccgaggaaagccggggaagaaucaagaugaugaugaacuucagugaaccccacuaaaggagaagucagugaggaugggccggagaacacugaacucagacaaccagaguucagagaggaggaggcagggccaccuccaagcccgucagcagaacugcucgcuuccugaaacaagucacagcucacagaaaucacaugcacaggaauaucuaaaauggcuuuuuuuuggggcgguggggggggguuguuuuuauguuuauuuuacuuguacuuuuuuuuuuaaugggaauuuuuuuuuuauuacacuuuaaguucuagguacaugugcacaacgugcagguuugcuacauauguauacaugugccauguuggugugcugcacccauuaacucaucauuuacauuagguauaucuccuaaugcuuucccuccccccuccccccaccccacaacaggccccgcuaugugauguuccccuuccuguguccaaguguuuuuuuuugugugagacagggucucgcucugucacccaggcuggagugcaguggugcaaucguagcucauugcagcugugaccucccagguucaaacaauccucugccuuagacucccaaguagcugggacuacaggcucacgccacuacgccuggguaauuuuuauuuuuauuuuuauuuuuuuuuugguacagauggggucucacuauuauugcccagguuggucuugaacuccugcgcucaagcaguccucccacauuggccucccacauuggccucccacggugcugggauuacaggcaugagcuaccacgcccggccgcuuuacuguuuuuacaucaaccuaaugccaccaguauaaggaauaagcaaugcccucuaacccaauuuacacaacaagaaguuguccaguucauuguccuucuucagauaugugagaagaaagaggcaguaaccacugaaaaagauaucaaagaaaaacgaaugauuuguccagccaaagaagccaucaauuguccgcaccuugaagaggaagcugccacuaaacucauaaagaggaaagugucucaucauaaacagaccaaccucagggugggaccaacaccaucuccuagacauaaggagcugcauccucaaucaagcagaagaacagggccaggcgcugacuugggauguaugacauuccgguuccuaaagugaguccagccacuauuaacagcuuuuagaaacagcugacgcccuugagcccucacuaugugcaggcauugccucuucagcgguucagcucccaggacccugcggggcucagugcaucacccccagcccagaugagacaagcaugcaggccccagucacaggggcccuggucacaugggcagcaaauggaagaggcaggccuugaacuccagcaagcagagcccagggcuccuauucccaacaaccaugcuacacuaucagcuucagguccuccaccaggauggaucaggaaaaaaagaguuagaaaaaagaaugaaggccaagccaggcggaucguuucagccuaggaguuugagaccagucugggcaacauggcaaaaccacaucucuacagaaaauacaaaaaucagugggcauggugguguucgccuauaggcccagcuacuugggaggcugaggcaggaggaucacuugagccugggaggucaaggcugcagugagccgugguugugccacugcacuccagccugggugacagagcgugaccuugucucaaaaaaaaaaaaaaaaaagaaagaaagaaagaaaagaaaagaaaaagaaaaaagacuauugguauuuccuaaucuaaaagaaauaggccaggcacgguggcucaugccuguaaucccaguacuuugggaggcagaggagggaggauugcuugagcucaggaguccaagaccagccugggcaacauggugagacuuugucucuccaaaaaauacaaaaauuagcagggugugguggugcaucccuguggucccagcuacuggguagguuggggugggaggaucaccugagcccaggaggcagagguuguagugagcuaugaucacaccacugcacuccagccugggugagaucuucucucaaaaaaaaaaaaaaaaaaaaagaaagaaaagaaaagaaaagaaaaagaaauaaagaaaggcugagcaaacccaaaagucaagcuaugcaucaagagcaaaaugccugaauccacucccagaaaaccagcucccuggggacggcuguuuccucccagcaaggcagcaggggcgagaccgugaaagaaccauccuguguucucagcugugcacuucccucacguucuuacucugagaccaagcuuccuccacugucccuggccaggcaagagccccacaauggucaccugucaccauccaggaaacaucucaugaaaacucugcucaauuguaccaagaaaauacucugagccaacauccagcagccggauaugacugugggaguugacaacaacccuaccccucuaauaguaaugcuuuucugccagaagaaagaacuaaaaccucaagacaaauuaaucaaucacaggaagaaaggaggcgauuaggugaccuuauuuuuuaaauaagcuaauaauucaaauucaguaauccaauguaguugcuugcauuuauaguugcuuuaauuuuguucugaauagucuaugacaauuaaagggcauucaaaaacauagcugugcuuuaugacauaaaggaggaugauuacuuuucuagucuagcaaguccaaggguuuauauugguaauaaaauaaaaaucaguauugcaguccugcuuaaugacugucuacauccagagacucaacuaccaggacugcuuggcaaauacugaccgacagccauccaaaccccugcccgcgaaaugaagcuuuuuuccuuuuugaaaaaaagaguccaaaccuaaaacuauuuccaguuaacggaacugcaacauaugaggcagaggagaauuauuccaggaaaauggauuuuucaccuuuaaauauacaucaaugcauuuuuuguuuuuuguuuuuguuuuuggguuuuuuguuuuuuuuuuuugagauggagucucacucuuguugcccaggcuggagugcaauggugcaaucucggcucacugcaaccuccgcuucccgggcucaagcgauucucuugccucugccucccaaguaaccgggauuacaggcacccgccaccacgccuggcuaauuuuuguauuuuuaguagagacgggguaucaccauguuggccaggcuggucucgaacuccugaccucaggugauccacccgccucagccucccaaggugcugggauuacaggcaugagccaccgcgcccggccacaucaaugcauuuuuacccaaaucugcaugugucauuucuguuguuucuucuugaugaucugaaggauaaacuaaaaauaaagcaagugucauacgccacaugaaccacucacaucacuaacugcagguagaguaguuccaccuguggcccacuacguggcuucuggaaaaaugaugaauguaaagcaggaagaagcuuaguucucaagucacaucacucuucagacaugaauguacuaaaaauaguucaaugacaaaaccaaauuacucagagauguucuuuaacacuccgauauuaacagaaacaggcaagucccaaaaaauacacguauauaacagacuuagcuuuaaaacacacacuggcacaugccagcauauguaauccaaucuccuuuaccuucaagagauacucuguuguccuguaauaacgaauguuuagaaugagauuaucaaauaaaagugcagguauuugcuaaugucuccaaauaaaguaaaacuaaaauuauuucagcucuuuucaaagcacauuuuaaccuguuucaaagucaagacugaauuauaaauaucauauuaagaaaacuuuuuaaaucuaaacagggaggccgggcgcaguggcucaugccuguaaucccagcacuuugggaggccgaggcagguggaucaccugaggucaggaguucgagaccagccuggccagcauggugaaacccugucucuacuaaaaauacaaaauuagccaggcggaguggugggugccucuaaucccagcuacucgggaggcugaggcaggagaaucucuugaacccaggaggcggagguugcagugagcugcgaucgcgccauugcacuccagccugggcaacgagagugaaacuccgucucaaaaaaaaaaaaaaaguuaaaauaguaaauuuuguuauguauauuauaccacaauaaaaaaccuccacauuauauauggaauauauacguaucucucucacgcaaaauagugucuacaaagaaggcgaggagcuggaagagcaugcucuccacugccccgacccucacggcuggucucugcugggcugcagcaagccccgcgcagcugcccaugccccuggaaugggaguuaccuggcuguuggguuaaaguacagaaucuggcucaggaggccuggcuggguccuggguucugcugcugccagcccgaggaccuugccgaggaggagacggccacgcuucagccucucaucaacccaaggugagagccgaccaccccucacucuaaguaaaaccugacagcugaucuuuucacaccucaccacucuccugccuuccucugauacucuccaccuggucacggucacggcgcagcaacagauuccucaagcagugaaagcugacccccaggccucaggaacaucacuccugccugggucuguggcacaggguaacaggccagaguuaaucagauuuggaauuaguuagguuuagaaugugcuuuugcaacugcuguagaaaagugccuggcuaaguaaacaauaggccaccagcuuuagcacaugggaacgaagugucuucaaacaauccagaaauuguuaucagcccaggcacaauagcaauacaacugccacaugaaagcucaccucguucuuaucuucucauuaacacaagauucgcuagaagauuuccagugacaaugucaauuuggaaaguauuuaaaacuuccuccauuccuucugacuucucauuuuucaggaaaagcagccaaguuagcagggaacugccugcccuaaucuugguauuaguggaauucucugggccagagcccuucgccugccuggggcucagcuuccucagugucccugcaccaacuggaucugaucccuuuaaccaaaucaguguuccuuccagggacuucccuaagggcuagcugacugcgaguuuacuucaagugccaggcggaguguccagccacacacacacacacacacacacacucucacauacaugcacguacaugccaugcacacauacacauacucacaguugcauuucuuucuccccacuguguccacauuucacacaucuggaaucagagaccccagaugcucacacacggagacaguaaccaguggccaccaucagcaggaacggggugcaaacagccuggggaaggaacugccaaauaauaaggguguuuguugguuuuguuuuuguuuuguuuuguuuuaauuuuauuauuauuauacuuuaaguuuuaggguacaugugcacaacaugcaggaugacgaguuuuguuuuguuuuuaaucagaacgcuugcuguauuuuauucucagcuuuacugggguauaaaugacaagcaaaauuuguaaauauuucagauguacaacaugauauuuugauguaucaugaaaugauuacccuauuaagcuaauuaacacaucuaucacugcacauagcuaccaugggugugcagacagaacauugaaacuccacccucucagccaauuucaagccuaucacaugguacugguuaacuacagucaccugccuggggcucuacauuagaccuccagaacuuauucagccugcagaacugaaccuucguagccuuugauuaaaaacuccccaauucccucuccccacccaccugccagcuccuuguaaccaccauuccacucugcuucagugaguucaacuuguucagaugccaggcaucagugagacuaugugguauuugucuuucgguaucugguuuauuucacuuaccaugauguccuccggguucacaaacaacaggauuucucccuuuuccaagcuuggauaauacuccacgguguauauuuaccacauuuucuugauccgugcacaucaguggaagcuuagguugauucuguaucuuggcuacugugaacacgggagugcagacaucucugagaaauacugauuuccuuucuucuagacagauacccagcagugggacugcuggaucauuuguucuaguuuuaauuuuuugaggaaccaucaugucuuccaccgcggccauacccguucacauucccaccagcaaugugcgggguucucuugucuccacauccucaccagcacuuacccuuugucuuucugaugacagccauucuaacaggugcgaccugacagcucacuguacugcuaacuuggcugucucugcaauuagucauauugaacauuuuuucauauaccuguuggccauuuguaugucuucuuuugagaaaugucuauucaguucaggaccuuugcucauuuuauuuuuuuuuauuuuuauuuuagagacaaagucucacucugucacccaggcuagagugcgguggugugaucuuggcucacuguaaccucaaacucaagcgauccuccugccucagccucccacguaggugggacuacagaugugcaccaccuccccuggcuaauuuuucuuauuuuuuuguagagacagggucucacuauguugcccagccuguucuugaacuucuggccucaagugauccucugacaccucggccucccaaagugcugggauuauaggugagagccacggcaccuggcccuuugcucauuguuuaaucugguuguuuucuuguuacucaguuguuugaguuccuuauauauuuuggauauuaaucccuuaucagcuguaugcuuuccaaauaucuccucccauucuggauguucucucuuuauucuguugguuguuucuucuguucugcagaagcuuuuugguuugaugcaaucccauuugucuauuuuugcuuuuguucucugugcuuucuggagucacauaaaaaagaaucauuagccagaccaauacugcaaagcuuuuuucuuauguuuucuucuaauaguuauaguuucaggucuuaugcuugacucuuuaaucaaauguggguuauuuuuuuuuuuuuuuuuuugagacggagucucacucugucacccaggcuggaguacaguggugcgaucucggcucacugcaaccucugccucccagguucaacugauucuccugccuuggccuccugaguagcaggauuacaggcaccugccaccacacccggccaauuuuuguauuuuuaguagagaugugguuucaccuuguuggccaggcuggucucaaacuccuccugacuuaagcgauccacccacgucagccucccaaaaugcugggauuacaggcacccagccugauuuuuguauauggugugagacaagggucugguuucguugugcauauggauauccaguuucccugguaccauuuauugaagaggcuguccuuucccccaaagguucuuggcaucuuugucaaagaucaacuaacaguaaacguguggauuuguuucugggcacucuacccuguuccauuggucaaugugucuguuuucaugcugaggucaugcuguuuugauuacuauagcuuuguagcauauuuugaagucaggcagugugaugcuuccagcuuuauuauugcucaaaauugagcaagaauuuugcuggcuauuuugggucuucugugguuccacauaaauuuuagaauuuuuuucuauuucuguaaaaaaugccauuggaauuaugauagugauugcauugaaucuaugagugggauuuuaaagcaauucuaccuugacacauguuaaaaaauaauuuuccaaaaagggcaaaaucaugacucuaauacagauguaaaaauaaagacacguuaaacucaugcaaugaaggagccagaccuaggucauaaccaacucaaagaagucaaggcacagagacguguggcgcagacagacgggaauacuggagccuguggagggugacaucuaggaagacacauggagaaccagagaggagugccacagugaguguggaaacacagguaaagcgccucaccgagggaaagugacgcaccacacacccucaaaucucaaguaggucucugauaugguuuggcugugucuccguucaaaucucaacuugaauuguaucucccagaauucccacguguugugggagggacccacagggaggcaauugaaucaugggggcauagucuuucccgugcuacucuugugguaguaaauaacucucaugagaucugaugguuuuaucagggguuucugccuuuugccucuuccucauuuucucuugccgccaccauguaagaagugccuuuugccucccaccaugauucugaggucuccccagccauguggaacuguaaguccaauuaaaccucuuuuucuucccagucucgguuaugucuuuauuagcagcaugaacacggauuaacacagucuccauuaaaaaauaccuaagaguguaacuggguuguuuguaacgcaagggauaaauguuugagggauggauaccccauuuuccacgaugcaauuauuaugcauugcaugccuaugucaacacauuucauguaccccauaaauauauacgccuacuauguacucauaaaaauuuaaaaaguauuaaauaaguguauuaugucucccaaaauagugcccauccuagcacccccuucucuuccucacagcaaguguuagaaaucguauugugaaugcucuuugucuguggucggucuccccaacuggacugcguauucugucuacugccacuugcccacgcuuagcagagcaucugauuuauaggcaguccuccaaaaagugcugaauaaaugagcaaguucacacucacugaguguucacucuacacacaucaggauauuaaaacuagaaggagcuuggagauccuugugcugagguggugacugagguggacacaugggcccccagagcuugggcaagucuagagaagugcaucagugccaccuugggaagaugauaaaauuccugcacucccccucaaaaagaaggaaauacaaagcaacauauaaaaagggcacaauaggagucuguaaaauaugcccuguaauguuaaggaccucuuuacaguccuucguucucuauuauuaagcaauuaaugacuagagccuugcugugggggaaaaugcugcauuuacuucugagcucuacauuccuguuucaugaucugacuccacagaaacaccguggauccuguagucuucacccagaagccaggaccaagcauacagcaaagcagaugaaaagucaauguccaaccagagccauuccaauccauaauucugaaagugauuccuucacauagcagagaaaccccaugagauaggcaccaaaaaaaaagccucagccauuuaauccuuaucacccuuuacaaaagcuaagggaaccuaugaugugccaggagaaagaagaugacauugcauuacugagagucgagaaccaugcugggcucccugcacaucugucaucuuauuuaagcuucauaacugucccuggaaauaagguuuauuacuacaguuuuaagaagacaucacugagacucagagacaggaucauaucuucauuuuguuuucuaaaaguguuccaauugauucaucuaaaaagaaaaccugcugaucccaaauacagcugugagggaaagguacaacccuaaauucaccuauuugggcaacauaagucauuucaaguuaugccaugagaugguagcgucccgaaaggcaguuccaacccacaaggaagcacagucacacaugagucuuccauuucuaaguagaaaugccucauuuuuuauugaugcacucagcggcucugcaggccacccuuggucugugugacagggccacuaagcgugugucauggcauggugcugggugacacccaggcucacaaaucuuaacugaccuggagcaucugugaacaguacaagcugaacuucuguuuuuuuuuguuuuuuggguuuuuuguuuguuuguuuguuuguuuguuuguuuuugagacagggucucacucuguugcccaggcuggagugcaguggugcagucacagcucacugcagcuucaaacucccagacucaagugauccucccaccucagccuccccaguagcugaaccuacaggugugcaccaccaugccuggcaauuuuuuuucaauucuuaguagagacagggucucgcuauguugccuuggcugguaccuaucuucugacuucaagggauccucccgucugagucucccgaagugcugggauuacaggcgugagucaccacgccuggccaagcugaacuucuguaccacaaacaauagaaaguguuccuccuucucaaggacucauaugucagaagccuggaaugccgccagucaaggccaggaagcugacuguugcgccaaaucacagcggucuacacggcgccuccucuaaccagacuguccugaacuagagcagccaaggucagggaagggaacggaccccugccccaaacacacugaaucagcuggcucugcauaaaugagaaagcgcagcucagacacgaggcgcaacaagcuuccuaugugaaugaagugcgcuuaauucuacacggggaaagcguuaacaggaaucuuaacacauugaucucguuagugaugagacaggccacagguugaaacuguuuuucauuuacuaucguugggugcagcaggacuuuucuaguucacaggcaccccaugcacgaaauagaacguagcccgauguacauuuauuaccuugugugagugaaugcauacuuggagcaauuccuuuccaguuccacucucacuuuaggauccaagucacuucuacgaaggacacagcaggcuggugagauuaagugcauaaauccucggacaggucugcccagaucagauccccacuccaccacuccuggaaaauaaccuugcuaccugcuacggugccagagaggauuaaaggagcuaaaauggggaagcguuuugcagagccucuggcacauauuaaguguuguggaagcaucggcuauaauuuaaggccaaagcuauaaggccaaagucuguagacuggaaccucagucuugggaagccugcaugaccccacaagcuaaugcuaaucagccuacacaacaguauugcaaauaggccgucccauuuauucuuuguaucuaaacacuuacuuuaaaauauagguaagcauuucagauauaaccuggagcaaaaaguuucccauagcagguauucuauaacugugaagcuaccaccagagcaacuccuuaugccgucaaggcucuuaguaauaaaauugagaauuuccaaaauacaaauaggaaaccuggucaacagacuacaaaaauaaaagacacuguuauccucaaggcaacuucaguuagaaugcuacaucuuuuugauccaacaauuuuucuuuuauggauuagaaaacaccauaauucggccgggcacgguggcucacaccugucauuccagcacuuugggaggcccaggugggcagaucacuugaggucaugaguucgagaccagccuggccaacauggugaaaccccaauucuacaaaaaauacaaaaauuagccaggugugguggugugcaccuguagucccagcuucucgggaggcugaggcaggagaauugcuugaagcugggagguggagguugcagugagccgagaucacaccacuguacuccagccugggcaagagaaugaaacugucucaaaaacaaaaauaaaaacaaaaaaaaacucuugucauucuggaaauguccacaauucagucucaccugccuccauccucaugaaggcaccaggggagcgcggugggcucaccugauuucuugguuaggucuguucuguuccuuuuuuaugcggggucugucggugggcacugcuccaaugugagggguccaggcuccaucguagccucuuaaccagcucagugccaggaaggguggacuuugacaaaaacccaccucaaaucugcacuccccaaccuggagugcaaccuguggcaagcucccuaggcucucugggccucagcuuccucaucugcaccgagaggugaggauaacaccaagcacacaaaguggaugccggaacaauggacaaugccagaaggcacugagugugaugucuggcacccagaagcaugauaaaugccugcugcucucacagcccagggcuccagccagguaagggcugggucccuacagaacccagaggccugaacaugugugugaugauuccaaacuucccaggccaguuuuucauaggacacuacccugacuuccuugcagaacccuagcaguagguagcugagcuauuucagaggcuuaagaccagugugcggagagcgguuaggccagagggaggaaagacauccguugccaucaacaucuugugaguccacaaaacaaaucagcaaauauuuacaaaaugcuuugcuuggagcuacaagcuuagcuuggucuguguuagaauauaagcuacuaaaaguuaaguguguugauuuguaucagcuuggguuaagcaggaaggaauauuucagacaaaagcugaauucuugaaugcagauucauuuugccugugcccuuuggcauuuccgaauuucuagcuucuucagcccugaaucuggaauccagggaacucaccacugugucuuuucauccacgguuccuagcucaugauucuuacagccauuguuacaaucuauuguuauaauguugggugccuuaggccucaggaacaaaaucuuucucucugaccuucuccuguccuccuuucaccuggcccaggccggacucuaaucugauugugggucauuagacccuccuuccagagaggguccugccccauacccuagaggaaggaaugcugcagagaggccuggggaaucugaacagacaggccuugcugggcuuagacugcacccuuuuuauccaaucacacuuuuuuaaauuuuuuuuuuuuuuaauugagauggagucuugcucuguugcccgggcuggagugcaguggcacaaucucagcucacugcaaccucugccgccuccuggguucgaacgacccucuugccuuagcuuccugaguagcugggacuacaggcacgcgccaccaagcgcagcuaauuuuuguauuuuuaguagagacagagucucgccauguuggccgggcuggucuugaacuucugcccucaagugaucuacccuccucggccucccacacugcugggaugacaggccugagccaccacacccggccuuuccaaucacauuuugacaugaugcccaugccucaaccacagacaaccaaugaagucuccauaagaagcccagaaaacaggguucagggagcucccagaaagccgagcacauggaggccaacaggaaggugaagaagaacucacccccaugccacaagggcaccccaacucuguggcaccccaacuccauggaccccaacucuguggcaccccaauuccguggcaccccuuccagaccuugcuccaugugucucuucaugcgguuguucauuuguauccuuugcaauauccugucuaauaacuaguaaacaaacauaagcaaccguuucccagcaaauuaauugaacccaaagagggggucgugggaacccccaccugaagccgguggaucagaaauuccagaugccuggaauugcaacuagggggaaggaagggguggucuugugagacugagcccucacccugugguaugagacgcuaccuccggguagauaguggcagaauuaaacuggaggacacccagcugguauccacugcucgcugugugggaaaaacccuacaccuuugcucacaggaguuuccugugucaaugauggcuguggcgcugugagagcagaggaaaaacucggguuuagaguuuuuuccugaaacacauucccgagguaucuaguggaucugccuucuccuugccaccuuccagagucuuauguuugcuuuuaagauaaaauccaagguuuugggcuguaauuagagggaagaguaggggaaaauacaucuuuuccaacuucccagaaacacaguccugguauguuagucuuuuuaauagauuugcaaugauauugaacucaaaagaaaucaagagcuacuaaagaaguuuuuuaggauaccauauaauuaaugucccagacccacaguucccuaccacgcacacaauggccuauuguaucacagcacucaggacaaugauauuuccacacuaauuuuaucauucagggucaauacaucgcuaagaaaaugaaacugcuaaugucagucugugaauuuuccccacugcuuucaaaaguuuccuucagcaaaaacuuaguuucaaaaauaucacagagcaaaacauuacauucuauggaaaacuccaagugaguaaaacccaaggaguuuauaaauccaaggaaagaaaaagagaucagaaaaacagacaaccagcaguauguacuauggggugcaaggucacuuuguagcaguuugguggaaggaggaauucuucccucugcuacaaagaccaagaaaugcuucacugaaagaugggauaaaauucaagcugggcauggccagagacgcuguaagcaccugugagaaccgagcaaagacagggcacacaggacgaacugcaaaucguacaucagggcucaagugccagcaggcagauaagaggagugauaagcuggggagugcuggaggggcucugagcagggaaggugaccagauccaggaggccuggcagaaagaccccucagugaggugcagaagagacagcaccagggaagccaggguugaaacgaagcuggaaccugccugggccagcguucgcggccagcuggaccauggaacucugucgucgcagugaugaauccauuauccuaagaaucaacagcuguuuaggcguguguguuuguacguguguguauguuuguacaaaauuuauuuuucuuggagagggauguuauaugaagucucaauacagaaagaagggcaauuugaucuggcaucauaaauuuucagccaggcaugguagcucaugccuguaaucucggcacuugaagagaacaagcagggacgauaucuugagcccaggaguucaagaccagccugggcaacauacugagaccccugucucuacaaaaaaaaaaaaaaaauacaaaaauuagcugggugugguggugcuguagucccagcugagaggugggaggacugcuugagcccacgaggucaaagcugcagugagccaagaucacagcauugcauucuagucugggugacagaagacgacccugucucaaaaaauaaauaaauaaauaagacgggcgcgguagcucacgccuguaaucccaacacuuugggaggccacgguggguggauugcuugaggucaggaguucaagacucgccugaccaacauggugaaacccugucucuacuaaaaauacaaaaauuagccgggcaugguggugggcacccauaaucccagcuacucgggaagcugaggcaggagaaucacuugaacccaggaggcagagguugcagugagccgagaucgugccagugcacuccagccugggcaacagagugagacucugucucaaaaaaaaaaaaaaauuaaaaauaaauaaauagggccaggcgcaguggcucacgccuguaaucccagcacuuugggaggcugaggcggguggaucacaaggucaggagaucgagaccauccuggcuaauauagugaaaccccgucucuacuaaaaauacaaaaaauuagcugggcgcgguggcgggcgccuguagucccagcuacucaggaggcugaggcaggagaauggcgugaacccaggaggcggagcuugcagugagccaagaccaugccacugcacuccagccugggggacagagugagacuccaucucaaauaaauaaauaaauaaauaaauaaauaaauaaauaaauaaaaauuucuauuucuccagagagcuuaaagauaacaaagcaugaaauugucucccaaaggcauucagugugacucaggugcucguuaacaaacacaguugaccuuaauuaaguuucuccugaaccacagugcacuaaagagccugcaagguccccuggcaccccaggauucccaggcgccacuccaggaggcugugggccgagccucccagcgcacacugcucgcaagcggccacugugcucugcaaucuccgaguauaaugucgcuuuguccacuccugcugaggccaggacaaccaauuaauucucuuucccccaucuuaauacccacauucauauucaggccacuguugcuggucaauaaagcagagggacucuacaaaugaggccuugcacccagaaggcaccuguucgaaguccucaguagaggugaccauguggacccacaugugccugggguuuugcagguugaccuuccagauacaaaccuuaacuggcauuucuuccaagaucuuuuguucaguaggagcugguguucaucuuaaauccacccucacuccacucuagcucaguacacacacacaguagaaacuugagagcugcuuguugaguugaacugaaucuugguguccuacaacugcugaauauuaaaccuuuuuagaagcgucuauaccuaugggaacagacuuuuagagaagcauugucuccuuuacacaacccaaccagggaucagcaaauguuuuccgcaaagggccagauaguaaauauguuuggcuuucggugcugucuggucucuguugcaaugacucaacucugccauuacaaggugaaagcagccauagacaaugcauuuaagugcaugcaugugcauguggcugugccaauaaaacuuuauuuacaacaaccagcagcaggccugcgucaggccccagaucuguagaaagaccaugugauugaccaaauggucuccagucacacaaacacuaauugucaggcugagggucaccauauuaaggccucaaaaaccacucagaagccucucccgacugaggcuaaaauagaaacuaauguaauaggaaagccagcuaaaaucugacuccuggcugggcgcaguggcucaugccuguaaugccagcacuuugggaggccaagguaggaagaucacuuuagcccaggaguucaaggccagcuugggcaauguagcaagaccccgucucuacaaaaacaaaaauuguuuuuuuaaauaagggugcacaccuguggucccagcuacucaggaggcugaggugggaggauugcuugagccugggaguuugaaguuacagugagcugugguuaccccacugcacuccagccuggacaacagaccaagaccuugucucaaaaaaauuaaauaauuauauaaauaaauaaaaucccccuggcuccacguguuuugcaggcugugcauucacuuuugcaccaaucucucaaggcuuuuaaaaaaugugcaguccucacacaagucaaaagugccgaaugucagccagccauggggucccugccaaagagagcugcucuccaggcccacccacagcaucaucacaauuccaaccugaagcagcaacacauaugacacagccuccaccccauuccguuaggagcagcugucauguggcugggggcugagguuuguguguggacuggaaggagagaggugggggcucgcgguccucugagcugaacucucccucucauucggcaccuucacccacaagccaccuuuguccuucacaaaagccaccugggcucugccucagacagacagcaguucacagcaugcaggccaaucucuuagcuaacuucacgggaacgagcacuuacauucucccuccuccaggcccaagauuucauaaccagaaacuccagcauccucuccugggcugcacugcaguuguucagguaaagagaaagcucuuaaaccaauugcucagaaucuugccuggggcuuaggaaagagccugcaugagcgaagcagcaucuucauuugcugcagagcccagccuggguucacagcaccucugaggccagagagggccuggagaaccugagauccuaaacccaucacgagccuuuccuugaaaaauccuugcauuucggcuugggagggagggaccugauccacugagaaacccguacucuagguccugagccaagcagcauccagaccuuggguucccaagggcaggaagaccaagcugugaagcugagcggcccuggcaccgugucagggagcgacugugggagccgccuccccucuguaagaugcugcuucccagucuguaggacggcaacguugacgccucccaggaggagccuugugaaaaggauguagcccgggaguauggagccugcacagagccuggcacguggcagggacccacauacaguggcaauuacuguaaguguuggaagcacgaguuucggaggcagcccguccuguuacacacaggccacaccugcucucccaccacaaaccuccaacuacucuaacgcgccggaauagaacucaaaugaggcuugaauuccucuuccacgugacaaccuuccaacacucaaaaacuuccugggacuggggcuccaguccucuccauuccacaccacagagucccccauuuucucaguccugccuuuugucacacagauuccagggccauugcacccugaucccuucucagguggcucagccaucagcauccucuaaagaggccagaggcugggcccaucucucuuccacaucuuugccguccacccguccuuggguucuggcaccaagaacauuggggucugcaaggcucaugccaaagcucagacuucuaguugagacagacagaggaacuguuuccucgcagcuugggcagaggacgccacggaagcgcaaacgugaaucagccugugccuucugcgggugaaaccagucaucagccggcccccugcucgacuccaaacagcaaaggaagaaauucaauauggccaggucucccagguugcugagcccuuggguggcagauggcgacuuuuauucucacucuuuaccacggccaccgcgagugcccccagccuucccuccucucgccguggccuccccauuuauuagagacuuguuugcuaggggcccagcugagccucccuccucccuuuguaacaugccugcugguguaaccucagugacaggcacccaaggccaggagacaauguuuguuuagcaaaacucacaugguacuuccucauucuggccacuguucugagaaccuugccaguguuaacuggcugacuccuaacaaagcucagacaggugccccuuucuucccuuauuacacaggaggagccugaugcaaaaggaggugacacagccacagccacagcuguggucggcagaugcccugaucuccagaaccugugcccucaucacaugggugagggacgcugagccugccagucaaccacccugaaaacaagggccaggauggaucccacaaaaucacagggguccuuuaaacccuuagaagagggaagcagaggggcugguucagagggaugcuguguaggacagaccugaccugacugccuuuucggagagaggauaaaaccaggaaaucaggcaggcuccagaagcuaggaaagucuaagaaacagguuccucccuucagccuccagaaaggaaugcaauccugcaagcuuugacuuuagcccagugagagacucauuugggacuucugaccuccagacuacuuaaagacaauauaucuaugguuuuaauuuuuauuuauuuauucauuugagacagggucuuacucuguugcccaggcuggagugcagugguaugaucauggcucacugcagccucaaccucccaggcucaagaaauccucuuaccucagccucccaaguagcugggacuacaggugcgcaccacuacaccuggcuaacuucuuuauucuuuguagaaaccgucucccuguguugcccaggcuggucuugaacuccuagguucaggugauccuuucacuucagccuccuaaaaugcugggauuacaggcaggagcuaccaugcccagcaaauuuguguuguuuuaaguaacuaauuuguuauagcagcaauaggaaacugacacagacuuuggaacugggagcagagagaggcugucacgaauauggaaguggcuuuagaacugggcaauggcagaucugggaggaucugaggaucaugagagggcagcccggauuggccuaaacagaugguuggcaggaaggugcacaugaacagcccugcuggugaggaaucagaaggaagcgagaagcauagcagagaaaaccugcauccucguagugaacaccuccaccagaaggagccaauuacagguggaagccuggggucugaaugaggacuguguuaucagaagcuggaggagggaggauguggugccagagagcucagcugagucgugccccacagcugugagggaagcaucacugugugaugaaguuggauauguagcugaggagauuuccaagcaaaguguugaagguguggauuuuucuugcuguuuauauuaagaugaggaagaacagauaggaugagggaagaauugucgaacaaagaggagcaggacuuggugaugugggaaguccucagucaggcagauugcugggaggcucacacuaggaggcccaccauccggaacgccugugcuggagaggaggcccugguguggccacauaaccuucugcuggugccucagaaggacccaaaggccagaggacucucaagagaccaagaugucucaucuuugcgguggccacuauucugucugucacagccuggcuucaggcucccacagacgugcauccauuccacaugcaaaaugcacucacucucuccaacacccaguccccagagacgcagcuggagcuggaugccggcacagggaaguggcgcaagucugggcuccccgccgccuuccaagcuggcucuucaagggccaggugcuggggaugcaaacgugagucagguaaugccccugcuccccccgccucccggccgccaggccacggccuuuagaagggaaggaaaacaaauguggagagcauucugucuccagggcucuggggaccaggucugugcugggcacaccagccgcuuucucaucagccugucguauuuucuucagagcaacgaucagaugugaagcuguaccauucacuucuugccugccuuucccccuccucuggaauccagggccugcggggcagcggccagccggccugcucacugcuguagaacgagggcccaaacagugcccggcaccggggagccucaguuuauauuugccaacaacaggcaacaccacuuuaggcuguccugagcaaccgggcaacacagaggagcacagcaguacgucuucuagggcucugccuccucgcugggcaaccuccuuuugcuuccuggauguacccacccaugcacagcaaccacuccacaucugugugcccaauuagacaagggcugggaguggcaagugcccccuaaaagggcauaaugagacaaggugaguuggaguuggaugaaccaaggucuaaaucccacuuaacuucugcugucuucccacuuuuuuuuuuuuuuuuuuuugagacagagucuuacucuugucacccaggcuggagugcaauggcgcaaucuuggcucacugcaaccuccgccuccaggguucaagcgauucuccugccacagccucccaaguagcuaggauuacaggcgccagccaccacacccagcuaauuuuuguauuuuuaguagacacggguucaccacauuaaccaggcuggucuugaacuccugaccuuaggugaucugcccgccucacccuccuaaagugcugggauuacaggcaugagccaccgcgcagcccugucuucccaucuguuuuuuuuuuuuuuuuuuuuuuugagacagagucucgcucugucaccggguuggagugcaguggcacaaucuuggcucacugcaaccucugccuccugguucaagcgauucuccugccucagccucccgaguagcugggacuacaggugugcgccaccacgcccugcuaacuuuuguauguuuaguagagaugggguuucaccauguuagccaggauggucuugaucucuugaccucgugauccacccaccucagccucccaaagugcugggauuacaggcaugagccaccacgccuggccccaucuuuaacaugcaaauaaucacaccucccucuggaggacuguugugucaauggaauaggguaauguacuucugcccugccaacucucuucccccucuucagcuccauccacugccugccuugcaggcuacaagcagccaggcauuggguguacacugacccccaugcaaucguuuuuacuauuaaacauccugucgcccucugcacaccugcacccccaccccagcccacccugccuuguguggcuaaaagcaacuuucaaaaugguuccuccuccggcugguccuuaccauucugccucgguuaugacaauuacaacaaaaacaacuugaaaagcaaugucugugggguggagagaaaguuuaggagcucagcaaaagaaggaaaagaacaggguccccuaaauguuaaauucugaauuuccaacaauuauagaaaagguaucuguuccuaccucucuuuucccuucaaguacccggucaggccacaggccaccgaggaggcaggcaagggugcccugugucccugccaacucugggcaagggccgccugaguguguacacaggaagucaggaauguggagaaggggccuggccacucucuguucugaggagcucuaguaauucacccuuaggaucuuucgaacaagcagcagcagccucggaugccaggaaaugagcugcugccccccaguaacgcuucaagacaucuggggcgucacaucagcacaacugcaaaaucucuggugaucaggauuccggcugcaucacguccuuggugcugaagaagcaagaggccaguggaaacgaaacugcugcuucauucccuccgaugcaggggccguuccagcacugcagggcagcucuuguuccagaaacacaccguguguuaagagucugccuccaacgguggccacuacagggguuucgguuagggucccccaauaacacuccugcauuaaccuugcuacuuguaaaccaagggcagcaguaaaucccagccaaccagcaaaagcagcagaggggcaaagcuuuguacaaaaccaaauuggguucaauuugacuuuguacagaagcaaauuggguucgugaauuggguucgauuugacuucuagagcguguguuccaucguuaccaaaugcucagugugagggagucagcucaguaaaccucauccugcagccugaggcagaagacagaguuggagcaaagaucagggaaaugcaccucuuuaccugggggacauuguuuucacaagaugauugccaauaaauuagucacgauguuaacugggauaauaauaaaaaagcaucaaagaaggcaaaagggagggggagaacuggaaguaccucugugagcuucguuaauucaguuuuaaagagagaauucauuaucaucuuguuuauucagcauacugauacacccaagauggcaauuuaagaauucuggacggggccuuuggguauaugacuuuuuaagaugcuaacauaaaagaagucagaacuuucagaguuucaggcuucuaaaaacucacacucauugaaaaugugucacacuauuuccaguuucuucauucacuuacaauaucuuauucuuuuguaaggagaaggaaauauauuccauugcaaugcuacaaucaccaguguuauuuuccaaaguuaaacagaaagccugaauugagauccucuaaguuguacuuuugaaaagucacaaauacuacacaauaaaaauaacucauuaccuaucuuaaaaaugcuuccaccggaagucacuccaacccaaacccauaugacguaucugagccaagaucaagcagaagauuaacuguaaaaggcagauaugcuccgggcuaagagguccggaggcuccaguuuuauuuccucucuccugacuaaacccaacaggggggaacacucugugccucauuuuacuuuuucuuagaaaggggcuaauaacaccagcucugcucaccccucaagugaaucucaaaggauaucauguuccuacggguacgugaaaacugaaaauaccuaacaaagcagccacagaggagcgucucugguucccagggcggcagagcaggaacgcggggcucgggagcaaaggcagcuuagguacacaaaugaccagcggguucucugcaacuuggguugucccugaggucacugaguggcugagaggcagcgcucagcccaaccagcaagggaggacgagugggaaaccccgagaaggaggcauuugcuguccgaggccgggacccugugcgcggccgggugcccugcuggaagccccgcgccccccguccccggcggagccccagggcgguguggcucaugcggcgccggccucaccugcggugucccagauggagauguuguaggagcgccacugcuucagguagaaggcgccgcccaccgugcugaccguguccgggaagcgccgcuccauauaccgcugcagcagcgacgucuuccccacguucaugucccccaggagcacgaucuugcugucgggcuuccucaucuucccguaagaacccccagcgcccccgcgcccucuccccgaggcuggccggcucgugcgcccugggcgcagcuggaggagcggaccccggacucgccgggacccggauucucgugaacgcuccgggaccuucgccuccggacgcccgggagcucaagagaggaagcgcgugugcgcgcccgggaaggagcugggugcagagcac

SEQ ID NO: 192994 - RNA, 38659 nt, Homo sapiens
gugcucugcacccagcuccuucccgggcgcgcacacgcgcuuccucucuugagcucccgggcguccggaggcgaaggucccggagcguucacgagaauccgggucccggcgaguccgggguccgcuccuccagcugcgcccagggcgcacgagccggccagccucggggagagggcgcgggggcgcuggggguucuuacgggaagaugaggaagcccgacagcaagaucgugcuccugggggacaugaacguggggaagacgucgcugcugcagcgguauauggagcggcgcuucccggacacggucagcacggugggcggcgccuucuaccugaagcaguggcgcuccuacaacaucuccaucugggacaccgcaggugaggccggcgccgcaugagccacaccgcccuggggcuccgccggggacggggggcgcggggcuuccagcagggcacccggccgcgcacagggucccggccucggacagcaaaugccuccuucucgggguuucccacucguccucccuugcugguugggcugagcgcugccucucagccacucagugaccucagggacaacccaaguugcagagaacccgcuggucauuuguguaccuaagcugccuuugcucccgagccccgcguuccugcucugccgcccugggaaccagagacgcuccucuguggcugcuuuguuagguauuuucaguuuucacguacccguaggaacaugauauccuuugagauucacuugaggggugagcagagcugguguuauuagccccuuucuaagaaaaaguaaaaugaggcacagaguguuccccccuguuggguuuagucaggagagaggaaauaaaacuggagccuccggaccucuuagcccggagcauaucugccuuuuacaguuaaucuucugcuugaucuuggcucagauacgucauauggguuuggguuggagugacuuccgguggaagcauuuuuaagauagguaaugaguuauuuuuauuguguaguauuugugacuuuucaaaaguacaacuuagaggaucucaauucaggcuuucuguuuaacuuuggaaaauaacacuggugauuguagcauugcaauggaauauauuuccuucuccuuacaaaagaauaagauauuguaagugaaugaagaaacuggaaauagugugacacauuuucaaugagugugaguuuuuagaagccugaaacucugaaaguucugacuucuuuuauguuagcaucuuaaaaagucauauacccaaaggccccguccagaauucuuaaauugccaucuuggguguaucaguaugcugaauaaacaagaugauaaugaauucucucuuuaaaacugaauuaacgaagcucacagagguacuuccaguucucccccucccuuuugccuucuuugaugcuuuuuuauuauuaucccaguuaacaucgugacuaauuuauuggcaaucaucuugugaaaacaaugucccccagguaaagaggugcauuucccugaucuuugcuccaacucugucuucugccucaggcugcaggaugagguuuacugagcugacucccucacacugagcauuugguaacgauggaacacacgcucuagaagucaaaucgaacccaauucacgaacccaauuugcuucuguacaaagucaaauugaacccaauuugguuuuguacaaagcuuugccccucugcugcuuuugcugguuggcugggauuuacugcugcccuugguuuacaaguagcaagguuaaugcaggaguguuauugggggacccuaaccgaaaccccuguaguggccaccguuggaggcagacucuuaacacacgguguguuucuggaacaagagcugcccugcagugcuggaacggccccugcaucggagggaaugaagcagcaguuucguuuccacuggccucuugcuucuucagcaccaaggacgugaugcagccggaauccugaucaccagagauuuugcaguugugcugaugugacgccccagaugucuugaagcguuacuggggggcagcagcucauuuccuggcauccgaggcugcugcugcuuguucgaaagauccuaagggugaauuacuagagcuccucagaacagagaguggccaggccccuucuccacauuccugacuuccuguguacacacucaggcggcccuugcccagaguuggcagggacacagggcacccuugccugccuccucgguggccuguggccugaccggguacuugaagggaaaagagagguaggaacagauaccuuuucuauaauuguuggaaauucagaauuuaacauuuaggggacccuguucuuuuccuucuuuugcugagcuccuaaacuuucucuccaccccacagacauugcuuuucaaguuguuuuuguuguaauugucauaaccgaggcagaaugguaaggaccagccggaggaggaaccauuuugaaaguugcuuuuagccacacaaggcagggugggcuggggugggggugcaggugugcagagggcgacaggauguuuaauaguaaaaacgauugcaugggggucaguguacacccaaugccuggcugcuuguagccugcaaggcaggcaguggauggagcugaagagggggaagagaguuggcagggcagaaguacauuacccuauuccauugacacaacaguccuccagagggaggugugauuauuugcauguuaaagauggggccaggcgugguggcucaugccuguaaucccagcacuuugggaggcugagguggguggaucacgaggucaagagaucaagaccauccuggcuaacauggugaaaccccaucucuacuaaacauacaaaaguuagcagggcgugguggcgcacaccuguagucccagcuacucgggaggcugaggcaggagaaucgcuugaaccaggaggcagagguugcagugagccaagauugugccacugcacuccaacccggugacagagcgagacucugucucaaaaaaaaaaaaaaaaaaaaaaacagaugggaagacagggcugcgcgguggcucaugccuguaaucccagcacuuuaggagggugaggcgggcagaucaccuaaggucaggaguucaagaccagccugguuaauguggugaacccgugucuacuaaaaauacaaaaauuagcugggugugguggcuggcgccuguaauccuagcuacuugggaggcuguggcaggagaaucgcuugaacccuggaggcggagguugcagugagccaagauugcgccauugcacuccagccugggugacaagaguaagacucugucucaaaaaaaaaaaaaaaaaaaagugggaagacagcagaaguuaagugggauuuagaccuugguucauccaacuccaacucaccuugucucauuaugcccuuuuagggggcacuugccacucccagcccuugucuaauugggcacacagauguggagugguugcugugcauggguggguacauccaggaagcaaaaggagguugcccagcgaggaggcagagcccuagaagacguacugcugugcuccucuguguugcccgguugcucaggacagccuaaagugguguugccuguuguuggcaaauauaaacugaggcuccccggugccgggcacuguuugggcccucguucuacagcagugagcaggccggcuggccgcugccccgcaggcccuggauuccagaggagggggaaaggcaggcaagaagugaaugguacagcuucacaucugaucguugcucugaagaaaauacgacaggcugaugagaaagcggcuggugugcccagcacagaccugguccccagagcccuggagacagaaugcucuccacauuuguuuuccuucccuucuaaaggccguggccuggcggccgggaggcggggggagcaggggcauuaccugacucacguuugcauccccagcaccuggcccuugaagagccagcuuggaaggcggcggggagcccagacuugcgccacuucccugugccggcauccagcuccagcugcgucucuggggacuggguguuggagagagugagugcauuuugcauguggaauggaugcacgucugugggagccugaagccaggcugugacagacagaauaguggccaccgcaaagaugagacaucuuggucucuugagaguccucuggccuuuggguccuucugaggcaccagcagaagguuauguggccacaccagggccuccucuccagcacaggcguuccggauggugggccuccuagugugagccucccagcaaucugccugacugaggacuucccacaucaccaaguccugcuccucuuuguucgacaauucuucccucauccuaucuguucuuccucaucuuaauauaaacagcaagaaaaauccacaccuucaacacuuugcuuggaaaucuccucagcuacauauccaacuucaucacacagugaugcuucccucacagcuguggggcacgacucagcugagcucucuggcaccacauccucccuccuccagcuucugauaacacaguccucauucagaccccaggcuuccaccuguaauuggcuccuucugguggagguguucacuacgaggaugcagguuuucucugcuaugcuucucgcuuccuucugauuccucaccagcagggcuguucaugugcaccuuccugccaaccaucuguuuaggccaauccgggcugcccucucaugauccucagauccucccagaucugccauugcccaguucuaaagccacuuccauauucgugacagccucucucugcucccaguuccaaagucugugucaguuuccuauugcugcuauaacaaauuaguuacuuaaaacaacacaaauuugcugggcaugguagcuccugccuguaaucccagcauuuuaggaggcugaagugaaaggaucaccugaaccuaggaguucaagaccagccugggcaacacagggagacgguuucuacaaagaauaaagaaguuagccagguguaguggugcgcaccuguagucccagcuacuugggaggcugagguaagaggauuucuugagccugggagguugaggcugcagugagccaugaucauaccacugcacuccagccugggcaacagaguaagacccugucucaaaugaauaaauaaauaaaaauuaaaaccauagauauauugucuuuaaguagucuggaggucagaagucccaaaugagucucucacugggcuaaagucaaagcuugcaggauugcauuccuuucuggaggcugaagggaggaaccuguuucuuagacuuuccuagcuucuggagccugccugauuuccugguuuuauccucucuccgaaaaggcagucaggucaggucuguccuacacagcaucccucugaaccagccccucugcuucccucuucuaaggguuuaaaggaccccugugauuuugugggauccauccuggcccuuguuuucagggugguugacuggcaggcucagcgucccucacccaugugaugagggcacagguucuggagaucagggcaucugccgaccacagcuguggcuguggcugugucaccuccuuuugcaucaggcuccuccuguguaauaagggaagaaaggggcaccugucugagcuuuguuaggagucagccaguuaacacuggcaagguucucagaacaguggccagaaugaggaaguaccaugugaguuuugcuaaacaaacauugucuccuggccuugggugccugucacugagguuacaccagcaggcauguuacaaagggaggagggaggcucagcugggccccuagcaaacaagucucuaauaaauggggaggccacggcgagaggagggaaggcugggggcacucgcgguggccgugguaaagagugagaauaaaagucgccaucugccacccaagggcucagcaaccugggagaccuggccauauugaauuucuuccuuugcuguuuggagucgagcagggggccggcugaugacugguuucacccgcagaaggcacaggcugauucacguuugcgcuuccguggcguccucugcccaagcugcgaggaaacaguuccucugucugucucaacuagaagucugagcuuuggcaugagccuugcagaccccaauguucuuggugccagaacccaaggacggguggacggcaaagauguggaagagagaugggcccagccucuggccucuuuagaggaugcugauggcugagccaccugagaagggaucagggugcaauggcccuggaaucugugugacaaaaggcaggacugagaaaaugggggacucugugguguggaauggagaggacuggagccccagucccaggaaguuuuugaguguuggaagguugucacguggaagaggaauucaagccucauuugaguucuauuccggcgcguuagaguaguuggagguuuguggugggagagcagguguggccuguguguaacaggacgggcugccuccgaaacucgugcuuccaacacuuacaguaauugccacuguaugugggucccugccacgugccaggcucugugcaggcuccauacucccgggcuacauccuuuucacaaggcuccuccugggaggcgucaacguugccguccuacagacugggaagcagcaucuuacagaggggaggcggcucccacagucgcucccugacacggugccagggccgcucagcuucacagcuuggucuuccugcccuugggaacccaaggucuggaugcugcuuggcucaggaccuagaguacggguuucucaguggaucaggucccucccucccaagccgaaaugcaaggauuuuucaaggaaaggcucgugauggguuuaggaucucagguucuccaggcccucucuggccucagaggugcugugaacccaggcugggcucugcagcaaaugaagaugcugcuucgcucaugcaggcucuuuccuaagccccaggcaagauucugagcaauugguuuaagagcuuucucuuuaccugaacaacugcagugcagcccaggagaggaugcuggaguuucugguuaugaaaucuugggccuggaggagggagaauguaagugcucguucccgugaaguuagcuaagagauuggccugcaugcugugaacugcugucugucugaggcagagcccagguggcuuuugugaaggacaaagguggcuugugggugaaggugccgaaugagagggagaguucagcucagaggaccgcgagcccccaccucucuccuuccaguccacacacaaaccucagcccccagccacaugacagcugcuccuaacggaaugggguggaggcugugucauauguguugcugcuucagguuggaauugugaugaugcugugggugggccuggagagcagcucucuuuggcagggaccccauggcuggcugacauucggcacuuuugacuugugugaggacugcacauuuuuuaaaagccuugagagauuggugcaaaagugaaugcacagccugcaaaacacguggagccagggggauuuuauuuauuuauauaauuauuuaauuuuuuugagacaaggucuuggucuguuguccaggcuggagugcagugggguaaccacagcucacuguaacuucaaacucccaggcucaagcaauccucccaccucagccuccugaguagcugggaccacaggugugcacccuuauuuaaaaaaacaauuuuuguuuuuguagagacggggucuugcuacauugcccaagcuggccuugaacuccugggcuaaagugaucuuccuaccuuggccucccaaagugcuggcauuacaggcaugagccacugcgcccagccaggagucagauuuuagcuggcuuuccuauuacauuaguuucuauuuuagccucagucgggagaggcuucugagugguuuuugaggccuuaauauggugacccucagccugacaauuaguguuugugugacuggagaccauuuggucaaucacauggucuuucuacagaucuggggccugacgcaggccugcugcugguuguuguaaauaaaguuuuauuggcacagccacaugcacaugcaugcacuuaaaugcauugucuauggcugcuuucaccuuguaauggcagaguugagucauugcaacagagaccagacagcaccgaaagccaaacauauuuacuaucuggcccuuugcggaaaacauuugcugaucccugguuggguuguguaaaggagacaaugcuucucuaaaagucuguucccauagguauagacgcuucuaaaaagguuuaauauucagcaguuguaggacaccaagauucaguucaacucaacaagcagcucucaaguuucuacuguguguguguacugagcuagaguggagugaggguggauuuaagaugaacaccagcuccuacugaacaaaagaucuuggaagaaaugccaguuaagguuuguaucuggaaggucaaccugcaaaaccccaggcacauguggguccacauggucaccucuacugaggacuucgaacaggugccuucugggugcaaggccucauuuguagagucccucugcuuuauugaccagcaacaguggccugaauaugaauguggguauuaagaugggggaaagagaauuaauugguuguccuggccucagcaggaguggacaaagcgacauuauacucggagauugcagagcacaguggccgcuugcgagcagugugcgcugggaggcucggcccacagccuccuggaguggcgccugggaauccuggggugccaggggaccuugcaggcucuuuagugcacugugguucaggagaaacuuaauuaaggucaacuguguuuguuaacgagcaccugagucacacugaaugccuuugggagacaauuucaugcuuuguuaucuuuaagcucucuggagaaauagaaauuuuuauuuauuuauuuauuuauuuauuuauuuauuuauuuauuugagauggagucucacucugucccccaggcuggagugcaguggcauggucuuggcucacugcaagcuccgccuccuggguucacgccauucuccugccucagccuccugaguagcugggacuacaggcgcccgccaccgcgcccagcuaauuuuuuguauuuuuaguagagacgggguuucacuauauuagccaggauggucucgaucuccugaccuugugauccacccgccucagccucccaaagugcugggauuacaggcgugagccacugcgccuggcccuauuuauuuauuuuuaauuuuuuuuuuuuuuugagacagagucucacucuguugcccaggcuggagugcacuggcacgaucucggcucacugcaaccucugccuccuggguucaagugauucuccugccucagcuucccgaguagcugggauuaugggugcccaccaccaugcccggcuaauuuuuguauuuuuaguagagacaggguuucaccauguuggucaggcgagucuugaacuccugaccucaagcaauccacccaccguggccucccaaaguguugggauuacaggcgugagcuaccgcgcccgucuuauuuauuuauuuauuuuuugagacagggucgucuucugucacccagacuagaaugcaaugcugugaucuuggcucacugcagcuuugaccucgugggcucaagcaguccucccaccucucagcugggacuacagcaccaccacacccagcuaauuuuuguauuuuuuuuuuuuuuuuguagagacaggggucucaguauguugcccaggcuggucuugaacuccugggcucaagauaucgucccugcuuguucucuucaagugccgagauuacaggcaugagcuaccaugccuggcugaaaauuuaugaugccagaucaaauugcccuucuuucuguauugagacuucauauaacaucccucuccaagaaaaauaaauuuuguacaaacauacacacacguacaaacacacacgccuaaacagcuguugauucuuaggauaauggauucaucacugcgacgacagaguuccaugguccagcuggccgcgaacgcuggcccaggcagguuccagcuucguuucaacccuggcuucccuggugcugucucuucugcaccucacugaggggucuuucugccaggccuccuggaucuggucaccuucccugcucagagccccuccagcacuccccagcuuaucacuccucuuaucugccugcuggcacuugagcccugauguacgauuugcaguucguccugugugcccugucuuugcucgguucucacaggugcuuacagcgucucuggccaugcccagcuugaauuuuaucccaucuuucagugaagcauuucuuggucuuuguagcagagggaagaauuccuccuuccaccaaacugcuacaaagugaccuugcaccccauaguacauacugcugguugucuguuuuucugaucucuuuuucuuuccuuggauuuauaaacuccuuggguuuuacucacuuggaguuuuccauagaauguaauguuuugcucugugauauuuuugaaacuaaguuuuugcugaaggaaacuuuugaaagcaguggggaaaauucacagacugacauuagcaguuucauuuucuuagcgauguauugacccugaaugauaaaauuaguguggaaauaucauuguccugagugcugugauacaauaggccauugugugcgugguagggaacugugggucugggacauuaauuauaugguauccuaaaaaacuucuuuaguagcucuugauuucuuuugaguucaauaucauugcaaaucuauuaaaaagacuaacauaccaggacuguguuucugggaaguuggaaaagauguauuuuccccuacucuucccucuaauuacagcccaaaaccuuggauuuuaucuuaaaagcaaacauaagacucuggaagguggcaaggagaaggcagauccacuagauaccucgggaauguguuucaggaaaaaacucuaaacccgaguuuuuccucugcucucacagcgccacagccaucauugacacaggaaacuccugugagcaaagguguaggguuuuucccacacagcgagcaguggauaccagcuggguguccuccaguuuaauucugccacuaucuacccggagguagcgucucauaccacagggugagggcucagucucacaagaccaccccuuccuucccccuaguugcaauuccaggcaucuggaauuucugauccaccggcuucagguggggguucccacgacccccucuuuggguucaauuaauuugcugggaaacgguugcuuauguuuguuuacuaguuauuagacaggauauugcaaaggauacaaaugaacaaccgcaugaagagacacauggagcaaggucuggaaggggugccacggaauuggggugccacagaguugggguccauggaguuggggugccacagaguuggggugcccuuguggcaugggggugaguucuucuucaccuuccuguuggccuccaugugcucggcuuucugggagcucccugaacccuguuuucugggcuucuuauggagacuucauugguugucugugguugaggcaugggcaucaugucaaaaugugauuggaaaggccgggugugguggcucaggccugucaucccagcagugugggaggccgaggaggguagaucacuugagggcagaaguucaagaccagcccggccaacauggcgagacucugucucuacuaaaaauacaaaaauuagcugcgcuugguggcgcgugccuguagucccagcuacucaggaagcuaaggcaagagggucguucgaacccaggaggcggcagagguugcagugagcugagauugugccacugcacuccagcccgggcaacagagcaagacuccaucucaauuaaaaaaaaaaaaaauuuaaaaaagugugauuggauaaaaagggugcagucuaagcccagcaaggccugucuguucagauuccccaggccucucugcagcauuccuuccucuaggguauggggcaggacccucucuggaaggagggucuaaugacccacaaucagauuagaguccggccugggccaggugaaaggaggacaggagaaggucagagagaaagauuuuguuccugaggccuaaggcacccaacauuauaacaauagauuguaacaauggcuguaagaaucaugagcuaggaaccguggaugaaaagacacaguggugaguucccuggauuccagauucagggcugaagaagcuagaaauucggaaaugccaaagggcacaggcaaaaugaaucugcauucaagaauucagcuuuugucugaaauauuccuuccugcuuaacccaagcugauacaaaucaacacacuuaacuuuuaguagcuuauauucuaacacagaccaagcuaagcuuguagcuccaagcaaagcauuuuguaaauauuugcugauuuguuuuguggacucacaagauguugauggcaacggaugucuuuccucccucuggccuaaccgcucuccgcacacuggucuuaagccucugaaauagcucagcuaccuacugcuaggguucugcaaggaagucaggguaguguccuaugaaaaacuggccugggaaguuuggaaucaucacacacauguucaggccucuggguucuguagggacccagcccuuaccuggcuggagcccugggcugugagagcagcaggcauuuaucaugcuucugggugccagacaucacacucagugccuucuggcauuguccauuguuccggcauccacuuugugugcuugguguuauccucaccucucggugcagaugaggaagcugaggcccagagagccuagggagcuugccacagguugcacuccagguuggggagugcagauuugagguggguuuuugucaaaguccacccuuccuggcacugagcugguuaagaggcuacgauggagccuggaccccucacauuggagcagugcccaccgacagaccccgcauaaaaaaggaacagaacagaccuaaccaagaaaucaggugagcccaccgcgcuccccuggugccuucaugaggauggaggcaggugagacugaauuguggacauuuccagaaugacaagaguuuuuuuuuguuuuuauuuuuguuuuugagacaguuucauucucuugcccaggcuggaguacaguggugugaucucggcucacugcaaccuccaccucccagcuucaagcaauucuccugccucagccucccgagaagcugggacuacaggugcacaccaccacaccuggcuaauuuuuguauuuuuuguagaauugggguuucaccauguuggccaggcuggucucgaacucaugaccucaagugaucugcccaccugggccucccaaagugcuggaaugacaggugugagccaccgugcccggccgaauuaugguguuuucuaauccauaaaagaaaaauuguuggaucaaaaagauguagcauucuaacugaaguugccuugaggauaacagugucuuuuauuuuuguagucuguugaccagguuuccuauuuguauuuuggaaauucucaauuuuauuacuaagagccuugacggcauaaggaguugcucuggugguagcuucacaguuauagaauaccugcuaugggaaacuuuuugcuccagguuauaucugaaaugcuuaccuauauuuuaaaguaaguguuuagauacaaagaauaaaugggacggccuauuugcaauacuguuguguaggcugauuagcauuagcuuguggggucaugcaggcuucccaagacugagguuccagucuacagacuuuggccuuauagcuuuggccuuaaauuauagccgaugcuuccacaacacuuaauaugugccagaggcucugcaaaacgcuuccccauuuuagcuccuuuaauccucucuggcaccguagcagguagcaagguuauuuuccaggagugguggaguggggaucugaucugggcagaccuguccgaggauuuaugcacuuaaucucaccagccugcuguguccuucguagaagugacuuggauccuaaagugagaguggaacuggaaaggaauugcuccaaguaugcauucacucacacaagguaauaaauguacaucgggcuacguucuauuucgugcauggggugccugugaacuagaaaaguccugcugcacccaacgauaguaaaugaaaaacaguuucaaccuguggccugucucaucacuaacgagaucaauguguuaagauuccuguuaacgcuuuccccguguagaauuaagcgcacuucauucacauaggaagcuuguugcgccucgugucugagcugcgcuuucucauuuaugcagagccagcugauucaguguguuuggggcagggguccguucccuucccugaccuuggcugcucuaguucaggacagucugguuagaggaggcgccguguagaccgcugugauuuggcgcaacagucagcuuccuggccuugacuggcggcauuccaggcuucugacauaugaguccuugagaaggaggaacacuuucuauuguuugugguacagaaguucagcuuggccaggcguggugacucacgccuguaaucccagcacuucgggagacucagacgggaggaucccuugaagucagaagauagguaccagccaaggcaacauagcgagacccugucucuacuaagaauugaaaaaaaauugccaggcaugguggugcacaccuguagguucagcuacuggggaggcugaggugggaggaucacuugagucugggaguuugaagcugcagugagcugugacugcaccacugcacuccagccugggcaacagagugagacccugucucaaaaacaaacaaacaaacaaacaaacaaacaaaaaacccaaaaaacaaaaaaaaacagaaguucagcuuguacuguucacagaugcuccaggucaguuaagauuugugagccugggugucacccagcaccaugccaugacacacgcuuaguggcccugucacacagaccaaggguggccugcagagccgcugagugcaucaauaaaaaaugaggcauuucuacuuagaaauggaagacucaugugugacugugcuuccuuguggguuggaacugccuuucgggacgcuaccaucucauggcauaacuugaaaugacuuauguugcccaaauaggugaauuuaggguuguaccuuucccucacagcuguauuugggaucagcagguuuucuuuuuagaugaaucaauuggaacacuuuuagaaaacaaaaugaagauaugauccugucucugagucucagugaugucuucuuaaaacuguaguaauaaaccuuauuuccagggacaguuaugaagcuuaaauaagaugacagaugugcagggagcccagcaugguucucgacucucaguaaugcaaugucaucuucuuucuccuggcacaucauagguucccuuagcuuuuguaaagggugauaaggauuaaauggcugaggcuuuuuuuuuggugccuaucucaugggguuucucugcuaugugaaggaaucacuuucagaauuauggauuggaauggcucugguuggacauugacuuuucaucugcuuugcuguaugcuugguccuggcuucugggugaagacuacaggauccacgguguuucuguggagucagaucaugaaacaggaauguagagcucagaaguaaaugcagcauuuucccccacagcaaggcucuagucauuaauugcuuaauaauagagaacgaaggacuguaaagagguccuuaacauuacagggcauauuuuacagacuccuauugugcccuuuuuauauguugcuuuguauuuccuucuuuuugagggggagugcaggaauuuuaucaucuucccaagguggcacugaugcacuucucuagacuugcccaagcucugggggcccauguguccaccucagucaccaccucagcacaaggaucuccaagcuccuucuaguuuuaauauccugauguguguagagugaacacucagugagugugaacuugcucauuuauucagcacuuuuuggaggacugccuauaaaucagaugcucugcuaagcgugggcaaguggcaguagacagaauacgcaguccaguuggggagaccgaccacagacaaagagcauucacaauacgauuucuaacacuugcugugaggaagagaagggggugcuaggaugggcacuauuuugggagacauaauacacuuauuuaauacuuuuuaaauuuuuaugaguacauaguaggcguauauauuuaugggguacaugaaauguguugacauaggcaugcaaugcauaauaauugcaucguggaaaaugggguauccaucccucaaacauuuaucccuugcguuacaaacaacccaguuacacucuuagguauuuuuuaauggagacuguguuaauccguguucaugcugcuaauaaagacauaaccgagacugggaagaaaaagagguuuaauuggacuuacaguuccacauggcuggggagaccucagaaucauggugggaggcaaaaggcacuucuuacaugguggcggcaagagaaaaugaggaagaggcaaaaggcagaaaccccugauaaaaccaucagaucucaugagaguuauuuacuaccacaagaguagcacgggaaagacuaugcccccaugauucaauugccucccugugggucccucccacaacacgugggaauucugggagauacaauucaaguugagauuugaacggagacacagccaaaccauaucagagaccuacuugagauuugaggguguguggugcgucacuuucccucggugaggcgcuuuaccuguguuuccacacucacuguggcacuccucucugguucuccaugugucuuccuagaugucacccuccacaggcuccaguauucccgucugucugcgccacacgucucugugccuugacuucuuugaguugguuaugaccuaggucuggcuccuucauugcaugaguuuaacgugucuuuauuuuuacaucuguauuagagucaugauuuugcccuuuuuggaaaauuauuuuuuaacaugugucaagguagaauugcuuuaaaaucccacucauagauucaaugcaaucacuaucauaauuccaauggcauuuuuuacagaaauagaaaaaaauucuaaaauuuauguggaaccacagaagacccaaaauagccagcaaaauucuugcucaauuuugagcaauaauaaagcuggaagcaucacacugccugacuucaaaauaugcuacaaagcuauaguaaucaaaacagcaugaccucagcaugaaaacagacacauugaccaauggaacaggguagagugcccagaaacaaauccacacguuuacuguuaguugaucuuugacaaagaugccaagaaccuuugggggaaaggacagccucuucaauaaaugguaccagggaaacuggauauccauaugcacaacgaaaccagacccuugucucacaccauauacaaaaaucaggcugggugccuguaaucccagcauuuugggaggcugacguggguggaucgcuuaagucaggaggaguuugagaccagccuggccaacaaggugaaaccacaucucuacuaaaaauacaaaaauuggccgggugugguggcaggugccuguaauccugcuacucaggaggccaaggcaggagaaucaguugaaccugggaggcagagguugcagugagccgagaucgcaccacuguacuccagccugggugacagagugagacuccgucucaaaaaaaaaaaaaaaaaaauaacccacauuugauuaaagagucaagcauaagaccugaaacuauaacuauuagaagaaaacauaagaaaaaagcuuugcaguauuggucuggcuaaugauucuuuuuuaugugacuccagaaagcacagagaacaaaagcaaaaauagacaaaugggauugcaucaaaccaaaaagcuucugcagaacagaagaaacaaccaacagaauaaagagagaacauccagaaugggaggagauauuuggaaagcauacagcugauaagggauuaauauccaaaauauauaaggaacucaaacaacugaguaacaagaaaacaaccagauuaaacaaugagcaaagggccaggugccguggcucucaccuauaaucccagcacuuugggaggccgaggugucagaggaucacuugaggccagaaguucaagaacaggcugggcaacauagugagacccugucucuacaaaaaaauaagaaaaauuagccaggggagguggugcacaucuguagucccaccuacgugggaggcugaggcaggaggaucgcuugaguuugagguuacagugagccaagaucacaccaccgcacucuagccugggugacagagugagacuuugucucuaaaauaaaaauaaaaaaaaauaaaaugagcaaagguccugaacugaauagacauuucucaaaagaagacauacaaauggccaacagguauaugaaaaaauguucaauaugacuaauugcagagacagccaaguuagcaguacagugagcugucaggucgcaccuguuagaauggcugucaucagaaagacaaaggguaagugcuggugaggauguggagacaagagaaccccgcacauugcuggugggaaugugaacggguauggccgcgguggaagacaugaugguuccucaaaaaauuaaaacuagaacaaaugauccagcagucccacugcuggguaucugucuagaagaaaggaaaucaguauuucucagagaugucugcacucccguguucacaguagccaagauacagaaucaaccuaagcuuccacugaugugcacggaucaagaaaaugugguaaauauacaccguggaguauuauccaagcuuggaaaagggagaaauccuguuguuugugaacccggaggacaucaugguaagugaaauaaaccagauaccgaaagacaaauaccacauagucucacugaugccuggcaucugaacaaguugaacucacugaagcagaguggaauggugguuacaaggagcuggcagguggguggggagagggaauuggggaguuuuuaaucaaaggcuacgaagguucaguucugcaggcugaauaaguucuggaggucuaauguagagccccaggcaggugacuguaguuaaccaguaccaugugauaggcuugaaauuggcugagaggguggaguuucaauguucugucugcacacccaugguagcuaugugcagugauagauguguuaauuagcuuaauaggguaaucauuucaugauacaucaaaauaucauguuguacaucugaaauauuuacaaauuuugcuugucauuuauaccccaguaaagcugagaauaaaauacagcaagcguucugauuaaaaacaaaacaaaacucgucauccugcauguugugcacauguacccuaaaacuuaaaguauaauaauaauaaaauuaaaacaaaacaaaacaaaaacaaaaccaacaaacacccuuauuauuuggcaguuccuuccccaggcuguuugcaccccguuccugcugaugguggccacugguuacugucuccgugugugagcaucuggggucucugauuccagaugugugaaauguggacacaguggggagaaagaaaugcaacugugaguauguguaugugugcauggcauguacgugcauguaugugagaguguguguguguguguguguguguggcuggacacuccgccuggcacuugaaguaaacucgcagucagcuagcccuuagggaagucccuggaaggaacacugauuugguuaaagggaucagauccaguuggugcagggacacugaggaagcugagccccaggcaggcgaagggcucuggcccagagaauuccacuaauaccaagauuagggcaggcaguucccugcuaacuuggcugcuuuuccugaaaaaugagaagucagaaggaauggaggaaguuuuaaauacuuuccaaauugacauugucacuggaaaucuucuagcgaaucuuguguuaaugagaagauaagaacgaggugagcuuucauguggcaguuguauugcuauugugccugggcugauaacaauuucuggauuguuugaagacacuucguucccaugugcuaaagcugguggccuauuguuuacuuagccaggcacuuuucuacagcaguugcaaaagcacauucuaaaccuaacuaauuccaaaucugauuaacucuggccuguuacccugugccacagacccaggcaggagugauguuccugaggccugggggucagcuuucacugcuugaggaaucuguugcugcgccgugaccgugaccagguggagaguaucagaggaaggcaggagaguggugaggugugaaaagaucagcugucagguuuuacuuagagugagggguggucggcucucaccuuggguugaugagaggcugaagcguggccgucuccuccucggcaagguccucgggcuggcagcagcagaacccaggacccagccaggccuccugagccagauucuguacuuuaacccaacagccagguaacucccauuccaggggcaugggcagcugcgcggggcuugcugcagcccagcagagaccagccgugagggucggggcaguggagagcaugcucuuccagcuccucgccuucuuuguagacacuauuuugcgugagagagauacguauauauuccauauauaauguggagguuuuuuauugugguauaauauacauaacaaaauuuacuauuuuaacuuuuuuuuuuuuuuugagacggaguuucacucucguugcccaggcuggagugcaauggcgcgaucgcagcucacugcaaccuccgccuccuggguucaagagauucuccugccucagccucccgaguagcugggauuagaggcacccaccacuccgccuggcuaauuuuguauuuuuaguagagacaggguuucaccaugcuggccaggcuggucucgaacuccugaccucaggugauccaccugccucggccucccaaagugcugggauuacaggcaugagccacugcgcccggccucccuguuuagauuuaaaaaguuuucuuaauaugauauuuauaauucagucuugacuuugaaacagguuaaaaugugcuuugaaaagagcugaaauaauuuuaguuuuacuuuauuuggagacauuagcaaauaccugcacuuuuauuugauaaucucauucuaaacauucguuauuacaggacaacagaguaucucuugaagguaaaggagauuggauuacauaugcuggcaugugccaguguguguuuuaaagcuaagucuguuauauacguguauuuuuugggacuugccuguuucuguuaauaucggaguguuaaagaacaucucugaguaauuugguuuugucauugaacuauuuuuaguacauucaugucugaagagugaugugacuugagaacuaagcuucuuccugcuuuacauucaucauuuuuccagaagccacguagugggccacagguggaacuacucuaccugcaguuagugaugugagugguucauguggcguaugacacuugcuuuauuuuuaguuuauccuucagaucaucaagaagaaacaacagaaaugacacaugcagauuuggguaaaaaugcauugauguggccgggcgcgguggcucaugccuguaaucccagcaccuugggaggcugaggcggguggaucaccugaggucaggaguucgagaccagccuggccaacauggugauaccccgucucuacuaaaaauacaaaaauuagccaggcgugguggcgggugccuguaaucccgguuacuugggaggcagaggcaagagaaucgcuugagcccgggaagcggagguugcagugagccgagauugcaccauugcacuccagccugggcaacaagagugagacuccaucucaaaaaaaaaaaacaaaaaacccaaaaacaaaaacaaaaaacaaaaaaugcauugauguauauuuaaaggugaaaaauccauuuuccuggaauaauucuccucugccucauauguugcaguuccguuaacuggaaauaguuuuagguuuggacucuuuuuuucaaaaaggaaaaaagcuucauuucgcgggcagggguuuggauggcugucggucaguauuugccaagcaguccugguaguugagucucuggauguagacagucauuaagcaggacugcaauacugauuuuuauuuuauuaccaauauaaacccuuggacuugcuagacuagaaaaguaaucauccuccuuuaugucauaaagcacagcuauguuuuugaaugcccuuuaauugucauagacuauucagaacaaaauuaaagcaacuauaaaugcaagcaacuacauuggauuacugaauuugaauuauuagcuuauuuaaaaaauaaggucaccuaaucgccuccuuucuuccugugauugauuaauuugucuugagguuuuaguucuuucuucuggcagaaaagcauuacuauuagagggguaggguuguugucaacucccacagucauauccggcugcuggauguuggcucagaguauuuucuugguacaauugagcagaguuuucaugagauguuuccuggauggugacaggugaccauuguggggcucuugccuggccagggacaguggaggaagcuuggucucagaguaagaacgugagggaagugcacagcugagaacacaggaugguucuuucacggucucgccccugcugccuugcugggaggaaacagccguccccagggagcugguuuucugggaguggauucaggcauuuugcucuugaugcauagcuugacuuuuggguuugcucagccuuucuuuauuucuuuuucuuuucuuuucuuuucuuucuuuuuuuuuuuuuuuuuuuuugagagaagaucucacccaggcuggagugcaguggugugaucauagcucacuacaaccucugccuccugggcucaggugauccucccaccccaaccuacccaguagcugggaccacagggaugcaccaccacacccugcuaauuuuuguauuuuuuggagagacaaagucucaccauguugcccaggcuggucuuggacuccugagcucaagcaauccucccuccucugccucccaaaguacugggauuacaggcaugagccaccgugccuggccuauuucuuuuagauuaggaaauaccaauagucuuuuuucuuuuucuuuucuuuucuuucuuucuuucuuuuuuuuuuuuuuuuuugagacaaggucacgcucugucacccaggcuggagugcaguggcacaaccacggcucacugcagccuugaccucccaggcucaagugauccuccugccucagccucccaaguagcugggccuauaggcgaacaccaccaugcccacugauuuuuguauuuucuguagagaugugguuuugccauguugcccagacuggucucaaacuccuaggcugaaacgauccgccuggcuuggccuucauucuuuuuucuaacucuuuuuuuccugauccauccugguggaggaccugaagcugauaguguagcaugguuguugggaauaggagcccugggcucugcuugcuggaguucaaggccugccucuuccauuugcugcccaugugaccagggccccugugacuggggccugcaugcuugucucaucugggcugggggugaugcacugagccccgcaggguccugggagcugaaccgcugaagaggcaaugccugcacauagugagggcucaagggcgucagcuguuucuaaaagcuguuaauaguggcuggacucacuuuaggaaccggaaugucauacaucccaagucagcgccuggcccuguucuucugcuugauugaggaugcagcuccuuaugucuaggagaugguguuggucccacccugagguuggucuguuuaugaugagacacuuuccucuuuaugaguuuaguggcagcuuccucuucaaggugcggacaauugauggcuucuuuggcuggacaaaucauucguuuuucuuugauaucuuuuucagugguuacugccucuuucuucucacauaucugaagaaggacaaugaacuggacaacuucuuguuguguaaauuggguuagagggcauugcuuauuccuuauacugguggcauuagguugauguaaaaacaguaaagcggccgggcgugguagcucaugccuguaaucccagcaccgugggaggccaaugugggaggccaaugugggaggacugcuugagcgcaggaguucaagaccaaccugggcaauaauagugagaccccaucuguaccaaaaaaaaaauaaaaauaaaaauaaaaauuacccaggcguaguggcgugagccuguagucccagcuacuugggagucuaaggcagaggauuguuugaaccugggaggucacagcugcaaugagcuacgauugcaccacugcacuccagccugggugacagagcgagacccugucucacacaaaaaaaaacacuuggacacaggaaggggaacaucacauagcggggccuguugugggguggggggaggggggagggaaagcauuaggagauauaccuaauguaaaugaugaguuaaugggugcagcacaccaacauggcacauguauacauauguagcaaaccugcacguugugcacauguaccuagaacuuaaaguguaauaaaaaaaaaauucccauuaaaaaaaaaaguacaaguaaaauaaacauaaaaacaacccccccccaccgccccaaaaaaaagccauuuuagauauuccugugcaugugauuucugugagcugugacuuguuucaggaagcgagcaguucugcugacgggcuuggagguggcccugccuccuccucucugaacucugguugucugaguucaguguucuccggcccauccucacugacuucuccuuuagugggguucacugaaguucaucaucaucuugauucuuccccggcuuuccucggggagaggaaguggggaggcaacggaagcagaagcuucucuuggcugccugacugucacauggaccuuggugagaggagauaucauucuuccugacuuucggugccugucuagggggaggccauccaccugccgcccaguccaugcuuuaguaggggucugagucaccaaguuccacaaagugggagggcuucaaacagcagaagcucauccucuccccauccuggagguagggucugaacuggcgucggcagggccgugcaccucaggaggcuccagggagaggcuguucccgccacuguccagcuccugacuggugcuggccguccuugccugcggagcuguggcucucaucucugccucuguuuccccauggucuccuccccgggggucugccuucacaucgucuuugccccugugucuccgggugucuucucuaauaaggacaccaguuagaugugauuaagggucugccguacuccauguggucacauuuuagcuaaucacuucugcagagacccuguuuccaaaugaggccacauucaugggugccagagaugaagacuugaauguauauuuuugaacccauaauaauacauuuaugauuccauuuuuaaacagaaagugcuguuuccugcccucugguucaccuucaaggagagaaaugaaauccauuucuguguuggaaggccuugcgcggccggagcuuuggguacugcugcugggcugagagcauggugugguccagugggcgcucagaggcgcugggccagccacugcguggaaggccugggcccagcgugccgggugugugcggugcuucacggcugccugugaaaaguuagucacugcacaggcauuuaauggaagggcccaagcugugaggcacucagagcaggcaggaggaggagagguggaaucuagggaauggguuccaaucucgccaguagagucucugagccuugacuuguagaucugcgaaaauggaaaacagagacuucccagagugguuuaaggauccaugaagacgugacccacgaagugguuguaugaauuagccucauguguuauuuauucguuucuguaacuucacgccuccuucaugccuguuccaagcagcccgugagugucugcugugguccaggaacuguaccugguguucaggguggguucggguugggggucuccggcucugagcagagucugcucugugccauccagcaugguagccacuggccacacguggcuuggacuuagagauguggcuaguucuaggugagaugugugcuuuucaaaaugaggaagaauucugaauuuaaauuucucacuacauucuccaucucugccaguaaaagauguuccugggcugggcgugguggcucaggccuguaaucccagcacuuuagaagggcaaagcggggggaucacuugagcucaggaguuugagaccaggcugggcaacuuagugagaccucaucucuacuaaaaauuaaaaaauuagccaggcguggugguacacaccuguagucccaccugcuugggaggcugaggugggaggaucgcuugagcccaggaggaugagguugcagugagccaugauugagccacugcacuccagccugggugacagagcgagacccugucucuguuuccacaaaaaaauauugcuggauaugucuucugcucuucguuuuggaaaucauauuuuuccuauuuuacuguuuaguugcugaacagcuggcaggagaggacuugugcauuuaugaugagguccaguuuuguggaguucacacucuuuugaagccugcuaggaagcccccuggggugcacaguagaggguguucauauuggaucagcauuuggaaagauaacugcccgggcaaggaacccucaaugaagaagugaccaguuugggucaaagugauccuugcaguuuucugaaaagccccugucaugccacuuccccugcccuggacauuuguuuggcugaggggcaaggcaggggucggggcguggucggcacccuugaccggcacacucguacaucacgguggcagcaccucuuuguaggggcucggccucaggggacagccugaaaaugggggagcuguacaggccucucuggagagccucagcuuugcagacagccuccaucccagggaagcaagugagcaguccacgugaauaaggcagccaggcuuccccagagaaacagaccugacagagggugugugagcucaggcaagguugcuuuguugcugucugggggcugaauuccuucgugucuggaagagcucagucuuuacuucucaggccaucagcugauuagacgaggccuaccacaucacagagcacugucugcuuucucacauccacugauguaaaugcugaucccaccuaaaaaacaccuucccagccauguccaggcuagugcaggaccaaacugcugggcaccggggcccgaccagauacaguuccccaucacgguggguggaggcuggcaagccauuggcucucuggaggcuuuggugcauguggguucuggggggagggccugcccacugcguggggcccuugccugcuagcucuccacuuuccacguacuggugggggcagguguguccagccaggcccugugcuggcuccaggcagcccagcuccauucaugcacccagggacucuugugggccuuccuuacugcacuaaaaucaacaaacaauugaauacaguguugguuauaguagucaauuauuuauucuuuucuaaugcuccugaggggaugguugcuuccacaucccauucucucuuuuugagauagggucuugcucugcugcccgggcuagagugcaguggcaguaucccagcucacugcagcccaaccuccugggcuuaagcgauccuccugccucagccuccucagaguagcugggacuacaggcacauaccaucauacccagcucauuuuuaaauuuuuuuuuguagagauagggacucacugugucacccaggcuggucucaaacucaggggcucaagggauccucccacaucagccuucugaagugcuaggauuacagguaugaaccacugugccuggccuccacgcaccauuauuuaaccaaguucacuaucgguuuuaaaaaaacaaaccuagagggaauguagaucaugccuguggagauggucccaugacucucaacuuuagccaaaacucaucaacuuuacaaaauagaacuaaaauaaccuuuuggcucguauuuguggaugcaaccugcaaacacuggagaaagcaugucgugguguuuuugaacaaucucugaugggaagugugucacagcuccucuaggcugcgcugcugcuggugccauugcuggaguugcuuauuuugcucccaucucuggucugggaauaugcacuuuuccuuuccucagguugucacaucgauguuuugugagcucccugccagggggcuguccgaucuggcaaggcagagaacucaucuuaaaaguuucuguucuccgcugggcacaguggcucaugccugugaccccagcacuuugggaggccaaguugggaauauagcaugaacccaggaguucaagaccagccuggguagcauaguaaguccccaucucuacacaaacauaaaagaaauuagcuggguguagugguaugcaccuguggucccagcuacucgggaggcugaguugggaggaacacuuaagcccagaagauggaggcugcauugagccaugaucguaccacugcacuucagccugggugacagagcaagacucugucucaaaaaaauaauaauuaaauaggcugggcguggugccucgcgccuguaaucccagcauuuugggaguccaagguggguggaucacuugaggucaggaguuugagaccagccuggccaacauggugaaacccugucccuacuaauaguacaaaaauuagcugggcuugguggugugugccuguaaucccagcuacuagggaggcuuaggcaggagaauugcuugaacccuggacguggaguuugcagugagcugagauugcaucacugcacuccagccugggcaacagagcaagacucugucucaagaaaaaguaaauaaauaaauaaugaaaguuccuguugucucaguguuugcauuuccugguagggcucacuuuucaaugaauugaaauaccaagcuuucuaauucuuacauuucaauagcugcccuuuuauuucccacuuucacuggguaaauugcugauuuucacuccuggugcaccugguauucaccuggggcgcuuuuaaagcugauacaaaugccagccccacucuugcccuggcagcugggucagggucugagcaucaguauuuuuuaagucuccccaccccaugcuuaagaugugagccaaggguguccguggcuucugauggcuaucucaacccacucuuauuuaaaccaauagugaaaacgacacaacacuugggguagaagccuggcuguguuuggcuuugggaaggcugaagagugaaauggaaagcacuugggcaguuuuugguuccgcaacagugaaucaggauuacugugggugcugacuucccuuccccuucugccugaacccugggccaugucagcuccacugaucuggcaacauccggagcacccccaggaccagggagaaggucaucaucugagaauaagaaacguagaagauugguccacugcaaaagcgcccagucggccccaggaggugguguguaaauggagggaugaugagacccgggacaugggcagcccugggacgguggcauccauccuuagguuugggaggaaucucacgauuuauggaacaagcacuucuauuacagggccuaaugugcugggugcagcuccagccaguucaccugugugcagauucugcuuucucagccacccuuuggcagguguaacccacauuuuagugacggggaaacugagguaccgcaugucuaagugacuugcccaaggucacacgguggggauuugaauguagucugucucuagagugggggcuguuuaccagaacgcucugcagucccugcccagcgaauuagccggcacuuccaggauaguucucugcguaaaauuuggagcuccugggaagguggcugcauucugcaaaugccugugcucugugggaucacaggguggaggcaggcuuuucuccugcccagcagcccaccucaaaggggcccuaggccccuuccucugccucugggggugguuagaccagacucccuggggugccuguugccagcgugcuucucagggcuccaccgcuccugugucuguugcccaccuccuucuccaucugugccucaguuccuccuccuguaaaacaugggaaagggaagccugcacgagcauaauaaacccugaggacucacacugugcuggccaugcuucuucccauagcuaaugcagcgcuuccuauccuugauacaggacgggaucguggaaguuaacagcucauucccugcuauaaauuacgaaguccuguucuggcuuccauuucucuuguuuagacagaacuuaaaccucauaaagugaguggaauuagcucuuuaggugaacagacacaauuguguuuuuagaucuguaaauucgagaaacaaaccuggugggaccugccuccugagggcccugugucuguguagagguggggugggugggaccuacuuccccaggguccugugucuguguagagguggagcgggugggaccuacuucccuagggcccugugucugcguagagguggggcgggugggaccuacuuccccaggguccugugucuguguagagguggggcgggugggaccuacuuccccaggguccugugucuguagagguggggcgggugggaccuacuuccccaggguccugugucuguguagagguggggcgggugggaccuacuuccccaggguccugugucuguguagagguggggcgggugggaccuacuuccccaggguccugugucuguguagagguggggcgggugggaccuacuucccuagggcccugugucugcguagagguggggcgggugggaccugccuccccggggcccugugucugcguagagguggggcgggugggaccugccuccccggggcccugugucugcguagagguggggcgggugggaccugccuccccggggcccugugucugcguagagguggggcgggugggaccugccuccccggggcccugugucugcguagagguggggcgggugggaccugccuccccggggcccugugucuguguagaggugggguggugggaccugccuccccggggcccugugucuguguagaggugggguggugggaccugccuccccagggcccugucugcagugagcagggcgucuucauuucuggcugcucugaacucacgguuaaaguccuggucaguuuugcugcauuucaguaguuuguccaacaguguggcugaucagacauuggaggcguucuuacagauucagguuucccucaccaccagggguaauugaccucuucgucuguauguguuggugacauaaagcugagcagaucacuuacggauuugcuacauagacgaguaauaauuccuggacaagucgaaccuagagccccaggcuccggucacucacccauccucccgucugcuuggccuggagacagcccaggcaaaaaggcgggagagucuggcggaaggcugggcuccuuccucaggcuugaacccgugcccccagcccugaugaugucaggcccguguugguaguggccacacaggcucggcagccuggcuccguucaccagaccaggguuggcagcucacugacccuuggcugcauugguugaauuugaaccaauuugugauuuuucucuuuugcccuguuucuggggcagccuggggcucuggcauccccagaauuggaccugaggcuguuuauuucuccaggaaaguccagguaaaccaccagaacucucagugcuuuggcuucacgauugguacugacggacuccggucugggggagaaggcaauagagauagagaugccugauccuguuuccagggagagggacuuugaaguacucaguuuaagcccauacuuguagacaggaaaucaauauucugagagauacaggggcugacauguguaugggguuggcagcagggggcugacggcccggcucagagcacauucacaaacuuccagaaaacgcgugaggguccuuggauucaaauacacugugaaucugucaaagccaagugcaaaaggucaaguuguagugacaccauuuuauuuucauugucuuauguucacucucaugccuuacauaccagagccccuacucaaauucaauuaggauuaaauucagaacuucuguucccugcgggacuggcccuucuugguguggacaaugcgcucauugagagcagccugacucuuccauuagcaauccuaaaagcuauacauuaucuccaaagcaguauuuuagaauuucaaauaugaaaacugcuugcuuguaaauucuuuagcuggggcaacugcauuuaauugguuugcauucauuaauggguagauaacagauuauaggguucaagcaacaauucuuacuuuuuucuggcuagcauuugugauucuucaguuccuguuuccuuucauuacuaagaucuuuccuuuuauauuauuauuuccuuuuuuaguuuuuuaaaggcaaaucaggcauuuuuaucuggaauggaaaacuauuuuaggcauaggcaucaacacgguucucccuuuggcccuagugaacuauguaacagagacuugaaaaccauucuuccaggguagcuggagugccccugacuccgcauucccauagucacacucuugugaaaucugguggguagaagcugaugacguuuuuagcucauguaaaaaccucaugaugccuggacuguuaucuaugggauuagugucccugaaacaaaagucuuaguacugugguaaugacgaagaagcauuuuucuuucuuuucuguuuuuuguuuuuuuuuuuuuugagauggaguuucacucuugcccaggcuggagugcaguggcgcuaucucagcucaccgcaaccuccgccucccagguucaagcaguucuccugccucagccucccaaguagcugggauuauaggcacaugccaccaugccuggcuaauuuuguauuuuuaguagagauggguuuucucugcguuggucaggcuggucucgaacucccgaacucaggugauccgcccaccccggcgucccaaagugcugggauuccaggcaugagucuccggccuuuuucuuuccuuuauuauuaccauuuuaaauuuauuuuagauauggggucucacuguugcucaggcuggagugcaguggcaugaucauagcuuauugcagccucgaacuccuuggcucaagcagucuucccuccucagccucccgaguagcugggacuacaggcaugcgucaccaugccuggcuaauuaaaguguauguguguguguguguguguguguguguguguguguguguguguauuuguagagauaggagccuugcuaugcugcccaagcugggcuccaacuccuggccucaagcaauccuccugcccuagccuguucuuuuugaagcuaaugccugcuguauuggguuuuaaaggcuuuugaucaucaucuucuguagugggagaaugacuguggauuccggggacacugucugauuucugccugcugggguccaguccagcuugacuggaaacggauugacuucucagucugaagcugaccccugguaggcgugcggaagggaggaauguugcccuucaggugcugaauuccagagcacaagcugcuugccaacaggguggcucugucgcccaaacaacagcauucccaggcuggcuuuucccagaagagggaggugacccggguagcucucgcacuuugacccucagacuggcagcagggcacauucuucugacuccuaccggagcuggucugggcucagcucccagcucgcuuucccuccacauccccaaagggcacacugucggcuuugcugaagggggagcuggaguccacgcucggggccugggagaccacaguggucaguagacaggucugucuggcucuucucacaggacaugagugugugucucugugggcgccucucuccaggguugcccaaggggugaccagccugccucaaaauccaggcagcaucgcccagcaagguuugaggacuuggcgucaucagaauguguggccauuucagaaagauuggggaugggaaugggaugaaauuugguugugcuucuuggcuauuuggcucuaaacagugguuuauuggcaaaggacagucugccuuagagagccacaugugugcaggugucaugcguucaguccaugcuccaaagccccacagaccaaggggccuuaacuucauuugugucaagaccccucggcccccgagggguacaagcccaggaccccuucucagaacacuaugcccaagugcgugcagucacauacaaagguaaccagcuguccuuaaguacagucgucuugagccuuuuuaaauuaugauugauaugugguucaugguccacauauuaaugaaugaaggcauggcaggucugaagggucgugggcaucacgcuggagugucugaggcaucuggcaugcggauggaagcaccugcuggcccuguuggugaugagugccccuuacugccauuucugcaguuugcugccaauauuuguggugaaaggaaaugguaaauuucagguagaggguggugaaaacaaagaugauguuuucucccucauucaaggucauggacccugugaauuugguuuaugaccccagugguuaagagcccuugcuaguggucgacacuguccacacacucaggggaaguugcccucagagugacaugggaccauuuauaauuuagaagcugccaaugaugggccacuguugcauuuugguuugccuaaaugugaucuuuagaaaauuuugaauuaguuuugagugcuuaaaacuugggagauuaaaauccacauuguuagcuucuuuuuaaaaaaucagaaccaggcuuacuucucccaggcgagggauuggaauggggccuggacacucccugggugccaccucucucugcgccagugccccagcagccucauccuuguucagaggcacuugaccuuggcguucugagcucgagaguggaggccagugcugucagucguucccagcucucccuccucuuggccuaagggcauggcccgggaggccacacaugccccagggaggaggggaugagcuggccugcagcaggugcuaugggagcuuccaggccugucugcagaggcuccuugggauggcgucugagcacaggucucagucucauuccucuucgaaagcgugcccccggcaggugugguugggagcaggugcuuugugguuggaagaucucacuugggguuugcuuguuggugauugaaacaaaugcaucaccaggagcgucugugaagccccuuccugccagcagggagggcccaugccaugcacagccugcucgguccucgagaggcaggugggggccaaggugcaugcugcugccucucccacagcugcuuccugagagcucguccccccagugcggcagauguguccaacgaugaaaagcacgccaaggcugggaggacauaccagcaggcgugcucggcucggcccucccugcugggggcucucaccugcugcgugcacugcaccugucccaggaacaccugccuuggccagaucugcuccccuugugggagucuguccuccacaucugaguaugcagaaagcuugugcuacagacagggguucagaauucugccagaaaguuccuagguagcccuugaguggacuggcagggagccgccugcugguggggaggugagcgggcccccuuggggaucugugcacuguuggugggauagaaaggugguccuggggcagacguugggaacagaacaguacggaugugcagguguuaccuguggggaguguauucugacccggguugauuugauuagaugacugcauuguaaaaguacacagagcuggggaccuuuuaaucuuccuuuuuagccaucaguucgggggucucugcguuuaaauguaggacgguggcggguguuccagugcccuggcccagccucccucuagcgcugcuaugccugacucccccacacuucaguuuccucauggaaagugugugugcccacaucgaccucgugaggcugaagugcugggggcacggggagagcagaugcccacacuccaggcacugcaggggugcaugccagcuggcccuguuccccgccagacccagugacagacagcaccuugucaguagccaauguguugacguugagcugugucccgaggguuugaucucaaccuggaaauguuuugggagcagguucccggcuugccugcaauugcccgcaccucugucuguuuuaaaccuggagggcaggcggggcugcggcacccacaagaagugcgaaugcuggggccuggcuccucagggauuccgauuccagcgugggaggggagauguccacuguguccuaaaaauaucgugagcaccgcagggugcugugugauucugggcagauaagggcaggugugguuuacaacugcuguuaugaacucagaagcccuccccgcagcacuuccugggcagggcagcacagggcagcugggagcacccaggggguguaaaggaggagggugaagggacaugggcacacuuugcuuccggagucugcauucccgagucagcuucuaucucagcaagggccuuggcagucgcugcuuuuuucuggacaucaguucuugauuccuuccaucuccagccauggcuggggccaggacuccuuuggaguuggugcuugaaggcagggagggcugugugaaugccugaggcccguucuuccugaacauucuuggauucuguuucccaucuagucugggcacccaacagcuuguuuucucgaggggcugccugcuuuggggauggugcccauggguggcacauucuccaucaacuauguuuaagcauuucauccuguguguguugcccuaaaaauaaacaucccugugggacguucccuugcaguguggcugguggcuauguucugagaugagagauaaccacucuuucugucccucucuucccaccagggcgggagcaguuccacggccugggcuccauguacugccggggggcggccgccaucauccucaccuaugaugugaaucaccggcagagccugguggagcuggaggaccgguuccugggccugacagacacagccagcaaagacugccucuuugccaucguggggaacaaaguggaccucacugaggagggggccuuggcgggccaggagaaggaagagugcagucccaauauggacgcuggggaccgugucuccccaagggcaccuaagcaggugcagcuggaggaugcgguggcccuuuauaaaaagauccucaaguacaagaugcuggaugagcaggaugugccggccgcugagcaaaugugcuuugagaccagcgccaagaccggcuacaauguggaccuccuguuugagacccucuuugaccugguggugccaaugaucuuacagcagagagcugagaggccgucacacacaguggauauauccagucauaagccacccaagaggaccagaucuggguguugugccugacuuucgagggccuccuggacucagacugugcauguugggaaggggucugaccaggcaagcugugaucugaaaggagcaaggaacagcaaggaauuauuuuccagaaugacacccgcagcagaauguuggaguggaaaugauggcuggcuaugaagaggaggucaacguguguggucuccucagucucugucagagggguggggaggugggaaacaggaauccucugcaaagcccaaucugcagagucgagaccccuggugcucucugccccgcugccuggcacugguccuuugcagccagccaccaacggcccccuugcccuugcagaggcagaagccugcgucugcaccugcaccucugaccguuucagcacccuggguuguuaccacguccuacaacucugacauuucuuguucucaagcguuucucuucacugugaguugucuuugguccucccacuugguacuuguaucuugaugcuuuauaauccugacucucgacguguucauuuauacaaaaucaggaauaacuuuguuuuuauacugauugcagcaauguuggcuacauguauuauuaaagaggauuuuuggaacaacuua

SEQ ID NO: 192995 - RNA, 62960 nt, Homo sapiens
acccccccuuuggcgagucggcagccacguccuuguccucacccgcagcgcagugacgccgacccauccaacggucaucgcaugcgcgugccccgcgcaggccccaaacccccacggauuagguugaaggucagacaaaaaaucccggacccauacguccgguuccuuaaggccuugcccacacgcagcggcuggccccgcggugggaguggggacggggcuuucgaaugggggccccgggaagagucuuggcagggaugaggaaagaacccguucuagaaagcaucuggguaacaccaaaauguauuacuacccuaaaucgccaugaacuggagcccuuucccggcuaacucccacaaagauuucuguucucaagccaacauggaaacaacuagacgggacacagcaccgggcaguuuuauguacugacuuccuuuaagcguuaucuaauaaaaaguguguuaucuaauaaaaguuccacacaguauuuaaccgucuuaauucaucuaggguagcaggggauauaacagaacugcuggguuccacaggagguugaggggccaggauccccaacacuagauaucuuccuuagcggggagaaagcuggaaauuacaagaugacucaacggagaaaugggcuucaguggguaacuuucagaaaauuauaaacccauaucagugcacauagcgagggaaaggggaguuuacuugagguuuggguuacugugagcagacuacuuggggugacuaguauuggcaucagaaccagaaauccaggcgcucagggcagcccugcagguggggugggucuccaggcugcuccauacucagcgccuguguuccucuccauucuucgggauccaucagacauacuccauugaguacccccaucccacccccuuuucagcuucacagguuucacagaaauuucucaccaccuguuuaaaaauaaaaauaauucagccucuugacauagcuucuucuagguaaacggucuucuuuuuuuuuuuuuguuuccuucugcucauaaaagaaggguauuuccuugucugguuuuuagacagaacacuagcagucugcagagugucaaagauguucuccugggggauuacacuggcgcuacaggguggcaggaucguggagucagcauuaguugguguccaugcugcaagccucaucauccccaaagcccugcugagagcugcuuggucgugucccuccaucagaggaaccagaacugcuaagugaaggugucuuauaaaauucaucaucucgacguugguaaaauagcacauaagcugcuuuagucugaaauacaagagggggaaagaccauucagugcuuggaaaaaucacccauuuuccccagcuuuucucuagcuguccaaaacccucaaggaucugccauauccacacagaggagacccuuccaccugaggauggcugccccugccaggcagcaggaaauggaaggagccuugugcagagaacucugaggagagcugagcuucucauuuaugaaggucccugaaggaaugccagccagcucugucacaccuagcucccacuaucacaucaggaugaugaaauaaccaacuagccugauagaggcucuucccagcuuuaauccauaacgacaugaggaagaaccacauaucauggccuacucaccacuaucugauccucagaggccagggacacguugcuaucaucaaaguaauaccauuuaccauucaguuuguucuucgcauaugcagugucugccaagucaacaaagaaaauacucuagcggucuccagagaauuaaucuggcuagcuuauuaggcuugcacuaaauaaacacaaaaauccccaaaacaaaaccccugaaauuaaaaaaguuuacagugugugucuuaacaaccaaaaaacaacucaccuucuuuucuaaucuguuccuucucaaaaaggaucaaaaggcuaaaaauggagcugucagggaccaagauuuuaaacuauaauuuugggaaacuaauagaaaaaacagagcuauucagugccaaucuucaggauggcuaugugcaauaauccaaaaccagggaacccauaaaaggagcugaaacuucuaagauuuaagcaaaacaauagcucucacaaggacaugccaagucagucucccccauugcaucuaggcagguggcuacuaacaucaacagaaugcuuagugccucgggagccuacagaauaaucccaguuagaggaacauuggguguuuggguuugcagagcugggaugugaacaacauaccuuagucuccauauccaaaaaaaaaaaaauuuaucuuucucuaaaacuaggaguccagagucugugguuagguaacaguuucccacaaugauucaagcauuucccagaggcaaugcuucuugucuugacuuuacacuauucccaagcaggauguguuuauuacagcaaucccagcccaguuccugcuccacccagacucucagaaacuacagaacccaauggagaucugauauccagugucaacuuacugugugguuuuagguaagguguuuaacacuucagccucaguuuccucacuauagcauugacugcacaaagugguggugaggaucaugggaaagggcaacagagaaggugcccaaggccaguucacacagucugugcuugacacaauagcagcaacgguggcuuucaauuuugaaguuccaacuguaggcccaauguggacccucacacaaccagccuaaccucauggaugagaaaacugaggaugagaaacuugcccaaaugguauguuugugugcaaaaauuagcaaauaaaaaugaacacaggcagggcacggugacucacaccugugaucccaacacuuugggaggccaaggcagggugguucgcuugagcccaggaguucaagaccagccugggcaacaugccaaaacccugucucuacuaaaaauacaaaaauuagccaggugugguggcgcacaccuguaaucccagcuacucggcaggcugaggcacgagaaucgcuugaacccgggagguggagguugcaagugagccgagacugcgccacugcuuuccagccugggugacagagugagaaucugucucaaaaaaagagcaaaccagccaggcacagugccucacaccuguaaucccagcacuuugggaggccgaggcgggcggaucacgaggucaggagaucgagaccauccuggcuaacauggugaaaccccgucucuacuaaaaauacaaaaaauuagccaggcgugguggcgggcgccuguagucccagcuacucaggaggcugaggcaggagaauggcgugaaccugggaggcagagcuugcagugagugagauugcgccacuguguucuagccugggugacauaacgagacuccgucucaaaaaaaaaaaaaaaaaaagaauuaaaaaaaaacagagaggggaaucaguaugaagaaagcgugcagcaugaagccugugaaacugcauaagcaaagcauuuagggcaaugccugguccacuggugagagaugauggccgagcacauuucaacaucucagaaggaagcagaugucaauacuuacaguggccaacccccauggcuccauaaugauuggacacggcaaugaggucguacacauaaggccuugcugacagguuacagacaaacucggacauguucagcccucugagcacaaaacacaaaaauaguuauugaauauguuaaacccaaacaaaguaguuaagaguaacccagcaaccucuguuaugcaacagggcagaacacagggaggcacucaaacuauucgagagagaccaagauggaagggacucuaggauccauguucugaccacugacauauucaggcuagaaaauggggcugggugugguggcucaugccuguaaucccagcacuuuggggggccaaggcagguggaucaccugagaucaggaguucgagacgagcccgaccaacauggugaaaucccgucucugcuaaaaauacaaaaauuaggccgcgcacgguggcucacaccuguaaucccagcacuuucggaggccaaggcaggcggaucacgagaucagaagauugagaccauccuggcuaacacggugaaacccugucucuacuaaaaaauacaaaaauuagcugggcgugguggugggcgccuguagucccagcuacucgggaggcugaggcaggagaauggcgugaacccgggagguggagcuugcagugagccaagaucgcacuacugcaguccagccugggcaacagagcgagacuccgucucaaaaaagaaaaaaaguauguguauauauauauauauacacacacacacacacacacacacacacacacacacacacauauauacauuuauauauacacacacacacaaauuagccgggcaugguggcacacaccuguaauccuagcuacuugggaggcugagguaggagaaucgauugauccugggaggcagaguuugcagugagccgagaucgugccauugcacuucagccugggcaacaagagcguaacuccgucucaaaaaaaaaaaaaaaaggccgggcacaguggcucaugccuguaaucccagcacuuugggaggccaagguggguggaucaugaggucaggaguuugagaccauccuggccaacaugguaaaaccccgucucuacuaaaaauacaaaaauuagcuggguaugguggcaggcgccuguagucccagcuacucaggaggcugaggcaggagaauugcuugaacccaggaggcagagguuguagugagccgagaucgcaccacugcacucuggccuggcgacagagugagacacggucucaaaaaaaaacaaaaacaaaacaaaaaaaacaacaacaacaacaaaagaaaaugggagaaccuuucuggguaacuccagcaccagacaaaauggugaugagggucuagagauacacacagagggcuucagcaaguaugcagaaauggcuguucuuaacagaauuacaguuggugccauaauaauuuaaacucaaccaaaacaggccccagaaagcuuucuuccuccaauauuuuauuuaaaaauuuucaaacacacagaaaagauaaagaauuuuuuuuuuuuugagacggagucucgcugugucguccgggcuggagugcaguggcgcgaucuugacucacugcaaccucugccucuuggguucaagugauucuccugccucagccucccaaguagcagggauuacaggcaugcgccaccaugccuagcuaauuuuguuuuguacuuuuaguagagaugggguuucaccauguuggucaggcuggucucaaacuccugaccucguaauuugcccaccucagccucccaaagugcugggauuacaggugugagccacugcgcccagccaagauaaagaauuuuuacaacaaauacuuauuauccaucaccuggcgucuccugcugacaugcuauacuucauguaucuauucuuucccccagaaagcauuuuaaaaucuacauuuugugggcaacucccuuuuuuuuuucuuuuuuuggaaacaggggcuugcucuguugcugaggcuggagugcaguggcacaaucuuggcucacugcaaccuccgccuaguggguucaagcaauucuccugccucagccucccuaguagcugggauuacaggcgugcaccaccacauccagcuaauuuuuguaguuuuacuggagacaggauuucaccauguuggccaggcuacucuccggcuccugaucucaagugauccacccaccuuggccucccacagugcugggauuacaggugugagccacugugccggccucuuuuuuuuuuuuuuuuuuuuuuuuuugagauagagucucgcucugucaccaggcuggagugcaguggugcaaucuuggcucacugcaacuuuugccuccuagguucaggcgauuuuccugccucagccuccugaguagcugggaccacaggugugcgccaccacauccagcuaacuuuugcauuuuuaguagagaugggguuucaccauguuggccaggauggucucgaucuccagaccuugugaucugcccaccuuggccucccaaagugcugggauuacaagcaugagccaccgugcccagccuauuuuuuuaaauauauuuuuuauuuuuuguagagaggaagucucucuauguuguccaggcugguuuugaacuccuaggcucaagugauccucccaccuuggccucccaaauugaugauaugugagccacugugcccagccagggaacaucuaucuguuaacuuacuuuccuguucuuaguuacagucuguacuguggggcuugagaggauaugaguagacagccagucccaaucccuaccccagggacaggaucauggcaggugugcagcccaccugcagcccccaauaauaacccaacucuaccugacaggcuauucuugguugccuuguccccuguugugcugccucugcuaaggugaggcuaccugugacagaugauggacaggaaggccaguuagguggccuaagugacucgagagggaaacuagcaguggcaggggugacuggcagcagccugugucugggcaaaugcuuccacuggagagucucuuccccaaagaugggaggauagggacagaagggguaacuacagcuaaacucugaccuccuagaccccggcaacacacauccuuacucagaaaaguuuuugguggcaaaccacucagccaaucagugccaagauuuucugccuguuuuuaaauguuccuaacacuguagucaccaugacccaccugauugggaauucuacgacugugucgagcuuaucccuccaguaucuguuguaggagaaacguuugagguggaccaccaggaucuugggcaaggaccauaggucaaacuuuuuuguggccuguugaugcuucuuacaguugggacaguaccuaaaaagagaaaccuccacuuagcagggcaagccggcagccagugccaccugggcacucaugcauggaggcacagcugcaguccccugauagcugccauccucucggucagcacucaacacuacugcuucuggccagggaccugucuuccaaaauggggugacggcuuuccuuggaaaccucaacucacagaggauuauguuguaggguuagcuauauaaagaagugacacauccaaauacaaagggguuuaugugcacagauggcccuagcagaucugaguccuggggugcauggggccucugcccagacagugaggagcugcguaccaggggucaugcuccccaagggucuccaugguggugaagagcucgaugcagucucucagggccacuguggucuucuucuucuucugaggcugcaacaugcucacaugcuucucguaggccuaugggaaucaaagcacucaguucugcuggagaaagagaucuuacugcauuaagacaugaaggccuacagaggcucucccaccuggaauguaguacacuuucuagagccucugaauauaaaaugacaaaaucuugaagugcuuuuccuucucagucuuaaauauaacuugcuaaauugcuguccaacuggugaaagugaucgcaguccacauccagagcagaaaccagcagacaccaccgaccacgaaccccgagggaccuaccucagauucuugcucaucauaguaaagucuccgaguuucacugucccaauccauggccaguguagaucgagcugaggaggaccaaaaugucacuuguuauggaauggcaagcaacaggaaaggcucuccaagugacaggagugagaaggaccacacucaggccacaccaucaacaccuucucccccaucagcagccagugucaagagcaaugcucugcaaugggccagcccuucugacccccagccccaaaaagccuuuggcaaagacuuccucagugauacagauaagcuacgaaggaacuaacuguggagaauucugaaagggcacaggucaagaugggaguaauagggaccagauuuaucauccuaccauaaaccacaaaaaaacugacaaaauggaugaaacaauuguuuucagacauuggauagagcaggaaggagaucccugacagaaggaaaaaaaaaaagagaccccuacaucgcccuagcuuauugccugcaggcaguuuccaggacuuagcauaggggagagaggggaagauuaagcugaaaagucaaagacuggaguuugagaagauggcuagaauuugcaaggcauuccagccugggcaacauagugagacccugucucuacacaaacuacaaauauuagcugggugugguggugcacaccuguagucucagcuacucaggagggugaggugggaagggagcugaaagacagagaugcuucuccuccccuaacuggcaaagguguccucacuggccaauugugcuuuucacacaaccccucagaaugccucuuccugucuguagagcaguccccauuacaaccuccaugugucggugaggcuacaaaauccaugaccauccucugaauggguacauuucgugaguauuaaugaacaaaauaaauaugcgcuuauucuuauaagugagcaaguauggggaaauguugcugccaaggguggccacaggaaagguuaucgacccacagcaaauucccgcagagggaguggagggagaccuacuuuccucugaggucaucgaggacugaggagaaaagccugaaagguagggggaucucugaaacaguccuuagggggcuucaagccaagggucauacaagugcugcuccuggaggcacagagacugugaaagcccaaugcagugagugucaaguguaaggauuuucaaacagauccuaagacccuaaagcccagcuugaaaggucagaaaaagugcuuacaguugaguuuaaguaguuuuccaucagcugcaagugaauuuaugucagcuguuccauaggaguucacaagacugaagguaaaaagccuuuuugggcagggcuggccuuugaucuucuuuuggguggucucacuggggucauuuccuggcucaucuuccccacugccuucuguuucugaaagcugcucuuugccuucuuccugaugcuccauuucuuccucaucuucuccuggcacauaaauggaaaacaauauguauauaauuuccuaccauuucaauguuaaaaauuuuauuuaauacauaacuaugguguuuccuuccagauuuuguucuguguauaugaaguuaaaucuauuccuuugcauuuaacuugaauucacaugugacucucaccacacccuugcaagacaggcagacugggcacugcuauuccacgaugaggaggcagucucagagagcuuaaaugagccaccugcaggcacaaugagauucagaagcccugccauccugucuacuggccaucacagcacauggucucucacucuugcaacuucaccauuaggcccacagagagaaaagggcuuaaaugaaacgcacacucaacacucaagaagacagcuugguaagaaacacuaucuaucuuccauuccauccauuccuuccauccauccauccaucauccauccaucuauccauccgagacagucucacucuagccacucuaucuaucuaucuaucuaucuaucuaucuaucuaucuaucuaucuaucugagauggagucucacucugucacccaggcuagagugcaauggcacgaucucggcucacugcaaccuucaccucccagguucaagcgauucuccuaccucagccuccugaguagcagggauuacaggugugcgccaccaugcccagcuaauuuuuauaucuuuuuaguagagacgggguuucaccauguuggucaggcuggucucgaacuccugaccucagaugauccaccggccuuggccucccaaagugcuaggauuacagacgugagccacugcaccuggcccuauuuauuuauuuauuuuuugagacggagucucacucuuucguccaggcuggaaugcaauggcgugaucucagcucacugcaaccuccgccuucuggguucaagcaauucuccugccucagccucccaaguagcugggacuacaggugcgugcuaccacacccggcuacuuuuuuguauuuuuaguagagacaaggguucaccauguucaccaggauggucucuagcuccugaccucgugauccgcccgccccggcuucccaaaguacugggauuacaggugcgagccacugcacccggccaagaaacacaacuuaaaggucaauugccuuuuuuuuugaaguggagucucacucuguugcccaggcuagaguacauuggugcaaucucggcucacugccaccuccgccucccagguucaagcaauucugcugccucagccuccugaauagcugugauuacaggcacgcaccaccacgcccagcuaauuuuuguauuuuuaguagagacgggguuucuccauguuggccaagcaggucucgaacuccagcccuaaagugaucugcccucucggccucccaaaaugaugggauuacaggcgucagccaccaggcccagcuauuuucaaauauuauaauaaacacaaauauuaaguauuccguuccuccagaaaaaaaccuaucaugaauuuuccuuuaguauuuacuaaaggucucuuaggugcagguaccaugcuagguuccagggcuccauaaggggagcacacagucuaaagugaaaguuaaaguaucaaauaaguaacuuuagcaaagauggggaccacuccaaaaggugguguaaaaguaacagagaagagcagauuuaaaacaaagaaucuacauacuugaucaguaaaaauggaaauucugagaaaaggagaaugugcuauuuaagagcccacaaccccuggcucucauggagguuccuuuccgaacuugcuuaauuccugagauaugacacugucccuuuacacacaauaagccugucccccuccuacacuggcaagaaaaaaccugcccugccugcugccucucggagaagggcagaacccaaaacugccucuaucccacucaggaaaugagcagugcccucauacuuauaagaacucuguccuggcccaugccacuggcugccaguuaccuggauaaugccaggagccuugggccaaugcagucagaauuaaaugccauggacuguauuucacaggaugagaaaaaaagcagccuaugaucccagcaccuugggaggcugacgcagguggaucaccugaggucaggaguuuaagaccagccugagcaacauggugaaaccccaucucuacuaaaaauacaaaaauuagccaggcauggugucaggugccuguaaucccagcuacucgggaggcugaggcaggagaaucacuugaaccugggaggcggagguugcagugagcugagaucacgccauuguauuccagccugggcaacaagagcaaaacuccaccucaaaaaaaagaaaagaaaagaaaaagaaaaagcaggauccacugaaagcagcuacccaaagucacucagaaaaucagcaggggaccuaaaggucagcagucacaggccuaacaaggagccaugucaguagagguuaaaaaugcuuugugguuaugccgggcacaauggcucacgccuaugaucccagcacguugggagguugaggcagauggauugcuugagcccaggaguucgagacaagccugggaaacaugcagaaacccugucucuacaaaaaaaagaaaaauuagcugggcgugguggcacacaucuguaguucccagcuacucaaaaggcugaggugggaggauugcuugaacccagggaacggagguugccgugagcugagauugugccacugcacuccagccugggcgacagagcaaaagaaaacaaacaaacaaaaaaaccuuugugcuuaaacaaggucugaagucuacacaccaagauucaccuguaggauucaaaaggugacacucauugucccggacaugccuaagaaacaggguuaggaguaaaaauagcaaacacacucacaagauguuguuacugauugagugccuuucaugugcccuguccuuuaaucgcaugaccucaaauuguaauugcagaucugugaagcagauauccuuuugcagacagguaaaccaagguucagagggaugaagugacuuguucaaguccaccccacaccuugagcuggggaucagagugccuuagcuuccagaguaccacagaucacccaggggcuguucagagaccuauuaccauuccaacaccucugcugcuggaccuauaaacaaaauguauuccuacuuaucccuagcgggaaaugaacauaacauuucgggcaagaauaagaagccaaauauugaggccgggugcaguagcucaugccugugaucccagcacuuugggaagccgagguguauggaucaccugaggucaggaauucgagaccagccuggccaagauggugaaaccccaucucuacuaaaaauacaaaaauuagccgggcaugguggugggcgccuauaaucccaccauugcacuacagccugggugacagagugagacucagucucaaaaaaaaaagagaauccaaauauuggccauguguggcggcucacgccuaugaucccagcacucugggaggccaagguggguggauugcuugaacucaggaguucaagaccagccuggggaacaugggaaaaccuugcuugucuccacaaaaaagaaaaaaaaagaaaaagaaauuagcuggguauggugacacauuccuguaguccuggcuacucagguggaugaggugggaggauugcuugagcccaggaggucaaggcugcagugagccaugauugcgccacuguauuccagccauauucaacccuaaaauaccaaaaauaauuuggaguaucucuugaugacagccucaggccuguaaccccagcacuuuggaaggcgaaggugagcagaucacuugaggucaggaguucgagaccagacucgccaugauggagacaccccgucucuacuaaaaauacaaaacuagccaagugugguggcgcacaccuauaguaccaacuacuugggaggcugaggugggagaauccccugaacccaagagacugaggcugcaguaagccaagauugugccacugcacuccagccuggccaacaaaguggacuccauauagaaauaaauuaauuaguuaaagucaguucucacuuucuaggacugcaugucuuggaggaaucuggacauuugguuuugcaacugauaauuuuuuguuuuugcugguuuuuguuuuuguuugagauggaauguuguucuguuguccaggcuggagugcaaugaugcaaucucagcucacugcaaccuccgcuuccuggguucaagagauugucgugcuucagccucccaaguagcugggauuacaggcacacacugccaugccuggcuaauuuuguauuuuuuaguagagacaggguuucaccguguuggccaggcuagucucgaacuccugaccucagaugaucugccugccuuggccucccaaagugcugggauuacaggcaugagccaucgcacccgucugcaacugagaauuuaugugcugggcgcaguggcucacaccuguaaucccagcacuucacgagggcaagguggaaggauagccugagccuggcagguugaggcugcaguaaaccaugauugaaccacugcacuccagacugggugauaaucaagacccuacgcuuuuuuuuuggagacggagucucaaucugucgcccaggcuggagugcaguggcgugaucuuggcucacugaaagcucugccucccggguucacgccauucuccugccucagccucccaaguagcugagacuacaggugcccaccaccacgccuaauuuuuuguauuuuuagcagagaugggguuucacuguguuagccaggauaguuucgaucuccugaccucgugauccacccaccucagccucccaaagugcugggauuacaggugugagucaccgcacccagccucaagacccuacucuuaaaaaaaaaaaaaaaagcugggcacaguggcucacaccuguaaucccagcauuuugggaggcugaggcaggugaaucaugaggucaggaguucaagaccagccuggccaagauggugaaaacccaucucuacuaaaaauacaaaaauuagccaggcaugguggcaugcgccuguaaucccugcuacuugggaggcugagguagagaguugcuugaacccaggaggcaaagguugcagugagccaagaucgcgccacugcgcuccugcaugggcgacagagcaagauuccgucucaaaaaaaaaaaaaaaaagaaagaaagaaaaagaaaagaaaaaauuuacagcacuagcuugaaagacauauaugguuuuacagaaagccacugagucacguaagucccaaaaagaagagugacaugucaggugggguggcucacaccuguaauccuagcccucugggaggcuaaggcaggaguauugcuucaggucaggaguucaagaccagccugagcaacauggcaagaccccugguccuuuuuuuuuucuuuuuuugagacagaguuucacucugucgcccaggcuggagugcaguggcgcgaucuuggcucacugcaagcucuaccucccggguucacgccauucuccugccucccaaguagcugggacuauaggugcccgccaccauguccggcuaauuuuuuguauuuuuaguagagacgggguuucacuguguuagccagaauggucucgaucuccugaccucgugauccgcccuccucggacucccaaagugcugggauuacaggcgugagccaccacgcccggccaaccccuggucuucacaaaaaauuuaaaaauuagcugggugucguggcaugcaccuguagucccagcuacucuggaggcugaggugggacaaucacuuaagcccaagagucugaaguaacagugagccaugauugcaccaccacauuccagccugggugacaggaaugagaccccuaucuggaaaaaaaaaaaaaaaaaaggaagauuccacaagguagcaaaguuggacaacaggcacuggcagaguagaauguuguagaccuaacuccuaacucugcugcuguaggcagagccccaacccagucccaacccccuucucccauguguguaacaccuuuagaagaagagggaaaucaggagguauuuggucagucacagccacagagcauggugcauacucaccuucacagcuguuccuggagccauugcaggccccuggcuccaagggugagcugccaaacucaucagguaaaggcuguuucacauagcggcuucaaaaagagaaaaagagaagaaaaaaaagauuguuaguuguaacauuuaucuauuuuuuccaccaugcggcuaagaaguaguucauaauuuauauggaugauagcuacugacaaagcaauuuauguaaauagaagugcuuuagaauuauccacugggccaggugugguggcuaaucccagcacauugggaagccaaggcagguggaucaccugaggucaggaguucgagaccagccuggccaacauggugaaaccccaucucuaguaaaacuaaaaaaauuagcugggcaugguggcacaugccuguaaucccagcuacucaggaggcugaggcaggagaauuacuugaacgugggaggcagagguugcagugagccgagaucaugccacuaggcacuccagccugggcagagagcaacucugucucaaaaaauaaauaaaauaaaauaaaauaacacaguggcucaauauuuuaagaaauuaaaaacacaaauggccaggcaugguggcucacaccuguaaugccggcacuuugggaggccgaggugggcaaucaccugaggucaggauuuccagaccagucuggccaacauggugaaaccccaucucuacuaaaaauacaaaaguuuggccaggcacgguggcucaugccuguaauccuagcacucugggaggcugagaugggagugucacuugaggucaggaguuugagacuagccuggccaacacggugaaaccuccucucuacuaaaaauacaaaaauuagcuggaaaucacuugaaccugggaggugaggguugcagugagccgagauugugccacugcacuccagccugggcaacagagugaaacuccaucucaaaaaaacaaacaaacaaacaaacaacaacaacaacaacaaaaacauacacacacaaaacuuagccgggcgugguggcacaugccuguaaucccagcuacuugggaggcugaggcagcagaaucacuugaaccugggagguagagggugcagugagccgagaucgugccacugcauuccagccugggcgagagagcaagauuccaucucggaaggaaaaaaaaaaaacccacaagaaauuagccaaugaagacucuuaagaaaguuugucucgagucuuaugugaaagucauguggcaccaucaguuuugaagguauuucccaauaauccuaauuuccagcuucagaacgauaguggaacacuucagaaauaaaauacaaaugccaucaaagcgcuagccucccuaacaugauucuaagaggacuggacuccuaggaucacgguaccuaagaugugccagguggcucaucccaauagcaccugcccuggcccauccaggggcuggcacaagugcauuuuuuuuuuuuuuuuugagauggagucucacucugucacccaggcuggaaugcaguggcgcgaucucagcucacugcagccucuagcucccaggagaaucaagaaucaagcgauucuccugccucagcaucccgagcagcugggauuacaggcacccaccagcaugccuggcuaauuuuauauuuuuaguagagacgggauuucaccaucuuggccaggcuggucucaaacuccugaccucaggugaucugcccgccuuggccuuccaaagugcugggaguacaggcaugagccacugcacccggcaaaugcauuucuuacagaggugagcauguaggaucaacacagccacuuggcaggaguugccacuacuauuacuggguauaucuucaucucagauaacaaccaaaucacauuccugccaccaaccugauacgaucacaaacagccugguacaaagacucaaggguuaacuugugcuuggggacagaaagcaauaguggcugcccauauagcgcugaugcggaggaagugcuugauggccuggacuuccucucccugaaguagacuggaagcgugacacauuccgagccauccacggaagugcugcagaccucguaccugcgucaaucacacaagagggcacuuuuagcaguagguccuugugaacaacagagaucugagcugaagcuaugugguggccagggcuaugauuacugggacagagcauauuugaguagaaaagguggcuauaacuauugccaagacguuucuagagguugagucaggaaucccuagaaggaccauugucagcacaaugugaaccuauacaaccuggggcugagggcuaaccgugauacuccuucuuccaaccacggccucaaacucugugguccuucaacugggacccaacacagauaacagccaucauucagaucaucacucugaacacaaaggcacacagcuggguccagccaccaaguucaucuuuugucaucaaagagcucaucuuuaaaaaauguauugaguuggcugggcgcgguggcucacgccuguaaucccagcacuuugggaggccaaggcgggcggaucacgaggucaggagauugagaccauccuggcuaacacggugaaaccccaucucuucuaaaaauacaaacaauuagacgggcaugguggugggcaccugcagucccaccuacucgggaggcugaggcaggagaauggugugaacccaggaggcggagcuuguagugagucaagaucuugucacugcacuccagacugggcaacagagcgagacuccaucucaaaaaaaaaaaaaaaaaaaaaaaaaaaaagcauugagugcccugcccuuuaauaagaccaaauauuguacaaagauguacaccuaggauauuagccaaacucuuuuuuuccaaaugagcaagcaaauuuauaaaaguaauugucaucuuuguucaaaaacacugaagugaaagaaucguaucuaauucugaaaaacaucagagauaaccaaagaaacugcuagauacaaaucaaugauuuugaaaaaugugucuuacuuagugaauacaugggauugaggagauuuauagauguuuuauccuggaacagauguuaccaaaauugcuggcaaccgacuguagucuuucccucuuccuauagggggagacacaaacuuacugauucaaauuuugaaacuaaacauaugcacgugugcgcgcgcgcgcgcacacacacacacacacacaccccccccuccccaaaugccuagcaaacaguccugacugaaguuuaugaaggaggaauuucuaauacauaaaaauguccaaggugugcucucgaguaaauacugugguccagcauagugguaaagaaccaggccuuggagugcaccugccccagguuccagguccacauugccauuuucuggcugcuaguaauaagcaccuaacuucuuagucuauuuauucgguggacaaugggauuacccacuuuaaaaggugugguaagaauuaaauaauuuaguagcacaguguacaacacauuaaaaaguagcagaugcaggccgggcacaguggcucacaccuguaaucccagcacuuugggaggccgagggggacggauuacgaggucaggagaucgagaccacccuaacuaacacagugaaaccccaucucuacuuaaaauacaaaaaauuggccaggugugguggcacgcgccuguagucccagcuacucaggaggcugaggcagaauggcaugaaccugggaggcggagcuugcagugagccacgaucacaccauuguacuccagccugggugacacagcaagacucuaucucaaaaacauaaauaaauaaaaaauaaaaaauaccagaugcuggccgagcacaguggcucacgccuguaaucccagcacuuugggaggccaaggcggguggaucacgaggucaggagauugagaccauccuggcuaacacggugaagcccuggcucuacuaaaaauaccaaaaaugagccaggcgugguggcgggugccuguagucccagcuacucgggaggcugaggcagaaaaauggcaugaacccgggaggcagagcuugcagugagccgagauugcgccacugcacuccugccugggagacagagcgagacuccgucuaaaaaaauaaaauaaaauaaaauaaaaauaccagaugcuacuauugcuuucauaaaacaauugucaauucaaauucaucuauaaaagaauuuguuuuuccaaugguuggcccauaggcccucugaaaauuccuuuguugguggucugcuaagcuccccacaggguaauccuccaguuccuuucagcucaggugugugaaaacacuacuuucuggaauuuacagagaccauguuaagggcuugggguuauaugugaaaguggacuuucccauguucuagcccuuggcacagugucagcucuuggcugugucugugcaagugagaacagaaauagaucuuggguguggcuaggaacuauuccuuuuagagagaucuagaagucauaggcccaaaaauguaaagggaaggaacuaucuccuuuacauacugaauuccucagccaaaaacaaaaaccaaaacaaaauccuaaaacccuuucucagcagaggcaaguuccugagugagagguaaagagggagggacaguacggcugugcuccauacuuccugggcaaguggcugccugggagcagcaggcaaguucauguaugggagcagccggcaaguuauuacaccacugugccuggaagagggacacacacacaauuacacagagcagccaugaagcagcaugugggaaggcagaggaggccuuuguauuguccucacagagaugaagaaacucagucucagagcuuacagaauguuugagcugaaaacagcuguuuaaaucagcccugucauuucugcauuggggaugguaguaucaugguacucgcugagaagcuacagccuguggcagagaaaggacaagauccuuccguaccacaccccuacuaccaucuucccaucacacagcugggauuccucuuaagaaaggcaucucugaugguaggaccaucuguaggagcagugauuuggccuucuucauaggcaaaacuguugaaaaaaggcuguggcugugcugaggagaguuaucagaauguuuagcucugcagggcaggagggguugagcacugauggcugcccacgaugcccucaauacccaucucuugcacccaggggucagggccaauccacaugagcaaugacugcccacauuuuuguucuggagauaugaaugcagcaaagucucuagaauguguccucugaccugaccugcagcagaaacugcugaguacucacacgaaaaugucaucccgaggcaugaugugguuuaaaccuucauccauuuggaaaauuuuguggaaucggugauuauacacaucugcgaccaccaucuaagaaugaacaguaacagaaagaccacagaauggcuaagagugccccuacuaacugcuuaaaacccagaaacaaaugaaaaaaaaaauacucauacucaaauguugccucuagagaaaccaccacacaaacagccccagagagcugagggccaaggcccaagggggagcagcauggcugccaucagaauugaacaugcugguagcaucugcccucgacuggcaggaagggcgaggaguguggugcuaaccagaaaccagcaguuguccagagccucuggaguauuccauagucugcagucucuaugccacccucagugcacagaucugacagcagagcccuacuccugguccuuugaccacggcuagugugaacccaaugaaggaaagauaguguuuccuggagcuggaagggacagucucagucacaaugugcauagugagugaggcauccagacacacacaaauaaucacauuugugcuggcaauaacaacaaccccaaaaaguggcuucaagguugaaaguaaacuccaaaugcuaugaaguaucccaaauagaccgagugccacugaucaccccgccuuacauuuucugcagcaaugccagacagccuggagagagccucgcacaggucggacacagcccccaucagcggcacagucacacgguacugcaagacagagauggucaaggucacaggggugccccacaaagggugcgaaaugcauuaggagaagcaggcaucacuaggggcagaggagcccuucuagaaacaauguauggugaggucaggguacagaugagucagaagcagagcaaauaagcaggaccucuaugucagcauccuccucaauacacaggcagcagcaugggggcuaggccaucucuuucucuuccaaacauugcuucauuuuauucuuaauucuuuagaguacuuucugaagaacugcugaaauuauacaaauucaaauugccaucugguccuaccuuuuuauuuuauuuuuauuuuuuguagagacagggucucaaacuccuggccucgagcaauccucccgccucagcaucccaaagugcugggauuacagguguuggccaccaagcccggccucaacuuucuuuuuuuucuuuuuucuuuuuuuucugagacacagucuugcucugucacacaagcuggagcgcagugacgcgaucuuggcucacugcaaccuccaccucccggguucaagcgauucuccugccucagccuccugaguagcugggauuacaggcgcgcaccaccacgccuggauaauuuuuguauuuuuaguacagacaggguuucaccauguuggucaggguggucucgaacuccugaccucgugaucugcccgccucggccuccugaagugcugggauuacagggguaagccaccgugcccagccugccucaacuuuuuuuuuuuuuugagacggagucucgcucugucgcccaggcuggagugcaguggcgcaaucuuggcucgcugcaagcuccgccucccggguucacgccauucuccugccucagcugcccgaguagcugggacuacaggcgcccgccaccaugccuggcuaauuuuuuguauuuuuaguagagacgggguuucaccguguuagccaggauggucuggaucuccugaccucgugaucugcccgccucggccucccaaagugcugggauuacaggcgugagccaccgcgcccggcccucaacuuucuuuagagacaaagaaaccaaaaccagaaggcuaagcaauacaauuacucagugagccaucagcaggguaagacacuaagaccugcugcucacaccucucaucuggccuaaucuucuguacaggcuguccuagguuaugugaggguauaucugaguacgaaaagaaccgugcuucugguuccccaacauucagauucaagaaccacuuaguagaucagguuacuuuagucgcgugaaugaaguguggccaaaaaagugacagaggccgggugcgguggcucacgccuguaaucccaacacuuugggaggccaagaugggcagauuacuugaggucaggaguucuggccaacaagguaacauccugucucuacuaugucucuacuaaaaauacaaaaauuagcugagcguggugguacacgccuguaaucccggcuacugaguggcugagguaggagaaucgcuugaaccugggaggaagacguuacagugagcugagaucaugccacuucacuccagcaugggcaacagagcgacucugucucaaaaaaaaaaaaagugacagagaagcaaagaagcugcaaagaccuucacaauaggccuuaaaugauaugggauuagacaaaggucugauggaggccaagggcccauacccaggcaaguaccaaggggacucagaggcagccaaugcagcagauaggagcagucccacugggaucuggagaccacuugcagugaggggugccauaaggguguggauucugucaccugaguaggucugcagugagggucagcaggaaccaggaaaaccuccauaacucgaucuuucuucaagggcaguggcagcguuagauagcaaaaugggucaaaggucacagaaaccuuagcacauucugggcaaaccaaaguagauuugaagaggccauggaaaguauccacaaucacagaaucauuccucaaccugugauucucccaggcuuccuuugccaccaccugcgucaaagggauaaacaggacauucucaacaccucucagccccuugccccugcauccagaaugacucacagcaaaccuggagaugaaucagguggcaaucuguacagccaagagcuugauccaggacaaacaaggccaggacuacucuuaguguaucauacucauaccacaugccagcucuacgcccaauccccaccccaacacacauauauauauuucacauauauguuuauauauauacauauuucaaauauauauuauauugauugauugagacauggucuugcucugucgcucaggcuggcgugaucaugguucacuacagccucaaccucccggacucaaagcgaucuuccugccucagacucccaaguagcuaggacuauaggcaugcaucaccaugccuggcuaauuuuuuuagguuugguagggaugggggucuuacuauguugaccagacaguucuagagcuccuggccucaagugaugcucccaccucagccuccaaagugcuggaaccgcaggggaaagccacugcgccucgcccuaauccucacacuuaauaagguuggcaacauaggaccuauuggaaacuaggggucuguguguccugauaagaaacagaagcccggagaacacuaucgguacagagacauggccagggcaaggaaagccccccuauauguuuccagugaucuaaaguaagguuuuuggcggggcacgguggcugacgccugaaaucccagcacuuugggaggccgaagcaggcggaucaccagaggucaggaguucaauaucagccuggccaacauggugaaacccccucucuacuaaaaauacaaaaauuugcugggcaugguggcacguggcuguagugccagcuacuugagaggcugagacaggagaaucgcuugaacccgggagguggagguugcagugagccaagaucacgucauugcacuccagccugggcaacagagugagacuccaucucaaaaaaaauaaauaaauaaauuuuaaaaauaaaguuuuuaucuauacuacagcucagcuaacucauaguuuuucuaagaagaucuaaauuuuacuuuaaagcauucauauugauuaucccaaugugauaggguagcugaaauacuaaaauccucuugcacugaucagauaaucaaggcaaaagguauaaauguccuaaugauacuaauaacaaauuaaguaaucauggauggauuuuauugugagcaauaacaaucuuagggguccucacuauagguacuuuacaguuuucagaguguucuuagucccuaguucaccagugaaauaucaaacaagcucacucuaauuugaaaaagcccaagaggaagccuuaggaguaacuaggguacagugccucacgccuguuguaaucccagcacuuugggaggcugaggugagaagacugcuugagcucaggagcuggagaccagccuagacaacacagcaaguuucugucucuauuuaaaaaaaaaaaaaaaaaaagcaguaacuacaguuagccccuuucugaccagagaccauaucccuauaacuagcuacagugagaagcaaccagggcccuggcaacaacacucaaagaccagaagaauaucccugcacucucaauaggaggcagcuucuuuggcauauuaucauucagacaucauuaauggcauaccgcaucuggccgcccauuggcauccuucagcuccaaguagggcuuuuucuuuacccgguucagaucuucaugcaauccaucuagaagaaaggccagcagcuccugagaaucuuguugcugguagccagaaaauugaggagcaaaacguccuacuugagucuacaacaaaagcaacuguaucagaaggcauaauacguaaagaacuaguuaaaucaaaaaagaauugccaucaaaaauagcucugaggaguuagcuggggcagugagagagaacacuugguugaguaguccaauuaacuccugaagagccuacaggaggccagugguucccaccagaaagaaggccuagaucagagagccaggaggaugaaccuggaaccugggccacugcccuaaguccuaaggaggaaggguggaguacccugaguaaccacacccaaguacugacaugaaucccucuccaacauguccuucuuugguucagagucuuaaacuccauaaggacauuacaaacaauacuuucaucagcuggaggaauccuccuguacauaacagcccucaggucccuaaauacugucuguccaguaauacucuccaccaguuauucugagaguaugguccccagucgcagcauuaguaucaccugggagcuuaguagaaaagcacauucucaggccccacaccaaaccuauucaaucagaaacucuggggaugggucuagcagucuguguuguauuaagcacucccagagauugugaugcauccuauggagaaccagccaggcacgguggcucaugccuaugaucccagaauuuuggaaggcugaggcaggcagaucaccugagguugggaguucaagaccagccuggccaacauggugaaaccccgucucuacuaaaaauacaaaaauuagcugggcaugguggugcacaccuguaaucccagcuacgcaggaggcugaggcaggagaaucacuugaacccaggaggcggaggcugcagugagccgaaauugugccaguacgcuccagccugggcgacauagcaaggcugucucaaaaaaaaaaaaaaaaaaaaaaaaaaggagaaccacuguucuacaccuguucucuaauaccauagccacuagccacauauggcaauugaaauuuacauuaauuacaauuaaaaaccauuaaaaauucaguuccucggucaaaugaaccacaucucaagugcucagaggugcuugagcugguagcuaccaaaacacagugcagauauauaacacauccaucacugaggaagcuccacacuucccuaauaccccuaaacacuaccuuccaguuguuuauuuacauuagcuucagcacaguguguugccacccaauucuuuuuuauuuuuuuuucugggacagggucucacucuguugccaggcuggagugcaguggcgcaaucucagcucacugcaaccuccgccucccagguucaagcaauucucaugccuuggccucccgaguugcugggauuacaggcauaugccaccacgccuggcuaauuuuuguauuuuuaguagagaugggguuucacaauauuggccaggcuggucuugaacuccugaccucaagugauccacccaccuuggccuccccaugggcugggauuacaggugugaggcaccgcacccagccguugccacccaauucuaguuucuuugugacuuaguaugugaacagucauuuauauauuucccagggauucaugugaccaaggggaugaaagauaauuaguuuucaauuucaacaaaccaccugagauuuuaguuuucucacugagcuaaggugcuauuuuuuuuccucucugaaucauaaauaugcaugucuuuucuuaucauaugcuucaugaagcuccaugaaucccagugguacaggcuaaauaggaucuuucagauuucagcuuaaaucugcugagcgggagggagcaaagcaccuccaccucagcaggaaaaagcaguuggggcaauggaaagcccaaguugcuccgaguguauccaugucuucuccuuaaaccuuccuggcugagggaccccagugauaacugccccucacaucaccuuccaagaaugugagcccaauuccugacuuagggggucccaacucaaaccacgaagccuguagaauccaggcucagagaaccuggaaacagccuucagaugauacuagaaauuaaacugaauuuucauuuuuuuuagagacagggucucugucgccaaggcuggguacaguggcacaaucacagcucacugcagccuugaccucccaggcuuaaguaauucucccaccucagccucccugguagccgggacuacagguacaucaccauguccagcuaauuuuguuguuguuguuguuguuguuguugagacagagucucacucugucgcucaggcuggagugcaguggcgugaucucggcucacugcacccuccaccucccagguucaagcaauucuccugccucagcauccugaguagcuggaauuacaggugcgcaccaccacgccuggcuaauuuuuguauuuuugguagagacgggguuucacuauguuggucaggcugaucucgaacuccugaccucgugaucugcccgccucagccucccaaagugcugggauuacaggaaugagccaccacgccuggacuuuuuuguuguuguuguuguuuuuucuuugagacagagucucguucugucacccaggcuggagugcagaggcgcaaucucggcucacugcaagcucugccucccggguucacgccauucuccuuccccagccucccgaguagcugggacuacaggcgccugccaucacaccuagcuaauuuuuuuuuuauguauuuuuaguagagacgggguuucaccauguuagccaggauggucucaaucuccugaccuugugauccgcccgccucagccucccaaagugcugggauuacaggcgugagccacagcgccuggcccagaucccaucuuaaucccaaaaugcaacgaaaggaaugccucauaacaacacuaaaccacucuccccaaagugggaaaaaggaaguacgggagaguaucccuuauccaaaaaucugaaauccaaaugcuuaaagauccauaaccuaacacugacaugauauucaaaggaaaugcucacugaaacauuuuagauuuuggaauggggaugcugaacuaguaagcauaauguaaauaccauaaaaaaaaauccuaaaaaaccugaagucccgaaacauuucuggucccaggcaucuauauacagggauacccaacccauauauauauaugucuaccuacuuugaacaugcgaggugccacaugggcgucccuuccagaccacaucugcuuaaugaguucagcauaggcuucugcaauuuccccuuucauccccagaggguugucucuguugauuucggcuucauacucaucuuugagaaaguagucagucaguggugcaguguugcucaaacacugaaacagaacaugaugagggcuuuacacaccuucuagacaguaccagagauacaagauaaaucaaguucuaaagggucacugagggacaacgccaacaaaaugaggcacucaggagauucucugaaggcucacgacaguaaagcacagccucaaggaggccaagcugcaagguggaccccuugcagcuaaucucggagggacguggucuuagaggaccgcauaugcauuggcuaagacuuugucucugaaaaaaacuaccuuaggaaaaaagcugaauaauugcauaauucuuauuuaaugaaaaaaguguuuuuuuuuguuuuuuuuuuuuuugagacaguuucgaucuuguccaggcuggagugcaauggugcgaucuuggcucacugcauccucugucuccugaguucaagcgauucuccugccucggccuccugaguagcugacaucacaggcaccggccaccacacccagcuaauuuuuguauuuucaguagagaugggguuucaccauguuggccaggcuggucucaaacuccugaccucagaugauccgcucaccuuggccucccaaagugcugggguuacaagcgugagccaccgcgcccagccuuuuucauuaguuucuguucuuaacgcuauuaguucucuccuacuuccuuuggguucuuuuuccuagcaucaugagauagaagcuuaaaucaugaaauuuuaacccuuuuugcccuaauauuuacauuuagaacuauaaaacucaucauuauccucgcucaauaauagcuaaggaaaauugaggguacaaagacuuggaaaaacuugcccaugagaagccaaaucacaccucuucuucaguacuaggcuacuuccaccucaccacaagaggaaaauaauuuuuuuguuuuguuuuguuugagacagaguuuugcucuuuuugcccaggcuggagugcaguggcgcaaucucagcucaccgcaaccucuaccuccuggguucaagugauucuccugccucagccucccgaguagcugggauuacaggcaugcgccaccacgcccagcuaauuuuguauuuuuaguagagaugggguuucuccauguuggucagccuggucuggaacucccgaccucaggugauccgccugccucagccucccaaagugcugggagccaccgcgcccagccggaaaauaauuucaaaacccaaggguuaucuaaucuuuuaacaaauguuuuauguuuuugcucacacuacaaaaaaauucaaaguuagacuguaggccaggugugguaguucauaccuguaaucccagcacucugggaggcuaaggaguguggaucacuugaggccaggaguucaagaccuuccuggccaacauggugaaaccccauucuacuaaaaauacaaaaaauuagcugggcguaguggcacaugccuguaaucccagcuacccgggaggcagagguugcugugagccaagauugcaccacugcacuccagacugggcaagagagcaagacuaugucucaaaaaaaaaaaaaaagugagaauguaagucuuuaaaaaauuuuuuuuuaauuuuuagagauagggucuugcuuauguuagcuaggcuuggucucaaacuccugggcucaagugauccucccauuugaaccucccaaaucacugggaaacaggugugagccacugugcccagccagauuaucaauuuuaugaggacaaaaaccauugcugguuugcuuaccacugagucccuauguaaagaauauugggccaagugcaguggcucagaucuguaaucccaacacuuugggaagccaagguaggaagacugcuuaaggccaggaguuugagaccagccugggcaucauaagugagaccccguuuccacaaaacaaaacaaaacaaaacaaaacaaacaaacaaacaaaaaacauacauacaaaacaaaaagaaaaaacaauuagcaaggccuggugguacacacuuguagucccagcuauuugggaagcugaggugggaggaucacuugagcccaggaguucaagguuacagugagcuaugaucaugccacugcacacuagccugggcaucagagagaguuccugucucuaagaaaaaaaaaaaugaauuuugcucugcucaaacagaaggucuagcuuugccccuggcuucugggagguaaucuauuugccccuggaauguuaugccugauaggacugucuguuugccuggugggccuugggucauacuggauaaccuaacaauacaauuuuggagguggagaagaggcugaucagaacuguacagucuaguccuagggugagaagggcuagccacuccagaaaaaccaaaaaugugacuuacggugggggcuuugggucacaugguaucaguucaccuagguaaugagucaaucauauuuauacuuuauuauauauuuuuuugagacagagucucacacugucacccaggcuggaguguaguggcaugaucuuggcucauugcaaccuccgccucccgggaucaagagauucuccugccucagccucccaaguagcugggauuacaggcgcccgccaccaugcccagcuaauuuuuuguauuuuuaguggagacgggguuucacuauguuggccaagcuguugucaaacucuugaccucaugauccgcccgccuuggccucccaaagugcugggauuacaggcgugagccaccacacccugccagucaaucauauuuauauaaugaagccccaguaaaaauucuggacgcugaagcucacgugagcuuccauaguuugcaguacuccauaugcaucauuacacaucaaugccaggaaaucaccauguucuggccaggcacgguggcucaugccuguaaucccagcacuuugggaggcugagguggguggaucaccugaggccgggaguuugagaccagccugguuagccaacauggugaaauccugucucuacuaaaaauacaaaaauuagccaggcgugguggugugugccuguaaucccagcuacucgggaggcugaggcaugagaauugcuuaaacccaggagguggagguugcagugcgucaagauugcgcgacugcacuccagccugggcaacagagaaagagaugcugucucaaaaaaaaaaaaaaaaaaaaggaaaguaccauguacugacuccauagguagaaaacaacagaagcucuacauuuugauccuccugaccucugcccuauaugccucuucccuuggcugauuuuagucuacauccucucacuacaguaaaccaucaucaugaguauaauaacuuuaaguaaauuccgugacuccuucuaaacaaauuaccaaaacuaaggguggucuuggaaaccugcaaacuugcaguugguuucggaaaugagggcagucuugggaacugugcccuccuaacuuugaagcuggacuuuaacuccuugcagcccaugacuauuacagugcugucacauaauauaugcccaauaaauauuugaugaauuaauaaacaagguuuauuuucuuuuccauuuugagacagggucucgcuaugaugcucaggcuggcuucaaacuccuggccucaagcaauacuacccccucagccucccagaguugugauuacaggugugagccauugcgccuggccaauaagcaaguuucaaagaggggauuuuggauuuucucuaguaaggagcauggggcgggacagcuuuuuuuuuuuuuuuuuuuuuuuugaaacggaguuucacucuuguugcccaggcuggaauacaauggcgcaaucucggcucacugcaaccuccgucuccuggguucaagcgauucuccugccucagccucccaagaagcuuggauuacaggcgugugccaccacacccggcuaauuuuuguauuuuuaguagagaugggguuuugccauguuggcuaggcuggucucgaacuccugaccucagguuauccacccgccuuagccucccaaagugcugggauuacaggcgugagccacagugcugcccccggacuuuuuuuuaaucuuuuuuuuuuuuuuuuuuuuuuugagacagagucucacucuguugcccaggcuagagugcaguggcguaaucucagcucacugcaaccuccgccucccagguucaagugauucuccugccucagccuccugaguagcugggacuacagaugcaugccaccacacccagcuaauuuuuguaucauuaguagagauggggguuucaccacauuggccaggugauccacccgccucugccucccaaagugcugggauuacaggcgugagccacugcgcccggcugggacagcuauuuuuagugaaaagguagucagccuucagcaaagcauaauugagcuuggcaucaccugcuguaaguuuuccucaucccaucagagaccaaucagggaugcacuccaauauuuucuagagagaucauaccucaacagucaguaaaauucaaaauaaucuuacuauaaaaccaaacacagagcugacuacaaagacaucugggguccacaaacacugaugaagccauucuauaccaccuagugggagaugcccuagcagagacuacugaagcaccaacaagggguaggcagggacuccugggagaggauccacccaguaccuuugcaggccacuuccacccaaaccucaagaugcuguguuauuugaauggaaguucucuccucuaccugcaaagcggaguucaugaagcagguguuucccagguuuccaaguccacagagcccagguuguauaugagaggaugguggcuccugacaauuauacgaagcagaaaagccagauccacuggaaaacacaacacacaucagcaauaaaagcaagugcauaacacaugcccucaagaugcuuuuugaggcuccuaugggggccucuagaacuugugugguaguaagcccaugaugcaaauucccucuacucccuccccugcccuccagaccugccccacccuuuacuugacacacuagcagcugguaagcacauccuuaaggaaagaaacacuacuugaauuuuccucuguuaggcuuuggcaaaugcuaauuuugccaggugacuuuagggaagaccauuuuaguuauuaagagcuugcaucugcuacuacccaccaggccacacccaggcuugacuggcccugaaaguucaugcacacuuccucaccccauucacccucuuccccacaucuaugccauguggcaggugugccugaaaugccuggagaaaggaucacggccauccacagcugagcacugucccuucacaacuauucugccauacgggccagcccaucccuucauaaacaaaugcagugacccccccacccuccgagacuaccugugauguaggcuguggggaaaacaccagcucacaggaggacaagcaacacagaucagaacuuggaagcacacuuuacuguagguaugaaauggagugagaaacuacauguagcauguucccaugaggaacucuaaccccacuaugcuuaguggagcagcagaugagcucucaagauacagccugggaaaggaccacgggaaaggaagcagagugaaaggaccugcucuuacccccugcugacaccggaacugugcaucccacaggugcuagugcuaucaccauuugcaaugagagaggcagacacugaggaauagggacuugcugaugauuuuggagagguaguaaaauuucugcuaggcgcagugcuugaucugggagagagaagcagaaacaaugcuacugacuuuuugcaaagagcaagcccuauuuaaugccuuagguugcuucucaaggaauaaauauucuucauauuaaguuaaaauaaauuacaaaaagccuguauucauacuacuucaagguaaacuuuauuuaagugagaguccacaaauuaacuggucuuccugucacaucaguccacaccaccacauacccuuucagugugaaaaaccacaaggcugaccaggcgcaguggcucgugccuguaauccuaguacuuugggaggcugaggcaggcagauugccugagcucaggaguucgagaccagccugggcaacacagugaaacccugucucuacuaaaaugcaaaagaaauuagccaggucgcgcgugguggcucaugccuguaaucucagcacuuugggaggccgaggcagacggaucaccugaggucaggaguuugagaccagccugaccaacauggagaaaccccgucacuacuaaaaauacaaaauuaggcugggugagguggcucacccuuguaaucccagcacuuugggaggccgaggcuggcggaucaugaggucacgaucacaaggucaggaauucaagaccagccuggccaugaggucaggaguucaagacacagugaaaccacaucucuacuaaaaauacaaaaauuaucuggacaugguggcgggcgccugucaucccagccacucgggaggcuggggcagaagcaucacuugaacccgggaguaagccgagacugcaccaccgcacuccagcuuggugacagagugagacuccaucucaaaaaaaaaaaaauuagccagaugugauggcgcuacucgggaagcugaggcaggagaauugcuugaacccgggaggcagaaguugcagugagccaagaucgcgccauugcacuccagccugggcaaaaagaacgaaacucugucucaaaaaaaaagaaaauaaagaaauuagccaggcauggcagcaugugccuguagucccagcuacuggggaggcugaggggcaggagaauugcgugaaaccgggaggcggagguugcagugagccgagaucgugccacugcacuccagccuaggugacagagugagacucugucucuuaaaaaaaaacaacaaaaaaaaccccacaagguucaucuucaagcauccugguuugauuuacaaaucauaaacuucccuacauuuuuuuucuuuuuuuuuuucuuuuuuuuuuuugagacggagucucauucucucgccaggcuggagugcaguggcacaaucuuggcucacugcaaccuccgccucccggguucaaacaauucuccugccucagccucccgaguagcugggacuacaggcgcgugccaccacacccagcuaauuuuuuuguauuuuuaguagagacaggguuucaccauguuggccagaauggucucaagcucuugaccuugugaucugccugccuuggccucccaaagugcugggauuauaggugugaaccaccacaucuggacugcuucccugaauuuuaaaaauuauuagugaaaggcaaagaaaaauggcaauaaggccaggcgagguagcucacgccuauaaucccaccucuuugggaggcugagguggguggaucacuugaggucaggaguucgagucuagccuuaccaacgugguggaaccccgucucuacuaaaaauaaaaaaaauuagccaggccuaguggcgcaugccuguaaucccagcuacuugggaggcugaggcaggagaacugcuugaacccaggaggcggagguuguagugggccgagaucgugccauugcauuccagccugggcaacaagaacaaaacuccaucucaaaaaaaaaaagaaaaauggcaauaagagaugacuuuccccaaaaaggcuggaugcaaauuaaauagcuggauauaaggacaugagaacagaaaaauggcaauuugguuucacuacgccuucuauggagaauuuuguuucuucaaauuugccaguguaaccucucuguuucaaacucauguuuuaauauuuuucaggcucuuauuuuagauuucuacuuucaaauuaauucaagggcuaauugcccaaauuuuaaauugcuaucaauuucaucaaucugcuagaaucuauauaaggacauaaggaagaaaguaaaucuuauuuuaaaguuuuuaauuuuuaccuuuuuuuuuugguaauccauagcaacagucuccuuauguugcccaggcuggucucaaacuccuggacucaagcaacccuccugccucagccucccaaagggcugggauuacauacaugagccacugcgcucagccaaagaagaaagugaauccuccuccauuguuucaaauauaaaacugguauuucccuuauagaauacuggguuauuuuuagaauacagaaaaugacuaagaagauguacuguucccacacaguguucacccucaugggaucugaucucaacuuggcuucccugugagaagaaaaacauggcagcaaaaacaaguaugaucuuguauaccagcaaugggcacaucaagaaauuauauagggccuaagcagguaccugaacugagguuugcuccacaaugcagucacaguaagggagaaugagggcuccucagucucucaccuucccauaaggaaauguacccuucucuaauccuaaagaggauuugguucacacagcuucauccucaugcugcaaaggaguccaagaacucaagcagcugcacuaagugagauucaccacagccaaggguacucucauucaccacaugggagacuuaagcaugcauguguucaauccuguccagugagauguccaaugugauuuccuagccucuuaugcauaaagaaagucugcugcccaaggcuggucugauaugcaauggcagacucagucaucucagcacugagggagguaagacagaauacugaaauucaaauucugaugcacagaaccucaagauauauaguauggcacuccucuucucaguaacuauucauugauaacuuaucuauuuucuugagcuuaaaagggcaaaaaucggccgggccugauggcucaugccuguaaucuuagcacuuugggaggccaaggugggaggacugcuugaggccaagaguucaagaucaaccuggucaacauggcaagacccugucucuauuuauuuauuuauuuuuaaaaagggcaaaaauccauacaaaucauuugagauauccaagaccugucaauuucuuaaacagacaacauuucagggugauagaaauuaaagaaaaauuuuauuugauguuuaaaauguucuagaaaauacugccaguuuucauaguaaauucaaucaaaaagaaaccaaauuaagggcauauaaggauacuuuuuauaugcuugaaaauuaacacaguaagauuuaaaaaaaaaaaaacucuauccuuaggcugggugcaguggcucaugcuuacaaucccagcacuuugggaggcugaacuucucuuuacagaacagaaaaagccaggcauagcagcacgugccugcaguccuagcuacucgggaggcuaagccgagaggaucccuugaucccaggaguuugagguugcagugaacuaugaucaugccauugcauuccagucugggcaacaaagcaagacccuaucuauuaaaaaauacucuaucuuugacagacaagucagaagcaaaacuucucuucagaaaauuuacuauaaucugggaaaugcugagcacuagggcagggacuugucuccagaccuucaggcaacuguggaacaaacccugggcauuacaggcuggaauauaggaagccaggagaaaugucugaaucucaggcauauauauuagguaagcaagaucucacucugauuugugacugggucucaugccacacucugaaaacagacacuaugccuccaaacaaggauaccucugcuccuaagagacacuguagucaagccucuggacucccaggcaccuuucuacugguaaguccugcuccccaggcaugucacgugauuaucaauuacaacucaaacgugugccugauaccauggugggacccuguaacaucccugugcccaggcccaaagugaggcucuggacaaaccaggcaaagcccaucccugcccuccuuaaucuacugcacuccacuugcuucucagauguucuccagacugaaugcugcucugaggaugaaucuauccuauccuuuaagacuaggccaggcgugguggcucacgccuguaaucccagcacuuugggaggcugaggugggcggaucacaugagguugggaguccgagaccagucugaccaacacagaggaaccccaucucuacuaaaaauacaaaauuagccaggcaugguggcacaugccuguaauuccaucuacucagaggcugaggcaggagaaucacuugaacccgggagguggagguugcagugagccgagaucgcgccauugcacuccagacugggaaaugagagcgagacuucaucuaaaaaaaauaaaauaaagacugaccucaaguauccagcgucugguaccuggaauuauaauuaagauaaugauaaacucuuuuaauuuaacuuuauuuauuuauuuugagagugucucacucugucacccaggcuggagugcagugguccaaucucagcucacugcagacuucaccuccccaguucaagcaauucucaugccucagccuccccaguucaagcaauucucaugccucagccucccgaguagcuggaauuacaggugcaugccacuaugccuggcuauuuuuuuauuuuuaguagagacaggguuuuaccauguuggccaggcuagucucgaacuccuggccucaagugaucugcccgccucagccucccaaagugcuagaauuauaggcguaagccaccaagcccgguuaacuuauuuuucauucauucauucaaucauuuauuuauuuuuacaaagauaaucuuuauugacagucacaggccacaggggugagcccugagguuuggguucugggaugaaggagaaccccugcccccugcccugggccucugcuggcugaggggaccuccauggugcucagacuacaaccaggaccucccuggcagcccaggagugugggugccgcagagacaggccccuugcagagcugaccuagagcccacccuccccauagccugugugagcacaaagccaggacccacaggcugugccccgggcuugucacugaugccaguggagguuggcagcugccccucuuagcaccugagacagugaaagaaggcagcugcugccaugaagaagacgcucuguggacagacuugcuggggcugaguugaggggcgcacagaggcaggcccugcccauggucuggucagcugucccugccaccacuacuuuucuggucugaggcuguagccuuggucagguucccagcuucccucuucaggacacugagcaaagucugggagcucuccagcaucuugagguagguggccuccgucuccgcgauggucugguagaacuuacugcaagaggcaaucuugcgugccagguucucguugacgcgggccagcuucucguugacgcaggccagcuucucugucagcugccucaccucauucugcagccgcuguuucuuguccuccuccugcuggaucugccagcacagcuccuccugcuucuggcauagcuccucuaugcauuugaccagcuuguugucguaguucugcagcgccaugcccugcugggucaacaucuccuggggcccccuauuuuuuuuuuugagauggaguuucacucuuuuuuuguuuuguuuuguuuuuuguuuguuuguuuuuuuuuuuuuuuugagacaacagucuuacucuguugcccagccuggagugcaguggcgugauaucggcucacugcaugcuccgccuccuggguucacaucauucuccugccucagccucccgaguagcugggacuacaggcgccugccaccaugcccgugguguuuuuuuuuuuuuuuaaguauuuuuaguagagacgggguuucacuguguuagccaggauggucucaaucuccugaccucgugauccgcccgccucggccucccaaagugcugggauuacaggcaugagccacugcgcccagccugagauggaguuucacucuuguugcccaggcuggaaagcaauggugaagucucagcucacugcaaccucugccuccuggguuuaagcgagucucuugccucaggcucccagguagcugggauuacaggcacacgccaccacgccuggcuaauuuuugcauuuuuaguagagacaggguuucaccauguuggccagacuggucuugaacuccugaccuuaggugauccgcccgccuuggccucccaaagugcugggauuauaggcaugagccaccgugccugaccuaauuuuauuuuuuuaagagacagggucacauuauguugccuaggauggucucaaacuccugggcucaagcaaucuucccacaucagccucucaaacugcugggauuacaggcaugagccaccagugcccagcuacaauaaacucuuaacagucagaauacuugcugccuuaccaaaagucaagcugugacuccacaccaacacugugaacaccaucuguaggcaaagguggcuuucuuaacuucagggacaccaaucucuucuggcucugggcuggcaaccuuaaagggccuuauagaccucaggcaagugacguuaaagggaaagagagaaacagauggaaagagacaaagccaggucuacacaaacccuugagaaacuaauauuaaguuagcuggagcaauucacauggaagagaaaacucugaaaaugcccagaauuuacaaggugguccucauuagugaaaaaaagacaauuaaauauaaacaaccggccaggugugguggcucacgccuguaaucccagcacucugggacgccaaggcggguggaucaccugaggccaggaguucgagaccagccuggccaacguggugaaaucccaucucuacuaaaaauacaaaaaauuagccgggcgugguggcacgaacccguaaucccagcugcucaggaggcugaggcaggagaaucgcuugaaccugagaggcagagguugcagugagccgagaucgugccacugcacuccagccugggugacagagcaagacucugccucaaaaaaaaaaaaaaaacaaaccaccaucaccaccaccaaggaauccauccauggaaacauuuacuauccucugccaagaaauauauuaaauuggagggaggacuguugagggauaaauaaauaaauagaaauacauuggccaggcaugguggcucacaccuguaauuccaccaccuugggagggauugcgccacugcacuccugcuugggugacagagcaagacugcaucucaaaaaaaaaaaaaaagaaauauauaaaacugacucuauugguagguuuuaaaaaaguuauuaagccaacuagugaccuuccuucgaugacauauucccuugauguacguuuucuuguuauuuuuugagacggagucuugcucuguugcccaggcuggagugcaguggcgcgaucucggcugaccgcaaccuccgccucccggguucaagagauucuccugccucagccucccgaguagcugggacuacaggagcaugccaucacacccagcuaauuuuuuuguauuuuuaguagagacgggguuucaccauauuggcccaggauggucuugaucucuugaccucgugaugugccugccucugccucccaaagugcugggauuacaggcauaagccacuauuuccauucccucaauuucaacuucucugugucuuugacacacaauguauuacuaaacauguuuguuuguuuguuuguuuguuuguuuucugagauggagucuugcucugucacgcaggcuggagugcaauggugccaucucagcucacuacaaccuccaccuccugaguucaagcaauucuccugccucagccucccaaguagcugggauuacaggugcacgccaccacuccuggcuaauuuucuguacuuuuaguagauaggggggucucgcuauguucaccaggcuggucuugaacuccugaccucaagugauccacccaccuccgccucccaaagugggauuacaggccaugagccacugugcccagccuuguuuuguuuucuuguguuuugagacaagcucuugcucugucacccaggcugcagugcagugcacaauuauagcucacuacagccucaaacuccugugcucaagggauccucccaccucagccucccaagaagcuggaacugcaggcacaagcuaccaugcccagcuaauuuuuaaaaaaaauuuuguagagacaggagucuugcuauguugaccaggcuggucucaaacuccuauccucaagcaauccucccaccucagcuuuccaaaauguugggauuacagguauaagccaccaugccugacucuuuuuuuccaagagacagggucuccagccugaccaacauggagaaacccugucucuacuaaaaauacaaaauuagccgggcgugguggcgcaugccuguaaucccagcuacucgagaggcugaggcaggagaauugcuugaaccugggaggcagagguugcagugagccaagaucgcgccauuacacuccaaccugggcaacaagagugaaacuccaucucaaacaaaaaagaaaaagaaaaagagacagcaucucacucugucguccaggcuggagugcaaugaugcaaucguggcucacgguaacuucgaacuccugggcucaagcaagcuuccucccucagccuucugaguagcuaggacuauaggcacauaccacuguaucccuggugugguuugucuuuuaaagucugaucugagaguuugucuuuaguuugguaaauuuaacucaucuacagugauucuaaugcuguuauuagacuucacugaauuuaauucagccuccuuauuucagguuucuuuuuuuucccccuuuuuccacauguucuaacaugcuuucuaauuaccauacuucuuauuuuuuccccccuucauuuuugccuuccauuaauuuuccuuuugcagguguggcaguuugcuagucgccuccugcuagcuauuuuccccuccuuccuuaguuugagaaccccaguuuuuagcuggacaugaugcaguccugcuauacaguacaucccagccuuccugaaagccagguauugucauaugauuagccaaugagauacaaaggagguuugauguaugauaucugagaaauguccuaaaaaggaagggguaggucagcuggguuuaauauugccauggagcugcuacgucagcaauggauugacugccuacgucagaaauucuuuucagaaagauguaagccuccaucuugcuuaauacgcuaauuugcagauuuuucuuaccugccagcaagccuuuccuaacugacguaguauguuucaaaguuauacauucaauuuuccguuucuguuaguuguuccauuaacuuauuaggaucucuauuuuuauuuuuccccauaaauuacauaaacuuacaauuguucaccuuucucauccucaagaauaguaguucuggacauucucaucucucucugcucuauacuaauuccucaccuauguuggaauuacccagaauuuaucucuggaauauuauagauacuaguugcuuucuuaaaccuugauuauuauuguaccuuuuuuuuuuuuuucuccugagacagagucucacuguaucgcccaagcuggagugcaguggcacgaucuaggcucacugcaauccccaccaccauucucaugccucagccuccccaguagcuacgauuacaggcaugugccacugcaccgggcuaauuuucuucuauuuuuuaagagaugggguuucagcauguuggccagccaccgcaccuggccuauuauugauuuuuuuuggccgggcgccguggcuuaugccuguaaucccagcauuuugggaggccgaggcaggcggaucacuugaggcuagaaguucgagaccagccuggccaacauggugaaaccccgucucuacuaaaaauacaaaaauuggcugugcauggguggcaugcaccuguaaucccagcuacucaggaggcugaggcacagaauugcuugaacccaggaggcagagguuacagugaaccgagaucaugccacuggacuccagccugggcuacagaucaagacuccgucuauuaaaaaaacaaaaaaacaaaaccccugaguguauaaaaucaagaaauuugcaccaagugauacauccauguaaccacuacccugaccaagaaacaggacacccccagaccccuagguguccuucucacgauucagucgcaauucuucccaacacuaaccaguucugaccaugaauccccaagguuaauuuugccuguuauaaaguuuuaagucaacagaaucauuaugcccugcucugugucuaccuucucucauucaucauuuuucauuagacucaucacuguugugcaaagcuggacagaauuuccuugugugcuuacacuuacugcaguuuauccauuuacuuuugauggacauuuggguuagcuccaguuuguaacuaugacaagcagugcuagcacaaacauccugaaauauguauuuaagagaacaugggauauauuucuauugguuauaugccuaacaacaggauuguugaguagcagaaugugcauauaauucuacauuuuugccucuuuuuuuuacuaguguugccugacuuguuuguauugacuaguaggaauuucuuugcaacucuagauauacgaccagcugugguggcucaugccuguaauccagcacuuugggaggcuaaggcaggcagauaacuacaggccaggaguucaagaccagccuggccaacaugguaaaacccugucucuacuaaaaauacaaaaauuagcugggcaugguggugggagcuuguagucccagcugcucgggaggcugaggcaucagucacuugaacccgggagugggggugcagugagcugagaucgcaccauugcacuccaaccuuggcaagagaguaagacuccgucacagggaaaaaaaaaaaagaaaaaaaaauucuggacacaacuugucagacauggauuacaaaucucuucucucacuguauggcuuauggcuugucuucacucacuggugaacagacauucuuuuuuuuuugagauggaguuucgcucuuguuccccaggcuagagugcaauggugcaaucucaguucccugcaaccuccgccucccggguucaagcgauucuccugccucagccucccaaguagcugaaauuacagauaugcaccaccacgccuggcuaauuuugcauuuuuaguagagacaggguuucuccauguuggucaggcuggucucaaacucucaaccucaggugagccgcccaccucggccucccaaagugcugggauuacaggcaugagccacugcuccuggccuuuuuaaaaaaaaaaaaaaaaaaaaaaaaaaagagauggggucuugcugucgcccaggcuggagggcaauggcagaaucauagcucacugcagccucaaacuccuggacucaagcaaugcucccaccucagccugucagguagcugggacuacaggcacucaccauugugcuuaaucccaucugcaaagucccuuuugccaugucaccugacauaaugacagauucugaaacagauucugggaauuaggauauggauaucucagggugaagaugagcacagcuaugccuaccacagcuauuuuauuuaucuugucaacaacuggcaaccgggguuucuuaaacuggaguccaugacuggacuucagggguucuaacaguucuucucuuaagaacucauaguuuucaugguucucaaaugaccuaggagcccacuacuauguaauggucacaguccaaggccugacagagggaaaaggacagagcgcaacauuauucccauaacuacuggaacacagauauaauuuccaaaacuuauaccauaacgaaaauuaaucacuucuuuaucucccuaagaacaugcacaguuccacauaccacaugaacaucucuugaaacagauguguccuuaguccaaguuuuguagcugaacaauucacccagcaagcucccagggcaacaaugaguaacaggccacugggcagaaacagguagaaucaagcuaucacuuuuuuuuuguuuuuguuuuuuuugggucagagucuugcacugucaccuaggcuggaguauaauggugcgaucucagcucacugcagccuucaccuccuggauucaagcgacucuugagccucagccucccgaguagcugagauuacagguaccugccaccaugccuagcuaauuuuuguauuuuuaguagagacaggguuuuaccauguugaccaggcugggcucgaacuccuggccucaggugagccaccucccacggccucucaaagugcugagcuuacaggcaugagccaccaugcucaggccucaacuaucacuuuuaagucauauaaaaccccaugccuuagccuuccucuuauccaucaaggccucuaacuacauguggagaaaauaaaagcgugacaaaaacaaagcaaccuccugguagagcagcaaccuuagacuugaucccucauaucccuuccuccuuuucucauucuccacgagcagaggcucgccaccuugcugagauauccugacaggcuucccuuagaugcugcccugcuaccaaaagccacggucuucauccagaagcaugaacucuggauauacaaaauaggcauuguucaucugaaucagaacaauuuuucuuaguacaaguacugccuuaggaaagacugucucuuuugcacaugugagccuacaacaagggagaaaaaauucacuuacuuugacugcaaggucugccugggccaugugccaucuucauuuugaggcucaauuacuagcaccugagugaaaggggaaaccaaaugaggagaguucaaaccaccgcacuuccaacaugcuuagaagcaaaaaguaucuggccacacacccugggcagagcuaccugcuggggaauggccagggcccuccuaccugacccugguauagcccagcauccuggacaguguugucuagcuugcucaacugcucguagguguugcucauguauuuguuccagagccguguuucacgcuccgcagggauguugaauagcuuccgcaucucuuucucgaugguugcuaggaacaggcagaaauaucacuuggggcuuuguccacaugcaaggcuaaagacagccauggcaaacuaaugcucauccucuuucuugucagaugcucacaggugcucuggaucaacccccugauaccucuuaaaaucaaucaucucccauggguggccucuugcacucauaugccuggaaaguaucccuaugcuucuuugcuaacgugugucucucauuuauggcgcaaaagcaacauagaaagcgagaaagcuuaucuuuggaguuaacucagauauggcuucaaaagcuagcuccaccauuuucuggcugcgauuuguuuuuuuuuuuaagagacaggaucuugcucugaugcccaggcugcagugcaguggugggaucguagcucacuguaaaccuugcugagauuuuuaaauaaguuauuuuuaaacuucuuuggaucuacauuuccuuaucuucauuaucauagacaaaugggcaaggagcaggcccaguguucucuccauaagaauuccuggaggaauaggcccccaggucaggacuggcaacuacagcucgagaugauuuggguaacaaaucuaaagagggcauauaaaauaaugcccucuucccucccaucagccacaauguccuacacucucucaccacauaccagggaccccagcccagccucucaccaauggugucugccuugcugaaauggcaacucagcacauugguggggucacuguucucacagagcuucaguuccagcaaauacaccucgacuuugcagugcuugacaaacaggccaugcuccacaaccuaugaacaagaggcaggggugagggcauagcgguuuugcagcugggcagucuuggauguagcauaucuuaucagaagcaaaaagcagaaaacucaugauaauccauuuccuuuacugaucaagggaucaaaagaacagauuuuuaaagcuaccaguaccuggacaaagaguuuaaaaauauuuuuucuggccgcgugugguggcucacgcuuguaaucucaacacucugggaggccgagguggguggaucacuugaggucaggaauuugagaccagccugaccaacauggugaaaccccauuucuaugaaaaauacaaaaauuagccgggcaugguggcaugugccuguaaucccaacuacucaggaggcugagacaggggaaucgcuugaacccaggagguggaggcugcagugagccaagaucgcuccacugcacuccagccugggcgacagagcgagacucuguaccccgcaaaaaaauauauauauauuuuuuuucuacccacuaagaccaagagcaucuugaugauauuagagagaagccuauucuucacuguuuuuuguuuuugagauggagucuuccuccgucagcagccuggagugcaguggugcgaucucagcucauuacaaccugcaccuccuggguucaagagauucuccugccucagccucccgaguagcugggacuacaggggcccaccaucaugcccagcuaauuuuuguauuuuuaguagagacaggauuucaccauguuggccaggauggucucgaucucuuaaccucgugauccgccugccucagccucccaaagugcugggauuacaggcgugagccaccaugcacggccugaucaaagacucuuuuuuuuuuuuugcaaccgagucucacucuguugccaggcugcaguacaguggggugaucucggcuuacugcaaccuccgucuccuggguucaagcaauucuccugccucagccucccgaguagcugggacuacagguaugugccaccacacccaguuaauuuuuggauuuuuagcagagacgagguuucaccauguuggccaggguggucuugaucuccugaccucgugauccacccgccucaaccucccaaagugcugggauuacagaugugagccacugcgccuagcucaaagacucuuaagcauagagggaaaagcaguaucauaaagguuuuuuaagauaaacaagaugcaggacauuagcuauauguccauaugcccccagugaacuuucucucauagaauuuuccagaaaguucucucacagcgcugcugggcacauuccaagccacugggcagcucugauguuuagaggccacucaugauaauauucugggugagcaacuucacucacaaccacaauuuccuaaagagaaccagaaacaggcugggcguaguggcucacgccuguaaucccaccacuuuggggggccgagucgggcggaucacaaggucaagaguuugagaccagacuggccaacauggcgaaaccccgucucuacuaaaaauacaaaaauuggccaggcguagugaaaggcgccuguaaucccagcuacucaggaggcugaggcacgagaaucacuugaaccugggagccagaggcugcagugagccgagaucgugccguugcacuccagccugggcgacaagugcacaagacuccaucucaaaaaaaaaagagauccagaaacaaggccucaagcaccacuauucaaccacugagguauguucauuuuccuagcaaacacuagucaguguccaacagaaagcaccugcagacagugaccagcaggugggacaauucacauaacucacuuuucugacgauggguugcuggccuucuacacagccguaccaguuuaguaguuuauuccacgccucgguagggaccaauacauaguccaauucaucaauuaaguguucuuucaaggucugacucucaggaucuaaaaaaggaaaagagcacauaagucacugcucuuuaccccagaaaugaugguuuuacaugauuuccauguacuuuucagaaauaagaaaauuauuuacagaaagaaacaggaaugaaauuccaaaauucugucacuggucauuauacagagcagacuuuugucuuuauccauguuuucucuuuauccaugaagauuuuaugaggaauuuguauuucuucuauaauuggagggagagaagaggauaaaaaagaaaaacuccaggcugggugugguggcucacaccuguaaucagcacuuucggaggcugaggcgguuggaucaugaggucaggaguuugagagcagccuggccaacauggugaaaccccgucucuacuaaaaauauaaaaauuagccgggugugguagcgggcaccuguagucccagcuacucgggaggcugaggcaggagaauugcuugaacccgggaggcagagguugcaguaagccaagaucacgccacugcacuccagccuggugaaagagcaagacuccaucucaaaaauaaauaaaucauacaugaggugguuaugguuucccaccaucccuccgacuaguuuacacaccuuuuucagggcaggguuccuuuguugucauuucaacaaugcucauaacaucuucaccagacauagauuccaucucaagaaaccauuuucuuugcucacccauaagaagcaacuccucagccauucaaguuuuaucauaagauuaaagcaauucaggccgggcauguuggcucaugccuguaauuccagcacuuugggaggcugaggcaggcagaucacuugaggucaggaauucaagaucagccuggccaacauggugaaaccccauuucuaguaaaaauacaaaaauuagcugggcauggugaugcaugccuguagucccagcuacucgggaggcugaggcauaagaauugcuugaacccaggagguggagacugcagugagccgagauaccccacuguacuccagccugggugacagagcaagacucugucucaaaagaaauaaaaauaaauaaaaauuaaaauuaaaaauaggccaggcgcaguggcucacaccuguaaucccagcacuuucggaggccgaggugggcagaucaugaggucaggaguucaagaccagccuggccaggguagugaaaccccgucucuacuacaaacacaaaaauuagcugggcaugguggugcacaccuguagcccagcuacuugggaggcugaggcaggagaauuguuugaacccaggaggcggagguugcagugagccaagauugcgccacugcacuccagccugggugacacagcgaaacuccaucucaaaaaaaauaaaaauaaaaguaaaaauaaaaaauaaagcaauucagucacaucuucaggcuucacuucuaauucuaguucucuugcuauuuccacuuuugcuguuacuucucccacugaugucuugagcccguugaagucauccguaaguguuggaaugaacuucuuccagacuccuauuaauguugauuuugaccucccaugaaucaugaauauuuuugugugugugugugggcaggugggaguggcaggccuuacucuaucacccaggcugaagugcaguggcaugauuacagcucacugcagcuucgaccucccagacucaagcaauccuccugccuuagucucccaaguagcuagaacuacaggugcaugccaccaggccuagcuaauuuucguauuuuuuauagggaugggguuuugccaaguugcccacccuagucuccaauuccuggguucaaaggauccaccuacuucagccugccaaaguccugggauuauagguauaagccacugcaccagguggaaucaugaauauucuuaauggcaucuagaaugguaaauccuuuccaaaagguuuucaauuuaauuugcccagauccuucaggagaaucacuaucuauggcagauaaagucuuauaaaauguauuucuuaaauaauaagacuugaaaguugaaaucaaaucaggcacgcuggcucaggccuguaaucccagcacuucggcaggcugaggcgggaggaucacuugaggucagaaguuugagaccagccuggccaacauggugaaaccuggucucuacuaaaaauacaaaaauuagccagguggagggacgggcaccuguaucccagcuacucaggaggcugaggcaggagaauuacuugaaccugguaggaggaggcaggagaauugcuugaaccugggagggagagguugcagggagccaagacugagccacugcacuccagccugggcaacagagugagacucugucucaaaacaaacaaacaaacaaacaaacaaacaaaaaaaguugaaauuacuucuugacucacaggcugcagaacggauguuuuuaguaggcaugaaacaacauuaaucuccucaugcaucuccaucagagcucuuggguaacuagguacauugcaauggagcaguaacuuuuuuuuuuuugagacagucucgcugugucccccaggcuggagugcaguggcgccaucucggcucacugcaagcuccaccucucggguucaugcuauucucccgccucagccucccgaggagcugggacuacaggcacccgccaccacacccgguuaauuuuguuuuuguauuuuuaauagagacaggguuucaccauguuagccaggauggucucaaucuccugaccucgugauccgcccaccuuggccucccaaagugcugggauaacaggcguaagccacugcaccuggcagcaguaacauuuugauaagauuagcucagugcuuuuucugagcaguaggucucaacccugagcuaaaaauauugggaggcuggaggcuggaggccggaggccgggcgcgguggcucccaccuguaaucccagcacuuugagaggccgagauggguggaucacgagaucaggagauugagaccauccuggccaacauggugaaaccccgucucuacuaaaaauacaaaaaaaguagccgggugugguggcaggcaccaggcgccugugaucccagcuacucaggaggcugaggcaggagaaucgugugaacccgggaggcggagcuugcagugagccgagaucgcgccacugcacuccagucugggugacagagcaagacuccgucucaaaaaaaaaaaaaauauugggaggccgggcgugguggcucacaccuguacucccagcacuuggggaggccguggugggcaguuaccugaggucgagaguucgagaccagccugaccaacaaggagaaaccccgucucuacuaaaaaaacaaaauuagcugggcgugguggcgcacgccuauaaucccagcuacucaggaggcugaggcaggagaaucgcuugaaccugggaggcagagguuguggugagccaagaucgcaccauugcacuccagccugggcaaaagagcaaaacuccgacucaaaaaaaaaaaaaucgguaaacuuguugugguggcucaugccuguaaucccagcacuuagggaggucaaggcggguggaucacuugaggccaggaguuugagaccagccuggccaaaauagcaaaaccccaucucuacuaaaaguacaaaaauuagccagaacugguggugcaugucuguaaucucagcuacuugggaggcugagccaugagaauaacuugaacccgggaagcagagguugcaguaagccgagauugcaccacugcauuccagccugggcgacacagcgagauucugucccagaaaaauaaaauaaaaacaaaaauauucgguauaccaugcuguaaauaaauaugcuaucaugcaggcuuuguuguugcauguguagggcacaggcagagcagauuuagcauaauucuugagggccuugggauuuuuggaaugauaaaugagcacuagcuucaaacuaaagucaccaucugcaguaucccuuaagaagagagucagccuguccuucaaggcucugaaucuggccggacagaguggcucaugccuauaaucccagcacuuugagaagucaaggcagacagaucacuugagcccaggaguuggagaccagcccgggcaacacggcaaaaucccaucucuacaaaaaaaaaaaaaaaauacaaagcugggcacaguggcucacaccuguaauuccagcacuuugggaggucaaggcggguggaccaccugaggucaggaguucgagaccaggcuggccaacgugcugaaaucccgucuuuacuaaaaauacaaaaaaaaauuagcugggugugguggcagguaccuguaaucccagcuacuugggaggcugaggcaggagaaucacuugaaacugggagguggagguugcagugagccaagauugugccauugcacuucagccuagacgacagagcgagacucugucuuacaaaacaaacaaacaaacaaacauauaaaaaucagccaggcaugguggcaagcaacuguaguccuagcuacucaggaggcugaggugggaggaucacuugagcccaggagguuaaggcugcagugagcugugaucacacacuacagccugggugacagggcaagacccugucucaaaaaaaaaaaaggcucugaacccaggcacugacuuuuccccucuagcagcaaagagguagauggcaucuucccaauagaaggguguuuugucuacauuuaaaaucuguuguuuaggccaggcacaguagcucaugcuuguaaucccagcacuuugagaggccgaggcaggcggaucacuuaaggucaggaguuugagaccagccuggccaacauggugaaaccccauggugagacucugucucaaaaaaauaauaauaauaaauaaaaauaaaauaaaauaaaaccuguuguuuagccugggcacagugacucacaccuguaaucccagcacucugggacgucaaggcgggaggauugcuugagcccaggaauucaagaucaaccugaacaacaugacaaaacccacaaaaaaucucugcaaaaaauacaauaauuagucgagugugguggggccuguaguuccaguuacucaggaggcugagaugggaggaucaccugagccugggaaggucaagguuguagugaggugugauugugcuacugcacgagguagcaguagcuaccuuuuuuuuuuuugagacaagauggcaccuugucucaaaaaaaaaaauaaaugaauaaacuuucuccauaucagcaauaauaaggcuguuucagccucuuauaauucauguguucacuagaguagcacuuuuuuuuuuuuuuuuugagauggagucucacuucugucgcccaagcuggaguggagugcaguggcgcaaucucagcucacugaaaccaccauuuccuggguuccuccaucucccaggcaacaugacaaaacuccaucucuacaaaaagaaaaaauaaacacauacaaaaaugagccaggaaugcuggcaagcaccuguaguccuagcuacucaggaggcugagguggaaggaucacuuaaguccaggagguuuacauuuacauucacaacuuggcuagcuauauggcacaagaggccuagcuuacaaccuauuucggcuuccuuaaccaaacucaaaucauuucuagcuuugauuugaagugagagacaugcaauucuccuuuucacuugaacauuuagaagacguuguuaggguuacuaaguggccgaauuucagugucauugugucucaggcaauagcaaagccugaggagagagagagagauggaauggcugguuggugaagcagcgagaauacacacaauaauuaccaauuaaguucacugucuuacaugggcucccuucaugaugccccaaaacaauuacaauagcaacaugaaagaucccuguuggcugggcaugguggcucaugccuguaaucccagcacuuugggaggcugaggucgggaguucaagaccagccugaccaacauggagaaaccccaucucuacuaaaaauacaaaauuagccgggcgugguggcacaugccuguaauccuagcuacucgggaggcugaggcaggagaaucacuugaacccaagagguggagguugccaugagccacgaucaugccacugcacuccugccugggcaacaagagcaaaacuccgucucaaaaaaaaaaagaaagcucccugaucacugaucaccauaacaaauaauaaugaaaaacuuugaaguauuuugagaauuaccaaaaugugguaacagagacaugaagugagcacaugcuguuguaaaaauggaacugacagauugucaaggcagcguugccaaauaccuacaaaauuugcuaaaaaugcaguaucugcaacauauaauaaagcaaagcacaauaagccaaaguaugccugaauuuaaaaccuuaagaauucuccauuucauaaaaaugagaaaaagaacaaaaugugaacauaaugaaaugauuccuuagggcaacuucguggcauagugccaccauuugaccuauuucaggaaacaaaguaaaugauauuguuuauaccauguagaccucuccuaaaacaaggucugagcugaagcauugcucaguuuuaaaaauauccaaguuaggccaggcacaguggcucacaccaacacucugggaagccaaggugggaggauggcuugaggccaggaguucaaccagccugggcaacauagcaagaccccgucucuaccaaaaaacuuaaaaaacagcugagagugguagaacacuguagucucagugacuaaggaggcugaggcaggaagauagcuugagcccaggagcucaaggccagccuagccaacaugguagagacgggguuucaccauguuggccaggcuggucucgaacuccugaccucaggugauccaccugccuuggccucccaaagugcugagauuacaggcgugagacaccacuccuggcacugcccugauuuuugacacccaugacagaucaccucuaucaugacuuuaaagaggucugaagucaggcaaaagaaagccugggaaaagcugacucugucaucucagugcauguacaagugcaagcaagcucuaguguguuacaugucgcuuuucccacaguucccauugggagcugacuacagucauaacucugucuacugaccuucaaccucuccucacacuaguuauaugauaaaaacagccaucacaggaauucuugaugaaaguucacagguuuacaauuuguuccacugcaaagguaacaaaaaauucugguucuuaaauuuuagauacaauuucaaaaugacauccuauuucuuuccauuccauauacuaacuuaaaaugugaaauagcuagcagaacuaauuugcaaagagagaaaguuaaaauguuagaagcauacucuuaucagaugcaguuaauuuaagggaaaaaaguagcuuaacuucucauuaaggguuugcaaagacuucugcuauagaugcaaaaugaggauacuuguuucuaucuccucacacuaggaaaguucacaacguccauguuacagaugcacauaacaucaggccacugcccaggugaauguuuagcuagaaaagcaacauuuacuauaccugaaaauagcccagaguugucuauugggccaggaaauagguuauguucacccacauuguacaugucccagcugucaaagcccacauacuucuuccacugcuugaaccaccggcugucaauaagauaccuagagagagacagaaauuuacuguagcagaaaagcugagauuauaaauuucugcagcugcuuccuuaaucuuuuuuaugguccuuccacuuggggcauaugcaauacccacuaaaaaacacugucacaagagcaagagcagggcccaggccccacauggcacagagagucuggcccaggguaugcauccauuaagugaaaugauuguucaaagagugaauaaaagaaagaaaacaagugguuucaaaaugcuuauuuaaaugcagucuuucuuuuuuuuucuuuuagacggagucuuguucugucgcccaggcuggaguauagugacacaaucuuggcucacugcaaccucugccucccagguucaagcgauucuccugccucagccuccugacuaacugggauuacaggcaccugucaccacucccagcuaauuuuuguauuuuuaguagagacgggguuucaccauguugggcaggcuggucucaaacuccugaccucaggugauccgccuacuucggccucccaaagugcugggauuacaggcaugagccacugcaccuggccucuuuuuuuuuuuuuuuuuuuuuugagacggaguuuucgcucuuguugcccaagcuggagugcagugguaugaucuuggcucacuacaaccuccaccuccuggguucaagcaauucuccugccucagccucccaaguagcugggauuacaggcaugcaucaccaggcccagcuaauuuuuuuguauuuuuaguagagauggaguuucaccauguuggccaggcuggucucgaacuccugaucucaggugauccuccugccuuggccucccaaagugcugugauuacaugcaugagcuaccacacucagucuaaauggagucuuuucauggguaaaaucauguuugcuaauaaacaagucauuaacuucuuuuuuuuuugagacagaguuucgcucuuguuacccaggcuggagugcaauggugugaucucggcucuccgcaaccuccgccucccggguucaagugauucuccugccucagucucccguagcugggauuacaggugugugccaccacaccuggcuaauuuuguauuuuuaguagagacaggguuucuccauguuggucaggacagucucaaacucccuaccucagguaaucugcccaccucggccucccaaagugcugugauuacaggcgugagccaccgcacccggccacaagucauuaauuucauaaugaucuuuacagaagucccacuccaggcagacaguuugguuacacuguuuugcuugacaugaacagcacuaaacuaaugcucuuucugaaaauggguuagaaacaccacccacuucaguuuuccuuuaaggaccaaaggaguuccaaaaauguacacacaaggccaggcgcaguggcucacaccuguaaucccagcacuuugagaggccgagguggauggucacuugagcucaggaguucaagaccagccugggcaacaaaccccaucucuacuaaaauuacaaaaauuagcugagcgugguggcacaugccuguagucccagcugcucgggaggcugaggcacaagaaucacuugcacccggaagacagaaguugcagugagcugagaucaugccauugcacucuagccugggugacaggaauaaaacccugucaaaaaaaaaaaaguacauaacaugcguguacauauauaaauauacacauacacauguacauauaauagugccuauuguucaucuugucaaaaagcauuaauuugugcuucauauucaacuuaccacuuuuuuacuuaaauguaagcaaaugugguauuuuauuuaccuauuuauuuccuuagagagagggucacccaggcuagagugcaguggcacaaucauagcucucuguagccucaaacuccugggcucaagugauccuccugccucagccucugaguagcugugacuauaggcacauaccaccaugccuggcuaauuuauuuuuuuauuuuuauuuuguagaggcuagcucuugcuauguugcccaggcuggucuugaacuccuggccucaagugauccuccugccucagcuucccaaagugcugggauuacaggcaugagccacugcaccagaccuguuuauauuuuuaaaguaucacugugcuggccgggagcgguggcucacgccuguaaucccagcacuuugggaggcugagucagguggaucacgaggucaggagaucgagaccauccuggccaacauggugaaacccugucucuacuaaaaauacaaacauuagcggggcaugguggugcaugccuauaaucccagcuacucgggaggcugaagcaggagaaucgcuugaacccgggaggcagagauugcagugagccgagaucgcgccacugcacuccagccuggugaugcagcgagacuucgucucaaaaaaaaaaaaaaaaaaaaaaaaaaaaaguaucucuaugcuguuuuacaauuaaaacaaucucuguggagcaacaaagcaucaacaauuauauuggugcauccuuaaaauuuuauaaccaacaaaugugagaggaggucaggcagcuucccagaggucacaaggauccauaaacacauccaucucuaaaaugcuauuuuucuuccaaaucccuugagcaauaccuuccauacaauuuuacuguaugauuuuagucuaucuuaaacuuccucuacuucugcugaguauucuuuaugaacccuauagagguuaacuuaaaaaguaccucugcuaggccgggcgcaguagcuuccgccuguaaucccagcacuuugggaggccacagcgggcgaucaccugagaucuggaauucgagaccagccugaccaaaauggagaaaccccgucucuacuaaaaauacaaaaaaaauuagccggccgugguggcgcaugccuguaauccuagcuacuggggaggcugaggcaggagaaucgcuugaacaugggagggggagguugccgugacccgagaucgcgccauugcccuccagcaugggcaacaagagcgaaauuccuucucaaaaaaaaaaaaaaaaagaaaagaaaagaaaagaaaacacaaaaaaaguaccucuguuuacccugccuuucacaaacugguuagcucaaggugaauacauaagcuguuaucuguacuccuccuaaccccaauuuuucuauucuccugcucaauuccucggcagaucaucaccacaaugauuucuuaaagauagguaacacucgggccgagcacgguggcucccaccuguaaucccagcacuuugggaggccgaggcggguggaucauaaggucaagaguuugagaccagccuacccaacauggugaaacccggucucuacuaaaaauacaaaaaauuagcugggugugguggcgugagccuguaaucccagcuacucgggaggcugaggcaggagaaucgcuugaacccgggaggcggagguugccgugagccaagaucacgccacugcacuccagcuugggcaacaagagugaaacuccaucucaaaacaaaacaaaacaaacaagauggguaacaaucauacucgaugcaaagucuagccuuaguuuuucuacuccuacacaauuacaccacccaggaaucucuccaguaguacaaaguauuguccccucuacuaaacaaucuauuaagaugccuaauaacucagccugggucuucuaaauucuggacccuucaucuucuaucuagcuccaggaccuaggcuauccuccucucccacuccaagacacugcugccgcaaauauuuuugacacuugcuaccaaaauaaucgggguucucagacauuuguucagcuucugaccuugacaucuguuggcaguuuacaaguuacaaaguaucuacuucugauuuuccccucaacccacugaggucggugagccaaauauugcuauccugguuuuaacagugaggaauccaggucugugacaccuucgcccaaggucacacggcgaguccucaugguaaagggcucuccccacccuuaggguccccaccaaccuuccccuucuccacaucccuccuccuggcccccgccgggcccgcccccuagggcuccaaaugaacugagacgacacucaggccccgccugcgcuuucccagagcugauccuggaguuauucuccugaggggcaggugucaggcuacucuuccagggucacuacauaccauccccgcccagccccuacucuagccgagaaaaaggaggccccuuuuucucggccccugguucugcauagaggaagagcgagccgggagcucaccacugcgccccgcguuggagugugguccucauuaaggguccaagcucggacuucugagucuccgcauccggucgcucacggcagccuccaccuuccgccaucuccuccgcggccccggcccagccggcccggacauccgccccgcgcgcggcgugcuauagaccgcgcccacgcacgcac

SEQ ID NO: 192996 - RNA, 3930 nt, Homo sapiens
gaggucagagacuuaagucuaaggcacugagcguaucauguuaaagaugagcggguggcagcgacagagccaaaaucagagcuggaaccugaggagagaggcgaguacugauucccaucuaccuuuuacccucccgucuccucaaaguuggggcguccgcucuuuaggaucggccucacuccuccacagugaaguuagggaccguccgagagaggaauggggagagucccuuauucugggguggugcuuacaaaccccuauugcuucggacgacggcgucucuccaccccugcccggagccggaacacgggcccugcucugugcugcugggcaaagggaccucgguugcccuugggaaauucauucuuucccguagccaacuucaggccucaucguuaggccuguccgcggggaggcaggucagcaggacacacccccgcucuaagacugggugaccaucgcucaggccguuuccgccgcuucgccaccagcgggccuucucccuaccccacccccaauucugucucagucucagugccucuggugucagcauggccaccuugguagcuggggcuacuggacccugcagcggauaggggaaccuugaggagacacaagccuuugggaggggugccgauggacagggagugguguguuuuccuuuugccguagaggucucugggccuccugcacaagagagcagccuggaucucuuaaguguaggaggccauuuggggucuccccaggguauuguccuucccucgggauuagucccugccucuuuaacccgguccugucucccagcuaaucucuguguaaccauugcaucaggccagccccguuuggcucugcagccuucugaccugaggcucuacugcugaugaaagccaagucccacacacuggaaggcaagggaggguuccccagggaggacagcccugcagagaaauacuucgggcaauauugcaucucuagccccuagggaucagcagcugccacucugcuucugccccuucccuauaagagagacuggggggaguuuauccauucauucuuaacaaauacuuaaugaggaccuacugugugccacacaguuuggggcucaggguacauccuugagcaagaggaaaaaaucaucucagugggaggccuacaguaaacaaaauauaagugccacggagaaagcuaaagcagagaaaggaauggagaauguucaggauggaggucagaguguuacaucagguggucaggaauuaccuuagguaauuccuccacucaaaacccuucagugacuuccaugacaugaaauaggaagucauuggaggguuugagcagaggaaugaccuguuuuaaaaggcucacucaggcugcuguauggugaauagaguugcggagggguggcaagagaagaaaugggaagaccuucugcagucagaaaguuucugcaguaauuuagagaugguagugaauugaucuagauuggaaacaauggaauuagaaguguuuagauucuucuaagcaaagguuuuaaaaacucauuuuuaaagaaugaguuaagggccgggcaugguggcucacaccuguaaucccagcacuuugggagaccagagguggguggaucaccugaggucaggaguucaagaccagccuggccaacauggugaaaucccaucuuuacuaaaaauacaaaaauuagccgggcauggcagugcaugccuguaaucccagcuacuccggaggcugaagcaggagaaucgcuugaacccagcaggcggagguugcagugagccgauugcgccacugccuuccagccugggcaaaaagagugagacccgucucagaaaaaaaggaaugaguuaaaauuugcuaguacuuuggauugcagggugugagagaagaggaaugaaggaugauaccaagguuuuuagcuuaagcaacuagaguugucaucugagauggggaugaccuuggaaggggaaaaucagcaagaguuugccuuugcacauagucuuaggugccuauuagacauugaaaaagaaauggcaaguaggcaguagacagcagagucugaaguucuggaagagguccagacuggaaauguacauuuggaggaugucagcccugugggaauggaguuaggaaaaugcuaugauuuguucccuucccuguaguuuaguuuuuacccuggcagauuugaggccugcuuuggauuuagagaaagcugaguuggccaggacuuuacuauuauguaaccaggacuacaaaugucagcaacuaaaaauaaagaaagucaggcccucuucugcccuucgaaauggcuacagggaccaaguaugcauaccccacaagaccagaaguaaggaaggaccaguaggaggcuggagguaaaagaaaaauaagggcccagcacgguagcucaugccuauaaucccagcacuuugggaagcgauggaucacaagguuaagagauggagaccauccuggccaacauagugaaacccuaucucugcuaaaaacacaaaaauuagcugggcgugguggcacgcgccuguagucccagcuacucgggaggccgaggcagaagaaucacuugaaccgaggaggcagagguugcagugagccgagaucgcaccacugcacuucagccuggcaacagagcaagacuuggucucaaaaaaaaaaaaagaaagaaaaaaagaaaaagaaaaguaaguugccucucccccuuccaaaaauggcugacauuucucuuuguugcccacaguguucaagaaggaaguguaucuucauacaucaccacaccugaaagcagguaaacuuaaccuacccuuuuccaaaaauuuuaaacggcaggacaguaaauauuuuagauguuaaaaguccuauagucucuagcgugacucuucaucucugccacuguagcaccaaagcagccauaaacaauauguaaauaaacagauguggcuguauuccaguacaacuuuaccuacaaaaacaggcaucagaccagcuugccaacuuguggcauagacuguuugcuacauggagcuuguuccagccacuccccauuauccugcagaugugcuuuuccagacugauccaacugcagagauggcagcugagucauugccuuucuccuucgggacacuguccagcugggagcuggaagccugguaugaggaccugcaagagguccugucuucagaugaaaauggggguaccuauguuucaccuccuggaaaugaagagguaagaauguuagcccuaaagcuaaagggggauguuaccuuucccuucucaacuaauaucuauguucccuuuccucauuuccuugaaggaagaaucaaaaaucuucaccacucuugacccugcuucucuggcuuggcugacugaggaggagccagaaccagcagaggucacaagcaccucccagagcccucacucuccagauuccagucagagcucccuggcucaggaggaagaggaggaagaccaagggagaaccaggaaacggaaacagaguggucauuccccagcccgggcuggaaagcagcgcaugaaggagaaagaacaggagaaugaaaggaaaguggcacagcuagcugaagagaaugaacggcucaagcaggaaaucgagcgccugaccagggaaguagaggcgacucgccgagcucugauugaccgaauggugaaucugcaccaagcaugaacaauugggagcaucagucccccacuugggccacacuacccaccuuucccagaaguggcuacugacuacccucucacuagugccaaugaugugacccucaaucccacauacgcagggggaaggcuuggaguagacaaaaggaaaggucucagcuuguauauagagauuguacauuuauuuauuacugucccuaucuauuaaagugacuuucuaugagccaa

SEQ ID NO: 192997 - RNA, 3930 nt, Homo sapiens
uuggcucauagaaagucacuuuaauagauagggacaguaauaaauaaauguacaaucucuauauacaagcugagaccuuuccuuuugucuacuccaagccuucccccugcguaugugggauugagggucacaucauuggcacuagugagaggguagucaguagccacuucugggaaagguggguaguguggcccaagugggggacugaugcucccaauuguucaugcuuggugcagauucaccauucggucaaucagagcucggcgagucgccucuacuucccuggucaggcgcucgauuuccugcuugagccguucauucucuucagcuagcugugccacuuuccuuucauucuccuguucuuucuccuucaugcgcugcuuuccagcccgggcuggggaaugaccacucuguuuccguuuccugguucucccuuggucuuccuccucuuccuccugagccagggagcucugacuggaaucuggagagugagggcucugggaggugcuugugaccucugcugguucuggcuccuccucagucagccaagccagagaagcagggucaagaguggugaagauuuuugauucuuccuucaaggaaaugaggaaagggaacauagauauuaguugagaagggaaagguaacaucccccuuuagcuuuagggcuaacauucuuaccucuucauuuccaggaggugaaacauagguacccccauuuucaucugaagacaggaccucuugcagguccucauaccaggcuuccagcucccagcuggacagugucccgaaggagaaaggcaaugacucagcugccaucucugcaguuggaucagucuggaaaagcacaucugcaggauaauggggaguggcuggaacaagcuccauguagcaaacagucuaugccacaaguuggcaagcuggucugaugccuguuuuuguagguaaaguuguacuggaauacagccacaucuguuuauuuacauauuguuuauggcugcuuuggugcuacaguggcagagaugaagagucacgcuagagacuauaggacuuuuaacaucuaaaauauuuacuguccugccguuuaaaauuuuuggaaaaggguagguuaaguuuaccugcuuucagguguggugauguaugaagauacacuuccuucuugaacacugugggcaacaaagagaaaugucagccauuuuuggaagggggagaggcaacuuacuuuucuuuuucuuuuuuucuuucuuuuuuuuuuuuugagaccaagucuugcucuguugccaggcugaagugcaguggugcgaucucggcucacugcaaccucugccuccucgguucaagugauucuucugccucggccucccgaguagcugggacuacaggcgcgugccaccacgcccagcuaauuuuuguguuuuuagcagagauaggguuucacuauguuggccaggauggucuccaucucuuaaccuugugauccaucgcuucccaaagugcugggauuauaggcaugagcuaccgugcugggcccuuauuuuucuuuuaccuccagccuccuacugguccuuccuuacuucuggucuugugggguaugcauacuuggucccuguagccauuucgaagggcagaagagggccugacuuucuuuauuuuuaguugcugacauuuguaguccugguuacauaauaguaaaguccuggccaacucagcuuucucuaaauccaaagcaggccucaaaucugccaggguaaaaacuaaacuacagggaagggaacaaaucauagcauuuuccuaacuccauucccacagggcugacauccuccaaauguacauuuccagucuggaccucuuccagaacuucagacucugcugucuacugccuacuugccauuucuuuuucaaugucuaauaggcaccuaagacuaugugcaaaggcaaacucuugcugauuuuccccuuccaaggucauccccaucucagaugacaacucuaguugcuuaagcuaaaaaccuugguaucauccuucauuccucuucucucacacccugcaauccaaaguacuagcaaauuuuaacucauuccuuuuuuucugagacgggucucacucuuuuugcccaggcuggaaggcaguggcgcaaucggcucacugcaaccuccgccugcuggguucaagcgauucuccugcuucagccuccggaguagcugggauuacaggcaugcacugccaugcccggcuaauuuuuguauuuuuaguaaagaugggauuucaccauguuggccaggcuggucuugaacuccugaccucaggugauccacccaccucuggucucccaaagugcugggauuacaggugugagccaccaugcccggcccuuaacucauucuuuaaaaaugaguuuuuaaaaccuuugcuuagaagaaucuaaacacuucuaauuccauuguuuccaaucuagaucaauucacuaccaucucuaaauuacugcagaaacuuucugacugcagaaggucuucccauuucuucucuugccaccccuccgcaacucuauucaccauacagcagccugagugagccuuuuaaaacaggucauuccucugcucaaacccuccaaugacuuccuauuucaugucauggaagucacugaaggguuuugaguggaggaauuaccuaagguaauuccugaccaccugauguaacacucugaccuccauccugaacauucuccauuccuuucucugcuuuagcuuucuccguggcacuuauauuuuguuuacuguaggccucccacugagaugauuuuuuccucuugcucaaggauguacccugagccccaaacuguguggcacacaguagguccucauuaaguauuuguuaagaaugaauggauaaacuccccccagucucucuuauagggaaggggcagaagcagaguggcagcugcugaucccuaggggcuagagaugcaauauugcccgaaguauuucucugcagggcuguccucccuggggaacccucccuugccuuccagugugugggacuuggcuuucaucagcaguagagccucaggucagaaggcugcagagccaaacggggcuggccugaugcaaugguuacacagagauuagcugggagacaggaccggguuaaagaggcagggacuaaucccgagggaaggacaauacccuggggagaccccaaauggccuccuacacuuaagagauccaggcugcucucuugugcaggaggcccagagaccucuacggcaaaaggaaaacacaccacucccuguccaucggcaccccucccaaaggcuugugucuccucaagguuccccuauccgcugcaggguccaguagccccagcuaccaagguggccaugcugacaccagaggcacugagacugagacagaauugggggugggguagggagaaggcccgcugguggcgaagcggcggaaacggccugagcgauggucacccagucuuagagcggggguguguccugcugaccugccuccccgcggacaggccuaacgaugaggccugaaguuggcuacgggaaagaaugaauuucccaagggcaaccgaggucccuuugcccagcagcacagagcagggcccguguuccggcuccgggcagggguggagagacgccgucguccgaagcaauagggguuuguaagcaccaccccagaauaagggacucuccccauuccucucucggacggucccuaacuucacuguggaggagugaggccgauccuaaagagcggacgccccaacuuugaggagacgggaggguaaaagguagaugggaaucaguacucgccucucuccucagguuccagcucugauuuuggcucugucgcugccacccgcucaucuuuaacaugauacgcucagugccuuagacuuaagucucugaccuc

SEQ ID NO: 192998 - RNA, 66097 nt, Homo sapiens
ggggaagcgcagugcgcaggcgcaacugccuggcucugcucgcuccggcgcuccggcccagcucucgcggacaaguccagacaucgcgcgcccccccuucuccggguccgcccccucccccuucucggcgucgucgaagauaaacaauaguuggccggcgagcgccuagugugucucccgccgccggauucggcgggcugcgugggaccggcgggaucccggccagccggccauggcggggcuguacucgcugggagugagcgucuucuccgaccagggcgggaggaaguacauggaggacguuacucaaaucguuguggagcccgaaccgacggcugaagaaaagcccucgccgcggcggucgcugucucagccguugccuccgcggccgucgccggccgcccuucccggcggcgaagucucggggaaaggcccagcgguggcagcccgagaggcucgcgacccucucccggacgccggggccucgccggcaccuagccgcugcugccgccgccguuccuccguggccuuuuucgccgugugcgacgggcacggcgggcgggaggcggcacaguuugcccgggagcacuugugggguuucaucaagaagcagaaggguuucaccucguccgagccggcuaagguuugcgcugccauccgcaaaggcuuucucgcuugucaccuugccauguggaagaaacuggguaaguucccuggcuuguuuggcgcccgccccuuuuucaggcaguucagggcuuuuauggcaccagccccgcgugggcccccggcacccagagcgcaaccaaaguauacacugauggaagugacuaaaagcuguaauagcgcuuugcuggguggagguccgggcaaaccaagcggccuuggggaagauaggauugccgucucccugcagccuauucuugcuuuauuuccauccuccaaggaucaaugggaagcaguccacucccuucccugcuucacuuugguggcaaccagaggaaacguguuugaaaccuggcgccagauuuuggccaaaagauaaaucgauguugcaccugggccaggcgaaggaaaaacuguaguguuuccuuagagaaucugucauaauucugcuccugaaagucuuaucccucucgguugccuccuaccgguggugucaguucuccagauugacccgggauugcugggguugguugcuggaguaaagcguaagcuaauuuagaagggcugaaacguaaccauccggcaacuuaaaguuuuggaaggaauuccguuguaaugauggugagauguuuuuaggaucauaaaccuguacugcuuaugaaaacuaaaaacgcggaacguguuguuaccucuuaaaaacuggccccguguuaagggugugcguuagauucugcuuggguuuucuuuuuggaaauugccuuagcugauugcuuucagauaguucccaaccgguuguuccuaguuuaaaaaguacuuauaaauuguaacugcccaucaaaauaagaaaaggcaaggaauuacuguaugcuagaaggaaauaaaggucuuaaaugucuaaaaauuucgguguaguuguaguuucaucuaaguuuuuuuaaauguuuguaaagcaggcaggauuucugugcccaacauuuacagaaucaucuuacagcauuauaauugcuuaucuauugcagugaauaaauggcaugcaucuuuguuagagcaaagaagacaauacuuccaguggugggaaaaaaccuuguuuauggcagcauaauaacguugcuuuauuuucagcagagggauagagacauagagaaaagaguuagauuuagcaaauacagaacauuuuuagaaagguauugucauagaguuguagauuagccgguuucaaagucuguuuuccauuugcuuggcuuucugccaagaguuaguugauugacucaaaaaccagccacuaggcuuguuggaggcguuucccauccaucccaggggccccucuuuauggauuuauuuuguuuuuguguaggcaccguagagcugaaagcacuguaguguauuguagaaauaugugauaucauugacugcagggcaacgagaagucgacagcagcacaagagaggaagacuaggcacagaacuauuuagagugcuguuuauuuugcaguauacuuggaguaacaugaauuugccauauguuugaacuuuaaggauaaaaaaucuuuaagguauaaacuccguuacauuaguauuaaauuuuuuuuuuuuuaagagacgggcaggggcgggggacgggugugggccgccuuacuuuguugcccaggcugggcaacaagcgauccugggcucaagcgauccuuccuccucggccuccgaaagugcuggaauuacaggcgugagcuacccugccggaccuucaggaacauuuuuuaauaaagcaggggccaugcuguuaaauguaaauauguaugguuuaguuuuacauacacagacuuuucgaauuaagcugucacucuuaugaugcauaaaguuuagagccuuauacuccagaaaaauguuaaaguuuguuuuguaccacagcuagaccucagacuucguccucaaagcuugaaaaaaaaaaaaaaaaaaaaaguaugcuaauuauuuugggagucuugacaaaggaaacgaagguuuaaauuuuuuuuucaaucacaaauucuuggauggcuccacauuuucuguaaaguaaacuguaguuugcaaucugcaggccaaccccuuuccuguacauauucagccucuccaguaaauuauauuuguuacacgaauuuccauuacauuagucucuacucaccuuuuuucaggacacauggaaauacuccauuuccauuuucuuggauucugccucucucacccugcccccccaacaaggaaaacucaaacaaaaauauauccaucauguagauucccagucaguauguuuucuucugugaagacuacuuucuuuuggaauugagcacccuuuuuucuacuuuuguagugcucauuggauuguaguaauaguucucaaacuuuuugcucucagaacccuuuauaugcuuauugaggaccccagagaguuuuuaugugggcuacaucuuccaguauuuacuauaugagaaauuuaaacuuaggcaauuuaaaaauauuucuuuaaaaacaaacuuauauguuuauauauauauuuuaaagaaaaaacacuuuuuuccccaaauaagaaauaguggugggaggagugggguuguuuuacauuuugcaaaccucuuucaaugucuggcuuaauagaggacagcugaauggccgggcgcacgccuguaaucccagcacuuugggacacaaaggcaggcgaaucaccugaggucaggaguuugagaccagccuggccaacauggugaaaccuugucucuacuaaaaauacagaaauuagccgggugugguggugcaugccugugauccuaguuacucagaaggcuuaggcagagagaauugcuugaacccgcgaggcggagguugcagugagcugggauugggccacugcacuccagccugggcaacagagugagacuccgucucaaaaaaaaaaaagacagcugaauuaucauauccacuucugcacucaaucucuugcgcuauuugguugaaguaucuaaagaaauagcagccccacaugcauauguaguaggaaaaaggagaaauauuuuauuagucuuuucagauaauuguggauauucugcacuaaaaugguagcuauuuucccccccagagaaagguggaagaaaaguaguuucuuaaaguuugcugaauuggaauuugaaaccuuaguaaugaauuucauacuuaauacguuaagauccauuggucuauuuuguacuuugaacgaaucucauccaugugugauuuuugugacauagugcauuaguuauuuggaaaauaaugguucacucaguuaagaacguccucugaauagcaacacauuucauuauacaauaucaaagaaaaucauguuuguuaauaucacugaucucaucagaaaacucuuuaaauauugggaagcuaucuaguucacuguuguggauacacauuauccaaaauguauuuuucaagcaacaauuagaaauguaucauugagaacaaauacugucaguuuuucuugaagcgaaaagcucacuuuguucauguugaagauguacaccaaaugcccaagucuuauuaacacaguuuaucagucucucaaguaaagaugaugguccaugaaaaauguggcuaguucauuacaugacucagacaaucacaggugcuuuuccuguaguauguaacaaaagccuguuuauguagucuccuuuuugucauauagaauauuaaaaagauaugcagccugggcaacauggcaagacccuguugcuauacaaaauaaaaaauuagcuuggcaugguagcaugugcguguagucucugcuacuccagaggcugagauggagggauugcuugagccugggaggugggguuacagugaaccaugauggagccugugcacucagccugggcaacagaagaaaaaaguagguauucauggguugggauuuaauacaauuaauuuuuauugugucaucaaggauauucuuuuuuuaauuuuaguuuuuguuuuuugagacggagucucacuguauugcccaggcuggagugcuguggcacaauuucagcucacugcaaccuccuccucucagguucaagcgauucucgugccucagccuucugaguagcugggacuacaggcaugugccaucauacccagcuaauuuuuguauuuuuuuuagcagagaugggguuucgccauguuggccaggcuggucuugaacucuugaccucaagugauccaucugccucggccucccacaggcaugagccaccacuccuggccaggaauauucuuaagugaaacuagcuugcuuuuuuuggacuguaauuagguagcugugaagaaugcagugacuaauggcucaaucuggugccacugccuugacuccugccaagguaccaguaguuuaccagccauugcuuucuaccaucaguacaaaugucagcacagugaaaagggcaaauaaacucuuagaauuauuaugaaaauaguuuuggccuuguagaaucccuauaaagauuacacagaccacugggagaugcuagucugcuauaguaucugccugucagcuaaaucuugaggucuuuggggccagagauacugccuuacucaucuuuaauuguuuuaggauuggccacauaauaccuugcccaaaguagcugcucaacaacuaguugaguuuaguugaauuucuguugaguguaaguaaauaaauggacuuucuuccauuuuuuaauuaaaauuucuccuuuuaaaaaauugugcuaaaauacagauaacauaaaguuuauaccaggccaggcgugguggcucacgccuguaaucccagcaauuugggaggccaaggcgggcggaucacccaaggucaggaguuugagaucagccuggccaacauggugaaacucagucucuauuaaaaauacaaaaaaauuagccgcacguggugguguguaccuguaaucccagcuacuggggaggcugaggugggagaauugcuugaaccugggaggcagagguugcagugagcugagaucacgccauugcacuccagccugggagaagacgcgagacucugucucauaaauaaauaaauaaaauuuauaccauuuuagccauuuuuagguauauaauuuaguggcguuaaguguauucauaauguuguacaaccaucaccacuaucaguuuucaaaacuucaucagcccaaauagaaacucuguguccauuaaauaauaucucauuguuucccccuuucccaucucugguaaccuccccauucuacuuuguacugcuaugaauuugacuauuccaguacuccauuuaaguagaaaaguguucuuuugugucugacuuauuuuacuuagcaugucuuuagaguucauucauauuguaccaugagucagaauuucugcugaauaauaucccaucauauagauguaugcaugccacauuguguuuauccaguuuucuguugauggacauuuggguuguuuccacuuuuuggcuauugugacuaguacugcugugaacauugguguacaagcauuuguuugcaucccaguuuuucaauucuuuuggguaugaaccuauaaguggaauugcuggaucauaugguaauucuauguuuaacauuuuaaggacuugccaaacuguuuacacagcagcuguaccauuuuacauuccuaccagcaagguaugaaggcuucaauuuccccauauucuaacgcuuguuaacuuuuguauuaaaaaaaaaaauccugaugaauguggacugucuuacauuuuaaaauuauagcuuuucuauguuacugagcccuucuugaauuauuugguguuaagcuugaccucucuugucuuucuaaugauguguacgccucccaaauuuacaaaggaaaauuuuuuaaauggcuuauuuuugucuugagguagggagauuugguaaauacaguauggaaugaaagaguauauaaauauauucuuuuuuugugugugugacagggucuugcucuguuguccaggcuggaguguaauggcaugaucaaaggucccugcagccuugacuuccuuggcucaagggauccuccugccucagccucugaaguagcugagacuacaggcaugugccugcaaaguagcugagacuacaggcaugcgcccagcuaauuuuuuuuuuuaauuuuuuuuuuuuauagagacagggucuugccauguugcccagggugguuccuuacccuggguucaagaagucuucccagcuuggccucccaaaaugcuguuauuacaggcauaagccaccacauccaggccugaauauauucuuuauuaaaaggucauuauuuuucuuuuuucuuuauucaugaucauaaguuuuagguuaugccuaauuuauacucacauauauauguuuacugcccuuuuauuaugcuugccuucuaagaaauaaguuuuuuuguuuguuuuguuuuguuuuauuuuugagacggaguuuugcucuuguugcccaggcuggagugcaauggugcgaucucagcucacugcaaccuccaccucccggguucaagcgauucuccugccucagcuucccgaguaacugggauuacacgcaugugccaccacacucagcuaauuuuguauuuucaguagaaaagaagugagacucugucucugggguuucuccauguuggucaggcuggucuugaacucccgaccucaagugauccaccugccucaggcucccaaaguguugggauuacaggcgugagccaccgcaccuggcaaaaauaaguuuuaaaguuuguauaggcuuuuuuagguuuacuuauuggaaauaauguuuucauugucccuucuuuugauaguuuaaagaagauggugaaugaagugcagcuuuuagcucugugucauagucuuaucaauagagucaauagaaagaugacauucugcaaagggugaucucuggugugauuacagggaauuggccacaguauuuguaaaggaagaugaaauacaaaaguuucauuuguuaacuuggacugaagauuuagagcauucauuuuaaaagaguaugaccaaggaaaucgugaagaaguuaaucuuaacauaaauuguugguucuagauuuggcauuacuuuaauuuaaaauggaaagaaaccaaaguggggagagagaauugaauuuggagaaaccucuuaaacuauagaauuuuaaauguguaucuuguuuuauguugguuguucgcauuuuuucaucauaaaggaucuucaccuucucauaaauuauacguucugaaagaguugugugccauauuacuuaucaaguucaaauuuauuuuuucuauuuucauuaucagucauuacuuuugauccuuauuagguagucucuccagaauugauaucacuuagagaaauagaagcaauuuaaauucucauuaguuucuacauuaugcagguaaaacuagauuucuuugcaucuuuauauuaugaaauauucaaaaagauguaaaaugauuaaacaaacacccauccauaacucagcuuaaaaaauaaaacauuaccaggccgggcaugguggcucacgccuguaaucccagcacuuugggaggccgaggcaggcagaucaugaggucaagaaccugaugaaacccaguuuuuacuaaaaauacaaaaaauuagcugggugugguggcaugcgcugguagucccagcuacagugagcugagaucaacgacacugcacuccagccuggcaacagagcgagauucugucucaacaauaaauaaauaaauaaaauaauaaaacauuaccaguauaguuaagccccuucucucugugucauauuacaucuuuuucacuccccaugaggggcaacugcuucuauauucaguguuuaucauccucacuauuuuuuuuauaauuuuauuagguauaucuuuuuuuuuuuuugacacagagucucgcucugucgcccaggcuggagugcaguggcgcuaucuuggcucacugcaagcucugccuccuggguucacaccauucuccugccucagccucccgaguggcugggacuacaggcgcccgccaccacgcccggcuaauuuuuuguauuuuuaguagagacgggguuucaccguguuagccaggauggucucgaucuccugaccucgugaugugcccuccucggccucccaaagugcugggauuacaggcgugagccaccgcgcccggccuuuauuauguauaucuuuaaccaauauacaguacauuuuguauuuuguuuguuuguuuguuuuuuaagacagagucuugcuuaaucucccgggcuggagugcaauggcgugaucucggcucaccgcaaccuccgccuccuggauucaagcgauucuccuaccucagccuccccaguagcuggaauuacaggcgcgcacuaccacgcccagcuaauuuuuuguauuuuuaguagagaugggguuucaccauguuggccaggcuggucucgaacuccugaccucgugauccacccgccuuggccucccaaagugcuaggauuacaggugugagccaccgugcccagccugcaugguuuuuauaacuuauauaugacaucuuacuauauguaugcuauugucaucccuuauguguugguuucacuuucugcaguuuguuaacuuuguucaauguugaaauauuaaauauaaaauucuagaaauaaacaauuuguaaguuuaacuugugugcuguugggaguagcaugaugaaaucuugucucgucccacugugucagcccuggauguuaaucauuucuuugcccagcauaucuacgcuguauaugcuaccuaccuguuagucacuuaguagcuuguuagucacuuaguagccaucuugggugugguuaucggaucaacucuuaugguauugcaguguuuauguucaagugacucuuauuuuacuuaauaauggacccaaagagcaagaguaguaaugcuggcauauuguuauacuuguuuuauuuuauuaauguuguuaauuucuuacugugccuaauuuauaaauuacauuuuaucauagauacguauguauaggagccaagcacgguggcucacgccuguaaucccagcccuuugggaggcagaggugggcggaucaugaggucaggagaucaagaccauccuggccaacauggugaaacccugucucuacuaaaauacaaaaaacuagccgggcaugguggugcgcaccuguagucgcagcuacucaggcggcugaggcaggggaauugcuugaaccugggagguggagauugcagugagccgagaucgugccacugcacuccaaccuagcaauagagugagacugucucaaaaaaaaaaaaaaaaaagauauguauguacguauaggaaaaaacauaguguauauaggauuugguacuauccaaaguuucaggcauccuuuggggguuuuggaacauaugccccugcgauaaggggguacuacucuauucuucugggucuuacuuuuuugguucaguauuguaugauuucuucauguugacacacguagcucuaguucguucauuuucacuuauggauaguauaaauauaccaauauugugcucauccauuguauccuugaaggauauuuaguuuuacaacuauuuauaauuaaaaacaaugauguuuggaauauuuccguacaugucuuugguuguucuucaaauaucugagggguucucugagagcccagguuuggcaaaguaaagccuacaggccgcauugggcuaccaccaauuuuuguagauaaaauuuuuuuuauuggagcacugccaagaucauuuguuuauacaaugucuguaacugcuuucacacuucaacagcagaguugaauaguugugacagauaccauauguuuugcaaagccaaaaguauuuucuggucuuucauagaaaagguuugcugacccugcucuaguguacuaggggaacaauugcugggucaugagguaugauaucuuggaccucacuagauauugccaaauugcuuuccaagguguuuauaccuguuuauuccccugaagaaguguaggagaguaucauucuuucaccuucuugccaauacuugaaguggucugcauuuuaugguggugaaauuauaucuuauugugguuuuaauucucauuucccugauuccucauaagauugaguacauuauuauuuuugagacggagucucgcucuguugcccuguugcccaggcuggagugcagugccucgaucucagcucauugcaaccucugccucccagguucaugcgauccuccugccucagccucccaaaguagcugggauuacaagcaugcaccaccaccccagcuaauuuuucuauuuuuaguagaguuaggguuucaccauguuggcuaggcuagucuugaacuccugaccucaagugaucugcacgccuuggccuccuaaagugcugacauuauagguguaagccaccaugccuggccauguuuucuuuuuaugaaauaccuuuuaauuuuuuugcccauguuaacacugaauuguuuucuugcugauuuguagaaauucuuuauguauuuugugggguuuuuuuguuuuguuggguuuuuuuuugagacagggucuugcucugucacccaggcuggagugcagcggcacgaucuuggcucugccuccuaguuucaagcaauccuccugccucagccacuugaguagcugggauuacaggcaugugcuacaaugccugacuaauuuuuguguuuuuuguagaaaugggguuucaccauguuugccaagcuggucucaaacuccuggccucaagugauccaccugccucggccucccaaagcgcugggauuguaggugugagcugccacgccuggcccaaaauucuuuauguauuuuggauacuaauucuuuguuacagaguuagcagguaucuuccaguuuuuaguuugucucuucacuucgugauguuuauuaaugaacagaagauguuaaacuuauguaauuuuauuaaucauuuucuugauaucucauguuuuuaaagaugcuauuguguucucuucuaagagguauacagcucugcuuucacaauuaaguccuccuaucauuuuuguuuuuguccuuuaccuaugugcuguccaauugacuggaguacacauguagccacugacuacauguagucaguggcuacauguggguauuuaaaaaaagaaaacagauuuauagagguauaauugacauacaauaaaugguacacauuuaaaguauacucugauaauuuuugacauaugcgcaugucaagccaucaucacauucaaagcaauaaacaucuaucacgcccaaaaguuuccuugugaccauuugcaauuaucccacauucuccaaucuccauuucuagguaaccacugagccgcuuucugucuuguagauuauuuuuucuauaauuuuauauacagucauauguugcuuaacaacagggauauguucugagaaaugugucuuaggugauuuuguguuggugugcgaauaucagaguguacugacacaaaccuagaugguauagccuacugcacaccuagauuguauauagcguguugcuccuaggcuacaaaccuguaugcaggugguaugguaucauuguuaacuuccugauuuugaugggaucguaguuauguaggagacuguccuuguguguaggaauuaaauacuauaaauauuuaaaauugaugggauuuggugguuuacacacuauugcuucaagaaaaagaaaauagaauuauucuugcaaaaaaggaaagguaaagcugaagauauaaaaagaucagaaacccggauacuuuuaggaaucuagguagcaguuucaucagggucuugcugcuggauguguaccagauaacagucuguuuuuuuuuucaaugacgagaauaaauaagaaacagcagcauuuggagucaccauuugguuaugauaauucacugucauuuuccaagagcuaucagacuuuugcaguggucaaacuauguaauaggaauagaugggauuuaccaccccuucuucuuucauguuuuagugguggcaggaaucuuuguuauucuuugaaggaugcgacagugcuuuuaaauuauuaguuuggaguagagucucauuguugaggugcuccaaagucuugcacuuggccuuuucuaccauaauaggcuuccuaaccuaucaguuaagagcuuucaggagaagcuauuaguuuuuguccagcuaguugauauuccauucagucuguggaauuggggaauuguguacuauguaauacuaaauaguauuacugcuuaaauaaacccuuuaaauaagggcuaaagugaaagcaguguagccuuuuuuuuuucauuuggacuauuucuucagaaaaaaaauucucaaaacugaauuauuugcuuaaacaauguauaccuuuugaugguugccaauaaguauuuucaaauugcuucccugaaggcuuuacaucuccauacuacuuuggaauuggaauucuguaagaacucuuaagugauugagaguaugugcccuagaguuguacugccuagguucgaauuccagcuucuccacuuacugagaguugacagcgugcuggcagcccucgcuggcucucagcgccuccucagccuuggcgccuacucuggcugcgcuugaggagcccuucagcccgccacugcacugugggagccccucccugggcuggccgaggccggagccggcucccucagcuuguggggagguguggagggagaggcgcgggugggaacuggggcugcgugcugcacuugugggccagcgcgaguuccaggugggcaugggcuccgcaggcccugcacucggagcggccagcuggcgcugcuggccgcaggcagugaggggcuuagcacccgggccacuagcugcagagggugcgccgggucccccagcagugcuggcccaccggcgcugcgcuggauuucucgccgggccuuagcugacuccccaugaggcagggcuugggaccugcagccugccauaccugaggccccccccccgccacccccccgccucacacagcccaagccuccccgaugagcaccacccccugcuccacggugcccggucccgucgacugcccaagggcugaggagugcgggcccaagggcugaggagugugggcgcaaggcccgggacuggcaggcagcuccaccugcggccccggugcgggauccacugcaaagccagcugggcuccugagucuaguggggacuuggagaaccuuuaugucuagcuaagggauuguaaauacaccaaucagcacuccguaucuagcucgagguuuguaaacacgccagucagcacccugugucuagcucaggguuuguggaugcaacaaucagcacucuguaucuagcuaaucugguggggacuuggagaaucuuuaugucuagccaagguauuguaaauauaccagucagcacucugugucuagcucaagguuuguaaaugcaccaaucagugcucugugucuggcuaaucuaguggggacuuggagaacuuuugugucuaucucagggauuguaaaugcaccaaucagcacccugucaaaacggaccaaucaguucucuguaaaacagacuaaucagcucucuguaaaauggaccaaucagcaggauguggguggugccagauaagggaauaaaagcaggcucagccaacauuggcaacacggugggguggcuuccacaccguggaagcuuaguucuuuugcccuuugcaauaaaucuugcugcugcucacuggguccacacugucuuuaugagcuguaacacucacugcgaaggucugcagcuucacuccugaagccagggagaccaccaacccaccagaaggaacgaacaacuccagacgcgcagcauuaaaagcuguaacacucaccgggaaagucugcagcuucauuccugaagccagcgagaccacgaacccaccagaaggaagaaacuccgaacacauccgaacaucagaaggaacaaauucuggacacacugccuuuaagaacuguaacacucguggcaagggucugcgguuucauucuugaagucagugagaccaagaacccaccaauucuggacacauuacuaccuuuguaaccuucaguaaaacuauuugcaccaggguauccuuaccuauaaaauagagauguuauaacaauuuauugguuuuugccuuuaugacaugcauauuuucuugcuuaagaaaauuuuccuuaggcugggugugguggcucacaccucuaaucccaacacuuugggaggcugaggugggcagauugcucgagcccaggaauucaagaccagccugggcaacauaguggaacccccucuguacaaaaaauacaaaaauuagcugggcgugguggcgugcaccuguagccagcccaggcaaacccagcugcuugggaggcccaggugggaggaucgcuugagccgaggaggcagagguuguggugagccaagaucaugccacugcauugcagcccgggugacagagugagacucugucugaggaaaaaaugaaaagaauacuuaagugagaguuaguauacuagauggugcugucuuuuaaugcacuucucguuuuaugucauuaaaaaaauuaaaauauaaaguaggaaauaaauacuauaguuaaggaagacaacauaaaaauaccaguugcuuaauauauaaauuuagugcaguuucaaucagaaucucaagaagguuuuuuaauuuugcaaguugcuacuaaaguuccuuuggaaaaguaugugggagaauuuucuuuuuacuuuuuuuuuuuuuuuuuuggguagagauagggucuuacuauguugcacagacuggucuugaacuccugggcugaagcuauccccuccugccuuggccugccaaagugcugggauuacagauguaagccaccgcgccugcaccucccucccccuuuuuuaagcgacaggaucucuguguuguccaggcuggaguauaguagcuauucacggguucaaucacagugcacuauagcuucuaacuccugggcucaagcauccuccugccucagccucacaaguagcugggacugcaggcaugagugacugcacccagcuauguaagauuaauuuuuuuguuuuuguuuuuuuuggaggcagagucuugcugucacccaggcugaagugcaauggcaugaucucggcucacugcagcuucugccucccaagcucaagugauucuugagccucagccuccuguaacugggguuaugggugugguggcacacaacuguaaucccagcuacucuggaagcugaggcacaagaauugcuuuaaccuggguggcggagguugcagugagcugagauugagccacuguacuguagccugggcgacagagcaaggcucugucucaaaaaaaaaaaaaaaggaaaacuaaaaagaaaagaaaaaggccagguucaguggcucaugccuguaaucccagcacuuugggaggccgaggcggcagauuacugaaggucaagaguucgagaccagccuggcgaacauggugaaaucccgucucuacuaaaaauacaaaaauauuagccuggugugguggcacauaccuauaaucccagcuacucgggaggcugagacaggagaaucucuugaacccaggaggcagagguugcagugagccaagaucacgccucugcacuccggccugggugacagagugagacugucucaaaaaaagaaaaagaauugagggauacuuaaacuaccaauuauuaaaaaguacuauaaauagauuaguaggaugaguuuagaaauagaucuaaggcaaaauguagcauauaauaaaggugacauuucagaugaauagggaaaguaugaauuagucauuuuuaggucauugcaaaauaucucuuuguucauguuaggcuuuugaccaaaagugugauuuaaauaauauugcaucuaaggauauuuauuuuuagcucguuuuuucacuugccauuuuguuuuaggugauuuuugugaauggcugaauuauuuguauacuguagguaaauuuuguuuuguuuucuuucuuuuacucuuuaggagacugagucuugcucugucgcccaggcuggagugcaguggcacgauuauagcucacugcagccuugaacuccugagcucaagugauccuccugccuccuccucugaagaaguuagaacuaacagaugcaugccacuaaaccugguuaauuaaaaaaaaaaauuuuuuuuuuuuuuuuguagagacagaauguggcuguguuccccaagcuggucuccuggccucaagugguccuccugccuuggccucccaaagcacugugaauguaggcaugagccacuguacccugccaaauuuuguguuuugaaugugcuguagaacuucugagaguucgccucauuuauucauucacauuuauuguaguagaaguuuuuuuuuuguuuguuuguuuuuuaauuuacuucaguuuguuuaaaaagaaagaggauagccaggcacaguagcacaugcuuauagucccagcugcuugggaggcugaggcaggaggauugccugagcccaggaggucaagguuguaguaugugaugaucacaccugugaauuagccugcacuccagccugggcaacauauugagacccuguuguuaaaaaaaaaaaaaaauagaagaaaggguuuuaucaaaagcuaguaaacaccccaaauaauugaaagggcugaagaaacauacaguauacucuaggcugagcuuccaugaaauaacuucugcaaccagauugcaaacuggaugggcuaugaagcuguccuugcugugauuucugccggcaaaauugauaccuuuucucugcuuuuuuuuuauuuuaaauauugcaaaauaagcauauguauagaaaaggucauaaaacauaaauguacacuucaaugaauaauuauaaacugaacaccauccaguuaggaaagaacauugucugcacugcagauaucuguauguccuuucugauuucauauuucuaucucccccuaaaaaacuaccuuccugacuuucaucaugagaguucuguaaugguuuacuuguuuuucuuaauaguuucaccacuuuucucuaaacaugaugguuguuuuugaagaaagucaugcucuauguguucuuuuaucaugugcugcuugugagauucuugugugcuuuauguaguauuguccauuuucauguugaacaacuugggcuguugcccauuuguagcccuuauuauuguuuuagagacagggucuugcuguauuucccaggcuguaaacuccugggcucaagcgaucccccugccucacagccuccugagcagcugguacuacaggcacauacuaccaugguugacucauguauuuguuguguauguauguuaauuugugguauauaccuaggagguagucaaagaguauacauaucuuuaccuuuaauaaguaaugccuaaauguuaccugcaauguaccaguuuacacuuucacaguaguugaugauaguacauguugcuccauuuucuugaccacaguucgguugcuauugucgaacuuuaauuugugcggucuuguaguuaugcagcacuaucucauugugguuuuaaauuaguauuucucugauaauuaaagaagcugaauaccuuugcauauuuuguggcuguuuggauuuccuauuuuguaaaaggcuuguuuaagcuuuuuguccauucucccauuuggguagucugucucauugauuugauuuguaggaaaauuuuauauauucuggaugcuuuuccuuuggcgcguagguguguguauucuguucucuguguuguuuuuauucuaauaaugguaucuucugaagaauagauuuuuuuaguugcuuuuaaaaaagaugugcaaugugauagaugauuuuauguauguauacauugugaaaugauuaccacagucaaguuaauuaacacauccaucaccucacauaguuaccuuuuuuugguggugagaacacucaagauuuauuuucagcaaauuucaaguauacaaaacaguauuauuaacuauacucucuguguuguacauuagauacuaagaacuuacucauaaugggaaguuugugcuguuugaccaacaucuccccacuucuccuaaccccuaaucccuggcaaccguccuucuacucuuuccuucugugacuuuuucuuuagauuccacguauaaguaagaucacacaguauuuguuuuuucuguguuuggcauauuucacuuagcauaauguccuacagguucauccuuguguugcacauggcaggauuuccuuuuuuuuuuuuuauggcugaacgauauuccauuguguauacauacauuuucuuuauuuauuuaucucuugcuggauacuuagauuguuuucauaucuuggauguuuugaauaauucugcagggaguguugagguacauguaucucucugagagacugauuucauuuucuuuggauauacauucagaggugcaauuccugagucauaugguacuucuauuuuuagauauauuuuuaauucuauaauauuuuccauaauagcuaugccaauuuacauuucuaucagcaguguacaaauguucucccuucuucacauccuggccagcacuuguuuacuguuaucuuuuugauaauagccauccuaauaggugugagguuaucucucucuuuauuuuuuuaauuuuuuuuuagaugggucuucucgcucuguugcucaggcuggagugcaguggugugaucacuguagccccagacuccuuggcucaauggaaccuucugucucagccuccugaguagcuaggacuacagaugugugcuaccaugcccggcuaauuuuuaaauuuuuaguggagaugggucucguuauguugucuaugcuggugauaaauuccuggccucaagcgaucuuccugucucauuuuguuuuugauuugaauuuccgucaugaugcuugauguugagcuucuguucauauacuuguugcccauuuguaugacuucuuugacaaaugucuauucaggucauuugcccaguuuuuuuuuguuuuuguuuguuuuguuuuguuuuguuuuguuuuguuuugagacagagucucgcccugucgcccaggcuggagugcaguggcaugaucucggcccacuguaaacuccacccccuggguucaaacuauucuccugucucagccuccccaguggcuaggauuacaggcgccugccaccaugccuggcuaauuucuguauuuuucguagagacgggguuucaccguguuagccaggcugguauugaacuccugaccuccugauccacccacuucggccucccagagugcugggaauacaggcaugagccaccgcgcccggccugcccaguuuuuaacuguguuuuuguuuguuuguuuguuuugcuauugaguuguaugauuuccuuauauauuuuggauauuaauaucuuaccacauaguguaaaguuuguaaauauuuucuccugaaaguugccuuuucauuuuguugaugguuuccuuucccgugcagaagccuuuuaguuugauguagcccaacuguuuuuuucugcuuuuguugcuguuuuuuuuguuuguuuguuuguuuuuuugagacagagucucgcuguacuacacaggcuggagugcaguggcgugaucucagcucgcugcaaucucugccuccugagguuaggaucccuccugagcugggauuacaggugugcgcuaccaugccuggcuaauuuuuguauuuuuaguagagacaggcuuucaccauguuggucaggcuggucuagaacuccugaccucaugguccacccacuuuggcuuuccaaagugcugggauuacaggcaugagccacugcacccagccuguugccauuucuuuugguggucauauuaaaaaaguaauugccaagaccaacgucgagauuuuuccuuauguuuuuuuucuaggaguuuugugcuuuuuguuuuucuuuucuuuucuuucuuucuuuuuuuuugaggcagauucucgcucuguugcccaggcuggagugcagcggcacgaucuuggcucacugcaaccuccaccuccaagguucaagcgauuugccugccucagcugccugaguagcugggauuacaggcgcacaccaccacaucuggcuaauuuuuauauuuucaguagagaugggguuucaucauguuggccagguuggucucgaacuccugaccucagguaauccacccaccuuggccucccaaagugcugggauuacaugugugagccaccgcauccggccugaguuaugcuuucaauguauuucuuacauuucaguuuuuaaucacuuuccaguuaauuuuuguguaugguauaagacaaggguacaauuucauucuuuugcauguggauauccagguuuuccagugccauuuauugaagacuaucccuaccucagaguuuuguuuguuuguuuguuuguuuguuguuuugagacaggaucucacucuguuggccaggcuggagugcaguggcaccaucuccacucacugcagccuccaccuccuggguucaagugauucucccaccucagccuccugaguagcugggacuacaggcacacaugccuggcuauuuuuuguauuuuuuuuuuuuuuuuuuuuugagacggagucucgcucugucgcccaggccagacugcggacugcaguggcgcaaucucggcucacugcaagcuccgccucccggguucacgccauucucuugccucagccuccagaguagcugggacuacgggcaccugccaccacgcccagcuaauuuuuuguauuuuuaguagaaacgggguuucaccauagucaggauggucucgaucuccugaccucgugauccgcccacuuuggccuccuaaagugcugagauuauaggcgugagccaccacucccagcguguuaagaguuaucucaaaaaaaaaaaaaaauuaucggccaggcgugguggcucacgccuguaaucccaacacuuugggaggccaaggcgggcagaucacgaggucaggagaucgagaccauccuggcuaacacagugaaaccccgucucuacuaaaaaaauacaaaaaaauuaguugggugugguggcaggcgccuguagucccagcuauuugggaggcugaggcagaagaauggcgugaaccugggaggcggagcuugcagugagccgagaucaugccacugcucuccagccuggacgacagagcgagacucugucucaaaaaaaaaaaaaaggaacacucauuuacugucuuuauuacugauuuuucuuuuugcuuauguuggauuacaagucugcauuuuuauuuuuuuucuuaacauaauucuauuccuuuaaacuuccaggaauucuucaucuuugccuaugaccuuucugugugugucuauauguuguggauuuauuucuaacauuuacauucuguccuuucagugggauuuugguggggagaauaugucauuguuuggacucauuuugccaucaugaacuauaaguugcaguuuguuuaguguuacauaauacuucagaauuguugaaugacagugaauuuaauuaaacaguauaggguuuguaauuuaauauacagggauucugccccuaaauauuugaguuaucugaagcagguuucuuaauuauucaaaguauugauauccuuaucugcaaaaugaggaauaaguaaauaaauaaagggaauaaucauaucugucucauaaguucgucacaagcauuauuugagauaauacauguaaagcucuuaguauagaacuugguauacagugaauauacucaguaaauguaauuuguuaaguagugacuauucaaaauaguuauuucaaaaacaaaucaagccgagugcgguggcucaugcccaugaucccagcacuuugggaggccgaagcggguggaucacccaaggucaggaguuugagaccagccugaccaacauggcgaaaccccaucucuacuaaaaauacaaaaauuagcuggggaugguggcaggcgccuguaauaccagcuacucgagaggcugagucaggagaaucacuugaacccaggaggcagagguugcacuccagccugggugacagaguaagacucaaucuaaaaaacaacaaaacagaaaaacaaguagcuuuuucagaaagccuuuuagaagagauaugaguaaacagaugcuaaguggcuggcuaaaugauaccacaacucuugaaucaaaacugauucagauuaaaaaaaccucuuaacacauucuuuccuaucaauguaguuaggacuaagagucauguagcaguaguaaaccuguccuguaauauauuucucuuaggauugguuugauaguuguaucauaauugcauuauuuauaacauuaauuuauuaauguauucauuaauuaaccuaaguccuuuaguaguuuucagaauauuuuucuuaaauuguuuccugugcuaauucgaauguuaacaugcuaauucagaguuuguugccauuuguauccugacaguguauuaauguuuauacuugcaagagugaaauauuuuauuucuuauuacagcggaauggccaaagacuaugacgggucuuccuagcacaucagggacaacugccaguguggucaucauucggggcaugaagauguauguagcucacguaggugacucaggggugguucuuggaauucaggaugacccgaaggaugacuuugucagagcuguggaggugacacaggaccauaagccagaacuucccaaggaaagagaacgaaucgaaggacuuggugggagguaacauucugucguuuucucuuuccucuuuugguucuauuuaguccuuuuaugcuuuacuaaugaaauugaccuacuacugucccuuuuacugaaguuacuuucuuaguauuacagguuuuuuaguuugucugauguaauacucauguauguauguucauauuuuucucauuacuaugaauugacuuuuauuucugauaaugacucuaauaggaaauaauauuucagugagccccaaggaaacaauucaagguuuuacugaaaaccuuucagaugacuuucagaaucuagacggagcagcucuuggaguuccagaguagaacacuuugaaucuggcugggggaaaaagauuaaguuagaauuaaccuucagcuuuuuucauugauuucagauuuacugcaaaccuuuccaguuauuguuuucuuuguuugaacuuagcguuucaauguguaaguaauuuguaaacuaggaacugaaauugauuucaauuuuauauuuuuaugauucaaacuuaaaugaaagauuauucuaaaaaucaagagagugaauaacaugaaaaaauuuaaaaauuaucucaauacuaauuuuuaaaaauugaggauaugaggcaaguugaguagaauccaauguuuucuaaauaauccuucuaacuaaagccuucccaugauaucguuacuugccucuuuuuugcuuuuauuaaaucaaaauuggucuuuugcagagaaacgacaaacuaaggaaaauaauuagcaucuggcugggcacuguggcucacaccuguaaucccagcacuuugggaggcugaggcgggcacaucaccugaggucgggaguucgagaccagccugaccaacauggagaaaccccgucgcuacuaaaaauacaaaauuagcugagugugguggcacaugccuguaaucccagcuacuccggaggcugaggcaagagaaucacuugaaccugggaggcagagguuguggugagcugagauugcaccauugcacuccagccugggcaacaagagcaaaacaccaucucaaaaaagaaaaaagaauuagcauccuuaaacuauaaggaguucaacaaauuaauaaaguacuaaagugugaggcugggcgcaguggcucacgucuguaauccuagcacuuugggagaccgaggcggguggauugucugagcucaggaguucgagaccagcuuggggaacauggugaaaccccaucucugcuaaaauacaaaagaaauuagccgggcguggcagcgugcaacuguagucccaacuauucgggaggcugaggcaggagaauugcuugaacccaggaggcagagguugcagugagcugagauugcgccacugcacuccagccugggcgacagagcgagacuccaucucuuaaaaaaauaaaaauaaaauaaaauaaaguacuaaggugcauggcaaccccgguuagguggauaaaggagagaaaguuugaacaacaaaaaaaugcaaaacaguaguaaacauuuggugaaauaaaaguaaaacauuaagaugaaacuucauuuccuguuauuagauuaggaaagauaaagagauuccucucaauauuuuuauugaaaugguuaccuucuugguaagauuacaaauugguacuaccuauauagaaaauaauauauaccaguagcuuuaaauguuuagggaaucuaaagaagaaaucugaacuguggacaaaaauaucugaauagaguuacugauugcagcauuuguaaugacuguuaaaggccagaaguaacuugaaggccuaacagcuggauaaugguuaaguauauuuagcaacauauucauaaugcugaauaugauacagccauuaaaaauaacauuuauagauaaguuuauaaaacucaugguguuuugaaauuuuuccaaguaaagguagaguaauaugaacucccauguauauggggaagguuuaaugauagaggaaaauguuuauggucacaaaaaagcaggauauaaaauuauauuucugguguuagcaaugcagagacaugggaauaagauggaaauauucuaaauuuuuauaaaugagugaugagauuuuaugccauacguuuauuuuuauuuuuuuaauggcgacauucauuugguucaaauucagguagcauaaaaaagaggauaugcuauggaaggucucucagcugcuacugucccaaaggccaccucguuccccuccacuugcuaagcaaccaguauggcuguguguccuuucaaaagagagauauucauauacaaucaaauauauuauggagcuguaccauguacagauguaccgucauuuauuuuaaucagucuccuauugaaggauuuuuauuucuaauuuuuuuuuguuauugcaaacugcugugaaaugaaaaaucugcacauauguguuuuugugcacuugccaguauauuuguaggaucauuuccuaaaaguggaauugcuuggccaaagagguguauguuuugaauauugauaacuauuugucucuauaaagguuguaccaauuuacacuucuaccaucaguguauguggauguccuggacaacaaauaaaacuuuuugaucauauccaguuucagguuuaaaaaagaggugucucaaugauguguuuuuuugggguuuuuuuuguuuuuuuuuuuugaaacggagucuggcucuuucgcccaggcuggagugcaguggcgcgaucucggcucacugcaagcucggccuccuggguucaugccauucuccugccugagccucucuaguagcugggacuacaggcgccugccaccacgcccggcuaauuuuuuguauuuuuaguagagaugggguuucaccauguuagccaggauggucuugaucuccugaccucaugauccacccaccucagccucccaaagugcugggauuacaggcgugagccacugcacccggcaaugauguuguuuuaaaaaaaaauuuuaagaaauagaaaugaggucuuaccauguugcccaggcuggucuugaacuccuaggcucaagcgauccucccaccuuguccucccaaauuguugggauuacagaugugagccacgugcccagcuucaguaauguuuuaauuugaauuuaucuuaugagaaauauugaaucuuuuuauauauuuaagagccauuuauauuuucuuuucucuguauuucuuuuaauauuuauuauucauuuugggggauuguuguuagccauuuuuuucccacauuaauguguaggggcuagcuguacauuaaagaaauuagucugauguaugugaugugaauuuuagauauuguuuccacaguuugucuuuugauuaugcuccuggaacuuuuuccacguggaaguuucuuuuaauguaguuaaauuuauuagucucuucuguuacaacuuuuuggguuuuaugccacacacacagugaagcuuuuuaauaaagucugcuauauuuucuuuuaguacaacaggaauauuuuuggucuuagaaacucuguuuguucauuguauuuguuuuugacaugaucucacucuguugcccaggcugcagugcaguagcacaaucauggcucacugcaaccucaaaugaucuucccauguuagucucuugagagcugggacuacaggugcacgugugccaacaugccagcuaauuuucuuuuucuuucuuuuuuuuuuuugagacagagucuugcccuguuacccaggcuggagugcaguggcgggaucugggcucacugcaaccucugccucccagguucaagcgauucuccugccucagccuccugaguagcugggauuacaggugcccgccaccaugcccagcuaauuuuuguauuuuuaguagaaacgggguuucaccguuuuggucaggcuggucuugaacuccugaccuugugauccgcccaccucugccucccaaagugcugggauuacaggugugagccaauucgccugaccaggaaggaguauuuugcucacuuuuccauaaauguuugucuuugauacuguuucaaaacucaagaaaugauaguuucuuaagguaucugaaacuuuauuaaugaacuuugcauauucuuacauuaacagccauuagucagucaaugaagacauuaguugaauagaaauuuuuuuuuuuuuuugagacuugaguuuugcucuuauugcccaggcuggagugcaguggcacgaucucgucucaccgcaaccucugcuuccuggguucucagccuccggaguagcugggauuagaggcauguaccaccacacccagcuaauuuuguauuuuuaguagagacgggguuucacgaacucccgaccucaggcgauccaccugccuuggccucccaaagugcuggcauuucaggugugagccacugcucccggcccugaauugaaugcuuuuuaaaaaucccugcauaauuuaaaaaaauuaaugacuuuaauuuuaagaguacuuuuagauucacagcaaaauuaagugggaagcacagaauucucauauauacuuuggccuaccccccgucucccaggcuuccccacuauccuucuccagaguguuuguuauaaucaaucagugaaccuacacugacauacuguuaucaccugguguccauaguuuacauuaggguucacuccggguguuauacauuuuauggguuuugacaaauacgucaugacacguauccaucauuauaguaucaugcagauuaguuucaucaccguaagaguccucuguacuuugucuguucaucccucccccacuuacuccuggcaaccacugcucuuuuuacugccuucauaauuuugcuuuuuccagaaugucauauaguuggaaccauauaguauguagccccuaugcaugacuuuuuaauauaugcauuuauuguuuguaauauacuaggucacugaguuauacagaucuugcaaauauugacacuuuuuauuauacuauauaauauccagucaugcagccucucaaaaaacuccacuguauacauguggucuuaguaguauuaugaaaaaaaaaaauggaccuuggagacacccugaaaaagucuguaguaaccugccaggggccccuaaaccacauuuugagaaccacuuugccaguacucguaugguuucaucaucuuuuauauuuuaaucuuuaauccuucuggaauuuuaagaucuaagcuauguaguaaauaggcaaguuaacuuuuuuucuagauggcuacuaguagccacuugaauaauuauacaucuuuucauuacugaguagcagggugaccaggcuuaagacccuucuuuagugggaagaugaccuugaauuuacccucuucuuguauuucucuggugaagauaaaugugaaauaucaccucuguuguaagacagcauugcuuauuguagaaugaucccugaauggaauugcaucuugguagggaaguuguugaauggacuguacauuucuauucggaagcacaggccuuggcuuccuuguaugcaugcaguuugucuuguguagggaccaagaaacuguagucaugugcuauuuauuacauugguuucugugacacaugaagcuuaccuaagcuagacccugucgucuugcuuacaacugagccaucacuugggagauggaaaaauggcuucuggcugucugaaucacugcugaagacaauauccuugaagcugcuaugguggcauacucuauuuccugcccaguauucugcaaaguuagaugaaccuccuuucaggcuauagucuauuugaucuugugauugugaaggugagaauauaucugacaucucugcugguugucaugcuaagugggcuuugcaaauuauaaacagaauucuuccauauauuugggucuuuucugggcuauaauuuuuuuccugcuuauuuaccaguauuauaauuuuuaaaacggagacuuuauuauaauuuuaaauauugguaggccugauuccuucucauuaaucuuccuuuuaaaaaauacuuuucuuggggccgggcacaguggcuuacgcuuauaaucccagcacuuugggagccugaggcgggcggaucaccggaggucaggaguucgagacaagccgggccaacauggcgaaacccuaucucuacuaaaaauacaaaaauauuauccaggcguaguggcauguucccguaaucccagcuacucgggaggcugagggaggagaaucucuugaaccugggaggcagagguugcagugagccaagauccugccucugcacuccagccugcccaacaagagugaaaacugucucaaaaaaaauaaaauaaaauaaagcagcuggcugcggcacuuguaauccuagcgcuuuggaggccaagaugggaggaucacuugagguuagaaguuugagaccaaccuguucaacauagcgggaccuccaucucuaaaaaauuuuuuuauaauuauaaauaaauaaaauaaaugaacaaaaaaggaaauaauuauuuucuacagaagaaauuacccuuuuguguuuuaaaaauaccuuucuugacuauucuuucuuguuuguuuuuuuacuugaauuuuaaaauuauauuuuauuugauuuuaauaauguuuuuagaaagaguuuuuuggcuuuauuaccaaaaacaccaucuggacaguugggcagauacuccgcuauuuuggagcagguaacuuuuugcaaaaauugagcuauuuuauuauaaguuauuuccuugcuucccucugucccggccuaggcaacgggccagcauuuuguuuuuccagccuucuguugcugcucagucagcucucugcgugucaggcuguuccuuuuuacaugccuuuuaaucauauaggacaacaacaggaagugcaguaaaagcaucuuuuauaacauugcuuugguuuuuuguuacuagauguugaaacuucuauguuuuaaccaguaucauuauuugucuuuuuguuucucagaaacacagaucauaauaucuuugaauauuaagugucgagagagcugcucgucuaguuauguuggaagcagcuacuguaaauuacuuagguacuaagccuuaccuuguaaggagaagguuuagcaaagaauaauagagcuuuaagaugguauuaaggcagaauguuggcaucuuauaacucuuguguuucauggauucuugugaauggcaaguuuagucuuuacucugcuguugacuuuugagagucaucauugaagaaagcuuaauacaacaaaaugaaugccuuugauauuuuaacucuuguuaugaucaaccuauuuauaucagaacuuauuuaaacuaguucuuggcugggcaugguggcucacgccuguaaucccagcauguugggaggcccggaugggaggauggcuugagcccaggaguuuaagaccagccuggcaaacauagugagaucuguucucuacaaaaaaauuacaugccuuuggucccagcuauuugggaagcugaggugggagcaucacuugagccugggaagucaaagcuguggugagccacgaucacaccacugcacugcagccugggcaacagaacgacacccugucucaaaaccaaaugaaaacuaguucucaaaagggaugguaggcugggcauggugacucaugccuguaagacuagcacuuugggaggcugaggcaggcagauuacuugaggccaggaguucgagaccagccuggcuaauaugguuaaaccccgucucuacuaaaaauaaaaaaauuagccgggcauuguggcgggugccuguaauccuagcuacucaggaggcugaggcugcagugaguuaagaucacaccacugcacuccagccuagguaacagagcgagacugucuccaaaaaaaaaaggguggggggauggugaaugagcaacuuucuggaauuucucuucuuuguuaacacccacaauguuuucuggucauucucuacuuguuucagucuuccucuggacuguucaguauacucaccacuagccacaaauggcuguuuaaauuaauaaaaauuaaauuuaaaaaaucaauucccauuugaaguaaagcucauuucggucaugccaggcauaguuugagagaccaucucuaauguuuugauuaucaguguuuuuuccuaaagaacuaaucauauuucaggccgggcgcgguggcucacgccuguaaucccagcacuuugggaggccgagguggguggaucacgaggucaggagaucgagaccauccuggcuaaccuggugaaaccccgugucuacuaaaaauacaaaaaauuagccaggcaugguggcaggugccuguagucccagcuacucauagucccagcuacucgggaggcugaggcaggagaauggcaugaacccgggaggcggagcuugcagugagcugagaucgcaccacugcacuccagccugggugacagagccagacucugucucaaaaacaaaaaaaaaaaccuaaucauauuuccaaguuuuaggcauuucuuuugcuccuaugacacauuuuaggaggguuuucuuacucuuguaacucccaaaucuauaugucuacagcugaucuauuucacaaagucuagucucaaacuuugaauuacagaaauaccuaaauauauaguauuuucuguauauugcugaaaucauauuaaaacugccaacaauuagcugggcaugguggcacaugccuguauucucagcuacucaggagacugaggugggaggaucacugcagcccaggaggaagucaagccugcagugaaccaugagugcaccacugcacuccagccugggcgacagagacccuguaucagaaaacaaaaaacaggcugggcgcuguggcucacaccuguaaucccagcacuuugggagacugaagugggaggauggcuuaagcccaggaccagcccaggcaacauagugagaccccgucuccucaaaaaagaaaaaauuaggcaggcgugguggcccacgugguggcucccagcacuuugggaggcugaggucaagaguucgagaccagccuggccaacauggugaaacccugucucuacuaaaaauacaaaaauuagcaggcgugguagcgugugccuguaguuccagcuacuugggaggcugaggcagaauaaucgcuugaacccaggaggcggaaguugcagugagucgagauggugccacugcacuccagucuggacaacaagagcaaaacuccaucucaaaauaaauaaauaaaaauaaacaaaaaaacuggcugggcacgguggcugacgucagccuguaaucccaucacuuugggaggccgaggugggcagaucacuugagguugggaguucaagaccagccuggccaacaugcugaaaccccaucucugcuaaaaauacaaaaauagccaggcaugguagcauacgccuguaauccaagcuacucgggaggcuuaggcaggagaaucgcuugaacccaggagguggagguuguggugagcugagaucacaccauugugcuccagcuugggcaacagagugagacuccaucucaaaaacaacaacaacaacaaaaauuaaaacugaaguucugcuguuucgcccguccucaacauaaacacucagaacccuauaaccuuuccuuuuuaauugcuuauaucacaauuuaaugccuauuuauuuauuuauuuauugagacaagagucucgcucugucauccaggcuggaguacaguggugugauucucggcucacugcagccucugccucccgaguucaagcaguucucucuccacuuagauaaggccuucugucaacccccaauuguuuacuaauuagguaguguugcuuuuuuuuugacaugguauuuauacuuacuuuucuucacauuacauucauuugguuauacugccuauuccaguaaucucaaaauuuuccacuuugaaucuacccuaauuccucucugaacaggaauuuuggcuuaugcaucuuuguauuugaaacacauaagacauuauuuuguaauaauguagucuuauuuuauuagugauuuaauauacugagcuaucuuaguuguuguauuuuaaucauuuagauuauuuaugugaacucuuuauuuuuaguguaaugaacaagucuggggugaaucguguaguuuggaaacgaccucgacucacucacaauggaccuguuagaaggagcacaguuauugaccagauuccuuuucuggcaguagcaagagcacuugguaaguaggacuuaauuuggugaaauuauauugaauuuucuacaauauaugguggcaaaauaaaagaggagacagaacuaaacccuuacuuggcauauagugaggguagagauaucaugauauucuauuaacugcuuuagaaccuaaucgaagccaugcaugguggcucacgcuuauaaucccagcacuuugggaggcugaggugggcggaucucuugaggucaggaguuugagaccagccuagccaacauggugaaacugcaucuucacuaaaaaauacaaaaauuagcugggcauagugauguguagcuguaguccuagcuacucaagaggcugagucaggagaauugcuugaaagcaggaggcagagguugcagugaucgcaucacugcacuccagccugggcgacagagcaagacucuaaaaaaaagccuaauugaggggaagguuuagguauauaauucacugacaguugcccuuuguucaugagucacguucaauguuuugcuaauuucuaucucuguuuagggaaguauaugcauaucuaggcuuaauguuacccuugaaacuauuuuuaaguaucccauucuccuuuagcccuuaauaguccuccugagagccuucaaaaccucuuuuuucuuuaguuaggaaaguaaaauaacuaugaaaaaaauaguuauauuucuggucuaccuggcuuuggaaagaaggcuagagaauuacaccuguuaaggugucuuaccuuggcuaugcuagauggggguaguuuuuucaaagaaaaugucucugagaaaacgcacauuuguuuauuuuuauuuuaugagacagggucuuguuuuguuauucagccuggauugcaguggcaugaugacagcucacugcaaccucuaccucccaggcucaagugauccucccacguuagccucccgaguaacugggacuacaggugugagccaccacgccuggcuaauuuuuucuuuuuuaaggagacggggucucacuguguugcccggggugguccugggcuuaagccauccuccuaucucggucucccaaagcacugggauuacaggcaugagccaccacacccagcacaacuacuauauauauuaauaauuuguuuccaaugugaaacuaauuuucuucuuucacacccugacugguggacuuuuauguuauauccaagcauuugcuauuaugaaaaauacugcaauaaauauuuccuuauauacacauauggguuguuuuuuuuuuuuaaauggaguuuuacucuuguuccccaggcuggagugcaguggugcagucucggcucacuguaaccucugccuccuggguucaagcgauucuucugccucagccucccgaguagcugggauuacaggcaugcaccaccacuaccggcuaauuuuguauuuuuaguagagacgggguuucucuauguuggucagacuggucuugaacuccugaccucaggugaucugcccgccuuggccucccaaagugcugggauuacaggcgugagccacugugccuggcaagauuucuuuaagauacauaacuagaaauggaauuucugggucauaguauguuacuuaccaacuguuuuugugucguaacacucacacaagaugauaauauuucuacaguaagcagaggaggcuacuugagacugagguaacuaacauggacucucuagccacugaggacccacccugcugccccuaggccucacucauccaaggaauaccaauugggagacucaguucagagauaucuacauguuuaguuuuauuagguauugcuaaauuucuucccaaagugauuaucccagguuauuacagucccgcuguauuaguuaucuauugcuguguaaucaaauacucccacacuuaggaguuuaaaacauuuuuuauguacacaguuccuccggcucaggaacccggggugacuuaacuggaugguucuggcucagggucucuuguguagcugcaaucaagaugucauuaaucaucgaagccuucaaugggguuggagcaucuacuuguaagacagcucacugaguaaccuggauuggcuggaggcuucaguuucuugcuuugccggccucugcauaggguugcuugaugugucuucaucacauggcagcuggcuuccuuagagcaagugaucauaaaaagacauuuugacuucuaccuugcuuucuugaucacuugcuguagggaacccagcuuuguauuuuguuagcccugaaucacuaaaucaagcccacccucaaguauaucaaauaauuuguggauguauuuuaaaagcauauaguuccuacuucuucaugauuguucuuuauucaccaaauauuuauuaaauaccugcuaugugcuagguacuguuccaggugcugaggauucagcagugaaugaaacaaaaauuccugcacccauggagcuuacuuucuagguuaggggaaaacaugauaaacuaaaauaacuaaguaggacacauacuguguuagaaaugcuaccaagaaaaauaaagcagggaaugcuaugaggguggggccuguauaauaauucuaaaugggauggucagaggagggucucgcuaagaugauaugucaguaaaguguaaguaaagagaugaggcagugagaccugugagugucuggggccacagaauuuaggcagaaguaacaaauguaaggguucucauuacucaugaauuuuucucuuuuuuuuuugagaugaggucucacucugugcccuaggcuagagcucauugcagccccuaaaguccugggcucaaguguucccccagccucagcuucccaaguagcuggggcuacaggugcaugccaucacacccaacuaauuuuuaaaaauuuuuuguagagacgucucgcuuugcccagguuggucucaaauuccuggcuucaagcgaucugcccaccucagccucccaaagugcaugugcgacagcgcucagccuacucaugauuuuuuuuuuuuuuuuuuuagacagaauuucgcuuuuauugcccagguuggcgugcagugaugugaucucagcucacugcaaccuucaccuccuggguucaagcaauucugcugccucagccucccaaguagcugggauuauaggcgugcgcccccacgcccggcuaauuuuguauuuuuaguaaagaccugugagugucuggggccacagaauguaggcagaaguaacaaauguaaggguucucauuacucaugaauuuuucucuuuuuucuuuuucuuucuuucuuuuuuuguuuuuuugagaugaggucucacucugugccacagggguuucaccauguuggucaggcuggucuccaacuccugaccucaagugaucuacccacuucggccucucagaguacugggauuacaggcaugagccacugugccccgcuccuacucaguauuuuuaacugagcagcuggaaaaauggaguugccacuaagugauaaagaaaugacuggaacaucaguguaaaggagaggucggaaguucaguuuuggacacauuacccuuucggcauguuuuagacauuaagguggugauaccuauuuggcuucccauuauaagaauugauuucagguguugucuaggguggagcuuucaauuugggggagccaguagcauauagauaguauacaaagucuugaggucauguagggauugagugcagauagaaaaggggacaaggucuaguggcugagcccugagauacucucacuguuaagacucgggggaugugcucugguuucauuugaggguuggauuaaaauuaaaaaaaaaucuaaaagaguuaggggaugugaauggaagaacaagguaaaacaacuaacagcuguaagucaaauaggaaauuuggguuagcguacccuggaagcuaagugaagaaaguguuuccagaaagaaaguguuucaaauacuguugucauuuagguggagggaggauugaaaaaugaccaugggauuuaggaauguggaggucauuggugaccuugaaaaagaagguagcuuuugguggaauagcaagaccacaaccaugauugggguuauugaagaaagaacugucuucuugagugggaggaauaaaauuugauacagcgaguuuuuagacaguguuuuuauagaaguuacuuuacuucaacauaauuuuguaaacacauacagaaaugaauuaauauuuugauaaaagggcuuauaagagaaaaucguuuuagugauaaaaaagcuuuuuuccucuugauuucucuugucacauaaauauuuucuuuucaaaaauaaugcuaccuuuuagauuuuaauauuuaagcuaaaaaggcuuugcuguauuacuuuucaaaccauuauucugacacuuggaaaaauuuuuuuuuuuuuaugagauggaaucucacucuguugcccaggcuggaaugcaguggcacgaucucagcucacugcaacuuccgccuccccggcucaaaugauucuucugccucagucuuccaaguagcugggauuacaggugcgugccaccacaccuggcugauuuuuguauuuuuaguagagaugggaucucaccauguuggccaggcuggucucgaacuccugaccucaguugauccgcccaccucugcuucccaaagugcugggauuacaagcgcaagccaccgcgaccgaccggccuggaaauaauauuuuuaaaagagccauguuauugguuuucugaguuuagcuuguugcauggaaauacuuacuggccuaaaguaaauuaaaugcucauauuuagcacacacccuuaugguuuacggccauuuuucuuauagguuuuuuugggcgggggaaggggugggaauagaugucuccuugucaacauugguacccacccuauagacacugaugauaauuacccaaguacaaauguagcaaaggugcccucuaguggcugccugcuggaauugcauuuugagucuugcaaaucauuuuauucacuggggagauaauuuuugaguauaguguguaugaagcacucugcuguauguacaagcacaugaucuuugcccucauggagcuugcagucuaggaaaggguugaaaggcauucaucagaugauaacaaaaaacugaaaaaaaaauuauuuuuuuuugagacugaguuuuuuucuugucauccaggcuggagugcauuggcacaaucucggcucacuguaaccuuuacuucccagguucaagcgauucuccugccucagcuucccaaguagcugggauuacaggcacccgccaccaugcucggcuaaguuuuguacaaaaauacagggguuuugccauguuagccaacuuggucucuaacuccuaaccucaggugaucuacccgccucagccaccuaaagugcugggauuacagaugagagccacagcgccuggcuaaaacugaacauuuuuaauucuucuucuucuucuuuuuuuuuuugagauggagucucacucugucgcccaggcuggagugcaguggcacgaucucggcucauugcagccuccgccuuccggguucaagcgauucuucugccuccaucucccaaguagcuaggacuacaggcgcacgccacugcacccagcuacuuuuuguauuuuuaguacagacgggguuucaccauguuggccaggcuggucucgaacuccugaccucaggugauccgccugccucggguucccaaaguguugggauuacaggcgugagccaccacacccagccaauucuuaacuucuuauauguacuaaugaaaaccuaaaauaaggauauuucacuuaaccagagaggccagaaaagugauauuugaacugaguuuugaagaauuacuggagguuaaggaggaagaaaguguguuuuaggcauagaaaacaacauuuucgaaaaguucggugauaggaagaagcauagugauauaggaacucugaugaagggcaguguagcuggaacggauaaggaaauaagagacuuggauaaaaugagaaaauacugcauuuuauaggcagugguaaauaaucauguuuggcuggaugugguggcucacacccauaauucuaacacuuugggaggccaaggcagguggauugcuugaguucaaggaguucaagaccagcuggacaacauggcgaaaucuccccucuacaaagaauuggcugggcgugguugcacgcgcuuguagucucaguuacucaggaggcuuugguugggaggauugcuugagcccaggaggcugcagugagccaagauuaugucacuguacuccagcuugggcaacagagcaagacccuguuucagaaaaaacaaaagaauugugucuuuaucuuaaaaacaauugugaacuauaacagaguuggaaugggaaacauaaccagauuuguguguuuuuaauugugguaauauaugcuuagcauacacguaacuuaccguuguaaagcaugugguucauugauguuacguacgguuacacuguuuugcaacugucauccaccauucauccuagauuugugggcuuuuguuuguuuguuuuuguaauuucagcuuuuagauucaggaaguacauguacagguuuguuacauggguauauugcauggugcugagguuugggguacgauugauuccgucauccagguagggagcauaguacccaauuguuaguuuuucaugucuuccuccuucucucccuucucccucuagugguccccagugucuauuguugccaucuguaucuucauguguacucaauguuuagcucccauuugcaagugagaacaugugguauuuggcuuucuuuuccuaaaagaaauuggaaauuucuuuuauuuagaaauuuagaaauuucuuuuccuaaguaaauuggauuaauuuacuuaggauaauggccuccagcugcaucuguguugcugcaaaggacauaauuucauuuuuuuuuuuguggcuguguaguauucuguaguguguauguaccauauuuucuuuaugcauuucacuuuugaugggcaccuaaguagauuccuugucuuugcuauugugaauagugcugcaaugaacauuugagugcaugugucuuuuuguagagcgauuuauuuuccuuuggauguauacccacuaacaggauugcuagaucgaaugguaguucuaaguucuuugagauaucuccacacugcuuuccacaguggcugaauuaauuuauauucccaccaacaguguauaagcauucccuuuucucugcagcuuugccagcauugucauuuauuggcuuuuuaauaauagucauucucacaggguaugagaugguauuucauugugguuuugauuugcguucucuaaugauuacuaauguggagcuuuuuaugauucuuggccguuugcaugucuucuuuugaaaaguguugaugccuuuugcccacuuucuaaugggguuauuuguuuuuaacuuguugaauuguuuaaguucuuuacagauucuagauauuagaucuuugucagauacauaguuugugaauauuuucucccuuucuguagguugucuguuuacucuguugauagcuucuuuugcugugcagaagcucuuuaauuagguccuacuugucaauuuuuguuuuuguuacaguugcuuuugaggauuuagucacagauucuuucccaaggcugauguccauccacgauucuuacaguuugaggucuuacauuuaaaucuuuaauccauuaguuuguguuuuaaagagagaauuuucauugaguuuugagaauggauuagaggggguaaacauuguuggaaguucuccaugggaagccacucaaaggggugcugaaauuugauagguguaaggaccacugagugucuuguggacugcuggcugccaagugccacaggagcaagcagaaaauauacuggaaccagaaagcaggccuccucucuucuggugucccuucagcacccucuacugaggaaaaaagggaauuggcugucugccaguuuccaaggcaccuccuuucaggaccuacagaaaugauguucuaugaucguacuuugguguacaaacacuagaccaguaauaaaaacccuuaguuaaaggcccaauucugauccuuaccaguuauuugauauuagauagaaucauauagacucuuugaacugguaaaacaagggaaagugucuaugaguaugaaucaucuggugaguuuguugaaaggucagauucuagggacuuuuacuagcaaauuugaagcaacuugagcaucaaaacaaauuauaacaggaauaaguuaaaaaauauugaauaaaaaagaaucuguaagucuauauagagauaaaaaauuguacagguagaagaauggauuuuuuuuuuuuuuuuuuuuuuuacauuuaaaggaguuuaauugggcaaugaacgauuugugaauuggguagccacccccgcccacagcagauucagagagacuccaaagaaaaucuuuuuuuuugagauggugucuugcucugucaccaggcuggagugcaguggcgcgaucucggcucacugcaaccucuggcuccuggguucaagugauucuccugcccgagccucucgaguagcugggacuacaggcgugugccaccaugcccagcuaauuuuuguauuucuaguagagacuggguuucaccauuuuggccaggauggucuaaaucucuugaccucgugauccaccagccugggccucccaaaguuuugggauuacaggcgugagccacugccuccggccaggaaacucuucuuuaaaaaagauuuucagccgggcacgguggcuuaugccuguaaucccagcacuuuggaaggccgaggugggcggaucacgaggucaggagauccagaccauccuggcuaacacagugaaacccccaucucuacuaaaaauacaaaaacuuagccaggcaugguggcgggcgccuuauagucccaccuacucgggaggcugaggcaggagaauggcgugaacccaggaggcgagaucacgccacugcacuccagccugggcaacagagcgagacuccgucucaaaagaaaaaaaaaaaaaaaaagacuuucaggccugagcacagugacuuaugucucuaaucccagcagccuguaauccuagcacuuugggaggccgagguggguggaucgcuugagcucaggaguucgagaucagccuggccaauauggcgaaaccccaucuguagaaaaaaauacaaaaaaauuagccuagcaugguggcacacaccuguagucccagcuacuuggaaggcaggugagagaacugcuugagccugggaggcgcagguugcagugagccaugaucgcaccaaugcacuccauccugggcaauagaguaagacccagucucaaaaaaaagaaaccuuuuugggguugggaaagaagagcaaaaagaaccaaaauaaaguaaaauaaacugucagcuaauaaauguaguuagaauguccuaauucugucaucaguuuauaaccguuauaauaauugauucauucaggaaucaucaguagaugcuaaaauauggcauauuuugguacagaacaggauauuucacagagccucaaacuuucacccuacagacuacucaccaguuaaaaaaagaaaaaggcaccuuuaugcugccaguagauagcacuuuaaccaaaugaugaaagucaauacugccaauaauaggacugacugacacacugucucuccucaugugauauacggagaaggacaugacaucagcaauguaguccuguagccaaaagugaguuuacccguucaugaaccccuguagagcacgagaacaagaggaaacaaucagauggauccaauuuaaaggucauugugcaauagaacucuuuucuuuucuuuuuuuuuuuuuuuuuuuuugagauggagucucacucucgcccaggcuggagugcaguggcaugauccuggcucacugcuauguccgcuuucuggggucaagcaauucuucugccucagccucccgaguagcugggauuacaggcgcgugccacccagcuaauuuuguauuuuuaguagagccgggguuucaccguguuagccaggcuggucuccaacuguugaccucaagugauccaccugccucggccucccaaagugcugggauuacaggugugagccaccgugccuggcaaaagaacuaucuugaacucuucacaguugucaauaccaugaaugauaaaaacaaaacaaaacccuagggaauuguuuuagguuaaaaaugacuaaaaaaugacaaaugcaauuaacuuuuuaaaaaguuuuuuuaaaaauaaagaugggguuucacuguguugccccggcuggucucgaacucccaggcucaagcaauccuccugucuccaccucccaaagugcugggauuacaggcaugagccaccuaaccugacugaagaaugauccuugaauggauccuggauauuaaaaaugcauuauugugacaacugggaagauuugaacauaaacuuuauauuauacagugcuauagcaauaugaaauugccugagugugguagaauaacauccucaugcuuaggagauaaauguugaaguauuacuguuuggaggugaaguguuuugagucuguaaucuaaucucagaugguucagcaaauaacuaaaaccagcucuauccacagauuccaacacuaucugcauaaaaaaucccagauaaucuucaaaagaacuacuggaauuaauaaguggagucagcaaguucacaggaccuagauuuagcauacacagucuaucauauuuuuauguacuaaaaaugaacaauucguaauaaaauuuaaauaaguaucauuuauaaucgcacccaagaaaaccaugaaauacuuagguauaauuguaacaaacuguguuuaagauuuauaugcgugaaacuacaaaaugaugaaagaaaucaaagaaauagaaauauaccacauaucuuagucaaaacccagaguuuaaaaauuuaaguuagaagaaacaaucccuucuucugaaaauguauugagguuuauugagaaagaaauagagauugaggcugggcguggugucuaacgccuguaauccuagcacuuugggaagccuagguguacagaucaccugaggucaggaguuccagaccagccuagccaacaugaugaaaccucgucucuacuaaaaauacaaaaauuagccagaugugguggcgggcaccuguaaucccagcuacucgggaggcugaggcaggagaaucacuugaacccaggaggcagagguugcagugagccaagaucgugccauugcacuccagccugggcaacaagagcgaaacuccaucucaaaaaaaagaaaaagauauuggagacuagugauuuggaaguugucaguaaaagaguuggaaacuugaaaggaugguuucaccaaagcaauguaaaauauauauguguguguguguguguguguguguguguguguguguauguguauauauauauguguauauauauguauauauauauguguauauauauguauauauauguguguguauauauauguauauauauauguguguauauauauguauauauauguguguauauauauauguauauguauauguguguguguguauauauauauauacacacacacacauauacauauacauauguagguagguagauagguaucuccagaaagauaagaacauaagaauaauaguccuuacagggaaaacuggaagggcaguggugagaagggagaauuuucacuguauauguacccuuuuauaucuuuugguuuucauacuaugcgaauauauuacauaauauuauaaaaaggcagacccaguaccguggcucauacuuguaaucccagcacuuuggggaaccgaggugggaggauugcuugaauccaggacuuggagaccagccuggacaacauagugggaccgccaucucuacaaaaaauaaauuagcugggccuguugguauacaccuauagucccaucuacuugagagguugacguaggaggaucacuugagcccaggagaucuauccugcagugagccaugauugugccacuguccccauguucauuuuuauuauuucgucaaccagggagcuuuguuuugcugguauaaagagguaagugugucuuugugagcuuaucuggauuauaauuagcuuuuagugcuugcauguauucuguuuugcugcucagagggcugaauugcuuuuugaagagucugguuagcaaugauuuugcuacuuucaagugggaguaauugacuugaauuauucuuucuuuggacucugagcauguuugaauugccaguauuucugauggggagcuaguggggaaguuuaaauaaagaaaaggacaaagcuuccucuuguuuaacaaaaaaaccagaccuacugaaaggggacaaaaauuguuuaaccucuugucugaaaaucuuuugcuuuuaauuuaggccuuucccuuaaauaguucacaauaaacaaaagaggcagaaauuaauguuuucuccuuucugucuccucuuccacauuuauuggaaacagaagaaaaauuuauauuguuucauuuauguugucuuauauauuacagaaaaguagaugguuucuauaaaucauuuuuauuuucuucuguuuuaguuuuauugaucuuuuuuauggccugggucgacuaaaaguuauugucucuugaacauuuugauguuuguaucuaauaggucuaaaggcagaaguuuaggcauuguuuuuauguggagcuaaucaaggagaaggauaaauguaagagcuuucuuuuuccggcucagugaaagggagaacuguugcucuccaaaguuuggucauaugguugguaaagagcauuacaaugcucauuuuuauauuuugaauuuucuugcaagugacugguacuuguucuguaaguuuugauguagguacuuuacugaucuagagauuaacaggaaguuugcaaacagccauugguacuucuguuuguaggauaaguucucaucuuguccuuuuucuucaaaauuaucuugauuaaucuuggcccuuugcgcuuagccugucaaauucuacaacaauccuuuugggauuuugguuagaauuacauugacuuuguagauuauuuugggaauaauugacaucuuuauuauaguaaguauugcuaucuaugaaucugauugguuacuucauuuauuuagauuaucuuuuuaauguuucaaaauagaaucuauaaucuucauaacaggcauguauaccguuuguuaaaguuguuccuaaguuccuuacauuugguucauuguuaaaauuggauuauuuaaacauuuauauuuucuaugucuugcuaucauauagaaauacguugacuuauauauuggguuuguauuuaacaacuuugcuaaacuuuucuauuguaauaauuuauuuuugguuuuccauguauaaaugaaauuaucugcaaauaauauuaguauuauuuucuccuuuccauuuuguauauacuuuauuuuuauuaucuuacugugcugggaaggacucaguauaguauuagaagagaagcaaugauacaaggcauaguuuucuuauuucuacauuuuaaagggaauacuuuuaacauuuuaccuuuaagaugauuauuacagaauucugguggauauacuuuaucagguuaagggaguucccuuuuauucuuaguuugcuaggaaaucuuaucaugagaggaguuugaauguuaucaaaugcuuuucugcgucuauugagaugaacuguguagauuuucucuuuuaaucuguugcuguuguacuauuagcuuccaacuaauacuucuugcuuuuucugcucccuucccccaggugauuuguggagcuaugauuucuucaguggugaauuuguggugucaccugaaccagacacaaguguccacacucuugacccucagaagcacaaguauauuauauuggggagugauggacuuuggaauaugauuccaccacaagaugccaucucaaugugccaggaccaagaggagaaaaaauaccugauggugagaugugauugaauaacuugauauuguugucuaaacauuguuuugguacuucugucagaaucuugaauaugaacuaaggacauugaccuuggguagauuuuugcauuugccuugaucugcuaguggguaaaacauaggcuuuguagcuccuaaucauuagaggaaugagacaagaaauauauaaccgaagucuaauaacaaaacacacaaccacugacuucaguauaaauuggccugugaaacguugcuaauuccuuauuuuuuuaaaugacauauaauuuccauaccauaaaauuuaucguuuuuuuuuuuuuuuugagacggagucuugcucugucacccaggcuggagugcaguggcacaaucucggcucacugcaagcuccgccuccugaguucacgccguucuccugccucagccuccugaguagcugggacuacaggcgccugccaucacacgcggcuaauuuuuguauuuuuaguagaggugggguuucaccuuguuagccaggauggucucgaucugaccucgugauccgccugccuuggccucccaaagugcugggauuacaggcgugagccacugcgcccggccaaaauuuauccuuuuaaaguguauaauucagugauucuuaguguaguucacaaaguuguacaaccaucaccacuacuacuuuuuuuuuuuuuuuuucugacugucucagugucucgcucuguuaccgaggcuggagugcaguggcaugaucucagcucacucuaaccucugccuccuggauucaagcgauucucccaccucagccucccgaguagcugggauuacaggugugugccaccccacccagcuaauuuuuuguauuuuuaguagagaugggguuucaucauguuggccaggcagggcucgaacuccugaccugaggugaugccucagccccacaaagugcugggauuuaaggcaugagccaccgcacccggccuccaucaccacuacuucuacuacuuuuuuuguuuuuuuuuccccccaagagaugaggugucacuauguugcccaggcugguuuagaacuccuaggcuuaagcaguccucucaccucagccuccugagcagcugggacuacuguggugccaugcccagcuccuaaucucaaaacauuuucaucaucauccccuaacagagcacauggaaguaucuggaaucaaaaauccaaagauggguuauccuuagaaaagaugaucuuucucucagauggcaggaauaguaaagcuguauuuugagguggaaggaggggcaaauugauugaauuuuuguuaaauugccuccauucauuccgggcgcaguagcucacgccuguaauuccagcacuuugggaggcugaggcggguggaucacccaaggucaggaguuaagagaccagccuggccaacaugaugaaaccccaccucuacuaaaaauacaaaauuagcugggugugguggcacucgccuauagucccagcuacuuaggaggcugaggcaggagaaucucuugaacccaggaggcagaggucgcagugagccaagaucaugccauugcacuccagccugggcaauaagaacgaaacucugucucaaaaaaaaaaauugccuccauucauucacucaauuaacauacuagguacuagguacagggauugcaaagguaaauagaauaugguccuuccucagcacuuaccauauuauuauaaauagaauauauaaaaaacuaacaaucccauuagaucaugaguucuuuuaaggugagagucaucuugauucaguuuuacauguucagggccugguguguugcauuuaguuggagauuaucauguaucaaagaguaacauaaagacucuucugucuaauggauuuagaauucuuuaaugaucugagagagaucauuucaauggcauaaagacaaaaaccaguuuguagugcauuggaagaaccuauuuaugaaccauaaaguguuuuaagaugaguauugaaggaagcauccguauaauguauaauuagaacaagucuuaugagaccuggaagagugagacgauagaaaacuucacaagacugcauaggaagcuucauggaagagagugauauuugagcaagaaaauuugcaggcuuaaucuaaggcagcagugguuuuuggaaaaaacacaaagaaauacauguaggccgggcgcaguggcucaagccuguaaucccagcacuuugggaggccaaggcagguggaucacuugaggucaggaguucgagaccggccuggccaacauggugaaaccccaucucuacuaaaaauacaaaaaucagccagacguggugacucgcaccuguaaucccaguuacucaggaggcugaugcaggagaauugcuugaacccaggaggcagagguugcagugagcugagaucgugccacugcacuccagccuggugacagagcgagacuccaucucaaaacaacaacaacaacaacaacaacaaaaaacacaaauacauaaguaguagaauugacagcucuuauguuuauaaggaggaagaauaugaugacaccuaaauuucuaacucuggugacuaguaagcuguuauaaagaagagacauuauuuagggagagaugggggagguaauuaguucagacauaggcauguugaguugagguaccugugguucaucuagauagauaucuucaguaggcaguuauaaauauuugagagagagggguggcaugcuccuauagucccagcuacucaggaggcugugggaggauugcuuaaccccaggaguucaaggcuguagggcucuaugauuguacuuguuaauagccacugcacuccagccuggacaacauagugagacccucaucucuuuaaaaauaaaaacuugggagggaagcguggaaauacuaauuuaacaguuaacaagaguugcguaaauuguggcaauauaugcacuuagagagacucugugguuuaagagcacacaauauuagggggacucaagucagcagaauucuagugagcugagggaaaaauauacagguaagauaguggaaaaugguuuauauaauuguuuucauagagcauugaugggaagggaaacaggcacacugaaaaagugagagguaagggcucagucagcugguguuuggagaguggaaccacaugccguagggaaugugauagauucaugaauuagagauuaaugcugccuuuaaucaauucugaggugcauauuuucuuuuaauaucucugaaauuggaauacuuuuuacaaaugguauaucacaguucaauuaacaguguuuuugguuuuuuuuuuuuuuugagauguaaucucgcuguguugccaggcuggagugcaguggcgcgaucucagcucacugcaaccucugccucccagguucaagcgauuccccugccucagccucccgaguagcugggacuacaggcgcgcgccaccaugccuggcuaauuuuuuuuauuuuaguagagacgggguuucaccacauuggccaggaugaucuccaucuccugaccucaugauccacccaccucggccucccaaagugcugggauuacaggugugaaccaccaugccaagccaccacgcccagccgacaguguuuuuuauuucguuuguggcacauaaaaugaugcauccauaacacaaggcucaugguauucuacaugaagaaaacaaucuaagugauccagucagaguuacaaaaaagaauaucauaguaaaaccccucaaaguaggagguugaaaauaauagagcagaaauuaauuauuuagggagauucacaaaacccagaagggcagucuuuuaagaagacacauaaggcaugauugauuguuucuaguucaagagaaaagcacaaaaaaguuugaguggacauaacuacacuuaaaaauagagauuuuuaaaacacacuuuaaaaaauucgaaguauacuauacauaugacauuuacuauuuguacuauuugaaauuguacaauucaauaguaaaaaauccauuuauauucuuuuuuuccacccuucaucucucucucccuacuacccuuccuggcuucuuguaaccacaauucuacucucucucuuugugagaucuacucuuuuagcugccacauaugagugagaucaugucuuucugugcuuggauuauuucauuuagcauaauguccuccaguuccaucccuguugcugcaaaugacaagauuucauucuuuucuauggccgaauacuauuucauuguguauguguauauacaccacauuuucuuuauccauucauguauuaaauggaauugacguaggaugauuccauauuuggacuguugugaauagugcugcaauaaacaugggagugcagauauaccuucaguguauugauuuucuuucuguuggauauauguauaguaguggaauuguuggaucauaugguaguuuacuucuguuuuuuuuuuuuuuuuuuuuuuuuugaggaaccuucauacuguucuucguaguggcugcucuaauuuacauucccacuaacacugaggguuccccuuucugcacauccucaccagcaucuguaguugccuaucuuuuugaugcaagugguuuuaacuggagugagaugauaccucauugugguuuugauuugcauuucucugaugauuagugauguugagcauuuuuucauauaucuguuaaucauuuguaugucuuuugagaaauguguauuuuagaucuuuugcccauuuuaaaauuggauuauuuggggcuuguuuuguuuuguugcuacugauuugagcuccuuacauguuguuaauuccuugucagauggauaguuugcagauguuuuaucccauucuguggguucucucuucacuuuguugauuguuuccuuugcauuuuagcuuguauuuucauuugucuauuuuugcuuugguugccagugcuuuugaggucucaugcaaaaauuauuugcccagaacaguguccuggagcguuucuccaauguuguuuucuucuaguaguuucauaguuugugagaucaaaguagaucucacagagggaauagaauugugguuaccaauucuacuaauugagaucuuagauuuaagucauuaauccauuuugauuugauuuuugugugugaugagagauagggguauaguuucauucuucagcauauaguuauccaguuuucccccuaccauuuauuguugcucuuggcaccuuuguugaagaugagcuggcugcaaauugcguggauuuauacauagguuuucuguucuguuccauuggucuaugugucuguuuuuguagcaguaccaugcuauuuugguuacuguagcccucuaguauaguuuugaagucagguagugugaugccuccagcuuuguucuuuuggcuuagaauugcuuuggcuauucaggauauuuugugguuucauaugaauucugagcuuaaagaaaaaauuaugugaagaaugucauuucaauuuugauagggauugaaucuuuaaauugcuuuggguaguauugucauguuaacaauauuaauccauccaauccauaagcauggacuaccuuuguaucuuuuuguguccucuucaauuucuuucaucaguauuuucuaguuuuccuuuauagaucuuucacaucuuugguuaaauugauuacuaggcauuuuauaauuuguguaccuauuggaaauaggauugcuuucuugauuucuuuuucagauuguuugcuguugguauauguaaaugcugcugauuuuuguauguucaucuuguauccugcaguuucacugaauuuaucagcucuaacaguuuuuugguggcgucuuuagguuuuuguagguaugagaucauguuaccugcaaacaaggcucauuugacuuauucguuuccaguuugguuacccuuuauuucuuucucuugccuaauugcucuggccgggacuuccaguauuguauugaauaacaguaagugagaguggggcauccuugucuguuucaguccuuagaggaaagaccuucaauuuuuuuccccauucaguauugauguuggcugugaguuugucauuuugagguauauuucuacuauacuuauuuuuguuggguuuuuaucauaaagugauguucaauuuuacgaaaugcuuuuucagugucuauugaaauaauaugcuuuuuuuuuuugagagagagagucucacucugucacccaggcugggagcacaguggugcgaucccggcucacugcagccuccaccuccugggcugaacugauucucccaccucagccucccaagcagcugaggugggaggaucacuugagcccaggagguggagacugcaguaagccgaggucacaccacugcauuccagccugggugacagagugagacccugucucaaaaaacaacaaacaaaauuuuccacucauuuucauuagucauuuauuucuauggguacuuuuaauacaugcaggcagccgggcacggcgguucacaccuguaauuccagaacuuugggaggccgaggcaggcagaucaccuaagauuaggaguucaagaccagccuggccaacguggugaaaccccgucucuacuaaaaauacaaaaaaaaaauuuagcugggcaugguggcaggugccuguaaucccagcuacuugggaggcugaggcaggagaaucacuugaaccugggaggcggaaguugcagugagccgaggucuugccauugcacuccagccugggcgacaagagcaaaacuccaucucaaaaaaaaaaaaaagaaagaaaagaaaagaaagaaaaaaauacauguaggcuuauuuccuggaguacaucauuuucacuuuuguucugugaaaccuagcagauuuuaaauucauauaugacacuggaaguuuuauuccaagccacauuuauuugcauaaaaugagauccuuuugguuuuguuuucuuuacucguucaauugguauauauuuguucuuuauacuauaagcaguuauuguauuacuuuuuccucauaugagugacauugacuguuuauauauauauaugagcuguuuauauuuccuuuucucuggauuuuguuuauauucuuugacaauuuuuauguugagucauuuucuucgauuugcagaaucucuuauguuagaaggaauuugacccuuugcaaugauuuuuuuuuguaccaugccugauugucuuguuugugaauuauguuuucuuaaauaacuugauguuuacuucuuguuguuguuguuguuuugagacggagucucgcucugucgcccaggcgggagugcaguggcgugaucucggcucacuguaaccuccgccucccagguucaagcaauucuccugucucagccucccaaguagcugggauuacaggcacacaccaccaugccugacuaauuuuuguauuuuuagcagagaugggguuucgccauguuggucaggcuggccuugaauuccugaccuugcaguccaccugccuccaccucccaaaguacugggauuaaaggcgugagccaccacaccuggcuacuuucuuuuuaaguaacuucuuuauaacuuuuucuuuucuuuuuuucuuuuucuuucuuucuuuuuuuuuuuuaaauggagucuugcucuguugccuaggcuggaaugugguggccugaucuuggcucacugcaaccuccgccuccuggguucaagcgauucuccugccucagccuccugaguagcugggacuacaggcaugugccgucgcgcccggcuaauuuuuuguuuuuuuaguagagauaggguuucaccauguuagcgaggauggucucgaucuccugaccucaugauccacccgccuccuccucccaaagugcugggauuacaggcaugagccauugcgucuggacaacuuuuucuaaauaaaguuacagugaaggcugaguuucuugauaaaaauaaaaauagugaaauuuaaugacaggauaaaaccuuguuuuauuaguauuuuuugaauuuagaaaaguauuauuuuaacauggcuaaggagacuggggauaauguuugaaaauuugggagcuuuggcugggcgcaguggcucacaccuguaaucccagcacuuugggaggcagaggcguguggaucgaggucaggagaucaagaccauccuggcuaacauggugaaaucccgucucuacuaaaaauacaaaaaauuagccggccaugguggcgggcgccuguaguccuagcuacucgggaggcugaggcagaagaauggcaugaacccgggaggcagagcuugcagugacccgagauugcaucucugcacuucagccugggugacagaggaagacucugucucaaaaaaaaaaaaagagaaaagaaaaaaaaaaauugggagcuuuguuugggccacagcgaacaccaaauauuuaauuugauauagauacagauguaguggcagcuaaaucugaguuacuuuccuucuccuuguucuuuugaauacagggugagcauggacaaucuugugccaaaaugcuugugaaucgagcauugggccgcuggaggcagcguaugcuccgagcagauaacacuagugccauaguaaucugcaucucuccagaaguggacaaucagggaaacuuuaccaaugaagaugaguuauaccugaaccugacugacagcccuuccuauaauagucaagaaaccugugugaugacuccuuccccauguucuacaccaccagucaagguauauaguuccauaguuuuuaaguuauguuuuaauagacaccaguucuuugguuagcgucaccuggaaacaauuuuuaaauucuuacaggauuuuggauuugaacucgauucaagaaagugauguaacuuauuaucagagagccaucuuuacaucaauacuaaucugaaugccagccauguguacagcacuaauaaaaaggugauugugggcccuuaagaauauuauuguuugccaucuaaugcuaugaacauuauuuuuaaagcauuuagaaguuugugaagcacuuaaauauauuuuauuugaaucucguagcccagaaguagagcuaauguuauuauuucauuuuaucaguaauaagccugagagauuaaacugucuaaacaaggucauagagaaucaaaauugagcuggaccugaggauagcagacguuacaacugguugucuguuaacucguauaagaaacuuuauuccuauuucuuauccauguuaauauugauugaguuuaagauaugcuuugaaauaagcaaauuuuaaguagauaucauacuuuuuugauuuacuaagaacucaaauacuugguuguguuuucauccuaauuuuucccaccaaaaauuagcaguauugauugauaauugcuuuaauacauagcauggcuaaccuggcuuucugagaauguguuuucaguagacugaccauuaaaaugggaaauguagggaaaucuaaugucaccuauucaggaaguuuuuuaaagugucaaaggccuuuaauuuugggcgucguaauccuauagucaauacuuggaaauggauuauuacugcuuugcuuucuuucacuuuacauacauauggcaaaaaccacauauggccagauacaauggaauguuuucauuucuuuuucuuuuuuuuguuuuugagacagaguuucacucuuguugcccaggcuagagugcaauggcauuaucuuggcucacugcaaccucuaccucccagguucaggugauucuccugccucagccucccaaguagcugggauuacaggugcccgccacuacgcccugcuaauuuuuuguauuuuuaguagagaugggguuucaccauguuguccaagcuggucuugaacuccugaccucaggugauccacccgcaucggccucccaaagugcugguauuauaggccuggcugaaaugaaguauuuucauucacaaaagguuucuuuucuuugaaaaccaugaaugguaaugcagguugaaacccuuuaaagccucuuuauucucuuuucaaagcugugaaagagcuuauguuuguauauuugcguauuucugaauauuuguauguaauuauuacuuucauguucccuuauaacugaccuuuaggcaguauagagaaggaggagacauuaggguggggaauagugugaggaacaaaagggcauucuuaauauugaccucaaauaaaaauuauugcagucugcugacuggcauuaguaaacccauacauaaaauacguuuaaaaaauuacuuaagcugggcacaguggcucaugccuguaaucccagcacuuugggaggcugaguugggcagauaaccugaggucaggaguuugagaccagacugaccaacauggagauaccccaucucuacuaaaaauacaaaauuagccagguguggugaugcaugccuguaaucccagguacuugggaggcugaggcaggagaaucgcuugaacccaggaggcggagguugcggugagccaagaucgugccauugugcuccagccugggcaacaacagcaaaaccccaucucaaaaaaaaaaaaaaaaaaauuccuuaaauucugggcugggcgugguggcucacgccuguaaucccagcacuuugggaggcagaggcacauggaucaugaggucaggagaucgagacuaucuuagccaacauggugaaaccccaucucuacuaaaauacaaaaaauuagcuggaugugguggcucgugccuguaaucccagcuacuugggaggcagaggcgggaaucgcuugaacccgggagguagagguugcagugagcugagaucgcguugcagcacuccagccugcugacagggcaagacuccaucucaaauaauaauaauaauaauaauucugauaaugaccuaauaauacuacuaaaguaaagauaagaagacguauguuugccauaugcagguauaguuauuuguuaacccauuggcccugcccaaauaugggaaaauauuuagguuaauucagaauaauuaguauuguuggcucugaucuaacaacuaacaaaagacagauuucugcccaagaaauuguuuuugguuuguuuuauuuaccuuaauugacauaaaggugaguacuccugacuauauuuaauuuacaucauuauuaaaguugucucauguuuaguaacauagagauaaauuuaauuauaaugugguuaauguugaacagucagagacuuaaucacauuuagacaaggcauuugagacuagauuugucuguaaacaugucagcuuccauuugaauucucacauaaauuagucuuuguuuugggauggagauaguggaaaagccuuuguuuaaguaagauagauuacuaugacacacauuucuuucucuguccuuuguuuagggcaaaacuaaauuuagcuauguuuuacaagcuaagaucuuuaagaacggaauggggaagagagcaaagaguuucagaaaauuaaaacuuaguuuuaguugcauuuuaggcacaguuuguaauuaauuguuuaauauuggauuacaggguagaugggaggagaaaguugaucucugaagcagugaacuuuuuuaaaguauguauuuuuagggguaaccucaauaucacauaacuguuuuacgaacaugcaggccuuagcaauacaaauuaaccugggguacaucuaagaagucuaaacaguugccugugcuaacagauacaauguauucccacagaaugccaauaaaaagagaauucccuucagaaauguucaagaagaaaguaggggaagggaagccagcacaccuguggugucagaauaauauucugugcauuuaggcugggugugguggcucacgccuguaaucccagcacuuugggaggccgaggcggguggaucacaaggucaggaguucgaggccaauauggugaaacccuguuucuacuaaaaauacaaaaauuagcuggguguggugacaugugccuguaaucccagcacuuugggaggccgaggcaggcugaucacccgaggucaggaguuugagaccagccuggccaacauggugaaauccugucuuuacuaagaauacaaaaguuagcugggugugguggugggugccugugaucccagcuacuugggaggcugaggcaggagaaucgcuugaacccaggaggcggagguugcauugagccaagacugugccauugcacuccagccugggcaacaagaaugaaacucugucucaaaaagaaacaaaaacaaaaaaacagagaagugauguauuuggggcaguaccagauuaguaacuagaaauucuuuguccuuuucuucaguguccauugguccuaaagucuauauauauauguguuuuucaguaaagcauauucauaucuaugauuagaucgagaucauuuuagaaacgaguuucugggccggguguggugggucacuuaaggucaggaauuugagaccagccuggccaacauggugaaaccccaucucuacugaaaauacaaaaauuagcugggcaugguggugagcaccucuaaccccagcuacucgggagggugaggugggagaaucgcuugaacccgggaggcagagguugcagugaacagagaucgcgccacugcacuccagccugggugacagagcaagacucggccucaaaaaaagaaaaaaggaagcuucuggaugccuucaauuucccuuucauuuuauuuuuugaaccucccugccucccuuauuucccuuuguuuuuaacucuagacaaauuaaaggaaacauuccuaugauaaguauacuuuuauauagcacuucuaagaaaguuguauauucaggcugggcgcaguggcucacgccuguuaucacagcacuuugagaggccgaggcggacagaucaccugaggucaggagaucgagaccagccugaccaacauggagaaacccugucucuacuaaaaauacaaaaaaaaaauuagcugggcaugguggcgcaugccuguaguccuagcuacucaggaggcugaggcaggagaaucccuugaaccugggaggcagagguuguggugaaccaagauugugccauugcacuccagccugggcaacaagagcgaaacuccaucucaaaaaaaaaaaaaaaaaaaaaggaaagguguuuauuuauaggagauuuuauuucggagaaagaucagauaaauacgucuucauuugcugcucugcuugggcuuuucagaaucuauuaauauuuugauacauuugauugagaguccacuugaggaaaauuuuacauguuugggggagagaguauuuaugcuuuaacucuggaccuugauaaaguauuaagacaaugauuuuaugaaauguuauuacuuuggaagagcuggguuugauaguaagaauguucuuaucuggaggugagcggcuauucugaguauauguagauuuagagcacuacacucaaaguaguggugcauaucuagauugacaugaagcguugugaaaacagcauuuuuaaaaacaauaaagugccuuggauaauucucauuuguuuucaucaauugggaauuucccuaaccauucucagaauggucccauguguacuacuuuucucaaaucacagagcaguaucuaguguuugcaggaugggugcaaagcagcauucuucugaguuuccauuaugaccauuaugacauaguugcuuuaauguuguacuuugcuuuaaugaugugcuuuaauguuguaaugcuuuccacacuacauacucagaaauuagaauuuaggagauaggauaaaccaaaaaacuacaaauuuguugcuuauccuacugagaugcuaccauccccuccagugguuacacugguuuucauuacuagaaaauucagauuuuuauuuuuaauuuuaauauuuauuuauuuauugugagacggagucucacuccgucacccaggcuggagugcaguggugcgaucucugcucucugcagccuccaccuccugggcucaagcaguucuccugucucagccuccagaguagcugggauuacaggugcacaccaccaugccuggcuaauuuuuguauuuuuaguagagacgcaguuucaccauguuggccaggcugguuuugaacuccugaccucaaaugaucugcccgccucgaccucccaaagugcugggauuacagggguuagccagugugcccggccaaaaauugagaucuuuaaaagcuuuuuuuucuuuuuugaaauagggaacgcuucaugaauuugugucaucuuugcacaggggccaugcuaaucuucuuuguaucauuccaauuuuaguauaugugcugcuguaguaagcacuuaauggcaucuuaaagcaauuuuuugaugguucuuauggaaaaauaugacuuuuaugaaaaauagagcgauuucaucagcauuauguuauuaccaaaaguaaauuaaaaugcacacagagaaugcgauacuuuugaucuucuccauguuugaguacagaauaguggaagagugaaugugugccuaugguuaauuuugaggguuuguuuugaaaucuuguuccuuaauguaucuuauuuuuguuuaccugccaauggauagaaaaugcuugugaccacgugaauuuucacccacuugaauagauuacuuuauaauuucaucuauuacccugaagacagaauucaaugucauucuuaccuuuauauugucuucucacucagguuccucccauuaaaccuuaacacauaguucaguaaauagaaggugaacgaauuagugaaugcauaccccguuuuugccauccuacuagcuucauaagaagccuaauaucacaugcauagauuuguugaguucugggauaaauuuuuucuuauuuguuuuaccuucuuauuuuucagucacuggaggaggauccauggccaagggugaauucuaaggaccauauaccugcccugguucguagcaaugccuucucagagaauuuuuuagagguuucagcugagauagcucgagagaauguccaagguguagucauacccucaaaagauccagaaccacuugaagaaaauugcgcuaaagcccugacuuuaaggauacaugauucuuugaauaauagccuuccaauuggccuugugccuacuaauucaacaaacacugucauggaccaaaaaaauuugaagaugucaacuccuggccaaaugaaagcccaagaaauugaaagaaccccuccaacaaacuuuaaaaggacauuagaagaguccaauucuggcccccugaugaagaagcauagacgaaauggcuuaagucgaaguaguggugcucagccugcaagucuccccacaaccucacagcgaaagaacucuguuaaacucaccaugcgacgcagacuuaggggccagaagaaaauuggaaauccuuuacuucaucaacacaggaaaacuguuuguguuugcugaaaugcaucugggaaaugagguuuuuccaaacuuaggauauaagagggcuuuuuaaauuuggugccgauguugaacuuuuuuuaaggggagaaaauuaaaagaaauauacaguuugacuuuuuggaauucagcaguuuuauccuggccuuguacuugcuuguauuguaaauguggauuuuguagauguuaggguauaaguugcuguaaaauuuguguaaauuuguauccacacaaauucagucucugaauacacaguauucagagucucugauacacaguaauugugacaauagggcuaaauguuuaaagaaaucaaaagaaucuauuagauuuuagaaaaacauuuaaacuuuuuaaaauacuuauuaaaaaauuuguauaagccacuugucuugaaaacugugcaacuuuuuaaaguaaauuauuaagcagacuggaaaagugauguauuuucauagugaccuguguuucacuuaauguuucuuagagccaagugucuuuuaaacauuauuuuuuauuucugauuucauaauucagaacuaaauuuuucauagaaguguugagccaugcuacaguuagucuugucccaauuaaaauacuaugcaguaucucuuacaucaguagcauuuuucuaaaaccuuagucaucagauaugcuuacuaaaucuucagcauagaaggaaguguguuugccuaaaacaaucuaaaacaauucccuucuuuuucaucccagaccaauggcauuauuaggucuuaaaguaguuacucccuucucguguuugcuuaaaauaugugaaguuuuccuugcuauuucaauaacagauggugcugcuaauucccaacauuucuuaaauuauuuuauaucauacaguuuucauugauuauauggguauauauucaucuaauaaaucagugaacuguuccucauguugcugaauuuguaguuguugguuuauuuuaaugguauguacaaguugaguaucccuuauccaaaaugcuugggaccagaaguguuucagauuuuuuaaaauuuuggaauauuugcuuuauacugagcuuuugaguguucccaaucugaaauucaaaaugcucuaaugagcauuuccuuugagcaucaugccugcucugaaaaaguuucugauucuggagcauuuuggauuuuggauuuucagauuagggaugcuuaaccuggauuaacauucuguugugccaugaucaugcuuuacagugaguguauuuuauuuauuuauuauuuuguuuguuuguuugagauggagucucacucugucauccaggcuagagugcaguggcgugaucucggcugacugcaaccucugccucccggguucaagugauucuccugccucaaucucucuccccagaagcugggauuacaggugugugccaccacacccggcuaauuuuuuuuuuuuuuuuugagauggagucuagcucugucauccaggcuggagugcaguggugugaucucggcucccugcaaccucugccuucuggguuccugcgauucuccugccucagccuccugaguagcugagauuacaggcacgcgccacugugcccagccaauuuuuguauuuuuaguagagaugggguuucacaugucagucaugcuggucuugaucuccugaccucgugauccacccgccucgaccucccaaaguacugggauuacaggcgugagccaccgcauccggccugaguuuuaugcuuucaauguauuucuuacauuucaguucaagugauuuucaugucucagccuccugaguagcuggaacuacaggugcgugccaccaugccuggcuaaguuuuguauuuuuaguagagauggguuuucaucauguuggccaagauggucuugaucucuugaccucaugauccaccagccuaggccucccaaagugcugggauuacaggugugagccaccgugcccagccaacuaugccauuauuuaaccauguccacacauucugguuauuuucaauauuuugcagaagauaauucuugaucggugugucuuaugccacaaggauuaaaauauguauucauugcuacaaaacaauaucucgaaauuuagcaguuuaaaacaacaaauauuaucuccaguuucugagccucagaaaucugagagugguuuagcugggugauagucucgugguuuuggucaagcuaccaaccagggcuacaaucuuucgaaggugucauuggggcuagaagaucugcuucccgcaagacucacagcuguuggcaggagaccucaguuuguugccacauguuccccuccagagggccucucacaacauggcaguuauuuguccccagagcaagcaacaccggagggcaaggaagaagccaugauguuuuuuguaaccuagccucugaaagugucauaccaauucuguauuuuguuggucacacagaccaagucaacuacaacgugggagacuccuacacaaggcaugaauucuaggaggugggcauuuuuaagugucaucuggaaggaggcugucacaaccuggaaguuaaaagcauugauauucugaaauacagcguguauaacauuguuuuaguagggugugcaauaguuauguuuugguaauagcauuaaugaacaauguuauuuucaucuuccagacaucuggaagauugcucuaguggaguaaaacaucuuaauguauuuugucccuaaauaaacuaucucacuaacaa

SEQ ID NO: 192999 - RNA, 158692 nt, Homo sapiens
aguuggugcagcggcgguuggggugagagcgccuacgccaccccuccccuccuccggccccggcccccaccccgccgggcccagccccagccccggcccgggcuccagcccuaguacccgucccagcccgagucggguccgucccgugcgggcaggugccgccccucugccggcgacgccccgggccgcccgcccguccgcuugccaccauggagcuggaggacggugugguguaucaggaggagcccggcggcuccggggccgugaugucggagcggguguccggccuggccggcuccaucuaccgcgaguucgagcggcuuaucgggcgcuaugacgaggagguggucaaagagcugaugccgcuggugguggcugugcuggagaaccuggacucgguguucgcgcaggaccaggagcaccagguggagcuggagcugcugcgggacgacaacgagcagcucaucacccaguacgagcgggagaaggcgcugcgcaagcacgcugaggaggugaggccggcggcagggcgggggccgcgggauccgucuccgggggcggccggggcggggucgcggcccggucggggacuagaggcgcgacgggccuccuggagggcgggccugaggccgaugcccccugggaccgaucccggcggccuccagguaccccgggagccaggccggcguuggaagccgaggccggcuacugaguguccugggaagggagcgagauggaggaggcagggcccggggaggaagcggcagccuggccugaggacaccugggguuggccaagggcggagauuguugggugucugguugcuucuuguugagggaaguuuccgaccaccgugggauagucagauggcgguucaaaguuuuacccuuggggagggggacacuucugcccuggauauguaacuuccgcuaguuccaguaccuuuccaggggguugccuugcuuugggaaguuagagaucucccucuuucggucaguuucuucuugacguuuuaaucuuguugagaaagacgucuuauuuuauguucuaugugccuugguugacacuuugucaacuuuuagauguuguguggcaguacucaauaaauauauaaacaauuucguugguaucccaaaccaaagcauuccuccguaucagguuguaaccuuggacaguucccuucaaaaacccuccguuuauuuauaaaaaggauuggggggcgggguugggaagauguaggugacaguuggcaacacuuuuuccgucugaguuuccuucuuagacugcuguuuauacgugcauuuggccaccuguuaacucuagcacccgagcagugaccugggcgcccucaccucgacucugugaaccuuuuggaguucuagggugcaagugauagguccuuggcuucuugagacugacaaggaguuuagcuuucagccugcguuggcguuauuucuguggaccuuaucaaaggcaggugauguguccuauuuuuguuucucaagcaccuagcacaccugcuuaaauacauggugaucaaaggaggcgaaauaacuaauuauugaaggaaugacauaguauuuuucaaaaagacuugaagaguuuuuaggaugugagguuuguagcucauuuccugacacugaauaguaacaccauuaaauuuuuguuuuauuuugucacguauaccuuugcaucugguuaaauaguucuuuuuccuuuuuuaaaagcuugacuguagugaugauuuuuaguucugauugugggauccaauuuucucaaaggaaugcuauugaauuugccaaacaaaauugccuuuuuuuuuuuuuuuuuuugagacguagucucacucugucgcccagggugaagugcaguggagugaucuuggcucacugcaaccucugccugccggguucaagcgauucuugugccucagcuuccuaaggagcuaggacaacacuccccgcucauuuuuguuuuuuguagagacaggauuucuccauggugccuaggauggucuugaacuccuggccucaagugaucugcccacuuuggccucgggcugaccaucccagugcugggauuacaggcaugagccaccgcaccccgccagaauggacuauuucaagagcuuuuccuuucauauagggaaggaagggaugaaaaaccaaauaaugauaggaucacaauuuccgcuuguuuguuagcacucuuuauagaacagaggucaagugcuacuugcugcuucaugcucauauagccccuugccaguguguggauauacauggaagugacugggaauuaaccacauguacacacaggugacaagcaagccugacaugaccuuuuaccucacguaaaauaaaugcucccuccagccuuaaacuccugucaguccguguaaauaugggcaaaaugccagggucacacgugccaagaaaaccaucugccacagguugcagaaucagaaaacaaaauugcccgacugcuagacucuggguucccuauuaauuucuugaguaaaugacucuaaaaaaaauagguuauccaaugaauuuauuuguaguuuauauuuuuucaguuacaucuguaaauucuccauagugaaaccauugggcaaagggucaugaccugagaacagagaacauuuaugaaaugcuaaaugagcccacucccaggccacaaacauaaacacaccuuguuaucaguuuucuuuucucuuuuuuuuuuuuuuugagacagagucucucucugucgccaggcuggagugcaguggcacgaucucggcucacugccucccggguucaagcaauucuucugccucagccgcccgaguagcugggacuauaggcacgugccaccccgcccagcuaauauguauauauauuuuguauuuuaguagagacgggguuucaccuuguugcccaggcuggucuugaacuccugagcucaggcaauccacucgccucagccucccaaaguacugggauuacagaugugagccaccacacccggccaucaguuuucacauaagaucauaaauuguguguugcucaguauccagaaauugucucccuuuggccaauauguagagugaauucuguguuuaguuuucugugagugcuuuguuugcgccuuuuuuuuuuuuuuuuuuuuuuuugagacggagucuugcucugucacccaggcuggagugcaguggcacaaucuugacucacugcagccuccgccucccggguucaagcgauucugccucagccucuugaguagcugggauuacaagcacgugccaccacgccuggcuaauuuuuuuguauuuuugguagagacgggguuucaccauuuuagccaggauagucucaaucuccugaccucgugaucugcccgccucagccucccaaagugcugggauuacaggcaugagccaccgugccggccuguuugugucuuuaaugcggagaccaagagucuuuuauaccaaaguaagugccucaggguauuuacagcaaaagugauuugaaagcauggaaauuauccaucaccagagagaguaaaguaaauucugagcaccucuguggaaacuuagguggguauguagauagaauguuuuaggaaugugugaggugcuaugaucucuugcuugcaggaauucucagcaaggcaucaaaaauuuaaucuuuauauugauaggacauauuuugaauaccuucugacuuuuuccuuugcuuuuauuugaauuucuaguguggagcuagucugcuguuuuagggauucuuuaaaaacaaccuaaagaagggcuaauuuuagauagauuuggaccgguuucagaugcuaaucaagaaaucugucaucuuaucgcccaucacucucuccuuugggcugccugugacacaccucuccauucuuuaaccaagacccgucugaugccuuugcccaugcucuagaaugcucuccuuagaauuuuacauagcuagcuccucacuuucuacucuguuucaauuucacuuuuucagccagaacauccuguugacucuauccagaauaagcccugugaaccuauugaauaauuuauuuuaaaaucagugacuuuuaaauuuaaauucuuuuuggagacagagucucaaucgccuaggcugggguguaguggcacagucacaguucacugcagccucaaucucuugggcucaagugauccucuugccucagccuccugaguagcuaggaccacagacaugcguuaccacacugggcuaauuaaauuuuuuacagagacaaggucucacuguguugcccagucuggucuggaacuccugggcucaagugauccuccugccuuguggauccugccaaaguguugggacuuacaggggugagccacugugccccagcccagugauuuuuuaaaauaaaaaucuggauacaaaaugaucuggagagagagguuauaacuggguauguuaggguuuuucugcaacuucugauucuuuuaaaacaggcaugauuugcuguaacuuuuaaaaaagggccaggugugguggcucacaucuauagucccagcacuuugggaggccgaggcagauggaucacuugaggucaggagugugggaccagccucgccaacaugaugaaacccugucuguacuaaaaauacaaaaauuaucugggugugguggugggugccuguaaucccagcuacuggggaggcugaugcagaagaauugcuugaacccgggagauggagguugcagugagcugggaucgugccucuguacuccagccugggcaguagagugagacuaccucucaaaaaagaaaaaagaaaaaaaaaagaaacuucugaaaaguagacauacgaguuuaaagaaccuuuaggaauuuaguucuuagugauucugugggucuuuuauguuaucacuguuauucucaaagugagagcucauuuagcaucauucaguagagggagauuacacauaaaaacgaagaggcauugucuuccuuccuuuucuuuuucuuuucuuuucuuuucuuuucuuuuuuuuugagauggaguuucucuuguugcccaggcuagagugcaauggugccaucucggcucacugcaaccuucgccuccuggguucaaacaguucuccugccucagccucucaaguagcugggauuacaggcaugcgccaccacgccuggcuaauuuuguauuuuuaguggaguugggguuucugcauguuggucaggcuggucuugaacuccugaccucaggugauccgcccgccuuggccuccuaaagugcugggauugccacugugaaccaccgcgccuggcuccuucccuccuuuuugagauagacucauacaugcagagaauggacugaagagagaauaucuuuacugggaauggauuaugugauuuugugucugcuuuuuuguggccuuuugcuuuaaaaaaaaaaaaaaaaggaugaguucaagccugggcaacguagugagaccccucuuccccaaaaaccauaaaaaaaauuaguugggugugauggugugagccuguaguccuagcuacucaggaggcuaaggcaggaggaucacuuaagcccaggaguuugagacugcagugaguuaucauggccacggcacuccagccuugacaacagggcaagacccuguuucuuaccaaaaaacaaaacaauaggaugacugaaugcagaggugagagacacuacugagaauuuucuaacuuguucccauggaaucagcacuuaaagcaguaacaaaaugauuuuuguuuaaauggagacuuuugacacuucuugucuuuggaaguguaugaacaugggacccguaagacucaugggcaggaaaauagguauugacauucauuguucuuguuuuaguguucucauucauucauaauuuuuuuuuuuuuugagacagagucucacucugucacccaggcuggagugcaguggcacuaucccagcucauugcaaccucugccucccagguucaagcaauucuccugccucagcugccugaguagcugggauuacaggugugcaccacuacacccggcuaauuuuuguauuuucaguagagacaggguuucaccauguuggccagggugguguaaaacuccugaccucaagugauucaucugccucaaccucccaaagugcugggauuacaggcgugagccaccacacuuggcccacacuugauauuuuauuuuuuaauuuuauuuauuuuugagacugaguuucacgcucuguugcccaggcuggggugcagaggcacgaucuuggcuuacugcaaccucugccuucuggauucaagcaguucuucugucucagccuucugaguagcugggauuauaggcaugagccaccaugcccagcuacuuuuuguauuuuuaguagagaugggguuucaccauguuagccaggcuggucuugaacuccugaccuuguuaucugccuaccuuggccugccaaaguguugggauuacaggcaugagccaccaugccuggcccauuuuuuaaaaaauuuauuuuugagacagagucuugugcugucgcccaggcuggagugcaguggugcgaucucagaucacuguaacucccaccuuccagguucaagcaauucuccugccucagccucccuaguaguuugggauuacaggcacgcgccagcacgcccggcuaauuuuuguaguuuuaauagagaagggguuucaccauguuguccaggcuggucucaaacucuugaccucaggugaucccccugccucggccucccaaagugcugggauuacaagcgugagccaccgcaccuggccuaaaaaacacauauuuuaauauuuuuauagaucuuuugauugauugauugagacgagaucucacucuguugcccaggccagagugcagugguguaaucccggcugacugcaaccucugccuccuggguucaagcgauccucccaucucaacuuccggaauagcugggacuacaggaucaugccgccaugccuggcuaauuuuuguauuuuuuguagaaauggguuucccauguugcccaggcugaucuugaauauuugggcucagacauuccucgcaccucagccucccaaagugcugugauuacaggugugagccacugcacccaaccuauuuucuuuuguuguuguuguuuuuuuuuuuuuugagauggggucuugcuuugccacccaugcuggagugcaguagcgcgaucuuggcucacugcaaccucugccucccggguucaagcaguucuccugccucauccuccugaguagcugggacuacaggugcucacaaccacaccucgcuaacuuuuguauuuuuaauagagaugggguuuuaccauguuguccaggcugguauugaacuccuaaccucaggugauccaccugccuuggccucccaaagugcugggauuacaggugugagacacugugcccggccaaccuauuugcuuuuucuuuucuuucuuuuuuuuuuuuuuuuuugauauggcauuucacacuuguugcccaggcuggagcgcaauggugcgaucucagcucacugcaaccuccgccucccagauacaaaggauucuccugccucagccuccugaguagcugggauuacaggcaugugccaccauggccagcuaauuuuguauuuguaguaaagaugggguuucuccauguuggucaggcuggucucgaacucccaaccucaggugauccgccggccucggccucccaaagugcugggauuaugggugugagccaccacgcccggcagcggccaacauuuuuucauauuuuuaaaaauaccauuuuuuuuuucugaacuguuuguuuuugugauuuuuuuuuccuuugguuggguuuuuuuuuuuuucuuuuuuuuagagaugagguucaggcuggagugcaguugugcaaucauggcccacagcagccuugaccuccagggcucaaguagaucccacuuccucagccucugagcagcugugacuacaggcaugcgccaccaugccuggcuaauuuuuaauuuuuuuuguagaaacagggucucguuauguuaugcaagcugaacucacuauguugcccagucuggucuggaacuccugggcucaaguggauccuccugccuuguggauccugccaaaguuuuuuuuuuuuuuuuuuuuuuuuuuuuguugagacagagucuggcucugucgccagucuggagugcaguggagugucuuggcuugcugcaaccuccaccaccuggguucaagcgauucucuugcuucagccuccugaguagcugggacuacaggcgcgcgccaucacacccagcuaauuuuuguauuuuuaguggagaugggguuucaccauguuggccaggauggucuugaucucgaccucaagucaucugccugccccagccucccaaagugcuaggauuacaggugugagccacugcgccuggccuuuuuuuuuuuuuuuuuuuuguagagauggggucacacuguguugcccaggcuugucuugaacuccuggccucaagacauuuucuuaccucagccucccaaaguguugggauuguaggugugagccaccacaccuggccaugguuaacgauucgaauaauguucacacugccccuagccagaguagauagagauaugccccugcaccuagucauucagacacuuucugaaaugaacaaucuauguuuguuuucuggcgggagugggaugggaagggguaugguuguugcuuuaugaaauaauaauuuguuaguuaauuauuacuuaagcuccuaagacauuuuuuuuuaaagacaaagacuagcucuggauuaagacaucuuuuuuuaaauuugagauuucugaaugugaauaucuaaaugagauaccauuaugugucccugcuguagugacacucauauuuuuauuuaguuaaaaaucacaaaagaacgcuacgcaugguggcucaugccuguaauuucagcacuuugggaggccgaggugguggauugccugaggucaggaguucaagaccagcccugaccaacauggugaaaccccgucucuacuaaaaauacaaaaauuaacugggcaugguggcggacgccuguaauccaagcuacuccggaggcagaggaaggaaaaucacuuguaccugggaggcggagguuguagugagccaauaucuugccauugaacuccagccugagcuacagagugagacugugucuucaaaagaaaaaacaaaacaaaaaaaaaucacaaaagaggacaccaaacuggguauaguaccaaacugguucagaggguagauuaguagauugacuauucacuggauugcugaagugugugccauaggucacacauccaguucugugcuugagagaguacaggauuccugcuucuugaaaucuuuaccuuaccuuuaacuacaugcugcuuacuuauguuguacugaacuuugcuucucaggagaacugauguuagaaccuacccaaguuauuuugcucugcucugcacucaaugaauacagcuguuaucuaaauaaguuauuagguuguggucagaaauaucugcauagaccaguuuaauaauguauguaauguuauauauauuuaaaaagcuguuauuuggaaauggguauauauaaguucuguuuuuuacuuugaaaucuugaccagugauauuugauuauugcuuugaacauagcacuguguuuucuuuucuuuuuuuuuuugagacggagucuugcucugucacccuggcuggagugcaguggcgggaucucggcucacugcaaccuccgccuccuggauucaagcgauucuccugccucagccucccguguagcugggacuacaggcgcccgccaccacacccggcuaauuuuuuguauuuuuaguagagaugggguuucacugcguuagccaggauggucucaaucugaccucgugaucugcccgccucggccucccaaaguggugggauuacaggcaugagccacccacccggccauacuguguuuuauuuucuuaagaauuacagcauucaguaguuuggcauaauaggcacacccaaaaaugugugaggugaaccaugggaauuuauauauuaauguaauagagaaguaccaaguugaggguauagaauuuuauuuuauguuauuuuuuucgagacaaggucuggcccagguuggagugcaguggugcgaucuuggcucacugcaacuguugccucuugggcucaagccauccuuccgucucagccucccaaguagaugggacuacagguguacaccaccacgcccagcuaauuuuugauauuuuguaaagacggguuucaccauguugcccaggcuggucucgaauuugugagcucaagugaucugccugccucggccucccaaagugcugggauuacaagcgugagccaccacguccagcuaggguuuuuuuuuuuuuuuuguaagguuaguaaacuuuuucaguaaauccaccaccaccccucccagcuuuuuauuagguaaacuuucaaacauauagaaaaauggaaaguacauuugucauuuguauacccacuauauagauucaguaguuguuguuuuauuuaucugucuguauauguggauguguggguguggauacacauauacacacauacacauauuuaauugcugaaccauuuuaaauugcagacauacuuugccccucaguacuuaacauauuuaaauuacagacauuaugauacuuugccucucaguacuuaacauauuuaucuccuaaaaaaugagaauauucugccauauaaccaccauauuauuuacguuugagaacauuuccaaggccgaguguaguagcuaaugccuguaaucccagcacuuugggaggcugaggugggcggaacacuugagcucaugaguugaagaucagccuggguaacauagcaaaaccuugucucuacaaaaaauauaaaaauuagcguggugugguggugugugccuauagucccagcuacuuggggggccgaggcaggaggaucgcaccagccuaggaagucaaggcugagguaagauguguucaugccacugugcuccagccugggcaacacagugagacucugucaaaaagaaaagaaaagaaaaaaaagaaccuuuguaauaucaucuaauauuaauuugaauuaauuuuuaagagcacaguaugugucaguuauuauauagcuaacuagcuucuuaauauguuuauaaugaauuaaugaaacucaucugggaggaaguguuugcauuuuaguuacuuuucuauaagaaauuuaaauuugaggccggacgcaguggcucacgccuguaaucccagcacuuuggaaggccgaggugggcagaucacgaggucaagaguucgagaccagccugaccaacauggugaaaccccgucucuacuaaaaauacaaaaauuagcugggcaugguggugugugccuguaaucccagcuacuccggaggcugaagcaagagaaucacuugaaccugggagguggagguuguggugagcugagaucgugccacggcacuccagccuaggcgacagagcaagacuccaucucaaaaaagaaaaaagaaaaagaaaaagaaauuuaaaugugaaauauauaaaacggaauuaaaauuggcuaauuuuguuuuaaaauuagcacauuggccaggcgugguggcucaugccuguaaucuuagcacuuggggagucugaggcgggcggaucaccugaggucaggaguucgagaccagccugaccaacauggagaaacccugucucuacuaaaaauauaaaaguagcugggcuugguggugcacgucuguaaucccagcuacucaggaggcugaggcaggagaaucgcuugaacccaggaggcugaggcaggagaaucaugugaacccgggagguggagguugcagugagcugagaucaugccauugcacuccagccugggcaacaagagcgaaacuuuugucucaaaaaaaaauaaaaauaaauaaauaaaauuaucacauaaaaacuauuauggaccaggcacaguggcucaugcuuauaaucuuagcaguuugggaggccaaggaaggaggauagcuugagccccagaguuccagaacagccugggcaacauagugagaccguaucuuuacaaaaaauagaaaaauuagccgaguguggugguaugcaccuguggcuccagcuacuugagacgcugaggugggaggaucccuugagcccaggagguugagguugcaaugaccccugauugugccacugcacucuggcacacagcaccacuugcucugggugacagagcaagacccugucucaaaaagaaaacaaauuauuuuuccccuuuuugaaacuuugagauauagaaauacagaaaaugacccuauauuuaauauuuuugcuaguaacuauuuuuuuuuuuuuuuuuugagacagucuuucgcuuugucaccuaggcuggaguguaguggugcaauuucaucucaccacaaccucugccuccuggguucaagugauucuugugccucagccuucugaguagcugggacuacaggugccugccaccacacccagcuaauuuuuguauuuuuaguagagacgggguuuugccauguugaccaugcuggucuugaacuugcaaccucaggugaccugccugccucagccucccaaaaugcugggauaaccagcaccagccaccgccccauggccaucuuuuuuuuuuuuuuuucuuaaaucauguauuuccaggauaucuuguuucugacuuguuuaccuacucugccaggguuauagagccugagaaauucuuuuaccugcugauaagauuuccucugggguauaggccuggaauuuuuaugauucuggauucuauuacugccccccucccuuuuuuuuuuugagacagugucucaugcuauugcccaggcuggagagcaguguugcaaucagagcucacuguagccucaaccuccugggcucaagcuaucccccuaccuuagccucccaaguaacugagauuauaguugugagccacaugcaacaucuauuauugccuuuuuuuuuuuuuuaaccuuuuuuuugauggagucuugcugucgcccaggcuggagugcaauggcaugaucucggcucacugcaaccuccaccucccggguucaagcaauucuccugccucagccucccgaguagcugagaguauaggcgcgugccaccaugcccagcuaauuuuuguaguuuuaguagagaugggguuuuaccauauuggccaggcuggucucaaacuccuaaccuugugaucugcccaccuuggccucccaaagugcugggauuacaggcgugagccaccgugucugacuauuauugcccuuuaaaguguguuuucucuuguucuuccugcaguuuuaauuaaauuaauuaauuuuuuuugguagggaugggggucagacuauguugcccaggcuggucucaaacuccuggccucaaaugaucugccgccuuggccucccaaggugcugggauugcaggugugagccacugcauccggccuuccugcaguuucuuuuaaagagcuggacaggaacuuuaugauucucuaguucuaccuuaucccauucccccaaguagguggaaagauaaacagaaacauagaugcuuagaaagaacaaauauuuauugagccaggcucuguucuuuuucuuuuuuuuuuuuuuuugagauggagcacucgcucuugcccaggcuagagugcaguggcgggaucuuggcucgcugcaaccuccgccucccggguucaagcgauucuucugccucagccuuccaaguagcugggacuacaggcgugcaccgccaugcuuggcuaauuuuuguauuuuuaguagagacgggguuucaccauauuagccaggcuggucuugaacuccugaccuugugaucugcacacuucagccucccaaagugcuaggauuacaggcgugagccacugcacccggacuuuuuuauuuuuauuuuuaaaaauuaagacagagucuugcucuauugcccagacuggagugcaguggcuugaucuuggaucacugcaaccuccgccucccagguucaagugauuuucccacccuagcuuccugagcagcugggauuacaggcaccugccaccacaccuggcuaauuuuuguauuuuugguagagacaggguuucaccauguuggccaggcuggucuugaauuccugaccuugagugacccaccucccuuggccucccaaagugcugggauuacaggcaugagccaccgcgccuggcagaacaaggcacuguucuaagcccuggggauguagccacuaaugaaacagacaaggaagguagccuaucuugucuuggaguuuacauugcaauaaacaauaagcaaaccaguuaauuacagauugugauagaugugaugggauaaagacuagaguggcagguacuuuauuuuacuuaaaaauuuuuuuaaauuuuauuuuaucuauuuauuuugagacacggucuugcucugucacccaggcuggugugcaguggagugaucauagcucacugcagccucgaauuccuggguucaagugauucuuuugccucaaccuccugaguagcuaggacuacagguguaugccaucaugcccagcuaguguguguguguguguguguguguguguguguguguguguguguguguguguagagaugggggucuugcuguguugcccaggaugggcacuugaacuccuggccucaagugauccuccugccucugcuucccaaagugcugguauuacagacaugaaccacugcgccuggccauaauuuuauuuuuuuuaaccaagcaagcagcagugaagagguaggcacuuuagauggaacaaacaaguuaauaaagguuaagcuuuaaguguuuuuucuuuuucucuuuuuuuuugagacagccugcucugucgcccaggcuggagugcaguggcgcaaucucggcucacugcaagcuccaucucccggguucacgccauucuccugccucagccuccugaguagcugggacuacaggcgcccgccaccaugcccagcuaauuuuuuuguauuuuuaguagagacgagguuucacuguguuagccaggauggccucgaucuccugaccucgugaucugcccaccucgccucccaaagugcugggauuacaggcuugagccacugcgcccggccaagcuuuaaguguuuuuucaagcuacuggggaagaaaagggaagaagaaaagguuaagcugcucuuucagcaaauaauucauuucaucucauaagauaauuauuuagaucugaaacuuuagauacauauucagagugucuccuacucauuauucuugaacauucagaaaaguuagcucucauaaaugccugucuuguuuucuaucuuauuccuucucauacuugaugucucagcaguguuuuuuggcuacuucuuccuuugagaaacauuacauuuaguuuguuugacuuugaaauuccuuggcuuuccucuuaccuacgugaccauucuguggauucuucuuacucagaugaauguugugcuccugggcuuucuuucuaagaauuucuauucccagggguucaauuuaccauuuguugauuauuacaaaauguuuaaccuacucaucuaacagauuuuauuuauuuauuuauuuauuuaucuauuuauuuuugagacagagucucgcucagucgccuaggcuggagugcaguggcgugaucucggcucacugcaagcucugccuccccaguucacaccauucuccugccucagccucccgaguagcugggacuacaggcgccugccaccacacccagcuaauuuuuuuuuuuuuugagacggagucucgcucugucgcccaggcuggagugcaguggcgcgaucucggcucacugcaagcuccgccucccagguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccuuccaaagugcugggauuacaggcgugagccaccgcacccggccuauuuauuuauuuuugagauggcguuuugcucuuguuacccaggcuggagugcaauggugugaacucgccucgccaucaccuccaccucccggguucaagcgauucuccugucucagccucuggaguagcugggauuacaggcaagcgccaccacaccuggcuaauuuuguaguuuuaguagagaugguguuucuucauguuggucagacuggucuugaucucgcgaccuugggugauccguccaccuuggacucccaaagugcuagaauuacagguguaagccaccacgccuggccuuacagauacuuucauugagugccaacuaugugcaugauacugugcucauugggcauacaguggugaguaaaacagacaagguccuucucucauggaacugauagccuacuuuaaggccagaucucucucuggaguuucagauucaucuuaugauuguuuauugggugugaauaucucccagcguguccaaaacugaacuuauuucccaaaccugguucucuuuucuucccuaucuucaugaaggauaccaccaucuaccuggccagaaaucagguuaccaucccuaacucuuccucauucccauugcugcuuucuuuuguuuucaacuuuuaaauauugcuggaaucucauuacuuucuaaauccauuuauacuacugugguacaggacaccaauaucgcucacccugaaugcaaacuccauagaccuggaaguuugucauucaccacuauaucccaguagcuagcacguugaaagugccagggaaauuuuucugaauagaugaauggacaacugaaacuaguccauaacugauuuuucugcuuccaguauggccaaccuauaaaccgcccaucucuccaaaauggaaaucugaucagaucauuccacaagcccuuaguggcuuuuucucaaauuccugggcucaagugguccucucacuucagcuucucaaaaugcugagaauacagaugugaggcaccgugccuggccaguugcucuuucuaaagcucuugaaaaugacuuaaguuccuaacauacaagaccuugugaucuggcugccccaaucuugucagucucaucuguuucuuuuugagccacagugaacauuuugaauuugguuuguaaaaaguauccucucuccaggccuuccuaaaagcugucccuuugcuuggcacucacuuucucuucuuuucuguugccuuauuuuauuuaucuuucagguuucaauucuggaaagccuuaacacccgacugugguuugggcacauuuuauauccuuccacagcuuacaguccucuugcccucuuguagcacuuucagcgcugugucaaacuaaccuauugcuuuuauucucccaccaacuaggaugcaguagauaauuaacagaaauuuguugguuggauggauggauaugcuaaaggucaaauugcuaagacuaaccauuuaaaguucucuuugugcauucaaauuaucguuccuacuucuggugccaaguuaugcuaaaacuuccaaaaaguuuuucaauaaguccuuucacuuuugcauauacagaaaaaccaugacuucuccuggguauaauuauuucagacuuauuucagacacuuuaccuacauugccuuauacuuacuauucuguaaauauuuaugcauuuaaaaaaucuaaauguuaagaucauuggaauuacuuucagaaguauuguaggaauucaagccggguauagcaacacacgccugaagucccagcuacucaagagauugagcccaggauucaaggccagcugggcaacauagcgagaccccaucucuaaaaauaacagugauaauauuaauaaugccaggugcaguggcucaugccuguaaucucagcacuuugggaggccgaguugggcagauuauuugaggucagggguucgagaccagccuggccaacaugguaaaaccccaucucuacuaaaaauacaaaaaauuagccaggugugguggugcacaccuguaaucucagcuacuggggaggcugaggcaggagaaucgcuugaacccaggagguggagguugcagugaaugaagaucaugccacugcacugcagccuugggugacagagcgagacuccaccucaaaaaaaaaaaauuuccauacaaaugaagauuaagugccaaaacuuaauuuuaacucuucguuucuucucuuauguuagacauuucuauuuuuuucuuuucuuuuuuuuuuuuuugcagacagagucucacacugucacccaggcuggagugaagagucaugaucuuggcucacuguaaccucuggccuuuagguucaagcgauucucgugccucagccuuccaaguagcugggacuacaggcgugugccaccaugccuggcuaauuuuuuguauuuuaguauuuuauguuuuuuguauuuuagagacgggguuucaccauguugcucagccugguaucaaauuccugagcucaggcaguucgcccaccuuggccucccaaaaugcuaggauuacaaaugugagccacugugcauggcccauguuagaccuuucuaaucaggauucagcaguaccuuagaguaacagauaaaauggugaguaaaacaacauuuauuucugaagaaaacauuuguucuaaagaaaaauaaacaauuauuuuugggggcguggaaauccauguugguuaaaagccugugcuagacuauuaugguauaggccaggcgcgguggcuuaugccuauaaucccagcacuuugggaggccaaggagggcagaucaccugaggucaggaguuugagaacagucuggccaacauggugaaaccccgucucuacuaaaaauacaaaaaauuagccaggcaugguggcgggugccuauaaucccagcuacuccggaggcugagacaggagaauugcuugaaccugggagguggagauugcagugagcugagguugcaccauugcacuccagccugggcaacaauagugaaacuccaucccuccccugucccccucaaaaaaaaaaggacuauuaugguauaaaucaaauuucuaguuuuaauuauguacuccucaauuuugaauuuucuuucaguuaccuguucuagccuagccacauuuuguuacugcuaccugucagaaacaaauaccuuuuuuguuuguuuguuuucuauuuuuauuuuuugccaggcaucagaugauggcaaaacaaauaccuuuuuaaagguuaagcaguuuuuucaaaguguagcaucaaaccagaaagguaauuuuuuuuuuuuuuuuuuuuuuuuuugagacagaaucucacagugucacucaggcuggagugcaguagugcgaucucggcucacuguaaccucugccuccuggguuugagcaauucuccugccucagccucccaaguagcugggacuacaggugugcgccaccaagcccagcuaauuuuuguauuuuuaguagagacgguguuucaccaaguuggccaggauggucuugaucucuugaccucgugauccaccugccuuggccucccugaaugcuaggauuacaggcaugagccaccaugcccagccccauaagggucacuuuuaaaaagacgauugccuaugguuucucugugaaaauaguccauuugaacuuguuugauguaauuuggacacauuuggcagaaauuacacacucauuuuuggcuuuguuuaguuuuaacuuuuuuuuuuuuagacggaguuuugcucuuauugcccaggcuggaguacaauggcgcaaucuuggcucaccgcaaccucugccccgccagguucaagcgauucucuugccucagccucccaaguagcugggauuacaggcaugcaccaccaugccuggcuaauuuuguauuuuuaguagagaggggguuucuccauguuagucaggcuggucuggaacucccaaccucaguugauccucccgccuuggcgucccaaaguaccagauuacagaugugagccacugcaccuggccauuuuuuuuugaaggcagggucucucuguccuagacuggagugcaguggcacgauuauggcucacugcagccuugacuucagucucaugugauccuuccaccucagccucccaaguagcagguacuguagguacugucacaaguauuauaggcaucaagccagacaccaccauguccaguuaauuuuuguaauuuuuguagagacaggaucucaccauguugcccaggcuggucugaaacuucugggcucaagcagucugcccaccuuggccucccaaagugcugggauuauaggugugagccacugugccugacccuaguuuuaacucuuuaaaaaauacuuuuaucuugggauaggaauucaguccauaauuggcucaguuuuaaccauccuuaaccuagccaagggccaggaauuaaacagaauucucagcagccaaauuaaaugucucaagcauuaaaguuuguuaucuuggcuuacugaagaaacauuuaagugcaaagugcuuauuuacccuuauuuuauuuuuauuuuuuuggagacagagucucacucuguugcucaggcuggagugcaguggcacaaucucgguccauugcaacucccgccucccagguucaagugauugucuugccucaggcuccugaguagcuggaguuacaggugccuuccacaaugccuggcuaauuuuuuuauuuuugguagagacaagguuuugucuuuuuggccaggcuggucucgaaguccugacuucaggugauccaccugucucggccucccaaagugcugggauuacaggcgugagccacugcgccuggcugggucuuuuuuaagauaacaauuucuaguuuuuuuuuuuuuuuuuuuuuuuuuuuuuuaguaauagaagaauauuuucauaacagagucaaguguugaagcaaaaaccacagugucaggauugaagaucuguaaauuaaagucagaaauguaagauguuggccauauaccuacagaagcacauaacuguguaacaaaguuaguaaggcaucacuuggcugauguagcaaacaucauaacacagguagagcauuccuagucugaaaaugugaaaucugaaaugcuucaaaaucugaaacuuuuugcaugcugagaugacgucacaaguuacuuugaacauacuacuauuucacuguauuuuuuuuccuuuuuuuuuuuuuuuuuugagacagaguuuugcucuuauugcccaggcuggagugcaauggcgcuaucucggcucacugcaaccuccgccuccuggguucaagcgauucuccugccucagccucccaaguagcugggauuauaggaaugcgccaccacgccuggcugauuuuguauuuuuauuggagacgggguuucuccacguuggucaggcuggucucaaacugcugaccucaggugaucugcccaccucggucucucaaaguguugggauuacaggcgugagccaccacgccuggccaauuuucacuguaguaaugguacaucauauucuuuuuuuuuuuuuuuuuuuugagacggagucucgcucugucacccagccuggagugcaguggcacuaucucagcucacugcagccucugccuccuggguucaagcaguucuucugccucagccuccccaguagaugggaccacaggcaagcgccgccacacucggcuaauuuuuguauuuuuaguagagaccggguuucagcauauuggccaggauggucuugaucuccugaccuugugauccgcccgccuuggccucccaaauugcugggauuacuggcgugagccacugugcccggcccaaaguaaccaauucuuuaaacccauccggcugggcacaguggcucaugccuauagucccagcacuuugggaggccgaggggggcggaucaccugaggucagaaguucagaccagccugacaacacagagaaaccccgucucuacuaaaaauacagaaaauuagucuggcgugguggcagaugccuguaaucucagcuacuggggaggcugaguuaggagaaucgguugaacccuggaggcagacguugcagugagccgagaucacaccacugcacuccaaccugggcaacaagagcgaaacuccgucucaaauaaauaaauaaauaaguaaaaacccauuuacccccacaggcuugugagacugguuggaagaagugcugcuaggcagggccuguguguuuggaaaaaaaaaucacucaggguguuugugauuauaacugucucacccuucccucuaauucagaaaccauugcuuaagaguggaaaaaaaaaaccacgaacugucugucuucugcucucacaccaaaaacaaucagcccgcuguauuuguaguucaugagcauggugauuggguguucaugcaggugugugagauaugccacccuugaaccuuguuacaacacuggcacauucucagaccugaaaaaaaaaacacacauaacacagaagacuucugugaccaaauaugugggguagggcaggugcaguggcucaugccuauaaucccagugcuuugggaggcugaggcagguggauugcuugagcccaggaguuugaaaccagccugagcaacaugaugaaacccugucucuacagaaaaauacaaaaauuagcugagcaugguggcaugugccuguagucccaacuacuuggaaggcugaggcaggaggauugcuugagcccugaaggucgagguugcagugagcccugaaggucaagguugcagugagcugggaucgugucaccugcacuccaacccaggcaacagagugagacccuaucuuaaaaagcaaacaaauaaaaaaauaugggaguguuuuucccuaccagcaagcaaucaguucugcaucaggcaccagcuaggugucaucuaacuuaauacugacacugucuacuugagauagugucacaucccacaguuugaggucucaguccccaagacuaccgacaacacuuaugccaaucucaagccucagguuauuuuaccugugcuucugaccaaccugccauguauauauauguacauauauauguauauguguguguguguauauaauguagauaccauaauuuuuuuucuuuaugagaugaaggucuugcuguguugcccaggcugaucuugaauuccugggugcaagcugucuuccugccucagccuccgaaucacugggauuacagucaugugccaccuugcccagcuacugucuuuuauuuuugaugaauccucuguguccaguacagucucaacuggcuauaaacugggguucccacaacccccuccucagguucaguugacuugcugaaugguuugcagaaccuggggaaacaguuauguuuacuguuacaaaggauguagaugaaaagaugcguaaagcaggguauggggguaguggugcagagcuuccaugcccucccuguacaugucacccugcaggaaccuccauguguucagcuaucuggaagaucucucaaccuuguucuuuugaguuuuuauggaggcgucacuacguagguaugaaaccauuggucauuggugaucaacuucaccuucagccccuuuccccuccugggagguuguguggggugggcugaaaguccuaacccucuaauuaugcuuuuggucuuuccaaugaccagcucccauccuuaagcuauguaggggcugccagccaugaaucuacccauuaacauacaaaaagacaucucucuggagauucuaaggauuuuaggaauuauauuuuaggaauuauauguuaggaaacugggucagagaccaaauacguauuucacgauaucacacuguuacauucuuauauaaucuugcauuuuauuuuuuuuuaccuguugaucuguccauguugauauacauaugcaucuaauucuuuccuuuuaacugcuguguauuccaucgaugacaugaauauaccacuauccauucuucauuaccacauuauauauuacaaauguuguuguaguaacauucggugcauauguaagaucuucucaaaguauauauuuuagaaauaggaugccagguuuuaggauauguauuuguaaaauuaacuagauaagguaacauugcuugucaaaggagugcagugauuuauauuccuaucaguaguauaaaagacuucuuauuuucuuguaucuuugccaacacuuccugcacuaucagacuuuuugguuucuguugccugucugaugugguugaaaccacuucuuucuuucuuucuuuuuuuuguuuuuuuuugagacagagucucacucugucacccaggcuggagugcaguggagcagucuuggcucacugcaaccuccgccuccuggguucaagcaauucugcugccucagccucccaaguagcugggacuacaagugcaugccuccuccaugucuggcugauuuuuguguuuuuaguagagucaggguuuuaccauguugacaaggccggucucgaacuccuaaccucaaaugauccacccaccucagccucccaaaguucugggauuacaggugugaaaccacuuuauauauauauauauaucacuauauauauauaucacuauauauauauaucacuauauauauauaucacuauauauauaucacuauauauauauauaucacuauauauauauaucacuauauauauaacuauaucacuauauauaucacuauauauauaucacuauauauaucacuguauauaucacuauauauaucacaucacuauauauauaucacuauauauaucacuauauaucucuauaucucucccuauauauaucucacuauauaucacuauacguauaucacuauauauaucacuauauguauaucacuauauauauaucacuauauguauauaucacuauauguauauaucacuauauauaucacuauauauauaucacuauauauauauauacacauuuuuuucuuuuuuuggagauggauucucacucugucgcccaggcuggagugcaguggcaugaucucggcucacugcagccuccaccucccagguucaagugauucuucugccucagccucccgaguagcuggaacuacaggugcgcaccaccaugccuggcucauuuuuguauuuucaguagagaagggguuucaucauuucucagccuuuggcuaagaucaagugagacgggguuucaccauguuggucaggcuggucuugaacuccugaccucaugaucugccccuucagucucccaaagugcugggauuacaggcgugagccaccgugccuggcugccacuuuuuuuuuuuuuuuuuuuuuuuuuuaaagauggagucucacucugucccccaggcuggagugcaguggcgaguucucggcucauugcaagcuccaucuccuggguuccugccauucuccugccucagccucccgguagcugggacuacaggugcccgccaccacgcccggcuaauuuuuuuuguauuuuuaguagagacgggguuucacaguguuagccaggauggucucgaucuccugaccucgugauccaugcaccucggccucccgaagugcugggauuacaggcgucagccaccgcgcccagccuggccaccacuucuuauuuuaauuugcuuuugucagaucaguagugugcuugagcauguuuuacauuuacuggugauucuacuucucugugaauugccuauucaguuucauucacugauaacuggcacaaacuaugucuggaaguacauagcuauauauuuuuaaugguuuuauaguauuccauuauaggaucaucacuuaggugaaaaggaucauuacuuggggaauccagaguuuaaaagagacuuaagagauauauuauccaaauguaauguaugaaccuuguuuggaucuugaguguaaaaacauauaugagacaaccuggaaaacuggauauuccuuauuauaucauuagggguugggaaauggugcuauuucaauccaguuauuccuucaacauuuaucagcuaaauuuucuuguaaaggaaacuuccccucaucaacuguuugguuacccuaagguauaguuuguauauaagaaagacaaaaagugcuggauucgucaauucauacuuuaauaauuuccaagugcucuuuccuguuuuguuucccuccucacuacuuuuaaaaauagcauacuauucugguuccaugggagcaaugacuuuucuuuggucucugaguauauuaauuauaguuuucauuuguucccugcuuugucuguuuugucagagucccauuuuuauuucuuauaguuuugguuucucucuuucaggcuagaacuuaaagugccuuauaauucuuaauuauccuucauguuuuaaaagugagacacuaaaaaaggaggguuggaagcuuugugugccuggauacaguuuacugccucuuggcaacccagauuucaauaucccaugguccuuucguagagacacuugaguuuuuccagagaaggauagucucuuugagguguggcugguggagugguagguaagccuagauauuuacauuauugcaaccuggaugaaggcaggaaggaggcccuauuacuguuuaguacguagacuuuagaccuucauguaauuccacuugucauuuggcaccugccuggcugugccuagaguguuccuagucuaaaauuucugguugaguuuauugagaaaacaaaccucuuauuuccugugugggugagcaaggaaggccaccuggccagucuggugugggacugucuaccuacuagggauauuacuaacuagugauuuuagacuuccacucaacccuccuguuuucagucccacccucacacaccacaccaguuuucuauuacauacuuuccauaguauggaucuguuauaauuuucuuuuuuuuuuuuuuuuuuuuugagacggagucuugcucugucgcccaggcuggagugcaguggcgcaaucucggcucacugugagcuccaucuccuggguucacgccauucuccugccucagccucccgaguagcagggacuagaggcacccgccaccacgccuggcugauuuuuuuaguagagacgggguuucaccauguuagccaggacggucucgaucuccugacuuugugauccacccgccucagccucccaaagugcagggauuacaggcgugagccaccaugccuggccagaucuauuauaauuuucuuauccacugucuguugauagacauuuaaguuaucuuccaguugugaacuguuacaaauagcccuucaaugaaugucuuuguacaugccccuuucugcauauuugcuuuuuaauggcaggacaaacuuuuuucauauuaaacaccacugauacuuuuauuccaauaauuuauuuucauuuuuuuguuuuuuuuaaaaagaggguuuugcuauuuugccuaggcuugucucgaacuccugagcucaagcaaucuguccaccucagccucccaaagugcugggauuacaagcaugagccacuaugccuggccaacuuuuuuuuuuuuuuuuuuuuacagaaauaucuaaacauugaugauuaccgagaauaguagaauauauuugaacucccauauacccaucauucaacuucagcaguuaccaacaaaaugccaauauuuuuucuuuagaaaaaaaaauuuuuuaagagacauuugcuugcucuguagcccaggcaggcgugcaguggugugaucauagcucacugcagcuuagaacuccugggcuaaagcaauccucccaguuuagcuuccugaguagcuagaacuacaggugucugccaccacguccagcuaaauuuuucuuuuucuuuuuuucuuuuuuuuuuuuuuuuguagagacaagggucucucuauguuccccaggcuguucucaaacucucggccucaagugaucuucccaccuuugccucccaaagcacugagauuacaggcgugagccacugugccuggccaaaccaauuuuucaccauaauauuaaggcagaccaaagacuauaucauuguaucuuuaggagauagggcuguuuaacaaauauaaccacaacaccauuaacacaucuaaaacuuauaaacaauuacucuuuaauaauauuuaauacuuaauaaguguucauauuucccuaauugucucuuaaauguaguuuuguaguugguuguuuucaaucaguaucuaaacaagagagucuauacauuuauacuugguucaauaugucucaaguuccucuuuauauaaugguucuuuuuuucuuuuuuuccccacuugacauuuauuguagaagaaaccaaaucauuuguguuaaaaaauuuuccacauuuuggacuuggaagggauuauaucccuugaguguuauuuaauauggucuucaauccugucuuauuucuuaaaagaaauuacauuuaaaaacaauuacauuuaacuaauuaauauaauaucuugauggacacuuaauaagccagcccuuuauuugauacuauuuuuuagacaaguacuauagucaaaguauuuaaauggcuauucuuuuucuuuucuuucuuuuuucuucugcaucuuuacuccaacaagcaacaaccuuuagggaauuuuuuuuuuuuuuuuuuuuaacuuugggagcuugucuuuucaaaguauucauuuguuuuuccccagaacaguggggcgaaacagucccuauaagccaucuggacuuaaaagcauuuugcuucaucacaaagcuuacucuuuuuagauccugacauaagucuguauuguccacugauuuuuuuuuuuuuaacggugucuaguugcucccaggagaguugucugaagucacuuuaauguuguugcuggccuauuaguuauugaaagggaagagggguauuuagugaagauguguuauuauaccugcugaaaaagcucauucacaggcccuuaaucccccuaguccuuaaaaaaaaguggguaugugugugagaaaaacagaaaaggggaggaguaugugcguuucauaccaacauaccugagugaucugacaaaugcuugugcugaggggacucucuggaauuuccagggcuaaugugguuuuauaauaugcaaacaacaacaacaacaacaaaaaaacagaaaaacaaacaaaaaaaacugcugcgcuucuccugccacgauuuugcuguuggccuaacccuaucgugguuauucuaagguuugccaagcguaguagagggugaccaacuuauaaagucaugccacuggcaagcaauuaagucacauuaaaucauuaaugacuauccuagacuuuuuaugagcauucauuuccuuuuuuuuuuuuuuuuuuguauacagggucuugauccgucgcucaggcuggagugcaguggcucacucucagcucacugcaaccucugccuccugggcuuggugauccccucccaccucagccuuugaguagcugggacuacagaugcacaccacuacaccaggcuaauuuucauauuuuucguggagacaggguuucguggagacagagucauauugcccaggcuggugucgaacuccugagcuugagugaugagcccuccuuggccucccaaagugcugggauuauacaagcaugagccaccgugccuggccugugcuuuuucuuguucacauauguaauuucagugugguuacauuauaugcagacuugaacuaugugauuuuuaaaaguuucauuucauauucagaguuugaaauguuaccuucucauuucagaaagucuucagaaaucauguuauaugaaagccugacugagcuguaaaccaauguugugcuguuauccuauguugguauuaccuaggcaguaacagaaauaucagccaucucuuaucagccuuaaccucaauuaggugacuguugaauuaugcaagaucuuuuguaaaucgaucuuuuuuauaaaauguaauuacccaugauuaagaccuuucaucuucuguuaaauuucaaucaauagaacauagggcucucuuguaacuuacuacauuucccaguaccuuggaauauuuaaaacaauaggggcucaaguuguguuuugaaaagauggaugaauguaaucuuuuuuuuugagauggagucuugcucuguugcccaggcuggacucggcucacugcaaccucugccucccagguucaagcaauucuccugucucagccuccccaguaccugggauuacaggcaucugccaccacaccuggcuaauuuuuguauuuuuaguagagaugggguuuugccauguuggccaggcuggucuugaauuccugaccucaugaucugcuugccucggccucccaaaaaugcugggauuacaggcuugagccaccgcaccuggccaaguggaaucuuacuugucuuuuuuacucgcuuugugaaucagagagauucucaacuuauucuuuaguuuauaguuuaccuuuacaucgacucaaaauuuaauggugaauuguaguuaccugggcaugccaugaucuuuagacguuugcaugugcugugaccucugccuggaaugucuuuaucucaguaaagguuuuaggcaaaccauuccuuuuagaguaagcuaaaaugacuucucucuuuuuuaaaaaaauaguauauauggccgggcacgguggcucacgccuguaauccagcacuuugggaggcuaaggcagguggaucaccugaggucaggaguucgagaccagccuggccaacauggugaaaccuugucucuacuaaaaauacaaaaaauuagcugggcaugguggugggugccuguaaucccagccacucgugaggcugaggcagggagaauugcuugaaucugguaggcagagguugcagggagccaagaucaugccacugcacuccagccugggucacagagcgagacuccauaucaaaaaaaagaaaguguguguguguauguguauauauauauauauauauauauauauauauauauauauauauaaaauaaaguguauauauauacauauaauaaguagauauacacauauauauuauaauuauauauauauaauuuuauuucaauauuuuuuggggaacagguaguuuuugguuacauggauaaguucuuuaguggugauuuccgagauuucggugcaccugucgacuucuuuuuuguuuguuuguuuuuuuguuuuuuugagacagaguuucacucuuguugcccaggcuggagugcaauggcacagucucaccucagugcaaccucuaccucuuggguucaagugauucuccugccucagccuuccaaguagcugggauuacaggugcccaccaccaggcucagcuaauuuuuguauuuuuaguagagacagggcuuuaccauguuggcuaggcuggucucgaacuccugaccucaggugguccaccugccucggccucccaaagugcuaggauuacaggcaugagccaccgugccuggcccaacuucuguuuuuuuuuuguguguguguguuuuguuuuguuuuguuuuugagacagaaucucccucuguugcucaagcuggagugcaguggcgcaaucucgcucaccgcaaccccugccuaccagguucaagugauucuccugccucagccuuccgaguagcugggacuacaggcgggugccaccucgccuggcuaauuuuaguauuuuuaguagaugcgggguugcaccauguuggccagaguggucuccaucucuugaccacaugacccaccugccucggccucccaaagugcugggauuacaggcgugagcaacugugcccaccucccauuuuuuuuuuugagacggagucucacuguguugcccaggcuggagugcaguggcacgaucucggcucacugcaagcucugccgaccaaguucaugccauucuccuaccucagccuccugaguagcugggacuacaggcgcccgccaccaaguccgccuaauuuuuuuuguauuuuuaguagagacgagguuucaccguguuagccagguuggucucgaucuccugaucucgugaucugcccaccuuggccucccaaaguacugagauuacaggugugagccacuguguccagccuugacuucccuuuuuuaaagcagauuuagucacuucuuccucucugcuuucauuauagcacuuagcguguuacacuguaaauguuuaugauacgucuuugauggcucucauacagugaguacuccuauuggaugggugggcaaagaguuuuaguuuuauauuuaacauguuauuuuaucuaagaauaaguccuaugaaugacauuaccuaguuuguaguaaauaucaucaugcugccuaacugccuagcauuuggagaauaggcauugugaauagguguguggcuuaacuauuacaacagcuuuuuccuagucucuuaacuaugacaaguuuuucuuugacuacagagugacggacugggauguuuccuauuuuuguuaucucaguuaguguguuaaguggaaauuauagaaguagaaggcagacauguuucuuugaaguaaaucaagaagacuuuaaaaagagggucagggccaggcauggucgcucaugccuauaaucccagcacuuugggaggcugaggcaggaggaucgcuugagcucaggaauucgagaccaggcugggcaacauggugagaccuugucucuacuaaaaauaagaaauaaaaaaaauuuagcuggguauaguggcacaugccuguagucccagcuacucagaaggcugaggugggaggaucgcuugagcccaggaagucgaggcugcagugagccaugauuguaccacuucacuuccagccuggaugacagaacaacaccucaucucuaaaaaauaaguaaaugaaaauuaaaaauuaaauuaaacaauaaagaaggucagccaugcuuguacuauacaaaccuaguaaugagguucagcagaacucaugugcuaccagcccaacuaagaucucugaauguagaagggaagcagaaagcccugagaacuuucuuuuuaguguaacccaugccacucauugcccaaguauuuuguugauaguaugaaaagguuagguauagagacaaagaaacuauucucauuacuucccuuaugcuauaccuccagccuucauccaggaaaaaagaggacucuuacuaggaccacgaauccaaaccuuuuucugccaagagcuguauuuuggcaucuguuugaauuucaugacaccgucucuguuucuauuccuguuuucucauucauaaauucuuauaucaauguuucccacuuucacaugauugcuaauugcuauauagagcuaugccauuucugaaguauuuuuguaauuaugaguguucugcuuucugagcuauucuacccuacagcaacuucuguuuaugagguuaccuauauugucagggauauuucucaaaacaguggcccaaaacuagacuauuugauggauauuuuucuuggauagcaauuuagaaacuuccagucacuuguuacuuuuucuugauucuugauuauucuuugaaaguuaguauuacauuuauccuacucagcuuucagugcccuguguaagcuauuagggaugucuuaucagaacugaggaacuuuuauuuuuguugcauauuagugauuagcauuuuauuuuuuauuuuauuauuuuauuuauuuuuugagacggagucucacucugucacccaggcuggagugcaguggcaccaucucagcucacuacaacuucugccgccuggguucaagcaauuuuccuaccucagccucccaaguagcugggauuacacacaccugccaccacgcccagcuaacuuuuguguuuuuaguagagacugaguuucaccaucuuggcuaggcuggucuugaacuccugaccacccaccuuggccucccaaagugcugggauuauaggcaugagccuguaauuuuuggagacagagucuugcuccauugcccaggcaggagugaaguggugggaugucggcucauuacagccuccaccuccuggguucaagcgauucuugugccucagccucccgaguagcuaugacuacaggugcaugccaccaugccuggcuaauuuuuuuuuuuuuuaucguguuuucaguagagauggggucucaccauguugcucaggcuggucucagauuccuaagcucuggcagucugcccaccucggccucccaaagugcuaggauuacaggaaugagccacugcacauggcugugauuagcauuuuaaaugaggauggcagcuguacguuuccaaaccaagacuuaauacacauuuaaaauugggauuuucagccgggugugguggcucacaccuguaaucccagcgcuuugggaggccgacgcaggcagaucaccugaggucaggaguuugagaccagcccagccaacauacugaaacccugucucuaccaaaaauacaaaaauuagcugaguauggugaugcaugccugauucagcuauggugauucagcuacuccagaggcugaagcacgagaacugcuugaacccaagagguggagguugcagugagcugagauugcaccacugcacuccagccugggcgacagagugagacucucugucucaaaaaaaaaaaaaaaaaaaaaaaaaugauuuccaagaggauaaaaaauuauuuuuacaaaaucaaccucaauaguguuuauaaauggggaaaaauccuccuugauuucuuuuagaacuugaagaugcacugauaaauguauauagcuuugaguuucaccuauuuaucuuucuggguauaagaucuguuuucacaauauacucaaaagaguuuaugauuccaagaaguuuaagaucuacuuagaacaagaaaggagaaaaugugcacacguuugugaaagacaacauuccauuuuguaaucucuaaguuuaucuguuuuaauuuguuugaaggaaaugacucaaaguauguauuugcuuugaaauauuuuuauuauugcucguacuuuccugugaaaggaaacuaaagaaacgagauuucucuuuggagauaauagccuugccaauccaagaccugucacaucacuuaaaaaaaaaucucuuuucucucugccauauuuauuuaaagugauauagauaaaaagccucaguagucauaauaaaacgugaaaaauucugaagcuugaaucauuccacaaagguaggucuuuuuggaauugucguauucugugguauccaucuucugaagcugaacuuggucgcuaagcaacaaagcagaugugaaacugugugucccuuauuaggugucuccuauuaggcagaaaggaguuguaaauaagcaaaauagugguaaaaauuuuugguagcaguuuaguagcacagcaucuucauaaugcuauauguuuuuuaaaauaguauuuuauccauagcacaaaaggugccuaagauaagaauuucugggcugggugcgguggcuuacgccuguaaucccagcucggccucccaaagugcuggguucaccugaggucaggaguuggagaccagccuugccaacaaggugaaaccacaucucuauuaaaaauaccaaaauuagccaggcaugguggcucaugccuguaauccuagcuacucgggaggcugagacacgagaauugcuugaaccugggagguggaggcugcagugagccaagaucaugccacugcacuccagccugggcaacagagccagacuccaucucaaaaaaaauaaauaaauaaaaagcaaaauagugguaaaauuuuuuguuagcaguuugauagcacagcaucuuaaguguuacuugguaaacauaaugcuguauguucuuuaaaacagcauuuuauccguaacacaagaggugccuaauauaagaauuucuggacugggugcagugacucacaccuguaaucccagcacuuugggaggccaagacaggcagaucgcuugaggucaggaguucgagaccauccuggccaacauggugaaaccccgucucuacuaaaaauacaaaaaaauuagcugggcgugguagcccaugccuguagucccagcuacgcagaggcugaggcaggaguauugcuuggaggcaggaguauugcuugaagccaggagauggagguugcaguuagcugagauggcaccacugcacuccagccugggugacagagcaagacuccaucuccaaaaaaaaaauuuuuuuuuugguuacuuucccagauauaguaguuaaguuagccaagggagcaucauuuucaaagcaggccaaaaaauaauuacauuuuccuauuaauucuuagucuuugcuuauauaucaaggcaaaauguugaaauaacuuacucagacuucauaguuucugcuuuucuauuuaacguaaccuuacaucaucugcuugcauucaguucuagccaaugaacacuuggaaggcagggcuaguuggauacucauagucauguucccugugccugguacauaguaaguagucaguagauguuucuugaaugaaugaaugauuuauuaguuugccucuuuuccuauauuuacuguaaccuuuacuuuuccuauauauggucaucuugaauauucugaaaaauaaacagugacuugauuuccccagaagucccacaaauaugaaauguuuucauagaaaaguauagcgaagaggugcuaaacuugggguuuguggaaggaacuacagugucucuaagcccucugagaaaaauagguggcauuugacaugggcgggggcguuuuuucuggggaaauaugguucauagauggaucaaauuuccaaauuggucuuuggacccccuaaugauuaagaaccaauguuauaggguuuguaguuuucaggcuucaaagaucaggaaaguuaaacaugguggcucacacauguaguuccagcuacucuggaggcugaggcaggaggguugcuugagcccaggagucugaggccagcaguucagcaguuguagaccagccugacaacauagugagaccuacaucuuaaauaaauaaauaaauaaauaaauaaauaaauaaauaaaauaaagaggcugugugugguggcucacgcuuguaauuccagcacuuugggaggccgagguggguggaucacuugaggucaggaguucgagacuggcccggccaacauggugaaaccccgucucuaccaaaaauauacaaaaauuagccgggugcgguggcaggcaccuguaaucccagcugugcgggaagcugaggcaggagaaucacuugaacucgggagccagagguuacagugagcugagaugguaccagcgcacuccagccugggggacacagcgaaacucagucucaaaaaagaaaaaaaaaaaaaagaaaaaagaaaaaccaacucaagcuuauguaaaaaaggaauuuauuggauuuuguaacugaaaagaacaaaacacacugggaaaauucuggcuccaggaauccuggguacaaauaguaucuuuaauuaaaguuuuucuccccuuugcucuuuuucucuauauuggcuuuagucucaggccugcucuucucuaugcuggaaaaagaugucagucugcagccuaggccugcuagguuuuuagaguuuaagaacuggcagaugucccagagaggacaucucaguuugguucaaaucaugugcccaccccuagggaguuggggucaucaccaaucaaauuacauggacugaauauacuuagcaugaaacuggagagagaaaguuccccaaaggaacguaauguguguagacaaaaaaacaaaaacaaaaacccauguccucugcagugauugaaaaguuugaggacaguuaauauagguaauagacugacaauuucauguuaaaacuaggauauauuguagugauaccuaaguuuuuugugaauuauaaauuuuucuauaaggguuucaguuuuuuuaacuuggaaaauuuucuucauuuauucauuuguuuaacaaauauuugagaaccugcuaugugcugcuaucaucauucuuuguacuggguauacagcagugaacaaaacaaaaaucccugacuucauggaacccacauucuagugaggacagacaaguaauaaguaacauuaauuacuaaaauagcauguuggaugagguuaaguacucuaaagaaaauaaacagggaggagagauagggaguagguaucacagguuuuuuuuuuuuuuuuuuuuuuuuuuugagacagucuugcucuguugcccaggccagaaugcacugcaguggcacaaucuaggcugacugcaaccuccaucuccuggguucaagcaauucuccugccucagccucccgaguagcugggauuacaggcgugcaccaccaugccuggcuaauuuuuguauuuaguagagaugggguuucaccauguuggccaggcuggucucaaacuccugaccuuaagugauccaccugucuuggccucccaaagugcuaggauuacaggcgugagccaccaugccuggccugguaucacaguuuuaaauagguuggccaaagaagccuucaccaagaaggugagauuugaacaaagaugugaaggaaguaaguagagagcaagcuguuuggauaucuggaagaagagaauucuagguaguaggaagcaagugcugaggcuugaaguguuugaggaacugcauggaugcuugaaucagagaaugggaaggagaagaggguaggaagagaaguaggggaugaugucaaagaaguaagagaaugguggaagcauguuguguagauccuuagaggcuaugguaaagaauuuaaaccacuagagcguuuuaagcagaggauaaauuguuuuuacuuuuuuuuuuuuugagacagagguuugcucuuguugcucaggcuggagugcaauggcgugaucucagcucaccgcaaccucugccucccgaguucaagcaauucuccugccucagccucccaaauagcugggauuacaggcaugcgccccagacccagcuaauuuuauauuuuuaguagagacgggguuucuccauguuggucaggcuggucucgaacuccugaccucaggugaucugcucgccucagccucccaaagugcugggauuacaggcaugagucacugcuccuggccugcuuuuuuuugagagggggucuuguucugucgcccaggcuggaguuuaguggcgugaucucagcuuacuguaaccuccgucuccuggguucaagcgauucuccugccucagccuccucaguaacugggauuacaggagccugccaccacgcccagcuaauuuuuguguuuuuaguagagaccgaauuucaccauguuggacaggcuggcuggcugacuuuuuaaagaauccuccuagauccucuagaauauauuguagaggauuaggguggaaguaagaagacuaauuaggagacuuucacuguugcaguaauccaggcauuagaugauuguggcacacaccaggauggugguggaaaugaugaaaagcggucagaucugaagguagauuugcugauggauuggauaugugagguacuagagaaacagaagagucaaagcugacuccagaguuuugguccugaguaacugaccacaguaauuuaaugagcuagagaagaccaggagaggagcaaguuuucacaugcuaaauuuaagaauuuaagaugcuuuuuuuuuuuuuuuuuuuuuuuuuugagauagagucuugcucuguagcccaggcuggagugcaguggugcgaucucggcucacugcaacuuccaccucccgggucccgguucaagcaacucuccuuccuuagccucccaaguggcugggauuacaggaacgugccaccaugcccagcuaauuuuuguauuuuuaguggagacaggguuucagcauguuggccagguuggucuugaacuccugaccuugugaucugcucuccucagccucgcaaagugcuaggauuacaggcgugagccaccacacccagccuuaagaugcuuuuuaaacauccaauugaaguuuucuaguaggcaguuggacauacaaaucuggaauucaggucugggcuagagauagaaauucagaaguugucagcauauaguucguacuuaacgccaugaaacuggacgcgaucacuagggaauaaguguaaacaaggaagagaagauguguccaaggacggagcaugccaauguuaagaaguuggggagaaaaggagguacuaccaaagaagaccaagaacgagcagcaaacaagaaaacauccugguagccaaauuaaaaaaaaaaaaaaaaaguuuuaaggagagcggaucacuugucagauguugcugauacaacaaucaagaugaagacugagauuuaaugauugcacuuaguguuacuauccuugaugagaacagguuugguaaguuagauuugagugguggaguuauuccuaggacauguccuuuucuuaggaauuuaaacuccaugguucaggugaaucuaugacuauuaaucacacaaccauuuaacaaauauuuauugauuauuccaucauucuuuuguucucuauuguacauguuauagauuuuuaaguugucuggaagucaagaugcauaugcaaguauacaaaaggguuuauauauuuguaguaagauauguauaucauauggaaugccuauaacaugaaguggaaacaauuauuuuguuauuuuuuucuucuauauuugggaguuuuuuaaacuuaauuuuuauagaaaaacuaaaaaucaacccaaggucauaauucugagaucuaaguaguuaauaccuaauugugauuauugauuccaagaaauaacaggaguugaaaauguaaaguuuaauuucucugauuaaauuuauauuguucuucuuuauuagaaauucauugaauuugaagacucucaagaacaggaaaaaaaggacuuacagacccgaguggaaucuuuagaaucucaaacaagacaacuugagcugaaagcgaaaaacuaugcugaccagaguaaguaaaacauuucuucucauaaguacacuaaagauugggcuuggccagacgugguggcucacgccuguaaucccagcacuuugggaggccgagguaggaggaucacuuggguucaggaguucaagaccagccuggucaacauggugaaaccucgucucuacuaaaaauacaaaaauuagcugagcaugguugugcaugacuguaaucccagcuacuuaggaggcugaggcacgagaaccauuugaauccgggaggcagaggcugcagugagccaagauggugccacugcacuccagcuugagcaacagaaugaaacuguguccccccaccccccagaaaaaaaaaaaaaggaauuggcucuaauggugcaaugacucauccugaaauucgacuaagguucuaaauacaaacuuggaauugucaucccagacucaagagugagaccuaggaccuaggguuaguucuuuuuuauucacauuuucacaugguacccaugugugcagaacugacuaaaccagauauaucgaucagacucacuucaauuuagaucucagccuuuguuuguaguuaacauuaugcuuuaaccauuaugcaaguguguguguauguguggaucauuuccucuauuuuugaucaaguacacaaagcuccauuuuuucuguuuugcuuugaaauguaaaaauguaagguaaacuuacagcuuugaaguauguauuuaaaaauuaccuaagcauguaauuagauacuggagaaaaaaaaguacugaauccucuuuuuugcuccuuuuuuuaauggaaaaauggggccauuuggggggaauagaacuucauuuuucagaaucauuuuauuuuuaauauaauuucauauuuucuugguuuuuaaaauuauuguuucaaaccucaaggaugauuuuccccuuuggcuaauaaaaacagaccuaauuaagucaaaauuagaaaaaaaaaaaggugagaaacuuuauggccuauuuucaugucugauauagguaggcagacaauucucugcuuuucucccagcauuguaaacuuucagaauccuagggagcaaaggauggccaggcagcuacucuauccacauuacucaugaaggcuacauagugacaccagcuauaaagguacagccauucaugauggaaugccuucgccagcacucuuggggcgugugugagaacugacuguucucucuaguacucuggaaagacggaauagagcuaaauuaaaaccacuggaaaucuggaguucaagcauucuagaauucaaggagaacucaaguggcuauuaagcagauguccuagaagagggccaauggauguuugguaacagaagccaacuugagcgagagaaaaugagccgugugucaugcuuuguguuuuuagccuuguggauacccagaguuguuggauaccuuuguuaccauugaauacauugagugacuucuaugauuucuaccauagaaauuugagguuugcuggguaugauggcucauggcuguaaucccaacacuuugggaggugaaggugggaggauugcuugagccuuggaguuugagaccagccugagcaagauagcgagauccugucuuuaugauaaaaaaauuaagaaaacgaggccagacgcggugauucacacuuguaaucccagcacuuugggaggcugccgaggcgugcagauugcuugaacucaggguuucgagaccagccugggcaacauggugaaaccccgucucuaccaaaaauacaaaaauuagcuggguaugauggugcgcacccguaguccuagcuauuugggaggcugaggugggaggaucacuugagcuugggagguggagguugcagugagcugagauugcaccacuacacuccaggcuggguaagagagugagacccugucucaaaagaauaaaaaaauuugaaaucucggaggacugcaugauggacuccacagggcauccacuaauagauauaguacuguagucacauuacuaugaauacuauucaucuggagaaauggucuuguggcaauugcaagcuuuugguacauuucaagaguugaaccuuuucuguucaagaaagaaaauuuaacuauuggagguaauguuuaaauccuaauuugauuguacuuuuuuuuaaauagagacaaggccaggcacggugggucacaccuguaaucccagcacuuugggaggucgaggcgggcgaaucaccugaggucaggaguuugagaccagccugaccaacauggagaaccccgucucuacugaaaauacaaaauuagccggacaugguggcacuugccuguaaucucagcuccucgggaggcugagacaggagaaucgcuugaccccgggagguggagguugcagugagccgagaucacaccacuacacuuggccugggcaacaagagugaaacugucucaaagaaauagauagauagcuagcuagauagcuagauagcuagcuagauagauagcuagcuagauagcuagauagcuagcuagauagcuagcuagauagcuagauagcuagauagauagcuagauagcuagcuagcuagcuagauagcuagauagcuagauaagauagauagauagagacaagaucucauuauguugcccaggcuggucucgcacuucugggcuucaaagugcugggauuucagacaugagccacuaugccuagcaugaagggauuauauaaucuuuuagaaccaaacacuaaagacacaguugacagacucagccuaccuuucauuguuuuacguauuaaguuuucuuguugauaucugcaggguacacaaaguuuucuuucugucuuuuuuuuuuuuaagacggagucuuguucuaucgcccaggcuggagugcaguggugugagcucggcucacugcaaccuccgcccccuggggucaagugauucuccugccucagccucccaaguagcugggacuacaggcaugcaccaccaugccuagcuaauuuuuguauuuuuaguagagauggaguuucaccauguuggccaggcuugucucgaacucccaaccucaggugauccgccugccucggccucccaaaguacugggauuacaggugugagccacugcgcccagccuggguaccaaguuuucaauaagaaauuauuauuuauugaaaccggaucucacucugucuaacgugugcaguggcaggaucgcuguucacugcgacuugugcuuccugggcucaaucgauccucuagccucagccuccugaguaacugagacuacagucacaagccaccaugccuggcuaauuuuuguauuuuuuguagagacaggguuucgccauguugcccaggcuggucuugaacuccugagcucaaagcaguccgcccgccucggccucccaaagugcuggcauuacaggcaugagccaccuugcccagccugaaaaaaauuuuuuuucuuuuucuuuuuucuuuuccuuuuuuuugagauggagucuugcuuugucacccaggcuggagugcaguggcgcgaucuuggcucacugcaaccucugccuccuggauucaagugauucuccugccucagccuuccuaguagcugggauuacaggugccugccaucacccccagcuaauuuuuuguauuuuuaguagagacagggcuucacuguguuagccaggauggucucaaucuccugaccucgugauccacaugccucggccuccugaagugcuggaucuuuuucuuuuuuucucagagaccgagucuggcucugugucccaggcuggaguacagugacacgaucauagcucacuguauccuugaacucccaggcucaagugauccucccaccuuagccucccaaauagcuggaacuacaggcaugagccaccauaccuggcuaauuuuaaaacuuuuuguagagauggggucuuguuauguuguucaagcuggucucgaacuccuggucucaagugauccuugcaccuuggccccccaaaugcugggauuacagguguaagccacugcgcucgaccagaauuccuuuuuugacuuggaaaagaauuccuugucuaacauccuuuugugcauuaaguaauuggcuucugugauuagaggaagaauuaccuuauacuugaaauugcauuuuugauaucaaaguaccuuuaaaaugucucacacucaaaaaagaagcagaagauacugcuucuuuuuuucccaaaaguaucuaaguggaaugaauuacuaauuauuucacauacauuagcccuuuuauuacuaaauuuaaaaaaucuguuuccuauuccuuucuaauaaauguaaacaaaauauagugguuucuuuucuucuucuucuucuuuuuuuuuuuuuuuuuuuuuuuuuugagauggagucuggcucuguugcccaggcuggaaugcaauggcaugauauugguucacugcaaccuccgccucccagguucaagcgauuuuccugccucagccucccgaguagcugggauuacaggcacccgucauuaugccuggcuaauuuuuguauauuuguagagaugggguuucacuauguuggccaggcuggucuugaacuccugaccucaguugauccaccugccucagccucccaaagugcugggauuacaggcaugaaccacugugccuggccuagugguuucuuaauuaagggaagugaucaauuuaggggacuguuugaguaugucaauuuuuuuuucauugucccagauuuguuauccaguccagagagucauaccuuuuuuggaauugucauauucugugguauccaucuucucauuccucucuccaaaagcauuaauuauguuuuccauuuuaauucaaagacuuuauaaaaaugagaucauuuaaaaauaauugacaauacucuagggaaaggaggaagaaauucuucaucaaguauuagauauggucuugagcuuaauuugaucuaaaaacuuuauuuuuguuaugaauauauuauccuccaaagaauuucuccccugggagucugcuguuccuuucugaaauaaagcuugcuguauaaagaacaauuaaggaacuuacaaacugugguuaaucaaaauugaccguucagaugcacgaaguugauaacacgaaaucuuuuuucuaugaacugaguuauuuuuugagcuggacccuugcucugucacccagacuggagugcaguagcaccaucucgguucacucugccuccuggguucaagcaauucuccugccucagccucccgaguagcugggauuacaggcgugcaccaccaugcuuggcuaauuuuuguguuuuuuuuguuuuguuuuguuuuuauuuuuuugagacggagucucgcucugucgcccagucuggacugcaguggugugaucucggcucacugcaagcucugccucccggguucacgccauucuccugccucagccucccgaguagcugggacuacaggcgcccgccaccacgcccggcuuauuuuuuguauuuuuaguagagacgggguuucaccguguuagccaugauggucucgaucuccugaccuuguuauccaccugccucggccucccaaagugcugggauuacaggcgugagccaccacgcccggccuaauuuuuguauuuuuaguagagaugggguuucaccauauuggccaggcuggucucgaacuccugaccuugugguccgcccaccucggccucccaaaguguugggauuacaggcgugagccaccgugcccggccugagucaucuuuuauuaaugcuuuggaacuuacucccuucuccugaaauuggagucuuuuucucuuuucuagugaauuguuuuccuuucucuuccuuuuguuuuuuucuaagccuuaacugguguaauaugaauucuaaguguaucuuaaauuuucuucagaguuuuuauuuuaccacacuuaaacauucccccacuuuuucuggggggaaauuauuugacuguuuuuucacuuuaccaccuuagguuuuuguuuuuuguuuuuuuuuaaaucugcaauaugaaucaaagcuucuuauuuuuaauuuuaaaaauuacuuauuucuuaauuuuuuugagacauuccagcucuauugcccaggcuggaaugcaguggugugaucauggcucacuguagccucaaccucccaggcucaagcaguacucucaccucugcuccgaguagcugggacuacaagcacaugccaccacacguggcuaauuguuuuuuuuuugagacggagucuugcucuguugcccaggcuggagugcaguggcgugaucucggcucacugcaagcuccgccuccuggguucacgccauucuccugccucagccucccgaguagcugggacuacaggcgcccaccaccacgcccggaaaauuuuugcauuuuuucaguagagaugggguuucaccguguuagccaggcuggccucaaacucccgaccucuggugauccgcccaccucugccucccaaagcgcugggauuacaggcaugagccaccgcgcccggcugaaguuuuguauuuuuuguagagccaggguuuugccauguugccuaggcuggucucaaacuccuaggcucaacaaucugcuugcuuugaucucucucauguuagaauuacaggcauuagccacuguacacagccuaaaaacuucuuauuuuuuaaaaaggugauguaggaaguaaucuuuaaguaucauuaguucccuauacuauuggaaaaccaagauugggaaugagugcuuuuuaaaagaugaaaacaaauugaaauaaauguuaugucaggaguucauuaauucuuguuuuguauaauagaaaacagaugaucugggcuaucuaaucuuaaugugacugauuuuauuuuauuuuuugagacagagucucgcucuguugcccagguuggagugcaguggcgcgaucucggcucacugcaacuuccgccucccagguucaagagauucuuucugccucagccucuugaguagcugggacuucaggugcgugccaccacaccuggcuaauuuuuguauuuuuaguagagauggaguuucacccuuuuggccaggcuggucuugaacuccugaccucaggugauacgcucaccuuggccucccaaagugcugggauuacaggcaugaaccaccauaccuagccugauuuuuuguuuuuuaaauaaaauaugagaccaggcgcgguggcucacgccuguaaucccagcacuuugggaggccgaggcaggcguaucaccucaggucaggaguucaagaccagccuggccaaaagggugaaacuccgucucuacuaaaaauacaaaaauuagccaggugugguggcgcaugccuguaaucccaccuacuuggaaggcugaggcaggagaauugcuuuaaccugggaggcggagguugcauugagccaagaucacgccacuguacuccagccugggcaauaaagcaagacucagucuaaaacaaaaaaagaaaauaugaauuuugugacaaaguaaauguaacccaacauuuaauuuaaaauaaacauuuauuuaggggcacugagaugacuguucgcaguaccuguagugggaggagagguggaugcaauuuuuuuguugagugccauuuguuugagugcuggaugccuuuucuaguuuucauguuuauacaguguauuagugucuuuaauuuuaaaagacugaguuugucaauucucaugaacauauuuuaggagcacacaucccuuuuaaaaaauagccacaauaaaaauucaaguucugcucuaaagacuacuuccuuuguuaaaaggggaaauuuugguuaaaguuauuugcuauuugagaagcaagaaaaaguaaagaaauaggaacugaauuaaaagacacacuuuacagcuuuugauaguauggaaucuaucauguugcaugauuuaacaauguugaaaaguugagucuauaauauguuuuuuaacaauuuuuggucauguuugauuuuggagauuucugauuacuuuucaaaaucuaaaugaauauaagaaauuuuuuuuacuuuuuccaacaugaauaaaggauuuuuuaaaaugcuguauauuauuccuuaucuggagcagcaauaauacguccuguuaauaucuuaugaaccuuaaggaagagucuguaaucgauauuguguggaauaaggaaguugugaauugagaaagccuuggugcuuuucaaguguguaaggaguguaaucaacuuugccauucauaguguggcaguaauaggucuuugucagaaaguacuuuuuauauuuauugucucuguuguauguuguguauuucuaucuuguaagccaaauaucuaaaauuugagucaagcaaguauagauauuuuaauacaguugaaaauauuaaacugguccaguaugccuagcauucugccuagguaugguugugguacacaagaguaugauaugguccuugugguuaaagaaaucauaguuuaguggggggaggaaggggaagauuaugcguauggccuacuagucuuuuucccauauauauuauauuuuuauaucauugugguuaggauguauauuuaauuuuguaucuuuuccuuaacauuaucauaaguauuuuuccuuguuguauaaucuucauuauuauuuuuauguccacauaaauccaccauccagaagcuaugccaucuauuaacaauuuuuguuuucccugaggacuaugcuuuauuuuuuccucuaaugagaauuauuuaauggccacuguguuuuuuaccauggcagcccagaaacagaacaaacguugaaaugcaaccauaacaacuaguuugaaccuuaccugguuggcauauuuaaauuguuuuuuuucuugauccacguuuuauacauguauaauuaauauauuaugcucuauuguaaacugucucaaauccuuuguggaaugaagaggugaaucaggguaaaauaaauguaagaaauuuaaaauaaaaaaaccaaaaacuucuguugguugguuggucauuuuuucugguauacugaaucauauugcaguaaauauuuuuuuacaucuacaaguuuucccuucuauugguaguuuucuuagaauauauuuaaggaaguaggucaaagaauuuuagugcuuuuuggcauauaauaguuuggccauuucuaaugucaauagaauuggagaaguaaggguuaguaguaaauuccauuuugcuugucauaacuuaugaauuugaagcauuauuuacagcauauuagcacacagagcugauauagaaucauuuauuauuugauucucucuuaggaagcuucuguugcccucaggcuccuuggauuuacaacuuauucuucccugaguauagagccauugccuuuuguggagaagaugaaaagauuuagaugacagugauauuuuuuuuuuagugaguacuucuuaauuugguggcuauguuuuuuggggaguacagguuuuuuuuuuguuuuuuuuuuuaagagaugagggucuaauuccuguguuuaagugauccucccaccucagcccucccgugagggagcccaccucaggugcaugccacugcacccguggcugugauuuuaagcuguuauauuuagacucuucuuuaauuccgcccuuccuuccuuuaaaugaaaauucgucuuuuugaauuaaauggaaaaauguuguuggcacugaagucaaauguguuagauccuuauacuuugaccuuucuaccuuuuuugucccccauguaacauuccuuugcuuuuuacaucuugugucaggaucuuagucuaguaaaauaccugcaagccuucacuuugaaacauuauuauuagaaggaaaacacuucuuauuucuuggucauaagaauaagcacuccacuagauagaaaguugggggagauauuaacauaaacaauaacauaauuuuuauuuuaaaggaauguuuaaauuuuauuuaauuaauuaaauuuauuuaaaggaauuaaauaaggcuuaaaacagaccuucaacacaaggugauugauaaauuaagaauuuucacagcacauaaaccauuuuaaaguugccaaguaucauuucauaucaaaguuaauauuugagagagccuaaauauuuucugucgcuguuuuucaaaucaccuaaaaaaauacauucaggcuuguacaaaacuuuaucagauccuuuacugugcuuugugauuagcaaugaauguuaguauuuugaaaaaauuaaauaauacuguaauaggacacuuuuuccacuuuaguucuaugucaauaggcaauuccuucuacauaauuuuaagaaugauaaaaguagauuacgaagauuuauauauauauauuuuaaugaugauauguguuuuuguugaaaguuuuuuuaaugaggcagcuuuaggaguuugaauuauaucuuuugguuuuaaaagaaugacaaguuaauuauuuagaaagcuacuuuuagucuguuuaaucagaaucuaguucuuugcaauacuaagaauaucuauauauuuaauaaacaauauauaucagcuguuucuuauuuagagccuacauaugagugggaaaguagaaaauuaggcacaagauaguuuuugcaaacacuaacauuacuucugcuucauuagguaauacuuguggucuuuagcuguuuuauguuuuauuaucuguauuugggcucuuucauuuuugagucuaguguugucuauugagaagcuuaaaguuguaauuuauaauuaauaucuagaacuaaagguaucagaaaauuaaguuuaugaguaaaaguuaaaggauuucuggugauuugcuuagagaacagggaaaauacgaauaauuugauuauucuuucaaacauauaaagggauggauaaggaguguagcaagcuguuugucuguuauuuuggaagauuaagugagagaaaaugaauuuuuuggcuuugguuggucaugaggaaguauuucuuggccaugagggugauacacaggaauaugugcagagguuaagcguggacugucccuacguagagacuuuagguaggagaaucaucagcuuuguuguggauggcuuaaguaacaucuucaagacagggaacugucagaucacuagaaguuucuaccgcugggauucuuugaaguuauccuacucuguuuugagaauaugaucauugauucaugauagcuuuaaaauauguauaauuucacauugugucauugauuaauaacauauaauaucugaaaauuuuuugaaguugagagacaugguaaaggacuuaguuggugaggagagguuguuauuacuguuuugaugugguugucugagauuucuuugcucuuaagucagccuugcuuaccuguugggacuucugaugcuaaauuguucaaggagaaguuucugaaagaccacaugucaaucuucugaggcccagcaacaguuggacuaucugccuuccaggaacaguaaaaacugaugauuccuuuugagaaggcaaauaaugaguuggauauggcauucuagcaggucuguuucucuuucuuccccccguaggccuaucagcagucugauggggcagaagacaacagagauggaagguguuccaaacuuggcaaaggccaucaaucucaggagguaagcucugauuuugagccggcagagcagguggcucuuccugccuuaaucuuauccucuugcuuuuuggaaagacggauagaaagagcgcucaaaaugaggcugaaguaucuccaucauuauucuaaaggggaaauuuuggauuugucuuuugauuguucuuuuuucuugcccccucaccuuuuuuuucuuuuuagauaacaugauuugccuuuuuuuuuuuacuccccagaaaauuagcaauuuuaaaaauggcaguuacuuaucaguuguuuugggauaggaugaacagaaucuuguuuauuuccaguuaaucucggcuuggagcuaguuuugaugaguaaaaugacaagguuuuagaauuuucccugagaucguuuugaaguuuagguuuaugugauaacuauuaaacaagaaaugaccuuuuaauacacuucaaauggaaugcaacaauauagguauagguuaacuucaugguacuugaggcuuucgaggaugucuauaguccuugccaggugggcuuuucuuuccugcuuuccccuucccuucuacuuccuuuucuuuucccuuuaacugauuccuuaguggcauucaggacuuuaaagagauggcucuuccacacuuuaaaaugacuucucaaaaguguuuauaccaucuuaugggacuuaggccuugaguaagcugaguucauuggauauguuguuguacugaguuauuguaaguauuuucagaaaagaaagguucugaauuuguauuauuugaucuugguguauguguguauauuuucuaauauuuucuauguauuauaugaucaauuauauaugaucuuuauguuacaugauuuauauuguaaguaccuacaaagauaauaauaaaauuuaggaucacaguauauguaaagaaaacaugaaauacacaaagucauaaaacaguuucuguucagguucuugcuguggguguuaggcaggagagaauauaccaccagaaaaacauucagaaaaucauuuauaauaacagacguaaacuauccuuuuuuuuuuugagauggacucuugcucugucgccaggcuagagcgcagugguguaaucucggcucacugcagcccccaccucccagguucaagcgauuccccugccucagccucccuaguagcugggacuacaggagugugccaccaugccuggcuaauuuuuuguauuuuaguagagacgggguuucaccauguuggccaggauggucuugaucucgggguuucaccauguugaccaggauggucucgaucuccugaccucgugaucugcccaccuuggccucccaaagugcugggauuacaggcgugagccauggucuuuuuuuuuuuuuucuuuuuuuuuuuugagacagagucucacucugucgcccagccuggagugcaauggcaugaucuuggcucacugcagccucugucuccuggguucaagcaauucuccugucucagccucccaaguagccgaaguaaacuauuuuuaaaacauaauggggacuggaggcaauggcucacaccuguaaucucaguauuuuggaaagcugaggcgggaggagugcuugagaccaggagaucgagaccagccugggcaacauagugagaccuugucucuacaaaaaaucaaaaaauuaucuuggccugguggcacacgccuguagugccaacugcuugggaggaucacuugagccuggaggauugcuugagcccaggaagucaaggcuguagugagcugugauugugccauugcacuccagccugggaaacagaacaagacccugucucaagaaaaaaaaaaagcguaaugggguaacauaccuuugauaauuuggaaugcuaacuuuuaagaggauuuuaguacauguuuauaagcugauauauguuaagcuaacuguaguugcuauaacgaacuagccacaaaaauuauauauuaaugacucaaauguuauuucuugcuuacguaaaguuuaaaaaguggauguuucagauaaguggguggcuuuugcggagacaugggcauuucccccuuuauagcuucuaaguuugucuuaccugcauuaaguuggaggaaggguaaagggcauggagcaucguguguggaggguuuuuacuggaccaggccuaggaguagcacacaucacuuuuacuacuacuucaguggcuauaagucagucagaggcuaccugcaggggcugggguggauagccuagcuauuugcccaagcaaaagaggaaacuguuuugguuaacaucuggccagucuuugccucagcuuaacagccuuagugggggccauuaguauguuauuuugcccaaguguugaggcaaaggaaugauucugccuaaggcuuagcaaccaucugccuauucuuucuacugugaauuaucugaggaagagaagagaaggacauuuuaaugaaauguccuucucuuauaacauaaauguugagauuuucuuuuugaucccuuaccauuugacuuuuucuuuaaaaaacagguuauuaaauuaagacauaauuugcucauacuuguguuaagggauagguuucaaaugacucuguuuaaaauugaaauccaggcugggccugguggcucgugccuauaauuccaggaauuugggaggcugaggcgggaggauugcuugagcccaggaguucauaaccagccugggcaaaauagcgagacccugucucuauuuaaaaauaaaauaaaauuaaaaauugaaaucuaauucacauaucauaaaauccaccauuuuauuuuauguauuuauauauauauuuuuugagauggaauuuuguucuaguugcccaggcuggagugcaauggugcgaucucaacucacugcaaccuucgccucccagauucaagcaauuuuccugccucagccuccugaguagcuaggauuacaggcaccugccaccaugcccagcuaauuuuuuguauuuuuaguagagacgggguuucaucauguuggccaggcuggucucaaacuccugaucucagaugaucuguccgccuuggccucccaaagugcugggauuacaggccugagccaccgcacccggccaaaauucaccauuuugaaguguacaauucagcgguuuuuaguacaauuuucaagguuguacaaucgccaccacuaauuccagaacauuuuuaucaccccaagaagaaccacccccucauaccuguuacacuuacuucugcuuuucugcuuccccuugucccugaaaaccacuaaucuaauuuuugucucuauagauuugccuguucuggacauuucauaauaauaggaucauacaauauauggucuuuugugacuggcuucuuucaccuagcauaaagguucauucauguuguagcaugugucaguacuuccuuccuuuucauaaccggauaauauuguuuuaugggauacccuccacccccauuucaauugccuauauauccugcuagagcuagaaacaaccaaaacucuaacuuugcuaucugaaagucuguaguaauacaguuuugaagagcugaguauaaugaacaaccacuuugggaagauauuccuuggguuuccucuuggcaucuugacuuguuuaguuccucauaaauggguaaguagauaacuuaauguuugaaccaucuuuacaaugcugugguugccuacuaggaguagguaguauauuagucaucuuguuuuauuuguauaauuagcuaucagugacacaucugaauauaacuaagcagaaugauaaaccuucuguuuaauuuuaaugggaaagauaaaugaauuaguuaagggccuuaaguaaguagacugaggugaacaggcucucauuuacuccucuacuggaguggagaggaagauggaaguggauaugauacuuaugcuagaggauaauacuuaacgucuaauuuauguagauauuuuaacccuuuuauuuuuugucugcuuuuauuuuauuuuuuuaaaauuccauuuuauuauuauuuuuuacuuacuuacuuacuuacuuauuuauuuauuuauuuuugagauggagucuggcucuguugcccaggcuggagugcaguggcacgaucuuggcucacugcaaccuccaccucccagguucaagcaguucuccugccucagccucccaaguagcugggauuacaggcaugugccaccacaccuggcuaauuuuuguuuuuaguagagaagagauuucaccauguuggccaggcuggucuccaacuccugaccucaggugauccacccaccuuggucucccaaagugcugggauuacaggugugagccacuacaacuggcccuggccugcuuuuauuuuagauguugcaaaauucaguauuuuuccuguuauuuaacagguuacagacaaaauacauuuauaugaaaagcugagacagagguuaauuuaaguauacuuuaugauuuauuuuguaucaaaaacuuagcgaaaagauagacguggucagcauacaauuuuuuuuuuuuuuuuugagauguagucucgcccuguggcccaggcuggagugcgguggcacagucuuggcucacugcaaccuccaccucccagguucaaacgauccuccugccucagccucccaaguagcugagauuacaggcaugcaccaccacgcccagcuaaauuuuuuuguauuuuuuguagagaugggguuucgccauguuggccaggcuggucuugaacuccugaccucaggugauacgccugccucggcuucccaaaguacugggauuacaggcgugagccacugugcccggccagcauacaaguuucuaauauguaacaguaaguugaaaauaucuuaaaauaccacuuuuugugcauuaaaaacaugaaauuuugugugugaaagagauaguaaaaguuugagaccuguaauuuuaagaccuuuagcucuuaugaaaauaacaggcauaaacuaugguaaucuagacaauggaauauuagucagugcuaaaaagaaauaaacuguuuguccaggaaaagacguggaguagguugugugugguggcucacgccuguaaucccagcacuuugagaggcggaggcagguggaucuccugaggucaggaguucgagaccagccuggccaacauggcgaaacccugugucuacuaaaauacaaaaauuagccaggcaugguggugggugccuguagucccagcuacucagaaggcugaggcacgagaauugcucgaaccuggcaggcggagguugcagugagcugagaucaugccacuacacuccagccugggugaaagagcaagacucugucucaaaaacaaacaaaaaaaagauauggaguaaccucaaaugcauauuacuaagugaaagaagccaaucugaaaaggcuagguacuauaugauucccacuaugugacauucuggaaaaggcaaaacuauggagacaguaaaaagaucauugauugccaagguuugggagaugguagggagggaugaauagguggagcacaggauuuuuaaggcagugaacuuauuuuguuugauacuauaaugguggucacaugucauauuuuugucaaaagcuguagaguauacaacaccacgaguguacccuaauguaauugauauauuuugggugauaagcaugugucaguguagguucaucgauuguaaaagguauaccacucugauucuggauguugaugguaggggagguugcguguguagggggcugcaaauacauggaaauucucuguacuuucauucaauuuugcugugacccuaaaacggcucuaaaaauaaagucuauuaaaaauuaaaagggacaagucaucuguaacuccagguaguuugcaugugcuaaaugcccuuuuucugugauaaaugguugcuauuaaauaaaaaaauauagauauguauguauauuauuuauaugagauuaguaaauauaaccauuucaccuuuugaaagagaugguuagagaauggauugauaguuuaucaaauguuauuucugaggugaaaguaagacuguguugccaaauggaaguaaauuuagcaaaaaguaacccugauggguuagaaagcugugaauggaggcugaaggaauuaaugauagaaauaauucaaaaugcuuaaggagaacaaaaugauuacuagaacuuuaaggaauuuuuauggaugaaccuaagcuuaugugaacaauggucauauucauuuagauaaauauuggaaaucucccaaaauuaaugguauauucuguuauaugucuccuucccacaagccuuuuuuuuuuuuuuuuuuuuuuuuuggagacagagcuuucgcucuuguugcccagacuagagugcaauguugugaucucaccucacugcaaccuccaccucccagguuaaagugauucuccugccucagccuucugaguagcuaggauuacaggcgugcaccaccaugcccagcuaauuuuuguaguauuaguagagggguuucaccauguuggccaggcuggucucgaacugcugaccucaggugaucagcccgccuuggccucccacagugcugggauuacaaguuugagccaccgcuccuggccuaaucucacuauuaagugguguacauuugacacaaagcaaugcaaacaaauugauuaggaaacuggcauaaaaucagucaggaccugacuuuguuuuguggcauuauaauguuuuguucuguaagguauaaacccagcucucugaccaagucaguugacaaacaucuuauauaaaagcuucucucgguggggcgcgguggcuuacgccuguaauccuagcacuuugggaggccgagguggguggaucacgaggucaggagaucgagaccauccugaccaacauggugaaaccccaucucuacuaaaaauacaaaaauuagcuggaugugguggugcacgccuauagucccagcuacucagggaggcugaggcaggagaaucgcuucaaccagggagguggagguugcagugagcugagaucgcaccauugcacuccagccuggggacagagugagacucugucucaaggaaaaaaaaaaaaaacaaaaaaaacccuuuucucugagguuugcuuaaugguauaagucagcuagggccgccauaacaaaauauuacagacuggguggcuucaauagcagaaauuuauuucucacagucuggaggcuggaaaucugagauccaugguacaagcagauuugguuucuccugaggccuuucuccuuggcuugcagguggcugcuuuaccucuguguccuaauauggccuuuugccuaucucuugcuguuauaaggauaccagcccuguuggaucagggccccaccuuaaugaccucauucaaccuuaauuaccuaccuucuucugccuuuuuuuuuuuuuuuuuuuuuuaaaaagacaaagucccgcucugucaccgaggcuggagugcagugguacagucucagcucacggcaaccuccaucucccagauucaagcgauccuccugccucagccucccgaguagcugggauuacugcuauuugccaugacgccuggcuaauuuuuguauuuuuaguagaaacaggguuucaccauguuggccaggcuggucucgaacucuugcccagguaauccaccugccucggccucccaaagugcugggauuacaggugugagccaccucgcccggcccuuaauuaucuucuuaaaggcccuaucccccaaaugcagucauauugggagguagagcuucaaccuaugaauuuggggggugagggagcacaauucaguccauaauaggucaggagauaagaguucucuguggggaugggaagcaaagaguguugugacuugacaaucagauccagaaaagucuuacagaccauuguaagaauuuuuuuuuccuuuuaaaaaugagaucggaagcuuugaaguuuugagcgguuagucacuguuugauuccaucucuauuuugagaauguagggaacaaagacuaaguagagaaacuagucaggagacuaggauuauuauuguaauaaccuaagcaagagaugaugucuugggucaaagugagagugaugaaggugguaaaaguggugagauucugguuuuugguuuguuuguuuguuuguuuguuuguuuuuugagauggagucacacucugucgccaggcuggaguugcaguggcgcaaucuugucucacugcaaccucugccucacugcaaccucugccuccuggguucaagcgauucuccugccucagccucccaaguagcuggaauuauaggcaugcaccaccacgcccagcuaguuuuuguauuuuuaguagagaugggguuucaccauguuggccaggcuguucucgaacuucugaccuugugauccgcccaccucggcucucaaagugcugggauuacaggcgugacccaccaaauuuucuuuauccagucuauucgguaacauuuuuguucucucccugagaaugcuacagucagagcaauaaagcuuguuuguuaugguucugaauaguuuguuuaaaucccauucuacauguugaacucauagccauuguaggauaacauaaggaagaaugaguauucaagcagaggaaagugccugugugaauggaugcacaucguguuugaacugaggugggcuggggcuauacaggcauaaauacaucagaucacugacuccuccccagagguaacuacuauccugacuuguaacauuucagauuaguuuuguguuaugucuuugaauuuuguauucuuuuguuucugcuucuuuccuucaauaucauauuugugcuauugguccaugauguuguguguggcaauaauuuguuuauucacguuguacaguauuccaguacaugaauauuuauccauucuacucuugauggacaguuggauuguuuucagauugugcuucuuugaacauuguuuuaaauaccuuuggguggacauauauauaggcuuucuagcaaugacauuguuuugugauaggguuggcaaacauucgaaacuuaacuaaaucuugccaaacaguucuuaaauugggcauaccaaguuacgguguaugaaaccauacaccacaguuuaugaaaguuccaguaguuccacauccauacuggcacuugguguguuguguuuuucacuguagccauucagaagcauggugguguugcauuuugguuuuaaugugcaucucccugacuuggguacacauuuugcuuggcaguuugaugcccuuuguaucaaaguaucugugaauggguuguuucuguaagaacagaggaguuuuuuguuugaagcauacuccccucugcccaaagugauaucuuaaaguaaacuccaauauacaaaacagauuaaaaugaguauuugcugagaagcaguauagcaugguaauuaagaacacagauucuggagccagauucugauaggaauccuugcuuugccauuuucuaucugugugacuuugggcaaguuacuuagcuccuauuugcuucaguuuccucaucucuaccauggauguaauaauaauacuuucaucguaagguuaauguuaggcucaaauaaguuaguuuauaugcaguucuuaggacuguaugguacauaguaagcacuugauguuguuggcugcuauuaguaguggugguguuggugauacaaauuuauuuaugaauuuauaucagcugacaagaauaauaaggcucuacuauugagcacaaauuugaaauugaggauuaugaaugauaguuggauuuuauuucagccucagcauccaauuuuuguuuuuguugcacauuaucaagaaaauaaugauucaaaaagaugaacaauugaaaauagauaugguuuguccaguagucucagaauuccuuuaagcuuuuaaucaguuuaaaugacaaguaguagaaaauguuuauuuugaaauuauuaaauauccauaauuugcuuggauuuccuguuuuuaaauaaaaaucauagaauuaaauuuuauuaaaaauuaauuugugguuuuagcaucuauuauuuuaucacaacacaucugcauaauaaauuugcuuauuaucgcuuucagccacaggauaagaugagcagcagauguauucaacacuuguguggcaugauaaaaugugcuccguggguacuguaguguguguuugcucucuggugcaaauguaaugagccagcgacacauaagcuugaauuagaaacaaaucaaaacaaagacagcuacaguuuuccuaaucacauauuuucaagauauuuaaacaaauuauggcaaguaaagguacacaaacccaaaaugaauuuucugggcagcacaagguauguuuuguuuggugucugguguguuaauacuaggaggcauauaaaacauucauuuaucugcugucagaauauuaguucauacuaguuccuucuacagcuguccuccacagucaccaguuguagauuacacacagccuugccuguuugcggccagcugacccuuaaacccagggaacauuuucaacuaugcuaaggcuuuccaacagacuaaaugaguacccugauaaacuccucuagcaccagcuuuauuucuccccagacugucucccacugcuccuuagccaaguaugggcuccuccagucuggccagucuccccucugccucaccaccacccucugccucaccacaggcaugguuuuguguucccuucucugugguaacagugucaggaaugcucucauuaccaucugucuugaguacuguaauuucuuccuuugugguucuguguggacaccaccuccucccugaaucauuccucuuugcuaucaguuauucuuuccuguggaauccuguccugacauucuguaucucaggaucuauuaauaaaacuuuuuuuuuuuaaauauccugaaguuguacucugugagcacuaccucaagucagugccacucacaaaacccaucagcagagggagcuaaauaaaagaagaugagucccugaaauugaggagaccugaagcagaaaaaguacuuauaaacaaucaacuuucacaaacugccagugcuaaagagcuugaguaguguuggaaauacauuauuugggcccuaaucccaguuuaaaacuuugaugaggugauuuguguuuuugaaagaguuaauucuguaucauguuaaaaaaaaaacuguuuagggggaugaccugauaaauauaggaauauuagagaaccaaucuaagguauuccgcucgucugaaaguuuucauuauuaaggauaaugaaaugaggucacugcuuugugaagacuugcauauggaacacugagucugaaaguugcuaaggauuauggauagcccauucugagucuaacauguacuuuuucaaguaaauuucuuauuuuguuuugaucaaguguauguaucuuaauuucaguuagcagacuugaagaaagagaagcagaacugaagaaggaauauaaugcauuacaucaaagacacacugagguggguuucuagguuuuucauuaccaugcuauuauugagacaaagaaaugaaccuuagaaaauaugucuuaauuuuucuuugaaaaucagaauuuuuuaaaaaagaauaauucuuggggauucuuucaagaaaacauuaaauuucauguggcauuuaccuaguuaccaaaugucaacuuuucuuggaauuagcuuuucauggggugaauuaguaugcuacagaauaauuuaguuauuuaaggcagcuauaguacuucucuccuuggcuggcuaagcaaaaaccuaugugcacauaaugaaguuucugugaugcuuagaugagagaacugauuuguuuuuuuaugaguuuggaaauuauggauugguaaguuauugguaaagggucucuacaucuauuauccauuguaaaggacuuauuugcauuaagcucauaacaaauaauauaagcacaaauuauaauguguuaaaauaacucaaaaguagguuuuuugcaugaguuuucaguauuuuaaauuaacaguuucagcacagucuccucaaaggaaauuagaaaauguacuugaggguuuuuuaaccuuuuuaugauucccugucagccuuucauguugcuuuuguuucuguuaucuuaaugugaaaauuauuuuuguaugucauggucagucuggguuucacauacccagauaaauauaauuuuuauaguuuuauacaauauuuguuacaugaaaaaaauaauuccucucucuuuccccuugcuaguccuauauuucccaugauacauaugguuccagucuuagcccguuuuuuuguuuguuuuuuuuucucccuaguuugugugaucucuuauccugcgucugguagaaacuauguuguuguuuuucuuuagaagaguauaaaaaccuuuauaaucuauaaucauaaaacaauuuaaaaucauguuuuggagaauauccacacagauuguauucuguauacaguaagcauauuaaugcuacaaagauuguauuuacauuauuauauuguagcuauauucuguuguugcuugugugugugugugugugagagagagagucuugcucuguugcccaagcuguagugcaguggcgcaaucucggcucacugcaaccuccaucuccuggguucaagcgauucuccucccucagccucccaaguaacugggauuacaggugugugccaccauacccggcuaacuuuuguauuuuuaauauaguagagacaagguuucuccacguuggccaggcuggucuugagcuccucaccucaggcaauccacccaccucggccucccaaagugcuggcauuacacgugugagccagugugccuggacguugcuguuuauuuauuuauuuaaaaaaauguuuuaauacuagccauugcuuuuaaggaacagaaaaccccaccacacauugcauuugaauaaugugguuagcacuuucuugggguaggguguagaauuuuucccuguuagccuugacacgugagauuugauuauuacaaucuuagcuuaauaaccauacccaaagcaugaaguaucacagaauugauauccaguagcagauggaaaggaugguccaugaagggcuugaaccauagagcucagggaagacaggagcagguuauacagcagcuuuuucagugguaaaaaauacccacauuuggccaggugcgguggcucacaccuguaaucccagcacuuugggaggccgagguggguggaucaugaggugaggagauugaggccauccuggcuaacacggugaaaccccgucucuacuaaaaauacgaaaaauuagccaggcaucauggagggagccuauagucccagcuacucgggaggcugaggcaggagaauggugugaacccaggaggcggagcuugcagugagccgagaucacgccacugcacuccagccugggcaagagagcgagacuccgucucaaaaaaaaaaaagccaaaaaaacccacauuuuggcugggagcaguggcucaugccuguaauccuagcacuuugggaggccaaggugagcggaucacuuaagcccaggaguuugagaccagccugggcaacauggugaaaccccgacucuaccaaaaaaaauauauacaaaaauagccaggcaugguggccugcaccuuuagucccagcuauucaggaggcugaagugggaggaucacuugagcccaggagguaggggauacagugagccaauauugugccacuacacuccagccugggcaacagacccugucuccaaaaaaaaaaaaaaaaaaaaaaagcccucacauuuuaaugacauuuguuagccauuaagguuuaauuuuaguggauauuaagauuuaauggcauuugguggauauuaagauauuaagguugcuaaaaggccuguuacugauuuucacaucauucaucucagugccuaaacaauguacucuauguacuguuugcuuaaguaguacuuauuaaagcugauaauuauaaauacauauauguuuuauauauauauauauauauauauauauauauauauauauauauacuuuuuuuuuuuuuuuuuuaauuagggucucacucuguuucccaggcuggagugcaguggcgcagucauagcgcacugcagccucaaccucccgggcucaagcaguccucccacaucagcuucccaaguagcugggaccacacacgugcaugccaauuuuuuuuuuugugugugauggagucucguucugucacccaggcuggagugcaguggcuugaucucagcucacugcaaccuccgccuccuggguucaagcgauucuccugccucagccuccugaguagcugggauuacuggagugugccaccacgccuggcuaauuuuuguauuuuuaguagaggugggguuuucccguguuggucaggcuggucucaaacuucugaccucgugauccaucugccuuggccuaccaaagugcugggauuacaggcgugagccaccgcuccuggccagugcacgccaauuuuuaaaauguuuauuucauuuuuauuuuuuguagagauaaggucucacuauguugcccaggcuggucuggaacuccugggcucaagugaucuccuaccuuggccucccaaagugcugggauuauaggugugagccacuguauccauuauaauugauaaauuuauaauuuauaauuuuauaaauauauuauaaauauauuugggggaaguaauugauagugauaaauaauaaacaacguuuuuguuuuuaaaaugaagcucuaaucuuuuuuaauaauugaaaauuauuaaauuaugcuauauuaaaguauaaaauauaaaauacauacuuuuuuuuguuuuuugagauggggucuugcucugucgccaggcuggagugaucuuggcucacugcagccucugccucccagguucaaguaauucucccaccucagccucccaaguagcugggauuacaggagugcaccaccacgcucggcuaauuuuugcauuuuucauagagaugggauuucaccauguuggccagccugaucucgaacuccugaccucaagucauccacccaccuuggccucccaaagagcugggauuacaggcgugagcuaccaugccuggccuaaaauauauacauucuuuaaaaauaacgguaaagugaaauuucauauuuuuuccauauauuuaauaaaggugaagauacgcuucuauaaagaagccugacauacuaauuuuaaaugaaaacauauacuuuuuuuuuuuugucuauuucuauuccuugaggaaaagauagucuaggaagaaaaaaagaucucaggaaaaauuuuaauuaccaagucagagagcuaggucuguccaguaaccaaggcagauuucccacgccgcccaaaagcucuuuucauagaucuccucccucaguuaugagcagcuucuauccucugaccugauaggcucccuauauuuuguuuugccucaaggaaggaagguuuauguaacauauauagggcugcuuugaaaugugggucuguucugcucuagcccacaauuuuuucuguuuauacaucuguucuagagaugucauucaauuagcaauuauaaauagcuaucuaaagccaaagaacuaggcgcccuuaaaacauaaacucugaaaacauucagggaaaggaagccugaagggguuuaaccuuaaccuuuucacuauuauuuccaaagaagauaaugucuuuuaauaguuguuuagcacuuuuaugaaacacauucauuguugcuuaagggaaaccuaccguggcuuuuuaaaauuugauuuaagaauaacuauucuuaaauuuaaauagucaacuauucuuaaaucaaauuuuuguauacauuacugaauuugcuuaaaagacaugccuuaaagagggcaguggaagaaauauaaaggacaauuuugaagcacucgggcccacauguguaugcuaaucaccaaaaacuuuagcccuuuggaaucuugggagagucucacaucagggaguguuugaaugcauucucauuuuauccuuugaccaaauucucauccauucccauuuuacagauugagguuuagaaagagucuauaaaaugauuugccccaaauucuaggcuaguuagugacuagauuugaagccagguuugucagauucuauugccugauuuuuuuuuaagagggagucucguuguguugcccaggcuggagugcaguggcgugaucucggcccacugcaaccuccgccuccaggguucaugugauucucccaccucagccuccugaauagcugggacuauaggcacaugccaccacgcucggcuacuuuuuguauuuuuaguagagacuggguuucaccauguuguccaggcuggucuuaaacuccuggccucaagugaucugcccgucccggccuuccgaagugcugggauuacaugugugagccacagcacccagucucccugaacuuuuaauaacacuaacaccuuggccgagugcaguggcucacgccuguuaucccagcacuuugggagccgagguggggggauuaucugaggucaggaguuuaagaccagccuggccaacauggugaaacuccauuucuacuaaaaauacaaaaauuagccaggcaugguggcaggcaccuguaaucccagcuaccugggaggcugagucaggagaaucgcuugaaccaggagguggagguugcagugagcugagauugugccacugcacuccagccugggugacagagcaagccuccgucacaaaacaaaaaaacacacuacaccuuuaguuccacuagacauuuuucuuuucccucccucccucccuucuuucuuuuucuuuuuguuuuuuuuuuauuuuuaaauucucuuucuuccuuucuuuucuuucuuuccuuccuucccuuuccucccucccuucguucuuuccuuucuuccuuccucucuuuuucucucucucuucaguuguuuauugcugaauugacuccugaaugugugaauuaauaugcauaccugagaaaauugagaauugcaguucugagaccagaagcaauggaccugguggacccaagaauagauuaucugaagcguguccuauuuuacuuucucacuucucuuuucugucuaacaacacuggugcucccucccacucacuuuuuuuuuuuuuaaccugagugauacugugaggccuuauuaauauuuaaauuguuauguauaauuuuuguucuuuuuuguguguuuauagacuauagugcauaucauuuuauuccagacaucaggaaaugcuuuaggguaugggauuuucuuguggguaugaggaagaaaggacaaugggcucauugccugcucagagaauuaaguacaaaggcggccugaguccuguaauucuuaauaacucagaugacugagucaggcaggccagaguucuggccccaaagcuagugacaacuugaaaaguuagucauugaccagacaaucaacuuggaguuuaccuaugaaaucaugauauggugaggauuaaauggagaaaaaauggcuguaacugcacugacugacuuauaauuggugcucaauaaauaauagcugccauuuuguuguuauuguucucucuuuucuuuucccccucagucauuuuugguugucaguucuuuccuuuaaagugcuaguuugguugaguuagaauugauuucauuauauagauaauuuuggaaugucagaauacuauaucuguaauuacauuggacuagucauuaaaagaaaguuuagaauaagauaauagagaaucagucuguagaauggcuauugggggagaacuauuuuugcauuuugcuugucauucuuuuucuauauugaguucauagauuacuauacagcaaucuggggugaguuuguuuucuucaucugaaugcuuaaggaaacuuagguccuccauuugaacaaaucaaucccauacauacaauuacuuuacuauccaguguauauaagaauucacggcugggcgccguggcucacaccuguaaucccaacacuuugggaggccaaggcggguggaucacuugaggucaggaguuugagaccagccuggccaacauggugaaaccccgucucuacuaaaaauacagaaauuagcugggugugguggcgggcaccuguaguacccagcuacuugggaggcagaaucgcuugaaugugggaggcagagauugcaauaagccgagaucgcgccacuguacuccagccugggcgacagagugagacucaugguucacugcaguuuugaucucccuggcucaaacgaucuucccaccucagccucccaaguagcugguacuacaggcgcaucccaaaauacccagcuaauuuuuaaaaauuuuuuuguagagacagggucucccuguguugcucagguuggucucaaacuccugggcucaagcaguccucccaccucagccucccaaagugcugggauuacaggcauuagcuacugcaccugaccucuuuuauuuuuaaagugguuuuuuuuuuugaggggucucauucuguugcccaggcuggagugcaguggcaugaucauagcucacagcagccuugaacuucuggguccaagcaguucucccacuucugccuccugagcaguagggacuauaggcgagugccugcuaguuguuguauuuuuuuuucuagagcuggugucuugcuguguugcccaggcugaucucaaauuccuggccucaagcaaaccuccuaccucccaaagugcugggauuacaggcgugagccacugcaaagccuuaauuuaggccuucuaaaaccuuuugaaaauuuaaauugagauugauuaagccugacagucacuuuguuauauuaguuucaguuugauuuuuguuccugaaaauucuuccugacacaaggaagcucauuauuucugacuugcugauagaugaaagguguauuucuccaaaacuguuguguaaauggugguaaaaucuauaaauuuaaaauaaaaaguaugucaauuaaaaaauuuuaagauacuauauucaugugauucuguuuucauucuuuguggauaacauuuguuguuuggacuagucuucauugaggaacagucugguuaauuuguuuuauuucaugcaucagaguucagcuuuuuguuuauuugaugauaaauaacaucuuaaaauuaacuuacauuuccuaauauuuguacaugccaaauaaaauuucuacaacaaaagcaagcuuuguaaagugaauuuaaacuuuuuaaaaauuuuauuuuguuacuuaauaugcuacagugcauauuuuaaguuauaaagagauugaaaugcaucuuaauacagcuaaaguuuagugacuuccaaagcuauucuauguacagcguuaagaauucaaguaauauuccuuaggaauggugagaagggacauuaaaaaaaaaaagaauucaaguaauauucccaagaaagacaucaaccuuugcuugccucuuaauauuuacacccuuuaaauacuaacacacuauuucuuguuuuuuaaaauucauuuuuuucuuauucauaucauguuaguaucucuagcaaaggccuuuugauuuuaugucuuaauuccaaauuuaggcuuuuuaaaagugaaacuauauauuaucaagaaucaaauaggacauuagaaguucuuggcaguuuauguacuuuauauucuugaaguuuuuacuuucuuauucagcuugucugucauaugauuccuuaucuaagacucaaaaaguauucuaauuuuuuacauuuguauuaauuugcugcuguuauaauagaugauuauaccaaguaaugauaccaguaacagucaaaggagaaaguauuuuaacauucuuucaacuaaauauaccgaaagaagaaacuuuucuugguauuaaauuaauuaaauugaaagugaucuuuauucuguuaauuccuuuuaaaauggaagagaucagcacauaaggauaugguuucuucagaaguuucacauuaauuucuuuguugugucucauuuuagugaauggcuuucucaaaugccaucuauuauuuuuaaccaauggucuuuuaugacuucuuucccagugucuguuuacuaauuuguguucuuuauaucaauauuauuuuaauagcaucacauauuguaaaaaaaguggguuuuuuuuuuuuuuuugccauccuaagcaagauauuagcuacuuuuguggacaccagcauccuuaaauguaagcauuugcauauuacuuucccuuaaaauuuuuuucauuccuuaauauucucuuacuuggaaucgaguagucugauagauaagaaaauuguaccaaaauguuuuccuuguuauaacacuaugauuuuauuccagguauuagccuuaaauauuguguauuuuuucuuucuuuaaaauagaugauccauaauuauauggaacauuuagaaagaacaaaacuucaucagcucucagggagugaucaacuagaauccacagcucauaguagaauuagguaagcuuuguuauauauuuugccuugagaaaaaguaaaauaaauaauauguuuguuucuguuuuucucuguucuuuaauccuggaacaauaguuaggcugauucaaaaagcucuccacugugguuggaaugcugcaggagagaauagcacagaaaaguagaaacgguuuuuaccauuaaaaagauaaauuaugagccauccauauaagcagcacauugaguauuuagauuguuuucugauacuugauggagauuauacuagguuuaaaauuuuguaauuuaugggaaugcugaaauauuuuauuucucccguguaauugguuugaaguccuuuuuguuacagagaggcauguuugaaaggguuagcuagccaucuguuugguguaggagugugaauaaauuauguagaucuucaggcauuguagccaaugagcuaagccaggacucuuaguggaggggaaaauaguuaauaggcuggcugucgcuugggguugcugcauaaaugcuaggagcagcagcucuaugguuaugagguggggagaacggaaugacgucaucgcuugggagcugcugcaggauggaguggaaagcugcugcugauggcauuguuuuuguggcagcaagcugaaugacagauccucacuacaaagauaccccuuuggcccccguguaggccuccuugguucggguguuucaccaugccagcacagcgccaugaguccuggaugcaugcugcuguuuguguuuggcuuuguuggcggggcgguggucauuaauucugcuaucuuaguaucucucucuguuuugcugcuugugcacuuuucuauuucuaccggugugccagcucugacgcagaaccuaccaaggauacucagguacucccaucucucuuagaagccccugcuuagcugguuuuuauuaaauuuuuagcucaacgggucugcuuuguaacaauuucuguugcagauugaaacaauggaaaauggccugaagcuaggauuuuugauucuaauuuauaguaauuuauagaccaucaguuaggauuauagcuuuauguuuggaaaccacuaacuaaagaaaaggauuuucauauuguacuuacacacaaguacaaggucaguguggucuuguuuuaagcagaauguucaaaguaaaagaagagcaagaguagagcaccggcuccaaguuuauacaaccucugcauuuagcuucugagcauuuagggacaaauaucuuuuaugcuuggacuugcagucaguuagauacaggccguaagcuuauuuuguuuuaauuauccuuugaaugauagaguuucagguaucauuuuuguaauuuuugauaauagcucaugggaacugacaauuuaaauauuuuccuccuaaaacaaaauauguuuuaaagugaaaaaauuuaagacuuuuagguuaaggaaugccuuuuuccccauuauuuacacaucaaaguugugaaagcuuuacaaagccuauucacuauuguuuugucagauguugcccuuucuuuucuuuguagucuugggugacaaauauccaugccugcuuguggggguagucauuaaucucuguagcuuuacuguugcucacucuacuuacacccuguaagagccaucuucuguauuuuagaggcuuaagguugugguuucuuuuguuuucuaaaccgucagacuagcagucucugauuuguucagauuucugcuuugugcaugguuuuaaaugaaaguucauaguauauaguuuuuauuuauuauuuaaauguuuauaaaauauuuaaacccuaauuguagauuuagauaaauuaagaagaauuaaaguaguaacuucccuuaauguguuucuuuuuauucauaggucaguucaaguuuaauauuaguugaaagcccagaaauuaaauuucaucaaugacuuaaaacuagauacuuggucuuuuauuuucuuuccugauuuauaaaaauugggaauaaucuuacuacuuguauauauauuaguacauaaaauauuuguguacguguaucuguauauuuaggcuuugaagaaauuaaaagcaacugaacuuaagaauauguagaauauuaauauaagacuaauguuaaggggaugucuuggguuuaggcuucauuugagagggcagugccgugagcugcugugcggcgccugcaaguggguacaacaaggcuuuggaauugaacugccugggugcaaaugcucuauugcacguggccguaggagcuuuggcaaguugcuuaaucucucugccugaguuuucucuccugaugggacuuaccccguugggugguuuuaaaaaucaagugauuuuauuauuuuguauuuaauuauaguuguaagauauaugguaaauuacuugaguaaauaauuuucaguuacuuauauguguccauuuuuagcagaaauuguuuuagcuacagcuaaaauaccuuauaauuaaaauuuuaaaguucuuuaccacaaaaauugcuacugaucugauuaaauaaagauaucaaagucuuugauauuaagauuaaauugucaaaaaguugguaguuccaaguaggaaguuccaaggaaagcaaagggcuuggaauugaacaguacuggcuuugaaucgaaacucugccaauuacuagugccuaaaaucucugagcaucacuuuuccuacucugaaaaauuggaaaaauaaucccuguuucuugauaaggauuaaaugcgauaauguaaauaagucaucuagcucaguacccaccacguggugaguguucaacaaauguacuuuuucuuuuaucugccuuuauauauaaagcagauuuuacuaauuaguuguaucaaaugugaauauagccaaaaagcuguuccaaaaauguaguuguaaaauuauuuauauacauaagcuaacauuuaauaaccaacucaaaaauggauauauggaaguagggcaauuaagaaaaaagaauucugauaguuguugauagcuucguuuucuagacaaguaauagcagauguuuuggucugcagguauaaaucugccacuugauaguuuuccacguguaucucauuuuuuuccuucuucugugaguuugaagcauuuaaugcaugccaacauaguacuggacuaauguuuaccuuucaggguuucuuuucaaaaguaggauucucaugaacuugccuaauuaugcguccuucucucccuuaccccaacuguauguaauuuguaaguaaaguaaggggaggaguauguaguaauuauuuuuucagaguuggaacauuguaaccuagagcaucauugacccacuugacagauagcugucagucucugaagagaucuccccucccuguagaguaguuucugaaugauugauacaagcaaauuaaaaaggugggaauucuauuugcaauuuggguuguagauuuuguugacuguugauuguagauuuugucaacugauuuuguuuacuuuuuggaaaguaaaauuuggauucauagaagacucccucccccaauaguuuuaaacuuuuucaauauuuguuaugugugaaaaugaauggcuuauauuuugauuucuauuagugugagggagucuuaugaagucuguauaucaucuuccugguugucuuugcauuuugaguuagagagcuuuccauuauauucagucauuaaauucccagucaccuuuugcuuaacucauuaagguauguuagaaaauaaauaaaagucagcuaguagcucuuaguccccuuggauuuucgguucacaaaauauggggggaaaacaucagauugacaacuuuuuauuuuguccagaaugaauaugaaaaggaaaucuagcuacuuaucacugucaccaucauuuaaugaaagaaagggcauuuuaaaaucaaagaagaagaaaagauguaauuuaaaauaagggucagucauuuucaagaaagaacaggguucuauaguauaugggaauguguauguguacaauagguacuauauuaucuaugcacuaaggaaauaauaaauaacgccucuuuuuucauggacuuauuauaaaaacuuuguugcugaacagcauuugggaauaacugguguaaacaugguagcugacuagucacuuuaauuuuugucauuugguugucccggcagcucauagucgcaaacuuagauuugguguuaaaauuuacccucuuggccaggugugguggcucacaccuguaauccuagcacuuugggaggccgaagcaggcagaucaugugaggucaggaguucaagaccagccuggccaacauggugaaaccuugucucuacuacaaauacaaaaauuagccagacguggugguaaugccuguaaucccagcuacuugggaggcugaggcaggagaauugcuugaaccugggaggcagagcuugcagugagccgagaucgucccacuguacuucagucugggcaacacagcaagacacaaacaaacaaaaacuacccucuuauuguacugccuuccugcuuuugaauuuucccccuaaaucaaaguucuguuuuuaaauuuuauuuccuugugcauacaacuuugacuaaauguagucucucaaccccuuugcuucaccucauuuuuaagaaggcauugggauaguuuuacuaguccuuuuagauuguuaggaauggaagaacacacccuuuguauuaagugaagacacauuucaaaaguggcugaaguuucuuggaauaaaaaugaacuacagaauuaaagacuuacuuagcaaaacugaaauuuucccacuuuaauuaaugagcucauuguuuuuauucuaacuuacauucuuaccaguagagguaggaauuccaggaggcaccaaaccuuuaguguaucauuucuuucuaguuucuacacuuuugaguuaaugacccaggaugacccguuaguaggcuuguuuccacccucuaaaagcucuucgauuuggaaucuugugugcaucaacaaaggauguguuucucguugaaauucuguuaguauuaaaauuguaacucuuguucauugaaacuucucacaaagcauuggaaauucaguaaucuuuuauagaauuauuugaccuucuuauuuggaaaaaaccgacaaugguuuucucauauguacugugcuugaaaggaacucauauagugguucuguagaaaaacagagcuuucuuacuugggugguggggagaaagauauuuugaguucuuuucaucauuuaauagguagcccugauuuagauaauauauugauuuuccucuaggcaggaaagucauacccugaagaagcuucaguaaacauccagggauuagcgagaggauuugggaagaaauggguuggauucacuuccaaagaaggagguugcaaguucccuagggcuaagcuacguaugguuaaaaacccagcagcagcucuucuccagaccacacuagaccacugacugcuucuugggcaaggaacucgucaguaacuuuuaagauuuccuuaacccuucuuaccacuuuucuuaguugauuucuugaggcuaauuuccugaggcuaacuaaacugagacuguccuuccucuuugguaagucuguuuuauucagaugggcagacagugucauuuuugagugaugguuguaaaacaguggcaguccaggcuuauuacuuauagucauggcaaauaaaaagucaaaauaaaugaaugccgaauuuuuucuccccucuucaaauagaaaagaacgcccuauaucauuaggaauuuucccauuaccugcuggagauggauugcuuacaccugaugcucagaaaggaggagagaccccuggaucugagcaauggaaauuucaggaauuaagucaaccacguucucauaccagccugaagguaagcuuuaugcugcugaaauugugucaguuuauauuucauaaacuuucuuauccuaauugaagugcuagacgaccacaguauaguaaaauguaauuguuuguauacauuuaguuuguaaaauugguuuuuuaaauuggaaaugagcucuuaccaaagaguguguuuuuuacuauuuuauuucaaauuauauaggaaaaaaagugaagcauuauaucaucuugauuaguauacuaaugacaaaaauuaauuucuauuugauuuaggcuauaugaguuuagaguaggguaacuagugaaccuaauuauauuagaauugaaaaucgcuauuaccagaaagucuugguucauguuagaggcuuuccaauuuaguaggguuucacuuacagaaaaacaaaacaaaacaaacacacuguuccuucuuuaaaaccgcuucauagagcagucuacaaaaaugcauuauguuuagcuaaaaaggcgugguguaaauuaauuauagauauguucuugaccaagaacuugucaucaaauaagugauaaauauaaacaauaauauaugcugaguggauauaagcuaauaauuaacuuuuaagaauauuugaaguucuguaucuuuuaaaaugaaauauucaucauauugauuauaaaagaucuuuuguuaccuuauaaaaucaacucaucaugaaacaggccaccugcaaugaguagaaaugaguuacauguaucuuauuuccuuuuccugcuuuauuuuucuccauaauacuuaucauggucuaagcauguaaagauagcucuuaacaaugcuucuaaaauacugucauuuacuguauuuaguugccucuagacucuucccuaagaacauaaauucuaugagguuuauuuacugcuguaucccccagcacuuggaaaagugccuagcacauuauagguacucagaacauguuuguugagugaaugauuuguuuuagauguuagaaggaaucuuuggggacaauauaaguggucuuucucucaacucuagaauguagaggcauucagaaucauucuauugaccuuugaaaugugcucaaaacaguaagcaguugauaaauauuugauagcuuuucucccacugaaaaucauuuuuaacaauagggguuaccuuaccuuuucucccuucuugccccaauuuguuagaagcuaauagugcucaguauuagcccacagugauguuacugggcaacucgcucgcucucacuuuuuuuuuuuuuuuuuugagacagagucuugcugugucgcucaggcuggagugcaguggugagaucucagcucauuucaaccuuggcucacugcauccuccuccuggguucaagcaauucuccugucucagcuucccaaguagcugggauuacagcacccaccaccacaccuggcuaauuuuuguauuuuuaauagagacagaguuucaccauguuggucaggcugaccucgaacuccugaccucaggugauccacccgccucagccucccaaagugcuggaauuacaggcgugagccacugcgccuggcugcaacucucucuuucuuuacuucuguaccacaaugggucuuuuagccuuccugcagguuuaauagauuuuccaaaacacucaucucucaauugccuacuugcugugugugcuuucccaaaacaaaaguaggagggauacuuuuaguacaaaaaaaaguaucccauaugguaacuauauuuuaauacuacccaaaagugcgccuuaagagauuauuauaauucucuuuauuuuuuacuccacugauaggcuaugccagaacuuuauugacaacuuauaaaccgauuaacaaauuauuaguauagacuuaagcagaggaguuucucguguccucccuagaggaggacuugccuuaguauaaggcagguacucaccagagaguuucuaaaacaaaacccugucucucucuacuuggucuggaacuggagccaccgaaugagauaaagacucaaugaauaaggauuuccaggaaugggguggugcuuacaaaauggcaaaagucuaguuuguaaaucauguuacuaguugggauguacaguauuuuauuuuucaccuaagcccuugucguucacuagauaacuuucuacuuuaccagggcuggaagucagggguuuaggauucacuugugggcuaugccacagguaugucacaugcccugucauuuugguuucuguguauaacaggaauuggacuagacucuaauuuaaaauaucauuuccccugagauugaggaugaccuagccaucuuagggcauguuuugacuucauuaugaaaaaauggaagguguaaauuuauaauuaauguuaguguuacuaccacaauuuuucugugaaguaagguuaaggugaaaauuuccugugagagaacgacagaaaacuuuguggcagaauagcagcagauaaggggauuugccagugauuguaaaguuaugggccuucuuuguugguguauuacaaauuucucacugugagagaccuguggugagugagguuguaaauaaucuaauagauuuucuaggaaugaugcaccuagaaaaauguacaaguucuuaaaaagaaauauuuguacauauucuugauuuaucacaaucucauggagaucgacaaacaaguaaacaaauaaaugaaauaauagaacuucaaguauuguuaaagcaagguaagcuaaagaguaauuaguaaggauggguacucauuuuaggguaugagagaaagccucuggaagaugacuuucauccugacauggggaugugcaggugcauggaaaggucuggaggaguacguguugaggaagaugagauggcaauugugaaggcccugaaguggggaagcacuucagcauguuuaaguggugguuuucucuucaucacacucagacuuucaguccuaccuacugcaccaacaugccuucugucaagggugccaaaagaauccaucguuccaaauauaauggaaaauucucaguccucaucuuaccuuuuaguagcauuuauauauuucaauauauucagcuucuugaaauacuuccuucaguuuucuuccaggauuccccauggcaaacacacacugauuuucuucaccauuccuucuccauugcugguuucucuucugcuuuuggaccucuaaauguugggguacucgucagcccuucuuuuuacuuaaucuggguagaucaaauuccaugucuguaaaugccaucuaugcaucagugcucacaaauuugaaucuacaacucauaucucuucccuggacucuagaccucugcaucuaauugcuuuucuuuauaguuuccucacauacauaugcuuuaccuugccuagauuaccacuaguaaaaauacccuaauucaaggccagugcaaauaccacaguuuacauguagucucacuaacgcccuagagacuaacacccuguugauuguccucaaaucgaguuuggagaucaguucaagaagaaagcagaggaguuuuguauugcuucauuaacaggaauuucguaccgggggacuucuagugaaauugauaaaaagaaacuccuuauauuaaauuaucaaagcuguugcguuaaagagcauauuauaaaagugcuauaggcuggacagguggcucgugcuuguagucugaguacuuugggaggccaaggcaggaggaucacuugaguccaggaguucaaaaccagccugggcaacguagugggacuccgucucuuuuuccuuuuuuuaaaaaaauguuuauacacacacacacacacacacacacacacacacacacuauauauauauauauauauaaaacacauauauuuacuuauuuuauuuauauauauaauuuuuuuuuuuuauuugagauggagucuagcuuugucccccaggcuggagugcaauggugcaaucucggcucacugcaaccuccaccucccagguucaagugauucuccugccucagccuuccaaguagcugggauuacagacguccaccaccgugccuggcuaauuuuuguguuuuuaguagagacgagguuuugccauguuggccaggcucuugaccucaagugauccaccugccucagccucccaaaguccugggacuacaggcuugagccaccgcgcccggccuauuuuuuauguauuuuuaaaauuuauuccucuagugucaagcgacucugucucuacaaaauauuuaaaaaucagcugggcaugguggugugcgccucuagucacugcuacucaggaggcacaggcaggaggaucaacuugagccugggaggcugaggcuauagugagccaugaucaugccacugcacugcagccugggugacaaaguccuugucucaagaaaaauaaugaauaauaauaguaauagucaugggcuaagacugagaauggacaaaauguuaaggugagacaguuaaucuuacugaauuauauucacaaagaagcuacaaaugaaggaauuggaaaacaaaaggccaaguauaaccaagacaguccugaagaacaguaaguauaagaacuugcucuaccagguauuaagauuuacuauaaagcguaauuauuaaggugguauaguauugcuucaucuucccuuucucuuuccuuucugcacaauuuaguucuaaagccaccaggcagggcagaggaagguaaggcuuuccauggugcuuaggagcaggggugggguuguuaucauaaccuaagcaaaguuacaaggguaauccauaugggguagccugguguagagagucagggccccagcaacauuaaggacaucccugcaggauggcagccaggcuuggggguacaagacccuaaacaggaugaugagagccuccccaaggagaggucccagguauagagugucagagccugagcagaugaggaaggcagcaucugugugugguagggggagagggggcuggaguggagaagaaagaagaugcaugggaaaagaagggcauuaguggagggcuguaguggcagagaagagagaccguaagagacuugagcgcugaaagucgaggcacaaagggaguuuuagaauggaagaagaugucagcagggucagcugguguggggaagucaaguagaaugaggacugaauuuguaaauuuauagguguagauuugagcaguuuaaguuguagggccaguaacaggaguaacuguaaaucauaaaaagaggaaauaacauguguagacuacucaaaauggugauuguggugggaggagagaaaaaggauaacuugagguggagauuggcagagcagagggaaaaguauagaaugggagagacuggguuguugcuaugcuuacaagaaggguucaauagagagaaaaauugaagacaagggagugaagaaagauaauugauguaucagaaucuuagaagaagggcagaggggaagggaucacauaucccagcugcaauucagaucuccuucguugcugagacagcuucauuuuuccuagucuuuugcuguuacaaauaauacugugguaaauaaccauccaaggccuagaaagcaucaugaaaauuauauggcuggcauagaacaugcacacacauguaugcauguguauacauauguacuccaaaaaaguauuuuuuucuuugaagagcauccuugguuguugauuauuaguagaaugugaccuuuagaucugagaaaagcaauuuuaacuaacuaaaccaauuggauagacaccuacuugugaaaauuuuagagaguucucauaaaaucacaugacuugugauacuuuaguaaacugcugugagaagcucuuguuagcagaguuugguauguaaagccagucaaugugugcugcauucuucaggggaugugcuuagcaugcagaacaggaaaugucuaaacagagccagcauucuuguugagagaauuuuccauccuccuccauuugugguuaaguucugaaauuguuccuauuucuuuaguuucuacaagcuuuaaucucuauaguaguugaaucauaucuauuguuauuugcaauuccuauuauaaaaugcauauguaauuuaaaaaguuaaaguucgcaguuuuaaauaacuuuuuugaaguaauuuuagacuuacagaaaaguugcaaaaauagugcagaguuccauauacccuucacgcagcauccccugauguuaacuaaccauaauacaaucaucaaagcuaugaaauuaacuuugguacaauacuguuagguaaaccuguauucgaguuuuaccaguuuuuccacuaauauccuuuuucccuuccagaauccagcccaggaucccauauugcuuuuuuaaaaaaaauuuuuauuacagacagggccucacuauguugcccagguuggucucaaacuccuggccucagguaauccuccugucucagucugccaaagugcagggauuauaggcaugaaccagcacaccuggcuuccacauugccuuuguacauuaugucucgccaguguucccaguguguaacaguuccucagucuugucuugucuuucaugaccuugagacuuuugaagaguacugguuaguuguuuuguagaaugucucucccuuugggcuucucugauuucucauuauuagauugagguuauguauuuuuggcgagaauauaacagaaucuaguaucuugguguggauauacuuugagacugugcagauacccuguuucugcucaaacuuucauucacugauuuuagcauccacaguggauuuugccuacaacaauuauuaguaaaauauugcuaauaguuauuuucuauuuucuucauucuacauuuauuaauuggaauucuucuaucagggagaguugucuucuucccuccuucccuccaguccaguuugaauucaagggauauauacauauauuauucugugggcuaugcgaaccuaucauuucuuugguuucucaaauuuuucuagcuuuggacauugagagcucuuucagguuggcuccugugcucuuuugacauaccccauccuuuuuugaaugcuuucuuccuuauuggcaccauaagaugcucuaagcuguuguauuuucccugccccacucuuaaaaauuggacuacuucucaaaggagcucuggcacauuuuuugggagaaguguauuuaggaaccaagaucuaggcauuauucauucauuuacuucugguuuggguuuuuccauuaguuuauaccuccuuuauagaauuuuguauuagugugccuacuaggguaaaauaaaaguagaguuuuaagaaaaaaauggauuauguguuguaauauuucauauuguuuuguuuaugacaguggauaaggaauuuguucuauaaacucaauuuuugcuuauaagcuuuuuuccucacauauaucuucaugugauaacuuuaggaaccaccuauaggugacuguuaggguuuggaaggaaaaaaaggguaaagauucuauuguguuguauguugaccaagaugccuauuauguauguugagaauagaaacugauaaagauguaaauaagcagcacuuucaaaauggcgguguuuaaagcuuguauuuuaaaugugacuucaucugagguaauuggcacauagguauuuauuaauacuuacauuuacuguuuaaacagacuuuuagaauaggagaaguuguuuaacauuuucuacugaaaaaauuaccuuuuucacucaaaaaaauuuauugaugcucacuguguuaggcacaaugccauguacuagaaauguuguuaaggugcucagagguccaaauauuuucuaaaagaggccuuuauaauuucuuuuaaaaaguuauuuuacuacucaggaggcugaggugagaagacugcuugaagccacgaauuccagguugcaguucacuguaaugguaccugugaauagccacggcacuucagccugggcaauaucgcaagauccugugucuaaaaaauuauauuaauucaguuucacaauuuuuaguaauacugaagaauguggaguaggaaugggaaguuucuucaacccuaaauuucauuuuuucccccagucauuguaaauaguugauguauccuuggccuuuuucuuuacaggugcacauagauauaauaucuuuuuaagauaaguggguuuauaaguguuuuccugcugcuugcuuuuuuuuuuuuuuuucauuuaaugacauagcuugacaaucuuucuacuuuuauauagagagagcuacccaaguuuuuaccuaguuuuugaugaagagaaugauuaaagaugaugagaaucuagaaucaaagaucuuauaaauaaacauuaagugcucuuaccaccaaaaaaaguaugacgugcuagauauguuuauuggcuugacuguggugauuguuucacaauguguauuaaaaaaaucaccuuaacuauaugcuguauuugucaguuauaucucaauaaagcuaggggaaaaaaaaaaaccacaucuguuaaagaagaggcagucugauuccuacaaagugaaucaugccuuguuaaucuguguauuuuguauuuuuuauuuuuuuuugagauggaguuucgcucuuguugcccaggauguagugcaauggcgugaucucggcucacugcaaccuccuccuccuggguucaagcgauucuccugccucagccuccagagcagcugggauuacaggagcccgccacaacgcccagcuaguuuuguauuuuuaguagagacaaguuucuccauguuggucaggcuggccuuggacucccgaccucaggugauccaccugccuuagccucccaaagugcugggauuacaggugugugccacugcggccggccuaaucuguguauuuuuaagggcauaacugagagcuagcagccuuucaaaaagacuuugaugaauuuccagaccaagaguauuugaaacuguugcuuuguauuuaagagaaacacauccgucucauagagggaaaauguauagauagaaauaaagaauaugaauaaauagauuuuuaugaaaaaggauuugggacugggcacauggcucaugccuguaaucccagcacuuugggaggccaaggaagauggaucacuugagcccaggaguucaagaccagccugggcaacaaggcgauaccaaaucucuacuaaaaauacaaaaauuuauccaggcauggugggguacacuuguagucccagcuacuugggaggcugaggugggagaaucaccugaauccugcgaaguugaggcugcagcaagccgugaucgugucacugcacuccagccuggacgacaggagugagaccgugucucaaaaaaaauaagaaaaaggauuuggauuuuggugauccuuugaucauuaguguuaucuaacuaauucagaaaugauagaaggaggugugauaaacauuucugaguaugcugcacuggauuauuagcauguuaaauagucaaagggacuggaauaaacaucaggaagauuucauaaagugguguaaguagaaaaaaaagguuaaacaaugagcugcauguugauaaguauaagacacugauccaagugguggcuucugaaccaugauauuacuuaaacuagaguguuaaggucagcuuaagucaaaauaaaacaaagcuuccaaacccucauuuuaaacacaguagauaauagaugaaucuuguaucuugggagauaguacaagccaaaguuacagcuguguuaaaaccuaguaaacacauaauuuuuuucucuuuuauaaucuucccucuuccuaggucagcaauaguccugaaccucagaaggcuguagaacaggaggugagaauggugcuucuuaacauuuugcaaaaaguauacuaaagugauuaacuauugauuacuuccucaacugcuauucucaagacaucagaugcucagcuuggaagacuauuguuguaauucacugaaauauaaaagaaaauuauuuccacuguagugguugucagggcuuuacugcaaucuguaauuuauuccuuccccaaaguaagcauuuuuaaauaaaggaaagaaaauauaaguaaauucugugaaauucagccuguuugcauuuauccagcucuauguaaugguauacuuuccagaaauaccuucuucagggcauaauguauguaacuuguauuuguccugaauguggccuagugugucaucuuacaguggacugcuuccuuaguuuaauagaguucuucaucuccagucagggcaccauccagcuuuauucaucaaacaucuguuaagagccuacuacaggccaggugugguggcucaugccugaaaucccagcacucugcccaggcaggcggaucacuuggucaggaguaggaguucaagaccagcauggccaguauggugaaaucuugucucuacuaaaaauacaaaaaucagccaggcaugguggcagacaccuguaaucccagguacuuaggagucugaggcaggagaauugcuugaacccgggagguggagguugcagugagcuaagauggugccacugccuuccagccugggcaacacagcgagacuccaucucaaaaaaaaaaaaaaaaaaagccugcuacaugucaggcuugauaugcugggcacuggggauaacaggauaucugugacuuucuccuacgugcuaggucagggguugaccuggguccauggaagcccucuagcaucaacagugaaacaguauccucuuccuuugaaauauacucagaguuaggacauucauaccuuuccuuuaauaauuugaauucucuugaagcuaccauucuguuuacacuuagauggauuuuaccuaaaugugaguaucuagaguuaagguuuuuaguguuuccuuugggucacagacucuuaggagucaaauuauuugaaacucuccagaagaauguauguacacaccauuuuguaacucuuuuaugccacauagcuguaaaucaaaagaguuuuaagaaccaaugcuuuagagacuuacuuuuacuuggggagaaagaaauguagguauaaaaguauauuuguguuaauagugagggauccuauguggggcuaguuacuuguuuguaguuuugucuuuauuuucauuuggcuuaaaacccucaaaucuaagagacaaacuuagguagcagaguugcuugccuuuauaugacuuauuucagaaguuaggcuacucaggaaaacacuacauuggcauguagugucuguaaguugaacugaaugggauaauucauuuucucuaguuguaaacauaguuuauagucuguuagaaaauaguuaugcugcaaugccagauaauccaugacauauauauucuguauagcacuaagcacauggugcauuugguaaauggaacaacugaaaauauuuugaagagcuuauagacuuuuagccugauauuuaaaacccauaagaaaauggcacaaagaccagauugcuuuuacugcaguaucucaagugaaacugaaaguaaugacguuuauuuugugugugugguaaaaacacauaaaaauuaccaucuuaugaccucugauguggucuccacagggaggaaaaaaaugaccauuuuaaccauuuuuaaguauauaguucaauaguguaaguauacaguucaauaguguuauguauauucauauuauuguaaaacagcaccagagcuuuuucaucuugcaaaucuaaaacucugcacucauuaaauaauaacuuccuuuccaacuacuguagccccggaaacuaccauuuuacuuuauguuucuaugaauuugaugucacauauuaaauaccgcacauaaauagaauuauguaguguuugucuuuuugagacuggcuuauuucauuuagcauaauguccucaagguucauucauguuauagcaugugacagaauucccuuccuuuuuaaggcugaguaauauuuauuugauuguauguguacaccauauuuuguuuauuuauuuguuaauggacauuuggguugguuucaccuuauggcuguuacgaauaaugcuuuugugaauacauacccagaagugagauugcuggaugauaugguaguucuauuuuuaauguuuuuaggaacuuucauacuguuuuccagagugguugcaucauuuuacaauccuaccaacaaugcacaagugucuaauguauucacauccucuuuuucuugauaguggucauccugaugggggccaggugaugauaucucauugugguuuugauuugcauuucuccagugauuagugguguugaucaucauuuuauaugcuuuuuggccauuuguguuacaucuauuuuuuuucaaagcacaauuuaaauaugcacagacaugccauucuuuuauaugcacuuccaaaucuuguacuagcuuuuugugaacauucucuagugacauguacaccuaugauguggcaguucccuaaaggcucuaaaggggaaaauggggcuauaaaauaaauauguuagaaagagacuugaugacugcguaagucuccauguuugccaccacucaugccauugaaaaagauaucuuaaugaugucagacaauaggauuugauaggcuaguggucauuugcagucaagaguauuagccaaaacagcacaaccuggcaagugaccuguaaagucuaauauaaaauaggaauuugcagugucaagaagccacagauugaaugugaaaugacagcaugcaacuccccuggaacuuuauguugaaugauucauaauaaaugcuuuucaauuaggaccucuuaagaauuuucccuuguuugcauacauagucaugugucgcuuaacaacagagauacauucugagaaauguguacuuaggugauuuuguuguaggaacaucauagagugaauuuacccaaaccuagacaguauagcuuacuacacaccugaacuauaugguauggccuguugcucuuaggcugcaaccugugcagcauguacugaauauuguaggcaguuguaacacagugguaacuauuuuguguaccuaaacauagaaaagauacaguaaaaauacaauaugaaaaauuuaaaaugguauaccucuauagggcacuuaccauggauggaguuugcaggacugcaaaugcucuuggugagucagugagugagcagugagugaauaugaaggccuagagcauuacuggacauuacuguagacuuuauaaaaugcuguccacuuaaacuauacuacauuuauuuaauuuuuuucuucaauaauaaauuaaccuuagcuuacuguaacuuauuuacuuuauaaacuuuaaauuuuuuuaccuuuuugauuuuuuuguaauaauguuuagcuuaaaacacaaacacauuguauagcucuaugaaaauauuuucuuuauauccuuauucuauaagcuuuuaucuauuuaaaaaaaauuuuuuuuuuuuuugcuuuuuaaacuuuuuuguuaaaaaccaagacacacacauauuauuagccuuggccuacacagggucaggaucaucaaugucaguaucuuccaccuccacaucuugucccacuggaaaguuuucaggagcaaugacacacauggagcuaucaccuccuaugaugacagugccuucuucuagaguacuuccugaaggaccuaccugaggcuguuuuauaguuaacuuuauuauuauuuuuaaguagaaggaggaguauacuuuaaaauaacaaugaaaauuuuaguaaauacauaaaccagugacauaauuguuuaucauuaucaaguauuauguacuguauagaauugcauguacuauacuuuuauacaccuggcagugcaauaguuuuguuaacacacuagggcauugcacugggauauuaugacaguugcaacaucacugggcaacaagaauuuuucagcuucauuuuaaucuuaugggaccaccacuauauaugcuguaugcugucuauuauugaccaaaaugucauuaugcagauguggcacaugaucguauuaucuuaugaguguacuguugaccaaaaguaguauauuuuaauuuuuaacaggucaaugauuuuuuuuuuuuuuuugagacaaggucuugcucuguuguccaggcuggagcgcagugguaugaucuuggcucacugcaaccucuucccccuucuggauucaagugauucucgugccucagccgcccagguagcugggacuacaggcauaugccacuacacccagcuaauuuuuguauuuuuaguagagaugaguuuucaccauguuggccaggcuggucucaaacuucugaccucaagugauccaccugucuuggccucccaaagggcugugauuacacacaugagccacugugcuuagccucauucugucuuuaguuggaggcaguuagugagguauaaugcaagaauauugugccccuggccaaauacuuuguccgauuucccaucuaagugcuuuucugcuaaucuuagaagcuuuaugucaccacugccugggauaccaagaagaaagaccucuuucaaaaaugguuucccggccgggcgcaguggcucacaucucuaaacccagcacuuugggaggcugaggcaggcggaucaccugaggucaggaguucgagaccagccugaccaacauggagaaaccucgucucuacuaaaaauacaaaauuagcugggcaugguggcgcaugccuguaaucccagcuacucgggaggcugaggcaggagaaucacuugaaccugggaggcagagguugcggugagccaagauugcgccauugcacuacagccuggggcaacaagagcgaaacuucgucucaaaaaaaaaaaaaaaaaagaaaagaaaaagaaaagggcucaaccccuaaaaucagagcuuuucccuucucagcucucaugcuguaucucugggaucuaguugucagaaauauagcccacacauugggcuauuuuaaagaguguaaaauauuuuuaugugguaaguauaaaagggaaguaaguuacauauaaguaaauuucauuuuauuuggauagccuaggauaaauuuaaaacauaauuuucuucuaaguagaucuaaauuaaccacuuccuuguagccugaaaccuugggauugcugagguaucauggucccuuuccuguuuuagguucagcucucuccugguuauuuuuuuuuuuuuuuuuuuuuuuuucucuuuucaccccaugauaucuagacugucuccugguuauuuuauuucaugcucccagauccacaaaugaauuuggaaaguaggccuuugccacacuucauauguugugaacuuuuaaauuacuaaauacaauuuuuucugaggugaaaauaaccugccuuuuguggggagugggggacuggaauaauaaggaggaagaagaaauaauuucucuauauuuaagagguaaaugagaauuccaagauugaccucaaauuauuuauuuuugacauaguuucaaaggcauaucacuuucucauauagaugaacucaauauucucuagggcuuucugaauccgccgucuuaauggguuuuaagugcuuucaucaacacuguuuaucagaaauacagacuguuuauuuuauauuuuuuaauguguguuacguuugaaacuuuuaaagaaugagaauucauguacaugauaacaugggugcaaucugagcucacugcagccucugccuccuggguucaagcgauucucaugcuuuagcauuccucguagcuggaacuacaggcgugcaccaccaugcugggcuaauuuuuggcauuuuuaguagagacaguguuucaccagguuucccaggcugaucucaaacuccugggcucaagugauaugcccaccucaaccucucaaagugcugggauuacaggcaugagccgaccguguccagccaaauaccacuuauuuuuuaaucgaguauacaucaaagcaaagacaaugcaaauggugcucagagggacuuguaguuguuuucacuaucaaucucuuuggcuccagagguguuaaauacugucaguuuuuuuuuuuuuuaauuaauacugucagucuuuuugacucaacuccaaacaaaugaauuugcuggaauuaguagguuucuaucagauacuuuuauauuuuauauugggugccaguuaccaauucaagaaaauagcauuuuuuuuuuuuuuuuuuuuuuuuuuuuuugagacagagucucacccugucaccagacuggagugugguggcacaauuuuggcucacugcagccuccgucuccuggguucaaugauuccucugccucagccuccugaguaccugggauuacaggcaugugccaccaugccuggcuaauuuuuguauuuuuaguagagacgggguuuccccauguuggccaagcuggucuggaacuccugaccucaacuaauccaccuaucucggccuuccaaagugcugggauuacaggcgugagccacugcaccuggccaauuuuuuuuuuuuuuuugagaugaagucuugcucuguugcccaagcuggagugcaguggcgcaaucuugccucacugaaaccucugccuccuggguucaagcgauucuccugccucagccuuuuuuauuuuauugugguaagaacauuuaauaugagaucuacccucuaaaaauuuuaaguguacaauacauuauuauuguuuuaugugaugggaucuugcuguguugcccaggccauucaagcgauucuugugccucagccuccgaaguagcugggauuacaggcauacaugaaguauuguacaauuuuuuuuuuuuuuuugagacagagucuugcucuuuuugcccagacuggagugcaauggugcaaucucagcuuacugcaaccuuugccuccuggguucaagugauucuccugccucagccucgcuaauagcugggauuacagacgugugccgccacgcccggcugauuuagagacggaguuucuccauguuggccaggcuugucucgaacucuugaccucaggugaucugccugccucguccucccaaagugcugggauuacaggcaugagccaccacgcuuggccaaaguauuguacucuuaacauggauaugcuauuuuauuuuuauauguuguguaaaauauauuguacaauauauuauaauuaauauguacaauauacuguaauuaauagugauacaguauugcaacugccauuaaaaugauguugacaucaguguguaauuuuaucacuaaugcuuuuccuuuuuuggagagagucucgcucuaucccccaggcuggagugcgguggugcgaucucagcucacugcaaccucugccucccggguagcuggaauuacaggcaccugccaccaugccuaauuuuuguguuuuuaguagauuacggguuucgccauguuggccaggcuggucucaaacuccugaccucaggugauccgccugccugggccucccaaaaugucgggauuucaggcgugagccaccgagccuggcugcuaaugccuuucguauuguauuuucaaauuuucuauuuagaaaaaucggcugggcgcaauggcucacgccuguaaucccagcacuuugggaggcugaggccagcagaucgcuugaggccaggcaucugagaccagccugggcagcguggcaaaacuccgucuguaccaaaaauacaaaaaauuaguggggcauggugacgcacgccgguaaucauaggugcucaggggacugaggcacgagaaucgcuugagccuggaagguggagguugcauugagcugagauuaugccacugcacuccagccugggugacaagaacgagacucugucuuagaaaaaaaagaagaauuucauguacgccuggaaaaauacgauuuacuuaaauauuucccaauuauuugcagaggagcuagagagauuauuuauugauaaucggugacucuuuauugccuuuuaaaaaaauugugacuuucucugggcaaauuuauuucuuaaccaauuuuuaaaguacuuuagaauaaauuacucaauuaaaauuucuuuuaaauuacuucuauuuguagguugaacuuucugauguuagccaagguggaucuaaagcuaccacuucagcaucaauagcuaaaucgauguggcaauaauuccugcugauacucccuuaagggaauuauauauaguauauauaauuuauaauuaaaauauuauaaauuaauaaauuauaaaaauauauaauuauguauuauaauuauacuaauaguuacuauuauaauaguuauaaauuauaaaaauauauaauuauguauuuagaauuauacaaauaguuacuauuauaauaauaguuaauauuuuaaauucuuaguaugugugaaacacauugcuaagccauaauguagaauaacuuaauaagaaucuuaagaaguagauacuguuaucuauauuuuacagaugauaaaacaaagguuuagaaagaauacauuacuuacccaaggucauacauuuagugaaugauaaauucacuuaauuuacccuaacccugauuuauuauuauuauuauuauuauuauuauuauuuugagauggaguuucacucuuguugcccagacuggaugcgaucucagcucacugcaaccucugccucccggguucaaguguuucuccugccucagccucccgaguagcuggaauugcaggcaugcgccaccaugcccggcuaauuuuuuguauuuuuaguagagacaggguuucuccauguuugucaggcuggucuugaacucccgaccucaggugauccgccugccucggccuccaaaaguguugggauuacaggcgugagccacugcacccggccuauuguuauuauuauuauuauuauuauuauuauuaguggugguggcuguaaacuuuuugucaguuucucuuuucuuaaaaccugggugcuccaaaagaacugcuucauuuuugauagccacuggacaauuguuuauaauuauuuuggagcugcaaaccccuuugaauaucugauaaaagcuaugauucuuuucccagagaaauacauuguacacaaauuuuugcauacaauuucaauuugcauauaccucuugaaaccuaucuguagauccuauaauagugaucaaauuucaaugaguauguaacucaccuggauugcuuguuaaaauauagaugaccuauucucacugcccaaaguuuggugcauuaagucuggaguuggacuuagacucugucuacuccucccuacucccuacucuuuucucuuuuuucaaagagacagggucuuguugggcucaagggauccucccgccucagcugggauuacaggcaugugcguggcuggaaucugcccccucuccccgcuuuuuuuuuuuuuuuuuuuugagauggagucuagcuccguugcugaggugggagugcaguggcgugaucucagcucacugcaaccuccgccucccagguucaagcaauucuccugccucagccucccaaguagcugggaucauaggugccugccaccaugccuggcuacuuuuuguauuuuuaguagagacgggguuucaccauguuggccaggcuggucucgaacuccugaccucgugauccgccugccucggccucccaaaguguugggauuacaggugugagccacggcguuuuaacaagcacuucaagcacuucaaaugauuuagaugcaggauauuuuaauaccacacuuuacaaagauacccgagguuaagaauuugguuauucuacuucuguuuuagaucagcuauuacagaguauguguucuaaauguucuaaaguaggucuuuauuaccaagugacuguacaauauugcaauugccauuaagaaugauauugacauuaauguauaguuuuauugcuaauaauucuuuuauuuucaaauuuucuguuuagaaaaauaucauuugaaaaaauacaguuuacuuaaauauuucccgauuauuugcagagggucuaaagagaguacuuaccgguaaucaguggcucuuuauugccuuuauuuuggaaaaaaaaauagaacuuucuuugguagauuuauuucucaacccauuuaaugugguuuagaguaaauucgucauuuaaaauuuuauuuuaaauuauuuuuauuuguaggaugagcuuucugauguuagccaaggcggaucuaaagcuaccacuccagcaucaacagcuaauucagauguggcaacaauuccuacugauacucccuuaaaggaagaaaacgaaggauuugugaagguuacagaugcgccaaauaaaucagagauaagcaaacacauugaaguacagguagcccaggaaacuagaaauguaucuacuggugagugacccuaguucuuuacuuacuaggaaaguauucaguaaaccuggauaauguggguaugagaaaauaugucuuuguggguguugccugcuuuguauuuauaaaauaggcagauauaguuggcccucuauaucugugguucugcaucuguagauugaaaauauuugaaaaaaaaaugauagcugugccugcacuaaacauguacauacuuuuuucuuauuauccccuaaacaguacaguaugacaauuauuuacauagcauuuacauuguauuagguauuauaaguaaucuagagaugauuuaaaguauaugggaggauauugauaaguuguaugcaaauacaaugccauuuuauauaagggaccugagcauccauggauuuugguauugugguggguucuggaaccaaucccccauggauacugagauaagacugcacuuaauuguauucaauuguaaauaagcuuaaaagagguaauguuuaaauagucuuggagagaaacuauuggggccaggaguugggggccaggaggucacagaacccaaaagacgggaggacaguucuuuucuguccccuaucuuaguuuagucuuugucuuuaguuccuuuaaauuccaucuuuuaaauaagaaugaaagcagggccuuggauacauuguacuguguguuccacgaaacacaagggaaaacuuucuuugguugcuuauuaguuuuugauacaaucuguuaacugaauaugugauauauuguauaaugcuguauuuccuaaaauccagucuugcacauuuuaaaaaaauguucaaaugauaccuuuacacccauaaaaacaacaggauuuuuauauugggguacuguguaauauauguauuguuuauuucaucauguccuuuuuuaaggcucugcugaaaaugaagaaaagucagaaguucaagcaaucaucgaaucuacuccugagcuggauauggacaaagaucucaguggauauaaagguucaagguaacauaaauguuagaugaagacauauucugcgccccccacccccaacucccauaaacacuguucuccagucucuggacaaaauggauucagauguuuuguugaagaaauguuaguauuauauucuaauuccuauucuugaaacuggacacuguacaugguuuaaauuuuuuguuaaauguuaucuuugcaggaucacaaauuagguguaugagcaggaaggauggugucuuagucuauuuuguacugcuauagcaaaauaccagaguggguaauuuauauauuuauuuauuuguuuauuuuuuugagacagaguuucgcucuuguugcccaggcuggagugcaauggugcgaucucggcucaccgcaaccuccgccucccagguucaagcaauucuccucccucagccucccuaguugcugggauuacagacaugugccaccacgccuggcuuauuuuguauuuuuaguagagacgggguuucuccauguuggucaggcuggucucgaacucccaaccucaggugauccacccgccucggccucccaaaguccugggauuacagucgugagccacugcgcccagccuuguuuauuuuuuugagauggagucucgcucuguagcccaggcuggagugcaguggugcaaucucagcucacugcaaccucugccucccagggucaggugauucuccugccucagcuucccgaguagcugggauuacaggcacccaccaccaugccuagcuaauuuuuuuuuguauuuuuaguagagacgggguuuugccauguuggccaggcuggugucaaacuccugaggugaucagccugccucggccucccaaagugcugagauuacaggcaugagccacugcaccuggccaauuuauaaagaacagaaauuaauuuucucacaguucuggaggcuaggaaggccaagaucaaggugcuggcagggucaggugucuggugagggcugcucuuugcuuucaaguuggugccuuguugcugcauccucuggaggggaggaacucugugucuucacauagaagaaggacaagugagcccugaacacuggauaaagccucauuauucuauaaggaccccaauccuguuuauaagggagaagcccuuauggccuaaucaccucuugaaggccccaucuuaauacuaucacauuggcaacagcugaauuuuauaggggacacauucaaacuauagcagauaggggaaaaaagacagccaagacauaucccauacuuucuguaacuugaaaaaaccaagaagcgggagugaaggaaguaacagaguggacauggcagggcuggcagcggugcuacuuugagggcaugaaacacaccguuggcuauggagcaugcuuauuuuagggccagcagccggguacuccagccugccggacacuucaguccagcccccuccugacuggggcuuguuacucacaagauugcauugucccggacacuaacuuggguccagggccccucccccuagcacuuaccuggaguuugugcauguuuccugcugcuggguggguucagaaggugauuucuuuuuuauguguacauaugcuaaauaaaugugauuuaaaaaacaaaacaaaaaaguuugaacaaacuuuuguaccuuccaccagaucaggaagagagaauguacuuccaucuugagaaguguaaucucauuauuggaagaaauuagucucauuuugguaucauuuuacaugggaaggcuguuuagugguaggaagaaaauaguuagaucucaucuuuuuuuuuuugagaugcagucuugcucugucgccuaggcuggaugcaguggugcuaucucagcucacugcaaccuucaccccacucccacccccacccccucccccggguucaagcgauucucucaccucagccucccaaguagcugggacugcaggcacacacugggcuacuuuuuguauuuuuaguagagaugggguuuuaccauguuggccagacuggucuugaacuuugaacuccugagcaccagugauccgccugccucagccucccaaagugcugggagauuagauaucaucuuaaucaggauuauccaaaauacauugaugcucaagaaugucagacaggagcuacugccuuucuuuucauuucuuccauaaaguugauccuuuaauuaauuaaugacuauaaaaauacaagccauuuauugaucucuguuaagcauugugcagucaguacucuguagcgguuaaaagcauagacccuagaguaagacugcauggguucaaauccugucuuggauuugaaucuuagguauguuuucucauuuauaaaacagcuuuguguuaauaccucagaugguugugaggauuaaaugaaucaauauaugauaaaucauugcaaaaugccccauucaauaaauguuaaguaauauuguuuucaucaugauuuuauauaauuugauccuaauuacaaccuuaugagguagaucuuuuuauccuuauuuuauaaauaaagagacuuagaacuuguucaaaguagcuugucccagauuaccaagcuagcaagagguggacuugggauucaaauccagaacccucugucucucucucucucucucucucucucucucucagacagguucucauucugucgccacucuucuuccuggauccuacaucacccugcuucuugauuuaugccuuuguuuugacagagcauauccuuacuagcuuucuggguaaagggugcacaacucuaucacuucuuagcucucucuuaugcuguuugucuucagguaucuaaaauaacauguucguccugccccuccuucaucccucccuuuuucagcugagauucugugagaaaauguaguccuaaugcccuaaggcaucucuuguauauaaugaauuagcuaugcuccugugcgucuagaauaggauucuagguauguacuuaccuugggagaauggaaaaaauacucacuuaaauccuuuucuguauuuuguagaucaaauacggaacccugguugaaaaaggcugugaugcuagcuguuggcuuucuguaguagaugaggauauaaugccuaaaccaccauccuuucauccuccuaauauuauauauuucaaauucuguuaguuaaauucauuauuuauaucaguaugacuauauaaaauuaaucuguaauucuacuuagccacagaauacaguauaauuacauuucauuuauuuuuuuauuuuuuucccuccuccgagacggagucucgcuuugucgcccaggcuggagugcaguggugugaucucggcucacugcaaccucugccucucagguucaagcaauucuccugccucagcauccuaauugggauuacaggcgugagccaccaugccuggcuaauuuuuguauuuuuaguagagacgggguuucaccauguuggucaggcuggucucaaacucccgaccucaugauccacccgccuuggccucccagugcugggauuacaggcgugagccacugcuacggcccauuucauuucuuuuacaacuuuuuguucuucugaaauuaauaaagccuuggguuauuuuguuucuuuuccuuauguuucuguggaccuguuacuaaaucacuggcagacacuaugcaauucauaaauguaaaaguccccaauaugaccaaacacaaaaccugccuguuuccuagggcuuacucuccugcagccuccuauucccauucuccaauugagacugcugucauauuuguucugguucuggaauaugcccucacuaucaucccuggaauucuuuucaccuuucuccucuguuguaucuuuuguuuccuggaugccacaucauccugcuucuugauuuaugccuuuguuuugacggaacauauccuuacuagguuuccuggcaaagggugcaugacaaguaaauuuuuuuuuuuugagcacuaugaacuugaauguuacaaauuuccuaagaagacauacuugauaguuuggcuagauaaagaacuauauggguugggagauuuuuuuuccaucagaauugcaaagacauuacuucauuuucaugcugaguucaggguguuguuauuugaguucuugcucauuuuuauauacuuucugaaaucuuuuaagauugucacuuucuugauuuuuuaaaaauuaaugauacugugcuugguguaggugucuuuuuuguaucuucuuauaugaaguaagucuuuucaucugaacauuccuaucuuccaguccugggaaauuuuaucucuuucuucuuauuguuguuucuucugcucucguucuggaacaccucuuagguaugcauugaacauccuggagugacugucauaauuuauuuucuccccucuuuccuaucucuuuuauuuuauacuaauugcuggcagauuuuuuuuuaaacccucauucuuuuuuuuuuuccaaauucuuuuuauugguugguacuuuuuauaccaucuugcuauuuuacgaaugcaacauuuauucugaagaaaauuaagugcuuuguuuuuuuguuguugcugcugccugcauugucuuuuuuugcucuuagugucucugucacauccucuuuguuuugggcccuuucuuuuauaauagaggccuucuuuagacaucugguacucuguggcuguuuuauucauacuuaaguaaauaaugcugauucuccacuuuccugccuauaacauuuaaacuuggcuuccauuauuagggagcugugccaagagaagggaggucucacuguucuggaggauugugucuagguccuguaccgccuuuuguacaguuuuuuuaauccuguccuucuguuucauguuccucccugcaugcccucccugugguugcugguaccuucaaguccuaggccuuucagggguucuggcagcauauugaccuccucccuaaaccccaguggcuuagguuucagcuuucucuggucuauugaaucacuuucuacuguuugcccaucuguuuuccaucuuacagaauuuuguucacauuucaucugcuauaguuucuuuuucuauucucuuuguccuuuuggguguauaccuuuuuaauuucuuaacuuucauuuuaguugagcuucugaguuauuaggugauaaaugacuauguucucuccaccauauuuagcuggaaauggucuacagaguuuuuucuauuaauaauaguauucaggcacaaacauauacacuuccccauuccccuauacaccccugcaaaauagggcauauaguauauacacuguuuugcaacuugauuaaaaaaaaaaaccuuuguaucauggguuucuuuaguuuauaaagcucuauuuauguuuuuaaccuuaaagguaaaaauuuuaauuuuguauguguauaacuuaccucaucuguccccuguuaacagucauuuaggucauuucaguuuuugccacugugagaaaugcuacucuaaccagcuuuuacauacauaauugccuucuugugacauagguaaucuaugggaagcacugagaccagcaccugguauagagcagaggagcugccauuauugcuuguguuugcugggaucacacaacaaaaacauucuauaauuucuucaccagcuauuuccauggagcuuagugagaauuucuuaggaagccuuugagaaaucuuuuuaaguuauauuuucuaguaaacguaaauuauagguaagaaaguccuauguagcuuagccuauuguauucauuuuacagcgucaaaaaagucuuugucauuuguugauuugguuuuguuguucuuguugcauagcacucccaccaaaggcauagagaacaaagcuuuugaucgcaauacagaaucucucuuugaagaacugucuucagcuggcucaggccuaauaggagauguggaugaaggagcagauuuacuagguaugauagcucaucugaagaaauaucauacuguuuuuaaaauugauuuuuuaaaugauuuaauugaaaaguccuuuaaaauguccccaacugcucagugauacaggguuauugcccuuuuagguaauuauugggaacauauucuuugugaucaugaaaguuuuaaaugaaagcaccuuugcauauggguaugcuuaaaacugaauugcauuuaaauucauguuuugaauucauacaacacaauuuauugaacuccugcuauauuucaaaacagauaacuacacauaagaacauggugauguguguguguguauguguguguguguguguauguguauguguguguguauggauugaugccuaguuauccccuggcuuacauaaauuucauuauauucuguugacuuuaauuaaauaagaaauuauaacacuugauuuuucuaaguuuucucagaguauauuauguuuuagcccuaugguaaauauaaucauuuuaaaguuuguguucuagaagaauacauggucugaaaagaauauugcauuuggcucuuagacuauuugccugcugaccuuugccaagugucuuaaccuuuuuggaccuuaauuucuuuguguguaaaaugaaggagcuggacccuaguucaggaaucuggcaaacugccgcuuaugggccaaauccagcugaccccuugugugcguguguaaauaaaguuuuauuggaacacagacaccaccauuuacuuauugucugugguugccuuugccuaccaacagcagaguugaguaggcaacugaaaucugaagccuaaaauauuuacugucuggcccuuuauagaaagaguuugccaaccccugcccuagaugaucucugaaguuccuuucagugcaagguucuggcuccuaugaauuaguuuugguauaccuuccuuauaacuuaggacccuauagaaauuaaaaacuauauggaauuaaaaauauauaccuuuggagauacuaagcuaaaaaaauuuguaucuauugguauaauuauaguacagauuacacuguucucaaaagguuucguuuguuaauuguuaugacuuuggaguggagugacauugcuugcauuauuuuauguuaaauuuauugauugccaguuauguccuugacauuguaaaguguuuuugaaggaaaacacaaguucuaucuaaaugucuaucuaggccgguugcaguggcucacgccuguaaucccaacacuuugggaggccaaggcaaguggaucgcuugagcucaggaguucgagaccagccugggcaacauggcgaaaaauaucaaaauuagccaggcaugguggaguaugccaguaguucagcugcuugggaggcugaggugugaggauggcuugaacccgggaggcagagguugcagugagccuggguugcaccacugcacuccagccugggugacagagccagaucccgucucauaaaaauaaauaaauaaauaaauaaauaaauaaauaaauaaaguaucuaguaagagagauugaaaguauuuuaaguacauauaguuagacagaaagggauugucaccauuaaaguuuaaguaaaacuuuggaagaaauugaaugaauugcguuucucauggagggcuaagaaaguuguaauucuuuuuuuuuuuugagacauagucucacucuuuugcccaggcuggagugccguggugcgaucuuggcucaccacaaccucugccucccugguucaagugauucuccugccucagccucccgaguagcugggacuaaaggcgcauaccaccaugccugacuaauuuuuguauuuuuaguagagaugggguuuuacuauacuggccaggcuggucucaaacuccugaccucaugauucgccugucuuggccucccagagugcugggauuacaggcaugagccaccaugucuggccugaaaguuuaauucuuaaggaauacuccauuuuuauauuuaauuuuauguuuuaauuuuaguuuacaucaaauuauaccugaaaaguuucuuuuaaggcauaauuaguuugagaaacuaacucccuggcaaauuugaggagcagaugaaaaaauguuagaagaauuuuaaaauguauauucagugcaguaaaauucaccagaaucaauauacaucaccccacaaaauuccuuuaugcuguuuguauuaacaagaaugaaguaauucugaauauaauuuguacacuguguuaccucauaaugcaguaaugagugauaaaauguuuaagguugguggccccaaacuuucuuuucuuaugaaguauuuagaagccccauaguacuuagaaauaucuguugucuuuuaaaucaauuaaaaguaauauccugaugcuuugguuucuuuuccacuuugaagauaagaaacagacuacaaacuaucuuuuccauuuuguagauguugauacauuuaucucuagaauaguucagauuagaauauuuuaauauauuacuguaaguuuaguuacuuaugaauauuuuuggucaaagaugguaaauaaaaauguuccuggccgggcacgguggcucaugccuguaaucccagcucuuugggagaccgaggugggcagaucaccugaggucaggaguucgagaccagccuggccaacauggugaaaccccaucucuacuaaaacuacaaaaauuagcugggcauuguggcgugcaccuguaaucccagcuacuugggaggcugaggcaggagaauugcuugaaccugggagguggagguugcggagagccaagauugcaccacugcacucuagccugagugacaaagcaaaacuccgucucaaaaaaaaaaaaaaaguccuuggcuucucuucuguguaauucagugauaacaaauuugaaucauuauauauggacucaguacuucaauuacuguuuuuuuuuuuugaggugagaucucacuacguuguguaggcuguccuggaacuccuaggcucaaggaauccucuugccuauagccucccaaguagcugggacuacaggcaugcaccaucacgccagcgcaaccuuuuucugauuuuacuaauuuaaaagaaucucaacaauuuguccuuuaucuugauuggugucucaucccucaacuuucuuauuuaaaacucucuuugcuggguuucugugauaucaacuugccuguguccuuuccugucucgacucuuaccuuuucagucaucuuaacaggauccgcuuccuuugcucgucuuucagguaucagcgcuccuguccuaggccugauacuuuguuuaagaaaucauguuugcucucauuguuucuugguuuucauggcuaauuacucccaaguuuuuaccuccaucucagaucuuuuucuagagcccaagacuauuauuuccuaauugcaugcuagacaccccuaaaaugacuuggagggcuuuacguuugacauguauaaagcucaguuuguuaucuuuauuguucugucccccaaggcugcucuuggaccaacaggcacuguuuuagugaaugaauagcucuccauccugcaccucucacuuucccucacagcuaaucaccaaggcuuguuuguucccucuccuaaauguguguguguauacauacauauauguauauauauauauauauauuuuuuuuuuuuuuucuuuucuugccuugcuuaagugauacauccuccaggaauucugccuugauccccuaauuaaagcuuaguuuucccugaaauguauucccauggcacugcauuuuauuauaccacucuucauacuuuacuguuauuuuuuaguuaucugucucccuggacagacuauaagcucaauguggcugagacaacugugucuuuguucacuguugcauauuuagcacauagcaacugagugaaugggauugcuaaauaguucugacaguuuuguuucaccucaaaaucggugauucuucuccuuuugggauuaaaaauucuucacaggugaauuuguaagagagcaauguaccuuuggaaaaacacacauguagaacuagauaaaauugugcaucuucucaagggauuaccauauaacucugaagcucaucuauggaccuagcuugagaaucaguguuaaaauccaaaugaaacuucugugauuuuaaaaacugccaggcaguuuuuuuuuuauuuugcuuguuuuuaauaaguaaaguuuucaaauguauuagaccuaaguuugugcuucauuuaagucuugaauagaaaugaggccacuuuauguuuuucuuauaaagaguuauugaucauuucaaaaugaaauuuuagauaauccuauugguuauauauucaauuuauacaccauauauuaagauaacucuucauugggaauguguacauuuaauguaaacuuuauuuauuuauuuuugccaucucggaaaggcuuuauuucuacuucauccgggucucaugcagacucaaaggcaccaucauguguuuccauuugguauccucaugacuuuuuguaguguuuucccuuaagaguaagcucuguacauugccaguuaaucuuuuaaugauaauuuuaaaauguuguugcuguuguaucauugaugcaaaaagaccaacaauagaaguacaauacaaggaaauucacaacauauuauagugggacagacugagucacauuuaggugauggugaggacgcaguagcaguauauucaugcacccaaagacgugcaagccaaguaggauaauauauggaucauacggugaauuuucuaagcccacugaggacuuuguaccuuuucaaaaauguccuguauacccuccaguuuacagaauuaucugucuugucuacuggcuucauggcuaauguaaacuuuagaaacuauauuauaggauuuguuuuuccuguagcacacauuucaauuuuuuuccuuuuuauaaauauuuacacuucauuguguuuaguuaaugguuucucuacaucuugucaauuucuuuguuuccucucucucauuuuaaaguaaaugaguuuaguucuugcuuucugaaaacaaucuaauugagauucucauucauuuuucucuugggcugcuuacguaggggaauauucugguguguaugauuuugaauauuuuaauauuacugcuuuuuaagcuagguguucuuggcugcuguucucaucuaaugcuuucucaucauuuuuuucugcucaacuauuuuuuugccuuucauauauuuucagcuuccacgcuuaucuaacugcuugagaguuuauagcaaacauaguuacuauauaaacuguuuucaaccagucuacauucuuauuucuucugucucuauaacuuuguuaaaaaguuaacauucccagccauuguaucuacaaaggaauaaaaauuuagcauuaguguuuaaagcaaauaucuugccgaagaucauuuuggaguuagaauuuggaaacuuuuuugggacuuuuauuuuguuuuguuugguuucaguuuguagauaauacauagguagaugauuaaucuauuucugauauuuaauucuuucugguguaaguacccugaucuuugagaaaauuagaauauagacaaaauaugaguccagguacacagaauauguagcauuccuagguuggcuguuuuuguuuuaaguaauuuuuaaaucauuuggaaaauuaccuuuuuuaaaauaaagggacauguuaacuccuuugucguauguaguuuucuuuagaaagauuucuuuccuguuuacuuggguuaugauuauuacuucuuccauuguaugugauuuuccaacauuauuagcucacaauuccuugaagaugagugacugguggguuuuuuuuguuuuguuuuguuuugcuuugauuuuuuguuuuuugagugauauucccuaguguguuauuucauuucuucaguuucuuaggaaaagcaaauuaauagcuuucuucucccuaaagaccacuccauuggaucuugcauuggaugcucuacgugcuuaucucacaguagucauuaaaaugccaaacacgaucaaagacauucacucaagugauaacugaacauuauuauuuuauagguggcacuuugaaggaaaguuuguauuguuaauugaagauuuucaaucuaauuauaguuaaucuuauugugagaaagaauugguaaagcauuuuuuagguauaucagcauccuuaugaaugaaggaaaucaucuuuauuucugucuuuugcacaucauuaugcauuaaaucauaacauugugauuccagauguuuuucauaucauguauaaaacuuuauagauuaauaaucuguuuucaugcuguuucuuacguaaaacauuucuuguucuuuguuuuugcuuuacauggaaugcaugggcuuuaagaccauaauuucuuugguaagguuucaucugccuugggguucuaucuuucuuuagccuuguuuuugccuguucucuauuaauaaggucuaauuuuuaggcaaaagccuacgaggucagaugugauuuagaaacaauuucgauccauauuaaagcuguucuuuuuuacccuauguaguguuggaauauuagaauauuuggcagaaaagucuugauccuuuugaaauauuaucuaugagaaauauagacuaacagauauuaaaaauuggccucauucccuagcaagccgauucagauuuaaaaaagaaauaggccaacaaaaucuuuagccuuguucguaaugaauaauuauuuauaauuuuauaaucuauuaaaguagguccaucaaaugaaauuauagacaaaauaaaauuaauaaaggacagauaaaauuucuaaaauaaaacuugugacuauagcuuauauuuuaaauguauauaauuauugaugcauuuauuuucaaagucuuuaucuuuuuucguuugauaggaaugggucgggaaguugagaaucuuauauuagaaaauacacaacuguuggaaaccaaguaaguauaugugaaauuuuaacagaagauaaagaauuuucuucuuguccaagucaaugacacuucaucguuuuaacauaauacuaauggaaucucccugucccaucucguuccccaacucugagugugcacacacacacacacacacacacacacacccuaauguugggaccuacacugcccuguuagauauguucccuugcccuguuuuuuuguagaaacacagauugucaucuccuuuucacucuauaaguauccaugccuuuuucuuaaucuucuaaauuuguccugguuuuacacuuuuuuugcucccucccuuaacauuugucuguuuucuuaucucuucuccugggguuucuuuuauuuccacacaaauauuuucauguauacucagccuuccucuucagagcugucuuccauagcugugcauucuugggugcaauuuguggagucuuaagcccucagacacauuuaaugggacagauccccagucauguggaaaagcugacuggguuccuuugucaguuugcugugucagagcaacuuuggaacaucuguguauauccaagacagaaugcaguuauaauaagguccuaugcccacuauacccaaaggaacuggauaucaggguuuuuucuucagcguagacugucuuaacuuuccaguuuaaacuguuuucucauuauuuauuaaagguaacaucaagaaauaauuuuacuuuauugauuggguaauauauucugaggaauuauuaacaauaguaaccuuuugaaugcuauuuuuaaaauuuaaucuucucacuuuuuaguaauugaugaucugucuuguuuuauucauuugauaaaugaguaaaaucuuagacuguugcuuuguguucuuuuugcauuuaucuacaaacaacauuggguagaaugucuugaaguauuaaauuauuauugucuaugguuguacaguuuagucuacaaaggaauagcugaaagauggaaagaauauuuauuuguaaugaugcacuugaaauauguguuucuuagaaaugcuuugaacauagugaagaaugauuugauagcaaaaguggaugaacugaccugugagaaagaugugcugcaaggggaauuggaggcugugaagcaagccaaacugaaacuagaggaaaagaacagagaauuggaggaagagcuuaggaaguaaguuuuaacuguguuguucuaaaccaaacucuuugccaguuaugccacaaaggguuacagauguaacccugagacugagaccuucuguccacucaagccuggaaggccaagagcugccugggagagggcaaagugccccagcccauugccucugcugugagcaggccccuccaguuguuagccugucaucuaaauauuauugucuuuuguuuuuuguuuucuguuuuuuugagacggagucucacuccuguugcccaggcuggagugaaguggcaaagccuuggcucacugcaaccucugccucccgaguucaagcgauucucuugccucagccuucugaguagcugggauuguaggugccugccaccacacacagcuaauuuuuguacuguuaguagagacaggguuucgccauguuggccaagcuggucuugaacuccugaccucaggugauccaccugccucggccucccaaagugccgggauuacaggcgugagccacugcacccggccuaaauauuguuauuuuuuaugucuauaaugaugcaaaaagaguuagagacuguucaaacaucuuuguuuugauaauaaggaaauuuaaaacauuauuuuuuuaucccacuuucuuuaauaccuguuuauuucugaacaaugcuaugauaugaugauacuccaccaaaugaggguggcuaaauacccuguuugggaaaagaaaaauaauccuuuagugguaguuaaaauuguugaccuacucuuauuuuuuugaaaagaugagcucaauucaaauaacauguuuuguuuuguuuuuuccccacuagagcucgggcagaagcugaagaugcaaggcaaaaagcaaaagaugacgaugauguagguuuacaauuuuggacuuuuuuucuuaccuuaccauguuuugguguuucgggaagaucuuccuacguaagcuuuggauauaauacuauaaagauuuuuaaaagucaggagacauguuuauggucaugaauaggauagcucaugcuucugcaugguauccagaugcugagcuuucuagcuccaugcagugugcucauuuucccucugugccucugugcucuuaccuguaguugcauguucaaguuugaggaccaacugggacauuuugggguuuuugguuguuguuauuguuguuucguuucaaauuuugauuuagaaauaugaaagcuuaauaauaaaaauuauuuaacaguauuaaaaagaugaagucuagaacuuuaguacuagucaauuaguucauauuguugugaacauaaguacagaagaauaaauaugagcuucuugcuaauauccuuagcauaccccuagucuuuuuuuuugagacagagucucagucugucaccgaggcuggagugcaguucugcgaucucagcucacuacaacuuccaccucccagguucaagccauucuugugccucagccucccgaggagcugggacuacaagucuaauuuggcuaauuuuuuguauucuuaguaaaggugggauuuugccuuguuggccaggcuggucucuaauucuuggcuuuagguaauccacccuggucagccucccaaagugcugggauuacagaugugagccacccagcccagccucauaaucauucuuauaacaaauguuugcaggucaaaggucagaccaaagauaugugguuguuuuggacagaaugaucacuuggugccccuucagucucuguuuuuuaguaucuuauguaaugauacacacaaaaacaaguaagacaugcagguuaugaaucauaauaaauuaacauugugaaccuaccacccaaucugauaauuagaacauuacuagacauugaacuauucuguguuccuccccugcagagaaagcugcuauccuauauuuaucauuugcuuaacuuaaaaaaaaaauuuuaucauaucacauauguauauaugguuuaauuuuuccuuuuuuguguuucacacuacauuuagucuuggagaccagcuucuuuuccucaguggcauguuuuugagauucauccguguaguacagugcuguaguuaucauucauauucacuacuuuaugauaucccauugaaugaauagucacaauuuauguauuuauuuuccuguuaaggaauauuuaguuugucucagcuuuuuacaaugcuguuguuacaaacauuacaguagaagucuccaggugggcaggagcaguagccuuuccagaguacauaccuacuagugggcuugcuguguuauaaacuuaagaucuuuaucauuuguuguuuaacuuuauugaaaggagaggcccaguuucuauaacagaacaacaaaggaggaggacugcuaagggcuaagcuuagugucuuucuuaugucccaaaccuuucagcuuugauccaaaauguggauaaugaaagccuauaggacguugacuugagccauguucccuugaggucuuaccccugugcucacucuauauucacauacucugucuaagaguaauucuggcuaauacaguugucuccaucuguuugcauuuauguugguauuuuagcgacucuuauaguugaguaccuugguaacuagguaauaaguuuacccuuaaugcuggucuugggugaguaugugguuugguaauuugagauaaauggaacuaacuuauaacuauuuucugagugacgauuguuacagagcaugaauuaaaauaaugguagagcaacauuuuuaggugaaacuuacaauaguguauuaaaucuauguagauaacaauuuugguuuuaguuuaaaaucugcacuauccuuuauuuuuauuuuaguauuauuacuauuuuuuagagacagagucuugcucugucacuccuccaggcuggaggaguacaguggcaaucauaucccaccacagccuugaacuccugggcucaagugauccuccugccuccgccucccaaguagcuggaacuacaggugcaugccaccccaccuggcuauuaauuuaauuuuauuuuuuguagagccagggucucacuauguugccuaggcuggucuugaacucuuggccucaagcaauucuaugcuuuuuuuuuuuuuuuaacuucagccuccugaguagcugggaccaaaguugugcgccaccccauacguggcuaauuuuuuauuuucuguagagaugggaucucacaccacauugccaaggcuggucucaaauuccugggcucaaagugauacucccaaagugcuaggauuauaggcguggaccaucgugccuggcccuacuguuuguuuuuguuguuguuuuuguuguuguuguuguuuuguuuuuuaaagacaggauugcacucucuugcccagguuggacugcagugguauggucauggcucacugcagccuugaccucccagcugaagcaauccuccuaccucagcuucccaaguagcugggacuacaggugugugccaccacuccuggcuacaggguuuuacuauguugcccaggcuggucucaaacuaagcucaagcauuguacccgccucagacucccaaagugccgcgacuacaggcgugagucacugcguccagcccccuacuauucuuuuuauuuuuuagcuuuauuuuuuauauauuuuuaagaaccaugagaacagacccacacuacucuuuaugauuucuuuauaauauguucaaauaucuguguauauauauucagaaauuaaauugcugccuuuuaucuuuguagucaugagugauuauuuaaaucucuuuguuggcugggcacaguggcuuacaccuguagucccaacacuuugagaagcugaggcaggagcaccacuagaguccaguauuucaagaugagccugggcaacauaacgagacccugucucuacaaaaaaauuuaaaaauuagucaggcguguugacauguaccuguaguccaagcuacucaggaggcuggggugggcagauugcuuuaacccagaaguuccaggcugcagugagcuaugauuucaccacugcacuucagggugggcaacagaucaaggcccugucucaaaaaauauauuuuuuuaaaaaaaagucuuuguugauuuuguuuuuauaaagccauuuuucuuuaaaugaucuacuagauuaaaaauuaaggaaugcuuaaaaacugaaagauuuugcauaacucugagaugaacaccaagacauuuauaagcuuccagaaugauaugucauuuucuugucauuauagagugauauucccacagcccagaggaaacgguuuacuagaguagaaauggcccguguucucauggagcgaaaccaguauaaagagagauugauggagcuucaggaagcuguucgauggacagagaugauucgguuuguaugacaagcgcuccauuauuuuccuacuauuauuuuguagguuugaauauuccuucauguggaacuuaaguccugcccuguaagauccaagccccuuucucuguuuacuaggagagacuuuuuaaaguaacacucagaauuagcaacagaaugugaucaaaggaggugcuuuuugggccaguaagggaucuuggaggauguuacuacgaccucuaaaaggcaauuauuauuacuuaggaaugauggucauuuuucaaauauagaaaucaauacuacuuacccaguaaugucaggaaaagaucacaauuucauaugcaacacaggaaaauaaauuauuuugacucagugucuuucuguaaaauacucuugcuugauuucuuucucucuuuucuaacuguucaugccaaguacacccuuccauugguaucuuucagucagauggcucuuaaaucucacccaaugcugccaucuaaugguuguagucucaguaauaguguuucuuuaauuuagaaagaacugaaaaguuuguaaaugagcugcccccuaauuuacccauauuuuugaguuuggauugucauaucagauuuaccaauaauaguaugcauugacauguuguuuuuaaguuuaugaacacauucucuaauugccaacuuuuacuucuuuaggauuacaucauuuauuucacaguuuauguacccuuuaccaauguuauauuagaaucaaguguuuuaacauaucauuuuacaauuugcugugauaguaauugcuuauaacugcccauaaggaagaucaguauucuaaucuauauuuauuagacaaggaaacuaacccacuagaaaguguauguucuuaacugcaguauuuaguggauaucgaauaaauaauaaguaaauauucaaaaaacugaaaguggaccuuauuuauuuauuuauuuauuuauuuauuuauuuauucauucauuuauugagauggagucuugugauggagucuugcucugugcccaggcuggagugcagaagugugaucucggcucacugcaaccuccacccccuggguucaagcaguucugccucauccucccugguagcuggguuuccaggugugcgcuaccaugcccagcuaauuuuuguauuuuuuaguagagacaggguuucaccauguuggucaggcuggucucgaacuuuugaccucaagugauccgcccgccucggccucccaaagugcugggauuacaggugugagccacugugcccaacuggacuucacuuuccauugcuguuuuuaacucuagcagccaagugguagucaacaaauuaaaggaaauaguagcuuacuuuuaacuacuucacugaaguaaagaauguuuuuaauuuaguucauaacaaaaaaguagugaaaagagagcucugauuaugauggcagaaucccuaccaccucauaaaucaauuuggaauaucuuauuuucugaaauuuuguugaaucaccugucaauccaguuuauccucuucccugcuguggucaucuuuccagugauggaaaaguuuuagucuugugaaaaaugaccccucaggaugccaaaguuucaagcuauuuugugagagcuccgaguauagaugauagagacuuuuauguaaagaugggaauuuacaaggcaauauuuuaauaaaagggaaaguuagaggguaucuuuucaauaaaaaauuuuaaauaucauucaggcauguuggcugucuagcacauauuacaguccucugucgguagacuaagcucuuugagggagggaugauauuuuauuuuucuuaguagaauuaaagucaaucuuuagcagauugacugacacaugguaggucaaaguaacuacaguauuuauugaacuuaauuguugacuccccucuguguaucccaugaacuucuugggucucuuguucuucagaaagaaagguagaauaccucacugauaaauguuucuuuucuuuucuuuuugaauguagggcaucacgagaaaauccagccaugcaggaaaaaaaaaggucaagcauuuggcaguuguaaguauugaaaaacaaagauguuagacagcacaugagacaagaaaauuacagucaaaauuuauuuccaagaaugauuuuauguccauuuucuuuccuucauuuuuuuuuuuuaaacuagggguaaugguuaaguagcuaaacugaacuuuuuuuuuuuuuuuaauauauagugugccaacucgguaaggcucuucucaaggacaaaaaauaugauaucguaagcugcaucauguugacugugcauuuguugcaauccucugccaaauuuaaauaauggggaauuauuuagagacuugaaaaugaccuggauccccauuaaauaaguuucugauuggcugguuuugugauuguaagaaacuuuacaaagugaagaugagaaauuuagugcuuguaggguuugaguaauauuguguauguauugagcuugaguuauguuugugcuagaaguacuauguguuuacugugauuaaaacuuacccuuuuuuggugaaucugcuauuuaauggaagugucaauuaaaaaagaaauagacccgaaaguaguuguuuaaauugagcuuaaucagaaaauguauaaaauguguguuaacaugguaauauguguuccaguacuugauuauaauaagcuguuuuuagaacuggcauacuaagcuuccauucacaucacacagccauaaccuugcgguuuaacaaucgcucuuaccuugcaccaaguaggagcuagcaaaaaaaccaaaauauauuuauucaguaggagaaguuuccucuauuuaagagcuucuugcuuucauuauacaaauugcuaguuaaagaacaggcacccgccauucuaagcaauaguuucucuucacugaaugucugaguuuggcuacgaguuacugcuaaggcuacagcguaugacuacaaaaacuguuuuugccaauuucuaacucauugccuuguaaaaguacucugaaauuuucuucaacauuaaaguuuguggaaaaucaaggauuguuucucauaguacaugugacacacagacauacugucuucuuuuaguuucagccgacuuuucagcuccucaaguaacacgacuaagaagccugaaccaccuguuaaucugaaguacaaugcacccacgucucauguuacuccguccgucaagaaaagaagcagcaccuuaucucagcucccuggggauaaguccaaagccuuugauuuccuuagugaagaguaagucuuuuccaaauuaaucauuauauucuaaauuaaguuagugguucagaauauucuuggccucuuaucagcucuaaggauucagguaaaucuauaaaaaaaucauuucugggccaggcacgguggcucacaccuguaaucccagcacuuugggagaccgaggugggcggaucacaaggucaggaguucgagaccagucuggccaauauggugaaaccccaucucuacuaaaaauacaaaaauuagcugggcguggugguguguggcuguaaucacagcuacuugggaggcugaggcagaagaaucgcuugaacccaggaggcgggguugcagugagccgagaucaugccauugcucuagccugggugacagagugagauuccaucuuuaaaaaaaaaaaaaaaaaaaaaaaaaaaaaucauuucuguaacuuggcugucuuuaaguaaauuacuuguagucaaaaguuuuuaugaaaauugcuuuucaguuuuuauaaaagagaaggauuuuuuuuuaaaugccucauuuuugcugguaugacaacauugauaaauaccuauuaauagaaaugugaauggccuuuagagguaaaugagccuuuauccuaaauguuugaacauuucuguuggugucagaggacuugguuuuccauccugacuuuacuacucauuagguacaaacacuugggcaaauuaaccuuucagagcccccaguuucucugucuguaaaauuaaucugauaaccuaucucaaaggugauuggacccaauuauacaguuaucuguaaaguaucugacauauagguagauauguuaacugugguauauauacauagcaacucaucuuaugaaaauuuaaauggccaaaauaauggcaaauuauuuucaaaaucauuuuaauaauauuuuaccuuauaacuccaaaguuuaccaaaucaguuugcauuuuuauuuucugaaacaaguuaaugggaucuaaaaucuaaccuauaucaaucuuccuaagcagauauugauuuacucaaguuuuaaaucacuucuagcacguuuucuggcauuaggauauucucaguaaauauuuguugaaugaacaacaacaacaaaaaagccaaacauacuuaagaauuuuccccuuucauauggccagcaucugaaaccugauauaaauuugguggcugaugauucaauuuaauguaacaaagcugcuugguaaccuguuaaagcuuaggcacugaauucacugcacaaacuuaaaaagaccagcuuuaguauaacacuuuguuuguuuguuuguuuguuuuuugagauggaguuuugcucuugucccccaggcuggagugcaguggcaccaucuuggcucacugcaaccuccaccggguucaaaugauucuccugccucagccucccaaguagcugggauuauagguccgcacuaccgugccuggcuaauuuuuguauuuuuagcagagacgggguuuuaccauguuggccaggcugcucucgaacuccugaccucaggcuaucugcccuccucggccucccaaaguguugggauuacaggcaugagccaccgugcccggccuauuauaacacuuuuuaaggagcuguuauaguugaaauaaacuaauuugaaaucauguaaauuuuuguuguuuuugcuguuuuagugacagaggagagauaaaacuggggauaaacguaauuaaacguauucauguaauuaggaaaaucuuuuuuccuuuuagaacugaagcuaguuuagccucacgcagagaacaaaagagagagcaguaucgucagguaaaagcacauguucagaaggaagacgguagagugcaggcuuuuggcuggagucugccucagaaguacaaacagguaauaugcacaugugguaagagcauccagcaggaaagaagagggcaaguugagugugcgugggcaugaaggauucacuguacgcaucccagcccugcucaucucagccgcauggacugggcacacauuuaagcauggaggguggugguuuucaggcuguuuucuagagcuguagaacucaaaugaaaugcucugagucugugagggggggaggagucaauaaaggguggcuaagugcauggaguuugagguacccgcucugcuguaaccagagcaauucugguuuaauauuugaagauuucauuuuuuaaaaaaccagcaucauuguugaaaaaauuauuggcauggaacuuuucaaacuguucauuuaaaauuaaguucaggucuucaggaauuuuaucugucuacuccauaauuccuaccccaaaagacucacauguucauguacaaacacauaugcaugugcacgugugcacauaugugugaauuagagccucuuuuugagcucccauuauauccuguuuauugaauugcucaacuugauuuuucuguuuuucaaauaagaauggcaaaauuggcugaugccugucauuggcucauggugccuguuauugacucaugccuauaauccuaacacuuugggaggccaagguggaggauggcuugagcucagggaguuugagaccagccuaggcaacauagcaugaccucaucucuacaaaaaauuuaaaaaauuagcugggugugguggccugugccuguagucccagcuaccuuggaggcugaggugggaggggaccgcuuaagccugacagauugaggcugcagugagccaugaucaagccacugcacucuagccugggcaguagagcgacccugucucaaaaaaacaaaaaaacaaaaaaccugaacuugauuucaaggaguaaauaacagcagugcuugcucaugucucaguggaucuguaauaaguucacuuuugaugaggcuuacuaaugugccuuuuucacuccuccuuccaccauuauuagguaaccaauggucaaggugaaaauaagaugaaaaauuuaccugugccugucuaucucagaccucuggaugaaaaagauacaucaaugaagguaaguucauugugaauuaaaaggagauguuuucuaaacucuggguaguuuuuuuucuaaaaccaaaaaaguauaaguauuacuucuauggugagguuauuguucauuuuauaauauuagguuauaagaccuguauuuacaaccauuaguuauuuuaagaaaacaugaaaaugcuaaacauuucuagacuuaauauuguuuucuuuuucaccugagaagcuguggugugcuguuggagucaauuuaucuggugggaagaccagagauggugguucuguuguuggagcaaguguauuuuacaaggauguugcugguuuggauacagaaggcaguaaacagcgaagugccucucagaguaguuuagauaaguuagaucaggaacuuaagguaaguguguguacuaacauuugaccugguuuaugagacuaugaguuuaacucuuucauccaaaauuugccucuggguccagcuucuaauugggauuacuaugcccuggcuuacugucccucagcacccuuuuaaaaucaauuuuaaaauauugagguauaauuuacaugcaauaaagugugcacucgaaauggguauaggucagaguuuugacacauguguacacguauguaaucacuacagugaucaagcuaauggaacauuuuaucauuguucugcuuuaccuguuaguuuuguguugcuguuuagagacagagucucacucuaucacauaggcuggagugcaguggcaugaucauggcucacugcaguguuaaccuccuggacucaagugaucuguccacuucagccacccaaguagcugggacuacacacccacaccaccacaccuggcuaauuuuauuuuuuguagagacgaggguuucacuguguugaccaggcuagucucacacuucuggccucaagcaguccucccaccucagccucccaaagugcugggauuacagacgugagccacugugccagccuaacugcuaguuuuucaucuacuaauuaauauugauaggugguuguauuagucuauauucacacugcugauaaacacauacccgagacugggaaggaaaaaagagguuuaauugggcuuacauagguaaccucuggggaggccucagaaucaugacaggagaugaaaggcacuucuuacaugguggcagcaagagaaaaugaggaagaagcaaaaguguaaaccccuaauaaacccaucagaucucgugagacuuauucacuaucacgagaauagcaugggaaagacuggcccccaugauuaaauuaccucccccugggucccucucacaacaugugggaauucggggagauacaauucaaguugaguuuuggguagggacgcagccaaaccacaucagugguuguauuuuuacccuuccaaauaaucuggaaauaaauuugaaauaguauugccuuuuacuguaacagcaccaccuuaugaauauuuguacauacauauuguuuuaaacauuuuuccuccuuugccuauacaggaacagcagaaggaguuaaaaaaucaagaagaauuauccagucuaguuuggaucuguaccagcacucauucggcuacaaaaguucuuauuauugaugcuguucaaccuggcaacauccuagacaguuucacuguuugcaacucucauguucugugcauugcaagugugccagguaagagugagucaugcguuucucugcccuccccuccauccaccuaccugcugggcacugauguagcagcugaagaugcaguucugcaccuugcugucaugaagcuuauguucuaguuagggaagauuaaaaaacaaacuggaaaccauugaauaaagaagauauuuucagguagugaaaaauacugugaagaaaauaaaacaaugggaauaugagaaaauaacugggagccagaggacuguuuggauuaauuaauaaggaaaggucuucuaaaguuuuggauuaaacauuaugugauguuaaaacauuaguuuaaaaauuaaagaaguguaugugauauauccauauguuggaauauuauucagccauaaaaaggaaugaaguucuuuuuuauauuuuauuguggaauacuuaauaugaguucuacuuuuuuuuuuuuuuuuuuuuugagacagagucuuacucugucacccaggcuggagugcaauggcaugaucucggcucacugcaaccuccaccuuccagguucaagugauucuccugccucagccucccgaguagcuggaauuacaggcaccugccaccacgcccggcuaauuguuugcauuuuuacuagagacgggguuuuaccauguuggucaggcuagucuuuuuuuuuuuuuuuuuuugagauggagucuuacucugucacucacacuggagugcaguggcaccgucucggcuuacugcaaccucuaccuccuggguucaagugauucuuuugccuuagccucccaaguagcugggacuacaggcacgagccacuacacccggcuaauuuuuguauuuuugguagaaauggggugucaccauauuggccagguuggucucgaacuccuagaccucgugaucugcccgccucggucucccaaagugcugagauuacaggugugacccaccaccccgggcagucagauuagucuugaacuccugaccucaggugauccacccgcuucguccucccgaaguacugggauuacaggcaugagccacugaacccagccugagaucuacccucuuaacacauuuuuguuuuuguuuuuuugagacagggccucacucuguugcccaggcuggauugcaguggugcagucacaacucauuguacucauugcagccaugaccuuccgggcucaagugauccucccagcucagccucccaaguagcugggaccacaggcgcacacuaccacaccuggcuaaguuguuuguacuuuuuguaggcaggguuucaccauguugcccaggcuggucuggaacuccugggcucaagugaucugccugccuuggccucccgaaguauugggaugcccagcccucuuaacaaauuuuuaagaguacaauacauuauccucuagguagaaguucugacacauguuauaacacagaugaaccuuggaaacacuaugccaaaggaaauaagucggacacaaaaggacaaauauuauaugauuccgcuuauaugagauaucuagaauaggcacauucauaaaaacauagaguuucugugugaggugauggaaaagcuuuagaaauaggccggccauggagguucacacucauaaucccagcacuuucagaggccaaggugggacgaucacuugagcccagaaguuugagaccagucugggcaauauagugagaccucauuccacaaaaaaucaaaaaaugaggcgggaggauaacuugagucggggaggucaagacugcagugagcuacgauugcaccacuacacacccaccugggcaaugggaguaagacccuguguuuuaaaaaaaaaaaaaaaaaaaaaaaaaaaaagaccuggcaugguggcuuacaccuguaauccagacacuuugggaggcugaggugggcggaucaccugaggucaggaguucgagaccagccuggccaacaugguaaaaccccguuucuacuaaaaauacaaaaauuagccaggugcaguggcaggcgcuuguaaucgcagcuacuugggaggcugaggcaggagaauugcuugaaccugggaggcagagguugcagugagccgagacuguaccauugcacaccagccugggcaacaagagugaaacucugucgccaaaaaaaaaaaauaauggugauggcuacacaauguuauaaauauuaaugccaauauuguaaauauuagugccacugaauuguacacuuuuaaaugguuaaaguggcaaauuuuguuuauauauauauuauuuuuacugcaauaaaaguuuuuagugugauauaaauaaaacaauuuucuaaauuaaaaaaugagauuuauuuuuauauuguaaauauuuuuauauuauaaaugcuuaguuuuuaauguuuuacuaauaucuuaaucaaccuauauacuuggggcauuuaauuuuuaacaguaauggauagaagcuuauacuucaaguaguagcaguagucuugaugauuuaaaagaauuuuuuuuuggcugauguugucagauauaauagauuguuuuuaaccuguggcugcugaggagcucacuaagaacagaagcuggcuaggcgugguggcucgcaccuguaauccuaggacuugucugagguugguggaucccuugaggccaggaguucaagaccagccugaccaacauaccgaaacccugucucuaccaaaaauacaaaaauuagccaggcgugguggcucacaccgguagucccagcuacucaggaggcugaggcaggagaaucacuuaagccaaggaggcggagguugcagugagcugaaucaugccacuguacuccagccugggcgacagaguaagacucugucucaaaaaaaaaaaaaaaaaaguuuauuuucugacauuuuuauguuuauuugcacuuguguuaauagaaguauuuucuuaauuuuuuaaguuaccuucccauauugugaagauuuguuuauguaaauuuaaugcuaccuguauucaacuaccuguacaucucaccugcauaacucucauuucaaaccuguaauuguuuuaguaaaaaaaauguuauuuauagaaguuuacuuugcuguuacaagaagauuuauuuuucaggugcacgagaaacagacuacccugcaggagaagaucuuucagaaucuggucagguagacaaagcaucuuuauguggaaguaugacaagcaacagcucagcagagacagacagccuguuaggaggcaucacagugguugguuguucugcagaaggugugacgggagcugccacuuccccuaguacaaauggugcuucuccagugauggauaaaccaccagguauauccauucucuuuaccugccaucuguauagagucuaaggcuacacucagaugccucauuauggacuuaauuuagaucuuaaguaacaagguugaaagaacuugaaagaagauacuguaggccgggcgugguggcucacgccuguaaucccagcacucugggaggccaaggcggguggaucacgaggucaggagaucaagaccauccuggcuaacacagugaaacccugucuguacuaaaaaguacaaaaaauuaaccgggcgugguggcgggugccuguagucccagcuacucgggaggcugaggcaggagaauggcgugaaccugggagguggagcuugcagugagccaagaucacgccgccgcacuccagccugggcaacagagcaagacucugucucaaaaaaaaaaaaaaugcuguaaugacuguuaaauggaaugaagaauucuuaauuucaugguacagugugaaggaguggguagauggaauggaauucuauaacagggguuuguguggggaaauaauuggaggagaaaagcccagacuuggaauaguguuuuauuuacuuuguagaaauggaagcagaaaauagugagguugaugaaaauguuccaacagcagaagaagcaacugaagcuacagaagggaaugcggggucagcugaagacacaguggacaucucccaaacuggcgucuacacagagcaugucuuuacagauccuuugggaguucagaucccagaagaccucuccccaguguaucagucgagguauaauaaugggucaucaacuuaggcaacugggugaagugcacaaauaaaaggaaccaaaauaaucucaaacagucaaaagauuuccacuaauuagugucacugugguggauuaaaagauaccuauucuugugauaauuucauguauucccgcuccaucauucucgcuggauauucccccccauuucuucuguacaccuuccaauuuaaaaaaaaaaucuuaucuauaaaaguauaaucaugcaucagucaacaauggggauauguucugagaaaugugucauuaggugauuucaucauugugugaacaucauagagugcauuuacacaaaucuagaugguauggcuuaucacacaccuaggccauaugguauagcccauugcuccuaggcuagaaaccuguacagcauguuacuguacugaauacuguagauaauuggaacauaacgguaaguauuuguguauguaaacaugcacaagguacuguagaaauauaguaguauaaucuuguggaaccaccaccauauauucuguccaucauuuuccaaaaugguuuuaccaggugugugacuauauauuagucaaaaucuuucuguucauuuucuccucugaucuguuuuuuuuucuuuuuuuuuguacuuacugucuuccauucuauaaguaauucuuugucauuuuaaucccaccccuacucuaauuuucacuccaguuaucagcaaaauuggccauuguuuaaaucugccauuguacaaguuucccacauggguguggaugaccuuuuugaauuuaguuuucaugcaaauauuuuauuaaaaaacaacucagauaguuccaguggcucaugccuauaaucccagcacuuugggagucugagcaggaggauugcuugaguccaggaguucaagaccaaccugagcaacauagugagacccucaucucuacaaaaaacuuaaugauucgcugggcgugguagcgugcaccuauggucccagcuacucaggaggcugaggugggaggauugcuugagcccugggagcuggaggcuacagugggccaugauaucaccacugcacugccgccugggaaacagaacaagacucugucucagaaaacaaacaaaccaaagaaaacuguuuguuuuaggcuccuccguuaaaggguugguuaaucuaggcccauuuagugaauuauuuuauuuucuuuccugccuuuucuagauccccucuagaugagagucucuuuaaacuagauccuuuuuaaaguuuaauauucuuaguguauaaaguaagaaagauuaauuaauaacccauuuaugccuagugguccauuauuggaaugcuaagcuugugggaguuauucauauccuacugcucaaggucaucgcuaaggucugauuuuuuacaaaaaaaauuugcaaccuccggcauaaauggguuaauauuuaauucuuuuuuuuuuuuggagauggaaucucacccugucacccaggcuggagugcagcagugcaaucucagcucacugcaaccuccgccuuccagguucaagcgauucuccugccucagccucccagguagcugggauugaaggcaugugcugccacacccagcuaauuuuuguauuuuuaguagagaugggguuuuaucauguuggcuaggcuggucuugaacuccuggccucaagaaauccacccaccucacccucccaaagugcugggauuauaggcgugagccaccgcaccuggccugaauuauuaauuuaagaauaagucauguuugaauuugauagccugguuauauaucuuuuacuaaauaugcccugacaauucaaaggaaagguuuugugauagaauauuaaacauauuucaguuuauuaauuuauuuuaggucauucuuuauauuucucccuacuauuuguauguguguaucccucccuucucucucacuugagaagaaacuaugacaaaacccaaaauaagagacagccauaguaauugucugaauauuaacugcuguauuucauuaccaugucuuauuaucuuuucugcuccuugggcuuccuaguuuguuaauguuauuucugguacaauuguugaaauaugugauguaagcuuuugacuuuggcuuuucuggaauuuuggugguuucuuuuuuuuuuuuugacuaaaaguugaagccaggugugauagugugugugccucuagucccuguuauucaggaggcugaaguggaaagaucacuugagccugagaggucaaggcugcagugagcccugauugugccacuguacuccagccugggugacagagugauacccuaucucuaaaaaauaaauaaauaauaaacaaaugaacaaacuuaaauauagaaggauucagucccugaaaacuauaacgauaguuaaguauacucagauuucuuuccuuuugcccucccuuuccagcaaugacucagaugcauauaaagaucaaauaucaguacugccaaaugaacaagacuuggugagagaagaagcccagaaaaugaguagucuuuuaccaacuauguggcuuggagcucaaaauggcugguaggugucaaugcuuuuaacauuagaauauguuguuuuacuuuugcuuuugaaaucagaagauaaguaaaauaugguaaacaaauacaaaaaguguggauuaaugcaaagaauuuuauauauacacacaauuugauguuauguugcaacuaccacauaaacuggacuugcacugguucugaauaguaagccauauguuucuuugucacagaauguucccuuucuauaauauucuuggaagaagagguauguaaaauuuuaaaaucgaggugcuccagaaauagaagauccugaacagcacaaagacagagaauauuuaauuuauguaggcuagaaugugggcaggaaaacagggauuaaaccaacauuuuggcugcaggaaggcccaaucccaacuuuuagugaauuuuuuacuaagauagguaaaacaaaucacaaucugcaaagucagaugaugaugacuaauauuauaugguuuguucacuuuccgguuguguggagaguuuuacaaaauugugcauuuacaaagguuaagcaagauuacuguugagcaucucuaauccaaaauuuaaaacucuuugaccacuguuaugaugcuggcagguaaugcucauuggagcauuuuggauuuuugaauuaggaauacucaacuguuauguaugauguaaacauucuaaaaucugaaaaagucagaaaucccaagcauuucaaauaaggguuacucaaccuguaguaugucuuuuucauaugaguccaauacuauaaagugaagaguuggcaaacuuaguguaacucucuuccaguagagcauuaugggcauuguaguuugaauuucauauaaaucuccccugucguaaaauacccuugauuucccccccacacacacuuuuaaaaauguaaaaaguauucuuagcuugcaggcuggauuaaaacagguggcagacuggaucuggccuguaggccauaguuugccacucccuaugugggccacucugucauccaaaaguuauagaucaguguaguagagagguaaggcaauucaaaaaaagaguuuugcccaaggacuaagugugugaaccugacugugcauugcacuaguucuugcuuuucagucuucauauguuuuucuuugcucagcagccuauuucuuuaccuuaggccuacccucacucucauuuuucuuuucugaccauugcacaaaagcagcagcaccuuuuccuaaaauuuguauguuacucuucuuuccuucugaaugaacuucgcgaucauuguuagauauaugcaaugucuugauguucucuaugccuuaccaguguugacuuuguucuuacaguuuguauguccauucaucuguagcccaguggaggaaaugucuccauuccauuaaacuuaaagauucgauucucaguauuguguaaguuuuauuuuggaaauucuucuuguuaaaacuaugcauuuugguauaaacuagauuuuaagacuuugaaagcuaauacauguuucacgacuaaauuaguauccaauuuguuuguuuuuuuaacccuuuuuauggaacuagagaaguuaagugagaaugaaacuguauaauagaaaacgaaguagaaaggauaacuugcuugauugaguccucaccauacugcgauuuauuuagcacugcaggaaauaaccaauaccuauuaaguuauguuuauuuuagaauauucuuuauggcuuguaaauauguugauuggggcauugauuacuaguucuuuucuauguguucacuguaaaaaaaucagacaguuuaucucugagccuacagggcugacucuguugguuccacucaaggugcaugucucuggucuuuagaguuuguguugauugucugugaugagaggagaaccuugggccagaaagugaaauaacugagauaccauucauacuguuuauuuaguucagcugacauuuuuucauagcaggacauccacagugaagaaagugguguguucauuuauauucaggugucagcuccuuaacucaucacagauuggcccuuugugaggccuugaacuaguucaguagcauguggucccuucuguauuccugaauggagaguucugaacuccccuuuccuguuugcagacacgugaagggaaucguguuaguagcccuggcugacggcacccuugcaaucuuucacagaggagugggugaguggugauguguguauaacauggacacuaauuuguugcuuugcaaagcauuuuuaaguagauugguuuauguuuuaaagaaaugauacucaguuuaaagaauaaauacuaacaauacacaacaucaguaaauauauuagugcgugcauggagguauacauuaacagauaccuuagggaaaauguguuuaccacaaugggcauuuuauggugcuuuuauuuuauuuuauuuuuugagacagagucucgcucugucgcccaggcuggagugcaguggcgcaaucucagcucacugcaagcuccgccucccggguucacaccacucuccugccucagccucccgaguagcuggacuacaggcgccugccaccacgaccagcuaauuuuuuuguauuuucaguagagacaggguuucacuguguuagccaggauggucucgaucuccugacuuugugaucugcccgcuuuggcuucccaaagugcugggauuacaggcgugagccaccgugcccggcugguacuuuuaaauaaugugauagggaggcauuuguuuuucauucauauacuuaugcaauucggagaaacuugguguuuuuuuaauguccuauguguuaaaaauaauuuguguccacuuaacauuuggacuuuuucuuaaagaauuuuaauuggguaagauuuaaucauuuucaugucaccuuauuuauauucucccccuuuaaaaccauuguuucaucuauagagggguggugguaucagaaacccuaccuuaaaugaauuaaguugagggaauuuaguauguauuccuccguaacuccuugguacuugugucaaccaaaaaugauacaucauuuucuacccacuugauugguauaucuaggaaguauuaugaaacauagauacccugaauuuggauuuuagaaaagcuuuucccaaaaucuccuaucuuucugggcuggggaaauguggaguagaugacaguuaggugcuuuuguaauugauugguaccugaaaauugcugguuaaugacuccauaucaucaaagagugagagggcuccauuuuaccuuuuucagcccuuuaucuauguuuaaucuuuacaguaaauuauuaagaaaguuccauggucauccucauuuuauagaugaggaaacugaaacacagagcauuuugguaacuuuuucauggccacucagcuaauaaguggaaaagccuagaaaaaaaaugaaacaaugcauguuuugguaaauugaauucaaaauaauauugacagaauaagacaaguaaaaugcauuuaguaagugucaauguaaaguccugcauuugaguucagaagagcacgauggggagacaugucugaagagugagaauuaccuaaagguugacuauaaacucaauaugaguuuaaugccuuaagccucaaagacaaggcuggugauaauccugcucuacuaggcuagauaaagacagcauauucaauggacaucaacaaaacagaguuaggaugaagggucuguaaacugugguagguacagagcacaugccaaagauaacuugguuuugaaaagaggagacauagggcuguaacgaagaaguuuguacuggauuuauucuuuuguuuccacucugcaagacugcagacgagugggugauuacauacaaaaagacagacuuuagcuagguguggguaauauuuuucaauuaaaggugucugaaaauagaauggcugcuuugugaggcaguaugcucacaaaagcuaacaaagcaaagcgagguucugaugacugguucuccuucauauuucuaguaucacugaaaauauaguaugcauaauuccuaaaguguuagcaaugaguugcccucaacuucuacccaagaaaauacaucaaaaugcacgugacugagagacguuauucccaaaauaaccuuaaguccauucuaauucgaaaaauauuaugauaaacagauaacuuguaacugauuuaucaucacaucacugcuuuugugagcauguuuuaaagggggucuagguacuggguggcacuuugaagcagaugaccuuugagggucucuuccaacuuugcagcuuauggaauaaaagaacccaggcugcaaauaaaagauauacuuaguacaugguacuuugagugcuuccucaauaaauuuaauuauacaacaaauaaaauguuucuuguguugaaauugaguaacaggugguauguauuuacuauaaccuuuuauuuuuuuuaaagaugggcagugggauuugucaaacuaucaccucuuagaccuuggacggccucaucauuccauccguugcaugacugugguacaugacaaagucugguguggcuauaggaacaaaaucuauguggugcagccaaaggccaugaaaauagaggcaaguuauuagccuauguuuucuguauuuauugaauuuguauuauccgaagacuauuagacuauaauuauuuucagcuucuuuagaaauuguuucuggaucuguguguuuuagggcacuugaguaauguauuugaauaucuuagcuuucuguguuacuuaacucucuugccaguuuugacugugaggguagaaaguggcuuuuuaaaaaaggaaagaggauucauacgugaauguuuaaaugugugucuguguauguauccagaaauauguauguguuuuuguuugaauacaugguucuuuuuauguuuaguuauaugaggauuguuugagaagaggauuccucccuguccuccccacguguaauccaggcacauccacaugugugucccagacagaaauaacauugcacugggaauuuguuguaaaaaugaaaaccuccuaaccuccuagcauuauuuucuuuuuuucuuuuuucuuuuuuuuuuuucugagacagagucuugcucugucacccaggcuggagugcaguggcauguucuuggcucacugcaacuuucgucucccagguucaagcaauucuucugccucagccuccaaaguagcugggauuacaggcucccgccaccacagccagcuaauuuuuuuuguauuuuuaguagagacgggguuucaccauguuggccaggcuggucucgaacucccaaccucgugauccgcccaccuuggccucccaaaguccugggguuaaggcaugagccaccgcguccggccuagcauuguuuucuuacgguuuuuuuuuuuuuuugucacaauacauaaaugcauucuaauuguuuagggggacaaaaagcauacaggaaauuuuaaggugaaagcccuccuucacccucccccaaaucacauuucuuucccuagaagucucaaagucaaccauuugguguuuguuuuuuauaucaauucuaucuaucuaucuauucuuucuuucuuucuuucuaucuaucuaucuaucuaucuaucuaucuaucuaucuaucuaucuuuaucuguguaucuguuuauaucuaucuaauuagcuagcuaucuggcugucuauccauccauccauccauccauccauccauccauccauccacacacagguugaauaucccuuauugaaaaugcuugagaccagaaguguuucagauuuuggauuuuuugcagauuuuggaauauuugcauauacauaaauaaugaaauaucuugggcauggaacccaaagucuaaacauaaaauuuauuuauguuuccuguauacuuuauaacagugaaaaauaugauauaccauuagugcaguaaaaaaaauacuguguucagcgugacuuaugguaucauaucggcacuuaaacacuuucagauuuuaaagcauuucagauuucagauuuuuggauugggaaugcucagccugugccucacacacauauacagcagcguggguuccuuuuaguuuaauuauauuuugguauuuuuguuuguuuguuuugagacaaggucucacucugucacccaggauagagugcaggggcgcaaucauagcucacugcagccucagacuccugggcucuagcaagccuccugcuucagccucccagguagcugagaucacaggcacacaccauuauaccugacuaauuuuucuuuaguuuauuuguagagacgggaucuugcuauguuguccagacuggccucaaacuccugggcucaaauaguccucccaccucagccucccaaguagcuaggaauacaggcaugcaccacuauucccagcuaauuuuuguauuuagaguugggaugucaccauguuucccaggcugaucucaaacuccuguguucaagagauccucccaccucggccuuccaaagugcugggauuacaggugugagccaccagcgcccagccugauuaauuauaauugugaucuuauuucaacacaguggcucugcaacaacacaaaauccggagauaaaaucuuucuguuaggccaggugcgguggcucaugcuuguaaucccagcacuuuggaaggccgaggugggcagaucacuugaggucaggaguuugagaccagccuggccaacaugaugaaagccugucucuacuaaaaauacaaaaauuaguccggcaugguggugugcgccuauaaucccgcuacucaggaggcugaggaaggagaaucgccugaacccaggaaggggagguugcagugagccgagauugcgccauugcacuccagccugggcgacaagaguaaagacucugucucaaaaauaaaaaauaaagaaauaaaaaaaaucuuucuguugagcacuguuacauaguguggaugcgcuaguauugcuguuauaaggugauauccuauauagugcugaaguccaauaucccguucuuaguucuuuauuuuuugcauuccaggaugaaaacaauuguguauauaagaguaaucauguuuaauauauaauauuugggcuugucuuuuaauagucugcuaacuugugcaaauuagcacaguuuuaaauaugaaauucuauguagcaaaaguaacuuugugauuggacaaucucuccuagaaaucuuuugaugcacaucccaggaaggagagccaagugcgacagcuugcgugggugggggauggcgugugggucuccauucgcuuggauucuacgcuccgucucuaucaugcacacacuuaucaacaucuacaggauguggacauugagccuuauguaagcaaaauguuagguaagcuuccaacgcguuuuaucuuuaccagucaaagaggguguuuuauuuuaucuaucuauguguuuauugaaaugaggucuugcuuuguugcccaggauggagugcaguggcuaugcacaggugcagucauagcacacuauagccuugaacuccugggcucaagcgauccucucaccucagccuccggaguagcugggacuguagguaggcacagccaccucacccaguccuuguuuuuauuuuuaaauagucuaaaaugcuggguagaaccaaugaauuaaguuaucucaggaguagugaacuuuuaucauugaaagugucagacguuucaaucuaccuuacucuuuuuuuuuuuuuuuuuucuuuuuuucaagacggggucucacucugucaccuaggcuggagugcaguggcaccaucacggcucacugcagcuuugacuuccugggcucaagugauccucccaccucagccuucccaguagcuggacaggccugcacuaucauguuggcuacuuuuuuuuuuuuuuccuguagaaaugagguuucacuguguugcccaggcuggccuuaaacuccugggcucaagugauuggcccagaccucagccucccaaagugcugguguuacaggcaugagccaaugcaccuggccccuuauuguucuugauggaaaguugggaucauuuuggacuccucuucucuuauuucccacaucuaaucugucacugggaacugucaagucugccucuaaaacuguauuaaaucaguuacuucuuuaucucuaccacuauccuuuuacccccaggccuccuaacugggcucccuguugccaccccagucuguucucugccuaguaaccaaggugcagauauuaccuucacacaccuccacuguugccuuuaggugaggugacaugaccaggagaccuuacauguucucaaacacucuccuugcucauaccgacccacagcucagcaagcuccuucccauuucaggguccucacaugugcugcuguaucaucuaccugggaaguucuucuuggucccuuuuuacuuacuuagcuuucaggucauagccuaacugucauaaucaggagagaccauuuagguccugucauacuuuuucuucaugggcuuaucauuauugugaucguaccagucuuaugugauucuuguuuauaaucucuccccuacagacccuaagccccgugaagaucagggaccaucauugucuuguucccugcucuaucuuuagcaccugaccuaguguuauaaugauuauuagaaaugucauaaaggauuccuuucaugaaaaaugauugaacuggaucagugguuuucaaccauuuagaguuacugcccucagaaaaccuuauuucuagcuauguaccuucucccuagaauauauacacaugcaaacacaaacuaauuucagggaucuacuuugacuggagguuaaagguuccuagguuaggcugaaugguaauuaagccuccuucuaacacugugauucagcgaucaugcccucaguucuuguaaguagaacuuaugaguacuaguguugucuuucuuaaauguauuaccugcucaauaaauuugucuuucaagucacugaaaauaagaucaguuguaaaaauuaacuugaaauacaaaaaugcguuuguucucccuaaauuauuuguguauaauacuuaaaauguuuaaacugcuuuagaaccuaaguauauaaaugaggggaaaaguauagauuuuguuuacaaagauuuuuaucugugcaaagaaaacuuaagggaaaccagaacuuuuucagcuuauaagaucaaaggacacuugauuuaucuggguuuguuuguuuuuagagacaaagucuugguccguugcacaggcuggagugcagugguuggaucacaguucacagcagccucaaacuccugcgcucaagugacccucccaccucagccucccacauagcugggacuacaggcaugugccaccaugccuggcuaauuuuuguacuuuuuguagaggugaggucuguugcccagguuggucucaaacuccugggaucaagcagucaucccaccuuguaggaucuacaggagugagccaccgugcccugccaguuucacuguuuucuguugggguuuuuuguuuuauguguugguuugguuuuacaguucccuaaguaaauccugugucacaguuccugauguauccuauuuccuguguacuuuucuucuaacuaauaauguuauguuacccacuuuuaggcuuuucuuuuuccauuaacccugaauugucagauagacaauaagccccaauaugagcuuacuuugaugugaaccuucaggaaacauccaucuagcucuagucacauuuccucuguguuguaucaauccugcuacuacuacuuucuuucuuuuuuuuuuguuuuguaauccugcuacuucuaaggaacuuggaauguaaaacacugucugcuuuaguuucucaauaacguguucccuccuuucuuuacagguacuggaaaacugggcuucucuuuugugagaauuacagcucuuauggugucuuguaaucguuuguggguggggacaggaaauggugucauuaucuccaucccauugacagaaaguaaguauauuuuuagauaacugccauggaacaaauaggagaauuauaggaaauaguuaugucugaaauucaaaucuguguuagcucagaaaaucagugauggcaaagaucuagcuauaguuacuucacucaaugaaacuuauaaauucuaggaaaauaaguuuucauguaucaagaccaauacucauaauuaaaaguuuuucguugucaaaacauuuucacaguucaggaaucacaguccuauuucaucuuuugaaauaaaaguuaaaguccauuuuucuuaagccuuauuauaccauuauccaaaaacacuaccuagcauucaucuuaguuuuucauaucuccuuagcagauaguuuaguauauuccauuugucuuauuugagguuuaaaaaaaguuguggaagaaguuucucaggaguucagcaagccuuuccaucuaucuucuauuuuaaaagaaugugauuuauuguuuuuaugaauaaaauauaccucguguguuucucauaugauguuccauuacauuaaucauccauuaaguaaauguuuuuguguugcaaaauucauggcagggaaugguuuaaaagcaaauacuguaagucuauaaaauacauuaauacauauacacuucaaaaucaccauaccuuuuuucaggccagaggagggagaaagacuagaagguauuucggaagccuuuaaaagaaagcaagguuucaaucccaccugucuuuucugcaguuacuuauaaaucauauuuagaccucuccuuauauccuaagagauuccaggauccccuagaguucauuucaguuauuuguaagagcuucauuuuagcauaguuauuggaacaggauuuguuuuuuaaaacacacacacacagagaaauaaaggagaaauuuuagcauuuaggaaaugcugcacauugaguucuuaguguuuugauucagauucacuaaaauugcuuuauuauuuaaaaaaaaaacaccauaaaucagauuuuccuuuuucagcagagauucuaauagaagccuugggaagaacuuuauguauuacuugguauuaugccaagugggaucuuguuauuuucguuaggggcuuugagcaccagguuuaccagauagaagacgcugagagugguggcucacaguaauucucuccucccugucaugcaccucuccauguccccuuuccuccuuucucacuuuagccguaauccuccaccagggacguuuacuggggcugagggguaagugcagauucugaaccaaacucuucuuccuggcuucuaauagccacuguaaggcuguuaccacuccucuagaauacccucuugaauguuccuaaauguuauccacuugcagucacugcaucgcagcaggugucuuuuuuuuuuuuuuaauguuuguuacauggccaccaaacugcucagcagcuuagucuauuuaucaucuuuuguugcagcugaacuuucuuucagacuuuguuuuccuuccaguauaaacaugaaacaucucuuaaagcugucauuaauuuacaucguuuacucuuguuaccgaucauauuucuuucauuuacuuacuugcccauggaauggggauguuuugugagucuggucuuuuacaguacgcagcacaccaucagucugguaucaauaaaagcugcucuauuguaguggcuggauucuuguaagcacaacuuuuuaccaacccccucaagggaaauauucuuacugugagggagaaaaaucagaagauaaacuauaaagaaagacuuuauuugcaaauauacccauuuacuuuaaacuguauaaugguuaguuuucuaacaugugcauuaaaaacaaaacaagaaacaacuaagauucaaauuuguuuuuuuuuuaacuaaaauuauuuuuuaaaugaauagauguguuuaaaaaauaagcuuacuuauugcuagacuggcaaaauccccuacuccauuuacugagguacuuaaaaauaacuagcaugcuguaucucuuuuuuucccagcuuugucuugaauuggcauugccauccuuguuuuaucucaacuggcuguagcuuuuagauaauaucauaaggauuaaccaguaaccucuuacauucauuacuguuuucuaggggaaaauauuugguauuugguuuuucuguugcagcaaauaaaaccucagguguaccaggaaaucguccuggaaguguaauccguguauauggugaugaaaacagugauaaagugacuccagggacauuuauacccuauuguucaauggcacaugcacagcuuugcuuccaugggcaccgggaugcugugaaauucuuuguggcagucccagguauguuagauuauucuguugagauguuccauguaauugucucucuucugucaucucuugguuccacuaccuaauagucuaaggcuaaguacucgaauugcagguaauuucaauauauacgaaggaaguucuguaauggaggugugacuaaggugcuauagggauacuugaaugaaguuacuuuggaauaucucucccacccccaaagauaaauuuguugauuuuucuuuaggagacuugcuuacuuuugaaaagcaguaguauuauuuuaucaucguggauugccaaaaauggucuugaccuaauaagagaaaucacuagaaagaagcuucuaucaucaaggcugcauggaggaagagagaaugcacucugguaccuuuagcagcuuaauaggaaaaagcagugaacuaggaggccugggggucuggccccugugucucugccacuaaccucgagcaaggcacuuaaccucagagacucauuuccucacuccuagguggaugugauuaauaucugcucugccuacuucauuuguuaugaaaauuaaugaaaaugcuacugggagcuauaaagcaccacccagaaaaaagauggaagugaugauguccagugaaaaaugacaaauuauccauugacaauacuuaagugaugucacugaccaucuguaagcaggacacagguuuugaauuuuuuuuucccauaagaggcaaguuuaggagcuagacgaaguucagaucugacuuucccccaccaacuaacugugugauguaguauauuagucaggguucuucagagaaacagaaccaauaggaugcauguguaugugcguaugaagagagaguuacuguuaagaaauugggucacacaguuguggggacuagcaggucugaaaucugcagggcaggcuggcaggcuggagaccccgggaagaguggauguugcaguccaaaucugaaagcagucuggaggcaacauuucucuuuccucuggaucccucagucuuuuucuucuaaggcuuucaacugguuaaaugaggcccacccacacuguggcguguaaucugcuuuacucaaagucuguuguuuuaaauguuaaucacaucuaaaaaagacuuacaaugauaucuagacugguguuugaccaaauaucuggguaucgagcuaacacgucaaauuacucaucauacuuauuuucccaagggucuuccaaagauuaaaugauuuuauguacauggggcaagggcuggcauaugguacccuaagcaauuauucaguuauucuuaacaacagugauaaugagcuuucugaaaccucauuuguacauuuuauauauuuguauagucauuuccuuccuagaaaugggauugcugguaacaguguuucucuugcuuaaaaaaaaaugaaauaucacaguuuccuuuaaaucuccuuuguaucccucuccaaucccauucuccucuccuuuuccucuccauugguaaccacuaucuugaagucgaugcaaauccucuugccccuguuuuuguauuuuuacuauguuugaauguguuuauaaacaauguaugauuguuuugugguuuuggacuuuacauguuaaauguuguguuuuauauguaugcuucuacaacuugcuucucauuuuuugagauuuaucaauguucauacauaaaaaucuaguuuauucauuuaacugguauuauaacugaauaaaagugcuacauuuuauucauucuucuguugauggaccucuaggcuucuccccuuucuuuuuucacuauuaaaaacaauacugaagcagaccuucuugugugcauguguaaggauuuuuuguuggguauaaaucuaaaaguggaauuagcaacaugguuguugcgaggccaguuggcccuaaagauuaaaccauucugguuggccuuaucaguaauaccacugugcucuugcuucuguggcagaacuaacucgucuaccaacagaagucauugcuggcaugcuugauuucuuccaaaguauaauugaguaaugcaugaaugaaucccuguggggauacgucagacuauccuauccacuuucaacauacauuaauuuuguuacagugugucgcauuaauggcuguccagcuagcuccuggaggcgcagucuguguaguuugaccaaaggacagcagauucugacaaggaaaaaaauaucccacaauuaaaucuugcuaagaggguuggcuuagagauugcucauuuguucauaguugugaauaauauuuaaagguuucucucuuucuauuauuucacacucaaggauucuaccuuagaacuuaagcuuuagaacaaacagcacauuuacuaguaauuuuguuugcauaaucuaaauuaaaaauaaccuguauuuuccuuaaauaugagaggaaagccauagauuugaaauaaauuuaaauguuaauuaugacuaugcaaacucauagggcuuaaguugaagacuuuucucagucucuuacacaaauaagcacauuccuuuucaagggagagaccuuuuccacugucuucucagaucaaaagauuuagacuauaauaguuugaagcagguaggcugugcaugguggcucacaccuguaauuccacaacuuggaaaucaaggcaggaggaucacuugagcccaggaguuugagaccagccugggcaaacauagcaagacuucauuaaaaauuuuuaagagaccaggcacagugucucaugccuguaaucccagcacuuugggaggccuagguggguggaucacuugaggucaggaguuugagaccagccugaccaacuuggugaaaccccaucucuacuaaaauacaaaaauuagccgggcguuguggcaggcaccuguaaucgcaacuacuugggaggcugaggcaagagaauuguuugaaccccagaggcgaagguugcagugagccgagaucgcgccauugcacucuaaccugggccacaagagcgaaacucugucucaaaaauaaauaaauaaaguaauuugggccaggugcaguggcucaugccuguauucccagcacuuugggaggccgaggcaggcagaucaugaggucaggagauugagaccauccuggcuaacacggugaaacccugucucuacugaaaaaguuagccgggcaugguggcacgugccuguagucccagccacucaggaggcugaggcagguaaaucgcuugaacccgggaggcggagguugcagugagccaagauugugccacugcacuccagccugggcgacagagcaagacuccaucucaaaaaaaaaaaaaaaaaaaaaaaaaagguaguuugaagcaggcagcuaagacccaccuugccaugcauauaucucauauuggauuuggggccuauuccugcuuuguuacaaaauugcuuuacuuagauuuucaaauuggguuuuguuuguuuguuuguuuguuuguuuguuuguuuuuuagaagcaaggucuugcucuguugccuaggcuggaguacaguggcgcaucacagcucacugcaacacugaacuccugggcucaagugaucuuucugccucaaccucccaagaagccaggauuacaggcgcauaccaccauucccggcuaacuuuuuugguagagaugaggccuuacuauauuugccaggcuggucccaaucuccuggccucaagugauucucccacuucggccucucgaaggugugagccaccaugccugaccucaaaucggguucuuaaaaccuucauguaaauguuuucugaucaugcagagccuucuagcuuccccaguauuugguuauuagaauauauuuaccuuuuuguuuaacucuaaaaauacuuaaaaaaaaaaaacaaaacagccucccuucugugauaaguaauauucacuuuuguuucuguauaaaacaggucaagucaucagcccacaaaguagcaguaguggcacggaucugacgggugacaaagcagggccaucugcacaggagccugguagucagacgcccuugaagucuaugcuugucaucaguggaggagagggcuacaucgacuuccgaauggguaugucauugguucugggugcucaguuugcacugugugcuaugacuuggguuuugucccaaaguaaauaagaaaccacucugauaaugauuuauaagagguucucuuugagcucuuuacacacgaaaggauuuuguggguuuuuguuuuuuguuuuuuucuuuuugguauuucuuucuuuuuuuuuuuuuuuugagaugacgucucacucugucacccaggcuggagugcaguggcaugaucucagcucacugcaaucucugccuccagguucaagugauucuccugcuucagccccccagguagcuagaauuacagacaugcaccaccacaucuggcuaguuucuguauuuucaguagagacaagguuucaccauguuggccaggcuauucucaaacuccugaccucaagugauccgccugccucggccuuccagcugggauuacaagcccgagccaccgcacccggcccuugguauuucuuuucauaccaaaauguauuuguuugaaaggagcauuagaaauagcaggauguggucaaugugaaguuuuaugugaaaagcauaggauuuagggucagaaggccuuggacaagucauucaaccucuuagagccucgguuuucugucaaaauggagaaauaaaaauauuucuuaaacaacuucauuuguucauuuucucaccuaacaaacauuaauugagcaccuacuguguaccugucauucuuaaacuggagauacagaaacaaaucagacaaagccuucgucuaauagauuauagaacagugcagagauagagacauguuaauaaauuaaaauguuacugaugcucugguagugaguagucaguucuuuccaaggguagggagagaaggaagucaagaaaugaugcuugaggugacucagcacugcauagucuuagcacaaagggucagguuggggaaugggguggggaggaccagggguuggcacuccgagguaagagaauagcuuggccaaagguuuagagauaugaaaccauuuuaauggaagaaaaacuauuuuaaaaugacaagaguguggaguagaagaaaguaugaauuuguugucaaaagggagggagggacuggaguaugggaggccuuuacauaccagauuaagaagauuguacuuuaucuuucaagcaaaagagaacuauaggagcaaugugauuagaguugugugaaggauggacuggagguucaagacuagaccuagggaaaugaguugggaacaagugaaugcccaagaaagguaguaacagugugaacagauaagaagcaugaugagaauguggggaaggagagaaugggccauagagcucaggacugucaacaggagaagcaggucuggagggacggaaagaggaguccagugcugaucauguugaucuugaagagcauaguggugauuuaggugggaaauuuccacugggcuucugaauauacagguccucuaucuuaggagggagggauuugggggcugucagcauggagugguacuaaaagccaugaggguuggugaguucgcccaaggagcuaaaagaaaagguuccaguggcuaaacccagucucuaauaaaaauacaaaaauuagcugagcgugaugccguguaccuguaaucccagcuauucaggaggcugaggcaggagaaucacuugaacccgggagguggagguugcagugagccgagaucacaccacugcacuccagccugggugacagagugagacuccaucucaaaaaaagaaaagaaagaaaaaggaaagguuccaggauagaacccugaauucauacuccauuuaaagaucauuagagcuuauggagggaucugagaaggaauggccagagagguacaaagaaaacauggagaacugaugcucgugaaagaguagugcuuuguaaauuguaagacacuguacaaauauguuuauuuauuugcuauaauuuuucuuuuuugagacagagucucacacucugucacccaggcuggagugcaguggcacaaucuuggcucacugcaaccuccaccucccgguuucaagcaauucucaugccucagccucccgaguagcugggauuucaggcaugugccaccacgccugguuaauuuuuguauuuuuaguagagacgggguuucaccauguuggccaggcuggucucgaacuccuggccucaaacaguccaccugccucagccucccaaagugcugggauuacaggcaugaggcaccgcacccagcuuauuugcuauaaauaaacugaucccuuggacucgcuuaaaaucucagugcuucaaaaaguucccagacauaaggcaguaggcaguuugagagaauauaauaguguuguagaucaguaacaaauacuuuagauaugaauucuguaaaggaauaaaaaaaaauuagggucauuuaaaugacaaugugacaaaugugauuagugucaccaauaucugaugcaaaaaguuuguugacacuuuuaagaggggaaggcuguuagugugaacuuuagaaauugauuccagggaugucagcaggaauggagucauuucaaaguguuuugaauaauugacuauuguugaauucccuuuuaugagaggaguuguuagggacuccacuuggcuggggugauuuuuguaacuuuguguuggagugcaguaugucaguuggaaccguacugaggaguuuguuaauaaaaucucuaugugguuuuuccauuuccacuaaaaauuccuuccauuguggauccugaaaauagaacaaaaauugcuuaaccagguuuggcaguaucucuaguuauuuccagccugaaaaacagacuugucuuuagcauaggcuaauuuuaauagugaauauacuguuguaaaaaaucaaauuugaucuuuuuuggggguccauuuccuuuuucauuuccuguaauauuuuaacagugagaaauugauucuaaagucccauauuuuuaaugauuuaaacuuaaaacuuaggcuguagagacccuagcagacaggauaauuuucuuacaaguaaaaucuucagaacaacucagaagagaaauggcgacagccuuuugucucagccaguuaauuuuuuucauugaaauuuuuuaaaauuuaagagccaaacuuaauuuuuuuaccuucuaaccaccuggguauguuucaguucagagaugggaguuugaacugaguguucuccucucucuaguuugauauugcugugaaaaggccauuacagggcuggguaagggaaaguuuggccugcagagaaaaaugcagauauuuaggguuuuuucucuucuguuguuucuagucaacaguaucaauauuuucuuuuguccagcugaaauucacauggggcacauuacaaaauucuguuagaucaguggaauauaucuuuagguccugugguguguauguuuuuaggauucugcugaagaauccaucccacuagacaacuuuucacuggguugugccaaaauaacccugcucugugacaacagauacaauugaugcaagcuuguaucgagaauuaugguaugcccugcacugggucuuauggagaggagugugguguaccccagacugggccuuggaagccagugucugaucaggacaccauggaucacauucacuuagccgugaugcagaagaaccuguaucuuggcugcuaccccaaccucuuuguuucuccuuuuccauuauacacuguuaauuuguaaccuauccuaaacuugaaaaucauuggaagaaaaacccaguagcuggugaaucugccaucugcagugcugcaggcuaauuauuuuaauuuccauaugcuugugucaauuaucuucaauuggagaacauuacaccugucauugauaauugugaguuauuuggguuuaguuaguuugcucuguaccugugcucacgcauuuuauaacacuauucucaguucuuaguuuaaaauaagugacaguagacucuucauuuuggaugaacacagaauugccuucuuagcuucccaugucuggaccaucgguaugcagacauguugggguggcuuuuuaacguaguauagugaacuggauuuuauaaauacagucugaaaaaugaauuaaccuuuucugaagucaagcaguggcuugggugaauaugggugaggauucugacucuuaguauuucuucuacuauuuacucuccagugaaagucagacaaguuuugggcaucuuguucauggacuaaccacgagcauuacaucugacucacaucauucuauauuuuauguguucagccuaacuugagucuucuuaucauucacuaggugaugaagguggagaaucagaacuucuuggagaggaucuuccacuugaaccuucugucaccaaagcagaaaggagucacuugauaguguggcaagugauguauggcaaugagugagcccaugggaaacagguggagauggggaagccgucucuucugcaugguuuauuuucccucuauccuuuuauuuaaugcucuuuugugagauaaguuucaccacauaaugugugagcauuuuuuccuguuaacuuuauauuacaaaauccguucuaccauaacaauacagaggaacuagcuguguuacugcaccaguguuauagguaacuucaguauauuaugaacaaaucaaagaauguuuacuuccugcaaacuggugaauuauagaaagcaauccagaugugguuuacucugccacagucuaaugucauucacuucauuugauggggucacuuguuagcugucacuaauaauggaauuaaugggaaacacuugauaaaugaaacuguaccguuaaauacaauagcugaguuuuccccaguguauuguaaaauugacacacacuaauacaagauggauuaucaggauguaucuaaaugucccgagaggguuaaaagcuaacuguaaauuacuuuaacuuucacuuucaaaucugacaaaucuuguuuauaugguauauaaaacuuuguuuucaucagauuuggggggguuuuauauuaaagaaauuaagacuacacuauuuaaauaaacguuuccuguuucugacuuauuagagcucuaaaguuuaugaggccuacuucucugaauauucugauggguuuuuuuugagaccagucucauuuucauacugacaugucugaaagauuuauuauuuauaaagcuuaggacauacucugggaagcuuagaagauacuucagcacugggaggauuuuuuaaaggaaauguguuuuguauuucuuguaccagagaauggugauguugauugaguuuuuuccauguaaaaaauguacuuguuugccaaauguuccuagauugcucuuaaccuguuaauacaaguaaaacuguaguggggauggagucuggccuaaguacagaaugagggauuuaauuagaaaaguuauuuucuuuuguucuguaucaaacugcagaacagcuauauacuugguauuuuguacgugaauaacguuuuagcuuuugugcccuuuugagcuugaaggguuauccucaaaggggaaaacuaugaaggggaagaagacaaaccuaagauaccauaaaguaaagguugacauuacauauuuucauucacaaugcccauuaaaaaaaaaaaauagguugggcaugguggcucacgccuguaaucccaacacuuuaggaggcugaggcagauggauugcuugagcccaggaguucaagaccagccugggcaacauggcgaaacccugucucuaccaaaaaaaaaaaacaaaauaaauuaaccgggugugguggcacaugccuguagucccagcuacuugggaggcugaggugggaggaugaccugggcccaggagguggagguugcagugagccuugauagcaccacugcacuccagccugggugacggagcaagacccugucucaaaacagacaaacaagcaaaaaauagauuaaagucuggauuucacugauuuucuugcuuaauaaguuuuuuaaaaccacgaugcugcaauuuuuucccucucaagcuucuugaaaaugugugauuuacccuuuuuuaucuauuacucuaggcaaagcuaaauaugauuuuuuuuuuuuuuuuugagacggagucuggcucuguugcccaggcuggaaugcaguggugcgaucucagcucacugcaaccuccaccucucagguucaaguaguucuccugccucagccucccaaguagcugggauuacaggugugugccacccugcccagcuaauuuuuguauuuuuaguagagacaggguuucaccacauuggccaggcuggucucaaacuccugaccucagaugaucuacccgccuuggccucccgaagugcuugaauuacaggcgugagcccccgcgccgguccgaagcaaagcuaaauguaauuuuauguacuguuuuaacaguauaaaccuaugggauaaaggcccccaaucaucagaaggacuacugaaaagaaaagaaagcaaacguagaugucaaauugucuaaacauucuuaaguaccacugauuuuuuuuuucuggacuauuauacaaagaugucuguaaaaaguauaccaguggcuuuuaugcauauacacgauuaggcuagauugugaaguacaugggauuucaugagccagaggaggcauuuggauccauugggccacaugugacuauaagcacauuguguacacaauaaaauuguagccacucauguauuaaaacuguuuugguaaaagcuguauuaaaagaauaauuuuuugcuugagcuacuuagucacuuuuuugcagggcaccaaaauguaggcuacuuuuccauagcuuguuugcuauguuuuuauuucaucuuaaaucugagccauuuuuggcaauaucuuuuaaaaaaucauuauuaaacauuuauuggaaauguuguauagauucacaagaaagagacaccaaaguguuugggaauuuuaaucccaagaaguaaacaucccagagucagaucccauuugcuguuguucagccauguuuguaugacugaauguaauuuaggaaaucaggaguuagagaugaaaaauacaaacaugucaaaugguuguaauugcuuuuuuugaacuuacuggcuuuaacuuaaguaauauagguguguaguuguuuuaucuaaagaugucagauuaucuguggcccuguuaauuaacugcagggaccagagagaggacaaaaaugccuguauaauuugcuuuaaaggcuuguccuuauguuuguaauuucaguuaaauauuuucuacagauugcuucacuuccccuuucccccaauaacaaguucauauucuuguaauguuuacuuuggucaacgugguaauuuuuggaagaaaaugccaaaauguaagcuucucacaagcagcaaaggaauguaacugccuguagcuaccacaucaagggagagaagaggcuugcguacuuuggguugaucucacuguacaaaaaaaguguaccccuauuggaagaaauaaggaauacuugaagguuucuccuuuuuuuacacuugagucaugugcaagguugaaccauaugaaauugccaguguucaaccauugcugaucugcaaaagcgacaauaucauaugccucaaccuaacacuuacucuuaaaugcagguuaaaaucucugugaggcaaagggauaauauucucuaggaacucacuuuugagaguauuuuucucuaacccauguggaucuaaauuuuaaaaauaggaaugaaucucuuaauugcagcuuguggagaguauaaaacauuuugagcacaauaugcagcacauaacuuuucagauuguguuugcauagaaaagguuaaaaucaauucuuucaguuacuguauuguucauuucuuguaaaggucuuccuacauuugagacgagacccuuuaacauaggcugccuuaguaacaaaauaaaacagaugugucauaauauuaacuguccuaaagaacaugugucuugcaaaugccauggaacugaauauuuauuuccuugugaguauuaugaccguuaccaaaggacucaaccagauuuagggcucuucuuaauugaucauguucagaaagggacucauuuggucccacuuuguaacaugggaagaguagaagagaaaauuaaauguggaaaucauaaaugcuuuucuaacaggguuaugcuauucuguaacacuaaaugucugucuuuucucuuaaaagauuaaguuuuauuaauuuugucauacauuucucuauuugaauauaucuuaaccauuuuauguuccaaauucguuuuuuguccaagacauucuaucagaauuuuacuugccucuauaaucugaaaaauggguucuagaaugucccacuugcugucucuuagaggcugagcuucauuucuaugagcaaagagcucauuuagcaauguaguuauuucaguauuuauuucuauuauggaaucccugggguucagaauguaacuuuguacaugagauauauauaaauauguauaugaacaugua

SEQ ID NO: 193000 - RNA, 90067 nt, Homo sapiens
ucuguagaaguaaauuuuuaauggcugguuaauuauaucacuacauuuuauugcaauauaguacucauuuaagcacuuaaaaauggaagguguacaaagauuaaauuaagacacgguaaauugacuaaauauuugguuuuuauauaaauaaaggucauaaccacaccguugacauguaauacuguuauaauacaacaguuaaacuugugagucuacaacagaagucaucuguaguuaaacaggaaacaaaguugaaaaagaccauguuaaaacaaaacuacugggacuaacaggucgggauuguaaguagcaacaaacauauucacucagcuccugaguauuucaaguuuuacaguacacauuaaaaaugauuucuuccaucaacacuauaaauucaaacugucggauguuuaugcauuuugcaaguuacacugauugaaugcuuauaugggagugggggucggaacaucucccaauuugaaguuuacaucacccacaugcuaacacaaacacaacuuguuccauuuccuuccccucucuccccccucccccacaaagaaggcaggauuuuugguuucuuuuagguaauuguuuuaaaggauuugugaugaucaauuugaacgucugaaauucaguaauauuuaacucuuagacaacuaagagguuaaagauggaaaauaauuucuccuaacacuaaguuagaaaaucauuugcaucaugcuguaaacuaggaagcaauguaaagcgacaaaaaccuguccccaguacauaauuuaaaaaaucuaaauuucaaaucagcagagcuggucuacuuccauguugacuauaugccacaauauaagugugagcucuugaaaugcauagcuaauguagguagucuuccacuguggcaaaugcgcaggauccaauuccugaucgagccaucaguccuagacauuguguggccugucccauugcuagggcaaguggagguugcuuuggcagauuguggguuucugaggaaaaauaauuuaaaaaugagaacagcaauuagcaagacauuuuaaaaaacauuucaaucaggagaauacugcaaugacuuuaaaaacuaccacucccauaccacucugaaauaucagcaaaugaagguuucuaagcaaaagacagaugccgccuuggacauacuauucugacaagguaguguggguauuguguauucaacuauaagauaaacucuggcagaaucagacuuuuaaaguaucagauacuaaaauacuuccauauuaacuaugaugggaaagguacaauuuuuuaucugauauuuggaguggagaguaaggaauuauuucccuucugguugaucaaagucaguugauacuaacuaaaacuaaaaaaggcaccagguuuucauuacaaguuuccacugauggguucuuccaccucuguggauaggaccaaacaggcugccuagccaucuccaaggcauauauagguaauguuauuugggcugguggggaguaaguggugguggugacagugagagaacauacagcagagccaccccacaguuuuggaggugcuaauuuacaguggacaguucagacauuuaaaaaaaugccaauaaauuuucaggguccugcauaucauaaguuucuuugucagacauuuguaguacaaaugcaauaauuaacaaaauuuguuccuugccagagauggaaaaaaaugaacuaaugguaaaaguggccagacucagaagcugguaauuucucuuuaugagaaggcaauguccaaacuaaucaauaaaauuacuaaucaguucuuuauaggcacaguugacaacaaagggcaaaaacaguugacacauggcuaggaaggcuucauaugguuuaacuccacucuugguucagaggaugcaauuugaugguggaagaaagaagaggaaauuuccaaaagggaaaaagcacaauaucagaaagaagcaaauucaggacuuaaagguagaagagaaaacaaaaacaggauuaagaauaaacgugugcaaaaaagggcacauagauugaugagaaaguguggugucuugaggguucacagggaagaccgugcucaaagacaaacaucuacagggaauauuuuuuuaauuuuauuuuggccaaaggaagcaucuggcgaugcaucuuuaacuuuuuuggauguaugaaauuuucauaacacuauauagauggaccuacauaauauagcaugguauuuauaaacauauacaugcccaucuauagcaguuuaauaauugugucauuaauuuuacaggaaucgcauacauuuauauuaauaagauuaagcacuauuuauggcugaaucuacauaauauagcacaauauguaagaguauaugugucuauagauaauggugcucaacaauuaaauucccuugaagaacucaagaaacuaaauuguaagaaaacuggucacuuuaaagauuaguaucaucuaauaauuaggucuuaaugauuaccuacaauauaacuucaaaaagacauuuauaguaaaccauaauuuuccuuacaauuccagcauuauuacuaaguuacuuuuaccaacggagcuaaaugaauuuuguagaaccaaugaaaauauaacacauuaaccaaagaaaauucacauuuauauacaaauccuaaauuccggagaacuacaacacugaggacacuacuccuauucccaaacuucaguauugguccuuaacaaauuaauaaauuuucuaagggcaaagaaacagacugagucuuaaauaugaaugcuuuucauugcuuccuuuacauucuugcuguaagaguccuggcccucauugcaagucucccuaucuaaacuacucuuuaaucuacuuuuuguggcacugcccucaucuuccuaaacuaguuugaaauaugugacuaaaagucccugaaccuugcagggccaaacagcacagcacagacuucuaaacuagacuggagucccaauuaccugggaauuagacucugaagucaaaugaaaacucacucuuuauauaaauuaccuuugaugagaacugcccaaaacucaaacuuguuuuauguaaacaaucgacccuaucacauuuauauagaaaugcacaauaugugcaguuacacaauucauauaaaaaguacuuguucaguauauaaauacuauaaucacaaacgcuacagugagcugcucauaggaauggcaaccaaacgaacaucgaauuagcguuucgcacuugaugcucaccccuggcuaagccucgccuuuuaaauugcuuuucucuuccucacccacccuuuuuauuggguaagggcauguaguugaauccggcuaauauaaaugcaaauagaaugugacaucaaggcuugauccugccggguacucacaagucaucaggaagccccuugugcccauauucauaagcauggugggagcugugauaccaguggcuuaggcugcugcuacccauugcaaauuuagcucaagcaaaaugguugggaaccagguaacaggggaggaccagcuaggaauccugcccucuacuggaucaguuugagcuucucugauauucaagcucuucacucccuuacuuccauuuucauucucuccaucaaaaccuuucuugaccucuuuucuucaaauguacccuguucccuucuagccuaacucuugugacaauuauuaaucuauguucuuaacguucuccgauuccuucuacagcagccaaacgagagaaugccacccaauuccuagccuagaaaucaguggcagaaaaugccuuucacuaaagagggcuguaaggaaugucucugguaggguaguauuuugaauuauacacaaggaccaccaaaucucucauucuaaugagagaaguagacauucguggcuaccagaaaugcuuacauacaugcacacaaaaacuucuauuucccaaacaucccaaguuguaccccaucuuacuguuuuuauucuauuuaaauccacuugaaucuggaauuaaaggaggggguuucuauauuuuagguauuuuuauauuuuaaaaauauagaaaacauuuuccugaugauuuuaccaaaguguaaaugccaguacaaacacccucucuuaaauuuucagagaaucuaacugaaauugugccuuauuuggcuuuacuuaccuaauauugcacuguuaagagcugagcacacagguucucucugaaucgggucaagcugauuuccaacugggcuguuccagggaucugaauaugcuaguagacugaaugcauccuguugaaaacacaucgauuugguuuuaauucaaauaguucaacuauuaugcucacaaauguuuccaaguugagagguaaaauauggcuuccaggcacagacuaauaauguaaacuuuaaacccauuuacucccagcacugggacgcucuacauuuuugaacauuaaauuaugcagcaaagccuaauuuauuuucauuuuuccuguggacagccauucucauucaacuuccucccaucccuaaacacaaaacaggaaaaaaaaauuucaaaggaaugaacuaguacugguguagggagaguggaaggcaaaacauucagauguuuuacuucacaauuuauuacuacugauaugaaugugacagucaaaggacagggccugucugcauuuccuuuuuucaacagauuuaggaacuggacacaucucacugggaugucaucuucucaaauucaguuaugaaaaaauuaaacaggcugcccuucaggaccuguuuaugcauucaguauuuccaacuaucucaagccacaccucuucaaaacuuaaaaugacugacagucgucuucuuuucaaacaacuacuuuauauuuuuugucuucuuucuaugggaggcacauacuaauggugguuucagauacuggcuucaaguccaagcuccaccacuaacuggcuguguagccuuuggcaauugacaaucuaagugccaguuucauuacugcauaauggggacuauaagaggcccuauuuccuagauuuguaugaggacuaaaugaaauuagcaguaucaguucauucuaaucuuucaauaaaugacgucuuauuauuaugccaaaagucaauacccuaauccagagcaauauuauacaaauauaaaaauagagaaauucagaacacucuuaccaauuuggaaggcagacauggagaguugcugcagaaacugucaauuugugaguucaggaacacaacacuuugaaaauacugacuacugaaauuccuaaagagcaccaucuccuagguucagcugcucaaaaaaccagauuccacacccauuuuccaucauuucucuaguuaucuuacuaguguuaugaaagcagaggugggggaaaggcuucugauuaacuguacucuugcccuuucucauccaaauaagccucuaauauuguggauuuaaagaagaauaacccaugaagaaaugcugugaagucagucugagaccacaaggcauggaauacacgugccucuacgcaaacacacauggcuccuccauuguuuuauauugcugaguauuucauucuggguaguuuucuccuccaauuacaauagaaguucuuugaagauaaaaauuauuuacuauacuauuuugaauccccugaagcuaugcaggugcuugguacaggaagauaauucauaugccuguugagagcaagaccugcuucuuccagcaaugaagauguuuuaugcaucccacaaagcuacuugguucuacuucccgccccuaacccaacccacacuucccaacccauggaaagaauauaugacccuuuauccuguaaagcuaacucaaaucaaacacauuauuuuguuuuuggccgggugugguggcucacaccuguaaucccagcacuuugggaagcagaggcaggcagaucauuugaggccaggaguucaagaccaaccuagccaacauggugaaaccccaucuccacuaaaaauacaaaaauuagucaggcaugguggugcaugccucuaaucucagcuacucgggaggcugaggcaggagaaucacuugaacccaguaggcggaggcugcagugagccaagaucacgccacugcacuccagcauggacgacagagagagacuccaucuccaaaaaaaaaaaaaaaaaaaaaaaaucacguuauuuuuaaggacugagcuuugcucaagacuuaauuuaccccacaaccaucugaugaggguaccauacccauaguacagauaaauuuaaaaagaaauacugaacaauuuuuccaaggaauacuugguaaacaaaaacuucaaguacaaaacuauauucauagccuacauccuaacacaccaccgaaaaugugaaaugucgcacucccaaaucuuaaauuaagacuacacugucuagugcagcaaaccaccauggcacacguuuaccuauguaacaaaccugcacauccugcacauguacccuggaacuuaaaggaaaaaaaaauacuacuacacugcaguguuuaaaaacucagagaaaaaguucuuuaaaaugacaacaacguauugugcacuaauauugugugaagaaguguuuuaggcacuaauauggaucaucuauuuaauccuuacaauaaucaucuaaaguuguuaucaugucuaucaucuagagaagcaaacugaggcagugaauaguaagaugcagauucuuuuaguuaccaaucuaaauguuaagaagaaaaaacaucuaaaauuuuucucugguauuucauuuucaguacaguucaacauacagcugucagauauugaggauacagugaugaccaggaccuagucacugcuucaagaaaaggcuuacauguaaauaaauaacacacaguacauuacuauugacuuaauacaugcaaacucaggcugagagaaaggagaaaaaagcaugguuggaaacauggguagggguuaggagcuaaaauaccccaaaaaacauacuaaaaagcuucaaguuuuuccaauaaggaaauaagguuuuaaaugaaggaaaccaauauggauuagacuuaauuuuagaaggaucacacaaaaacacuauaaaacauggcuuggaaguagagugaagcuguaagcaacaaaacuaacagagccuuaaaaauaaaaaaugguuuauaccaucaaacucccagucguaaacaucuaggacuugauucuuucuucacaaaggaaaaugaaugaaacuggcaaaacaauacuaaugguuuaaagccugcuguaaaaguuaacuggugaugauaaccaaagaaaugcaaauaagcaauuuuaagauacuaacauauguuaaacccgcuaaaguagcauuaauguaguagugccauugguacauuccuucauuacugcugguaaaaguugguaaaggguuucugaaaaccaguauagcaacaugcagugagagccacaauaauguucauauucuuugacucaauucuacuucuagaaauuuaucucaguggaauaauuuaagaaacaaagauacauguauaaagauuucacuaaagcaucugacauaaaagcaaauggaaaaauccaacaacagagcaauguugaaauaaaccuauacagcaacaauaaaauaucauugagccuuuuuguuuuuuugagacagggucuugcuaugucacccaggcugcagugcaguggugcaaucacagcucacugcagccucgagcuucugggcucaagcaauccuccugccucagccucccaaaguguugggauuacagaugugggccaccacacccagccucguguaguuauuuaaaaauaauuggaaauaaugcauagaaacugggaggaaauaaauucuuaugacaaaacagaauacaaaauagugucacuacaguuauuagcuaguuaagauacaugcacaugggaguuaaggcacaaaacugaaaauaccugaaauauguagcauuauggguuauuuuaaagcaaaaaacauuaccucaguggaauaacuucugagggaaaugugacaucauuuagguaggauuuucaaauuguacucauauuugguuuagaaucuggagcaguuucuaaauagggugacucuaaaugguucucuugcuacuucaguuacuaaaggguccuugcaggcuggggcuguucauucauacuggacuuuccacagucccuacaacaaugccucuccacacugcaaaaauucaauaaacagcugcucaacaaacaauucaagaguucuuuugggagccacuggaagacguaggcagauaaggaacaaagacaacaggaaaagaggaaagaagacuuugaaaaaacuaaaaggaaaaaggucaagagaaacagugugccaccugaccuucaacauuaaucaaaucucucaaucucucucucucaugucucugucucucucucucucucucucucucucguguguguguguguguguguguauuugcaugaacuucugagucacaugacucaaaguuuaugcaaaccuaaaaacgaugcuacaauuuuaaaaaaugcuacaauuacaagugaacugaagugacaaaaagaaguggaaugauuucuaaaccuguuuucucuucauguugcccucaaaucauccggccuuguucuuuggcuacuuauauauaaggugggucaguugcucaccuuaucccuaucuagaucaagauaaguuugggaaaugagauggaagcagcucagaguauuaagaaagucucugaaaguagcuggcauuugcuuagaaguuagaggugcaaaaucaaagacaucuauacucuuuaaauaaagaugauacaucuucacacaauucaguauauaaccaaggaauaucuuugagaauuggccauauaaugccaucuucugagcuucauguaaauaagaaucaaacacaaaguaagcuaauggaguauaaucuuaaauuuucaaagguauuucauccugcucaauuagcauaaaguuuuaaaaagaaaaccaagucagaugaccuaguguaaaaaaagucuuaagaauucuuaaaaaaaaaaaaaaauucuuuauuuccaaauaugcccuaaaacaacaguacucaaaguaugauucagggacaccuggguccaaaaaccuuucaggggaucugugaagucaaaauuauuuguauaauaguacuaagauguuccuugcccuuuucucuuucauuuccucugacuauauaguggaauuuuccagaggcacaagacaugugauaccacaacagacuaaaggcagucuggucuguaugcgaauacagcucaccuauuaaaccaagcauuaaagagacuuacaaaaaaauauaaagcaaugccacucuucucauuuuucuauuuuuuuuuuuuuaagaggcaaggucucacuauguugcacaggcugaaccugaacuccuggguucaagugauucuccugccucagccuccugaguagcugggacuaccggcgcccgccaccaggcccagcuacuuuuuuguauuuuuaguagagacgggguuucaccguguuagcaggauggucucaaucucuugaacucaugauccgcccgccucagccucccaaagugcugggaauacaggugugagccaccgcgcccggccugauuugacuuuuuaaauuaaacuuguuucaauuaucaauuauuuuuuaucuaacauaaaaauaauuuaacuuuuuugauagcucaggguaaccacuagaaacagcaguuuuuauacuauggaguagaugaaguucaaaguaugauaaauacaccugacuucccaucucagcuagggaaaauacaagauugcaugccuuuaacuugaggugcucuauaacacauccuaggccaggcaagcauguuauguccuacacuugugcuauguuucagauuucagauuuuuucaaauguuaaaacauuacuaauugagcaucucucaucuuaaaguccaaaauguuccaaugagcauauccuuguguaucaugucggcacucuuaaguaucagauuuuggagcacuucagauuuucggacuagggauacucaaccuguacuaacuuucaguccaggucaggaagaaacagcggcaggaaucuuuugcuugcccuuuccuaccauacccaaacauuagucucaaggccacugcauucaucuccccuuuaauuucagucuucuuccaaaauauucagaagaaaauguuuacaaugaaccaacuguuaaagagcuguacaucucuacaacugcaaugcugacuuaaguuaggagaaagccccuccaccuucaacugguacacaaaacuguggcuacuuuacugaauuagauuguauccauccuaucagcucauggacaacaauccagaagagacuuuaaaauguauuuuaacuauucuggccaugaaaagugacccaauucuucacuaauucccaucaaaaugagaaccauguguuauacauccaaaaugcuauaaaccugaacaacauuuacuaaaaugagaucucagaccuauaguuuuaucugcacgcccacauugcuccuaguaacugcugauuuuacagcugagaaaauaaaacuaagaaacuaaguuaacgaggacacacaauguugauaagcacuagcacugggauuuaauccuuuuuuuuuuuuuuuuuuuuuuuuuuuuuuuuuuuuuuuuuuuuuuuuugcuuuaguccaaugcucuuuccaguagaucagaacugccuaacuucaucaaauauuuccacucucagaugggcaaggagccagggggaaggucaggucccaguucccuaacaagaauuucugguacacugcucaguguuucacaaaacuacauuuuaguuccucugacauauucauaauuuuucaagaaaaaauauauucaccuucaacauuuuuuuguuugcaguguucuugccacagucucuccuuagcuguucacucauugcuugcagcucucguccaaaguggaucauucuuucuauggcggccugacuuccuccacacaacuggcgucucaacugacuugaaucaacuucuguaagaaaaacagacaaguauuuuacuaccuuauggaauggaguauaaugaggacacgaacauacauuucuuauaccauuuuguacauuuaguaacuauucccuaauauuucaucuaaauaugcagauuguuaaaaauucauuuuuaauaugaaacugcagcuaaaagauauacuuuauuuagcucucaagagucuaggauccaguauucagcaugcaguugagaggggacaaccuuucaguguuagaggguacuuaugucagaaaaaaauuuuagaaaaaguauaauucccuaaaacuacauuaagcaacauuuaaaaaaaaaaaaaaaaaaaggaaaacuguuaauaaugccacucaggcugccuuaacugacguaguagagauguaauaaaaugcuccugaaagcuaagaaaagcuaaaugacuacaauaaaaauacagaagacagcauauuauacuaacugaaaagauuaaaugcacuacuuuuagaaaaauaccacuuugaaaaaauaauuuuuuuuuuuuuuggauggagucucacacucugucacccaagcuggagugcaguggugugaucccagcucacuggaaccucugccucccagguucaagcaauucuccugccucagccuccugaguagcugggauuacaggcacgcgccaucaugccuggcuaauuuuuguauuuuuuaguagaaaugggguuucaccauauuggucaggcuggucucaaacuccugaccuugugauccgcccaccucggccucccaaagugcugggauuacaggcgugagccaccaugcccagcuaagaaaauaguuuuauauaucuugauugauaaaauaauuuaacuguauaaauuacuuauaagucauuaaaaauaagguaaugacgaugaugaugguuaauauuucccaagcacuuugugcuauuagcuuuuuggauuauucauuuacuuucacaauaacuuaugaggucguuauuauacccauuuuacagaugaagaaacugagacacagagcaguuaaguaauuuuuccaaggucacacagcuaguaaauggcaguuuugcagaaaucaaaucuauguaaucuggcucuagaacuccugcucuuuaucacuguacuuaaauuacucuucagaaacugagguggcugauauugaagaguaaaacaaagcugcauuucuuuuuaaaaaacaauuuuaguaauaccacucaaucucaaaauaauaagaaaucuaacauugccauggaauuccaacaaauaaaugaaaaaauguaauccaacaaauaaauuuucacucuccauuugaugggauaguuugcugaugggacaggcaauuuacuacuuaaguugucuacaaaauaaaauuaugcaugcuaaugugucuuggagccacauaauuuuuuuguugguggugggguuuuuuuuuuuggugagggaggucauacuuaagcaccuacuauauaccagggauaguacuaugcaaagucacacacguuuacguuaaacucauuuaagaaauacugauuagaaauuuguaaaaucaucuaaccauuuggccuuacugacuauacugacauaaauauaagaaguucuaucaucuccaaccuaaaauagccuagaggcucaacaccaguaagucaguacugcugcauuagugacagcgcuaaaccugagccuaagcaguucagcaagaaacacugccuguagcugaaagguaacucuacuuucucuagcagcccacucaaacaagaguuuaagugcuaugcauuacugucaaguccuacagcacauacaucuuuaaaucugguuuaugcucaucagcugugaaucaguacaaguaaaaacauaaccuuguagccaucauuuuuuauuaaaaauguaagaaauaucacugcagacccauuucggugucacaaucuuccauuucguggucauguuuagagcuaccauuuaggaaaccauuggaugaaguuucuccaacuccauuggaguagugaucuguuuccaugucuacaucauuacugaaaacgaaaaaacaaaccuaauuuuagaaauaucauacuugcagcuuaguuuaaaauaaaucacuacugaacuacauagccuacgaauaaacuaauuucauaaggcaacagaaaucugcaaaaaagguauuuaguuaaaucuugaacguauucaaagccaaacaugucgcugacuuuuaacaaauuuguacccccggagguaagggaggaaaaaaaguacauaugcuaaaauguagugguuuuaugacuuuacaucaauauggagaaaucauacuuccacacaauccuauuauuuuucaaauucagaucuguacgucuucguuaaucaacugcugccccaccaacuccccagccagcccucucccccuacccccagcacugauuucuaguauguaaggggaaaaccucacucucaaaacaaauacaucucacuccuggaacccgcuucaccucguuccggaccucauacucaauccacuccuaggcuguuuuuaaauagcauucuggcauuuguccucacuacuuaaaaauauacauucuuucaaggguaacugauaacuuaaaaaaugauugagcuucauucucucaucccuuuucaccacacgacagagagugaacucacaggcuaucuuauuggcuaaaguauugcugaaucuuaacuuuuaaacugauguccuggauaguuuccaguuuucacucauuccacucaaugaauaucuaucugccaauaacuauauuugcacauauuuaagcugucaauguauguccuucagaaccauccgcacucuuauaagcaacaauaaauaucuaaucuuuaggauuuauccuauggaagccuagguaauaauuauacaaucuagaaguaaacacucgaugaaauuuuagguaaugcuuagauaaaaaugacauuucucauuacaaaagcaauauauauucaauuguagaaaaaaaaacacagaugagcaaaaaccacuaugcguaauaccaccagagguaacaaauucuaacaccuugggggugugugugugcaugcauacacuccuguuaguaaaauuguuaagguaaaaaaaaaaaaaacaagagaucuagggaaaagggggauauggcccuacgacuccagagcagacuuacucaaccaggaaagcuuguuuauaaucuuaacaaacuucgaaaauugguaagaaaaaccaaacuuuaagaauaagaaaauccuuaccaucacagcuuucaguggcuuuuuaaaaaauacuaaacuuuuuuuuuuuuuuugauaacucaguuuaguauuuggaaggaacucguucauuuaacacacauuuaagagccucugagguaugaucccuguuaggugcuaaggauauuaugaaacagccucugccuuccuguagcaaacaaccuauaaaaagcuaauuaaguuauuauauuacagaguaauuaugaucaguacuaugauggaaguuaaucacaaaacaugacauauuugaugggauguaaaucaaggaaaacauccuggaagaacugacaucugaacuugaauuuucucagccuggacagaaguuauacuggaggugagggaggguaggaagaagagcauuucagauggugggcgguaucagggaaaaagcacaaguuugcaagucaaauccugaaacgcagccucagcucugcaacuuacuagcuacuaauaauugaccuuaagaaaaaaaagucauuuacuuuucugauaucccgcucuacaucuguaaaaugguuuaaauaguuaauaccaucuuugccuacuucacaguuaggaaagccauuaccaacuacaaaauaacuuauagcuuaaggcaguucaaaguugacuuucuuucccuuuuauacugcagacaaaggaggauguugugucaucagacccuuccguuaagcuugcuucccugaacucagguaauaauagaucuguuuagcaacuuccugcuguagggauaguauucaagagaaaaacucacaaacugacugcaaucuuacccucaaacauuggcaagagccuugaucaaugauaaaguaccaaugcauuuaguauaaagcaugaugaaguacuuaacuuuuuacauuuccaucuauuuuuaaacuauaauauuuugauuuuauauuuuccaauauaucaccucugcugugaaagacgauuuuucugcucuucucauacacuuuugugguucuccauuacaacuuauaucaaucacacacacuauuacuucaguaaauuuuugucacgugugacagacaacccagaaauugagauuaaucucccaauuuucaaauacagauuuuuuuuuacauacaauccuuucugcaaaaucauauuuccauuaagauuccaugcuaaaaguuaggcucucucuccuuuaauaagaaaauguggcacugaugaccauuuccugaaaaugcaauguaaccaacugguuuguuauagaccaaaccaauauuaaauugacccaguccuggaugauuugggcagggugaauucacaauaauuugcuacugcacaguaguauuuaauucaaauaaugucacuucaugaacuuuuagguuucauaaauauuaaaccugaguauaucaagggucauaguacacugacugagauaucaucuuucaaaccucuucaaagugagacacccuaccuagcagaauguuuggugcccaacaaauccucaaaaccauccucacaccaauguuuacuaaaugacuuaaccaucugcuauaugcaagcuacuuaaaggcaggcuuucaaaaaagauuauuuguaaaguuaguuuugaacuuggaaaacauucuacacauuuacaccaaaaaaaacucacacacagagaaaaaaucaguuguaaauuuaucuuaugucaccguucaagguuaaauaugcuacugugucuuaaccacugugaaaacauaacaaauggcauuuaugugaucauuuguauagcucuguggcuggcaggaagacaaugcaugaagcccugaauuuguccuuauaacuuuacuagagggaagaagguaguagagaagaggaagaaacuaaggaaagagcucaugugcauaauaggagacuaaaaagcuuuggggaacugacucccuacgcuuuuauucucugggggcuuaagaacucccagagccccucugugggucacauaauucaaguucuuucaaaauuauuacaacgauuacaccuauaacuagguugcuuauauuagugcaaaagucagugaaauuacuuaccuggugaaguuauuaacuugcugugaucuugacauauuuauacuguuuaguucugguacauucaaguuggaugacugguguuuauuacuauggcaauaugauugaugugcuuuauuugauauuacaccauuacuacaacuuucaaaaccugaagaaaaagauaccacguagaaacagaaacaaacacuaauuuauuaauacgguuguaaacaagucuccauguugauuuuguacuaagacuucuagaacguaggagagucaauggaugauguaaacagguaacuucuuugaaaggauacuaagaauacuuaauugugagaucuuaauuauuaccucaucuaacauuuauugaaggcuuaauuacacaucucauuuaauccucaaaaucccccuaaaauggcaauauuaugaucauccccauuuuacauaugaauacacugaggcucagaauuuauccaagccugaagugacuguaugauauucaagaggaguaguggcuaagaacagacaugggaaucacacuuguuguacagaguggugauguaaauaaacugagaggaaguaaugcagaaaagagaauaaauugaaauaagaaaaagcaaugguguuacuucaugaaaggaaaggagacacuaucugacuuguuuaagaauguuaaauguacaaagauaacaucuugggaaaugcagaauuaaagagaugggcaaacagaagacugagaagcaucagaaauaaaucuguggcugggcacgguagcucacaccuguaagcccagcacuuugggaggcugaggcaggagcagugcuugaggccaggaguuugagaccagcaucagaaacauugcgagacuccaacucuuuaaaaagaaacaaaaacaaaaccaaaaaaaccuguagaagugaugucacaaaagccaagaaaggagagaauuuuaauuaagagaaagcccaaagucacagagaguaagacuggugagccaacaaacggaugggagaaaacgaacuaggcagagcugacuuuugcaagaggcuugguugggaaagguuggggguggggggagaggagggaggcagcggcagcccagcuagaugugguaaccaguggcauaagguaucacagccacaucaccuuuaaauuuauauuuuauuaaaacacacaauuaccuuuucacuauuaaaaaucaauaauuuaauucuggugacuacucauugugaaugcugacuuucauuuaggaaggucugcuaauaaccuauucucagacagcuguucuucaagugacuuccugguacugagaacaugucaaucugaaccuacaauuuuucacccagaaaaaucuuaaguauacacauuugaaaacagcuacaaaggaaauauacagauuuucugagacaaauggagugucccucugucacccaggcuggagugcagugacgugaucucagcucacugcaaccucugccuccaggauucaagcaauucuccugccucagccucccgaguagcugggacuacaggcaccugccaccaugcccagcugauuuuuguauuuuuaguagagaugggguuaucaccauguuggccaggcuggucucgaacuccugaccucgugauccgcccacccuggccucccaaagugcugggauuacaagcgugagccaccgugcccagcuggaaauauacagauuuucaaaaggaaaaagguuuaagauuauaaagaggaaaaaucuaaaaauaaugucauaaguuaaaucucaccugaaaaaugugcggugcuuccuuugccugaugcuaaauuguggauauucauuccauggcuggggcucauacuuggacuacuaaaaggucgaggacuaacaggauaacugucuugagacuuuggacuucggccucccaaacaucguacuucacuaucuguaccauucaccauuucuauaaacugacgcacucuaaaggagaaaagaaaaauuuacuuagacacaaucuucaaauggccuuuuauuuaauagcaacagauuucuaaaaauauuuuuaaaacuuugauuuaucaguaggauuggucuuuaguaagcuaaaaauauuaaauaugguguccuaugcuuuaaugcuuagaauuuuagaauuuccagaaaaaugagaguacaauguaauagacacuauaauaauauuacccccuuuaaucaggauuuaccaaauggaaauuuaccuauaagaagauaugaaccccauuuuuuuggcuacaaguaauuuaaucaaaauaacauuugcgcuugguagcaaaucaaauugugccuaaggacaugauuuuauguauaugagauacauauaaagcguagccuuucuccccacccgucccauucccaaccucuuaaccaaaaugggccucauuuaaaauucuuauucuaaagcaaaacaauucugucauuugacuuacaaaggauaucuguugcuuaacaaguugaaaucugaagcucaguaacaucucauuuuuuaaguaacaaagauucauaaaaccaauuaaaauugucaaaucaggauggcuauuauuaaaaaaaaauaguuaaacauagaauuaccauaugauccagaaaguucacuucuggguauauaaccaaaaaaaucuaaugcagggacucagauauuuguacaccuauguucacagcagaauuauucauaacagccaagagguagaagcaaacuuuaaguguccaucaguggaugaauggauaaacaaaaugcaguauuauccaaacaauggaguaaaauucagccuuuaaaaggaagaaaauucugauacauacuacaauaaagaugaaccuuaaggcuauuacacuaaaauaagccaguaaugaagaauaaauacucugauucuacuuauauggguagucaaauucauagaggcaaaauguagaauggugguuuccaggggcuagggggaugaauggaugguuaguguuuaauagagaguuucaguuugggaagauggagaaguucuggagucggaugguggugaugguugcacaaugaugugaauguaaaaaaugguaaauuuuauguauauuuuaccacaauuuuuuaaaaugccagagagauuaaauguaagguacuucugagaaggaaaaauagacacccaucuucuaaauaagauuuucacauuuuuaaacacauaaauagaauaauaaaagcaaauacauagcaaaagacaccuucugcuuaugguccuuaacacaaaaguauuuuucauaacauguugcuuaaaugacauuacaaaauuguauauacuugaaaaacgaaaaaaacuaaaauuacaaaagcacgaaaaugucuuuuauuacauaacuugacaaauauuuauaauauauaacaaauauagcauuuuauuaugcaaacucacuuuaaugugaaaaggagauuaggauuucuuucaaguaaacuuggguauaacuguuguguuguuucaauggcuucucccauucuuccugcuaauaccaauuucugaauuccuauucaguaaaagaaagcaaacgauuaacuuuuacaaaaguagauaaaacauaaacuuagugaccucagaaaagaaaguuaguaagaaaucuuuaaauaaauuaugauuaauuucaauuucuuucucuaacaucauaguuuccauuaggcaauccaggaaacauuucagacauacuagaaaauuagaaaaacaaguacggucacaaauuuuuuuuuuaaaaucacgaacauacgaguaauauaguuaaaauaccuauuaugcaauauugaaguuucaaacacugagauuaaaaagacuguuuuaaagggauacuaaaaugccuuaucaaacauaaucuucugaacaaaggacugaaaaaugcuagcuuuugacuaagauuccaauuuaacagagacucguugagcauucacuugaucuguuauauguuaaauuagaugauaaggauacaaaaugaguaagugaucucuguucaacagagcuuauuaaaauaguagaaaaggacagcacacaauuaacuacaacccaauguaaucagugcuauuacagcaauuugaccuaugaaauaguuguuuucacccauuaauuucacccaucuauuuuguuuucaucucuauacucuugucaagucauacccacccugauggacaaacagcaccaauuuuaggauggcuaacuauggaccaguuaugcugacuugccauuguuauacaggaccuguuuuaucucuggccacagaggccagcacuaggaucuaaauaauaaauacuuauggaucaauacuguauuagccauuuaaauucaaagauauuuacauuucuuucacauacuaucuccuccaacuaaucaggacuacuuuauuauuauuuuuaaaucuuuuuauuaaauguuuauuuccugaaagcuuaagaaaacauuuaagaaaaaaaugguaaagacauuccuucaaaaaacuucuguaaaaucucucuagaauuagaauucugacauaguccuaugugaauuuuuaaacugaucuucaaaaaugucagugaaaauaaaauucagaggcauccauuuuaaauuaauauauuugaaauuuuuuuaauuaaaaaaacaaaauuucuaaaaauuaaaguaaccaaaucuauaaucugaaaacaaauguuagccaugcaccacaguguccuuacuuugucuauucuuaauggaagcuaauucuucuagaacggucuggucuguagaucuggcaaaggccucugcuguggcacaguacccaugguggacuaaauaagaugaaaccauucuuaaaauaaaaagaagaaacauacaucuuuuagugaagagaauacaugcuucauacuacaauuuauauaaacaaaaucuauucugguguuauaaaaacgaaccuauuuccuugaaacaaggcguuaagaaccucaccuuuaaaguaagcuuuugaaaaacaucauuuuguucuauucauguacuauuuucgaaaagauaacugcaaaugcuauguugagacuacucucccuaaaauaaauauuacuugagaaucaaggacauuaaaugaccuuuucuuugauucuuggacucucauuacccccaggucccuuccuaucuuauuauucagcccuacuaaccauaauuucuauuuugacuuuaucauaugacuuauuccaguauugcuggcauucuguaaaauaaccaacuuuaaaauaaaagauuaacucuuaauguuccagaguucaaccaucuucuuuacacaccgguuaaaugaagugggaucacaaaguauguacagaauacuaaggugaauccagagagacaaucuuccagaacaugucuauaaguguacuacuaauuaaaggaggaaucagccuucuaaucuaaaucaauuacuaugguuuuacccaagagauuuaucaaauaugguuuacauguaagugacacauuuccaagacaauaaucuuuuaaaaacguaccagguagucaaaacauauacuuacaucuacccacaagaugugguuagaaaaacuggugaugcaacaauauuaacccaaauaucuguuaucuccaaacagucaauuuuuaaacuugccuccaccugacacuacuaagggccaguuagaaaaucgugggaagcagugguucaccacaggaggagacugaggcaaagagcggagggagaaaagggaggaaaaugucuaagaaacagaucugcaucuuauuuuacccaauuguucaaauuaauuuaagggggaggggaccuuuuagaauggacuucucaagaguucauggugaacaucaagucagugaagaaguggguggaaggauccugguuauaagguuaagauaaauguuuucuacuaucuugccaugauacucagugguaaccauuuucagagcauuaaaacaguguggccccagaacaacccauucuagcuucacuucguggugacuauaggauucugcaucaggguugucuauucucaacugggcuggacaaaaaaacuaguguccaaucucuguaauacagaugauaauagcuccagggacgaagugugauuucagagucaucaucaugucucccaaucacuuccuuuucuaaaaaauacccccaacauuuuauuacaauuuuaaaguuaagaauauucaaagcaauuauaaggacauuaaagaugaaauguguuggaccaacuguaucugaaagucugcuauuuucuugaccuggauuauaauagugaagaggacuuuuuaaauuuaaugguauuuauuuaaauuuuaaguccauacuuaacuacugcugauaguucagauauuaagagcuuggacauagccaaguucaugaccaaaaaccacagauccugauuauaagaucuagauuaucucucaacuuuaucuuuuccauuaacauuauuaaaaguuaaauuguauaaccuacagaaaucauuaaauccuauuacuaagaauagcaaaugaauuaaccuagccuaggugaccuaacaucauuuuauuuccuucaucaaauuaauucagacugaaauacaauucuguacgugugucaaacaauuguuuuuaauuuguuuaaauaguggaguaaauuacuuuucguugagagauuaaaaucaauaauauaauagauaugucaguauauaaauuaguggauuaaaaagcuucuguggauaccaacagaauaaaugucuuauaaaaaacagauucugaauagcaucaauugaaauuucuucacucuuacuuuuguaucauggucugccauucuccuucucgaucuccgauaggaaaucgaucuaucugugccuggauuuugguucuccacucccgcauauagucuucuauaucaaacacgaaaggauguugcccaaaauuggcaucgaccacuucuccugguguuugaagccccacaguaggauacaaauuuggcuguaagauagcauauuucauuaaacaucuauccauuuuauguuagauuuaauaauucuuuuaauguuacauuuaaaagaauagaacuauaaauuuacuucauauuuuaaaaucccaaucaaaauauuagaaggcuaaaacaaaugaucuaaaauacauuauauguuagaugaaaaaauaucacuuccugcaauguaaucaucaagaaaaaacaaagagacccaagaucucuguuuuauuuauucagggacuacguuguauuauaccacgugguauuaugcuacuaauauaugugcauguaauucuuguucuaagauuaugucauauaguaguuacagaaauucaacuauaaacacauaacucagguuuaucccacauuuuauauaugauacauuucuauaaacugcauguuaaagcuaguuaucauaaaaguaugaucucagcuagucuggcauuuaauagcuuaaauuuacuguuuucauucuguauauuugggaugccuaacuuuacaaagggaaggggauaagaccauaacuauaagcaaaacacagugccaggaagaguggagauucucuauauuaaaaaaaaaacacaaaaccucaaauauauguauuucaagggaggaaaaggaugaaucugaauauacccaaacucagaaaugcauucagguacacuccaugguuucaagguuaaucaagaugaaaaggugauaacuucaaguaaacaaaaaauacaggggucauucuuuuggcuaugucacuaauugguuguuacaucuaaaggcagaaugaguuucugaguggcuacuaaaugccaggguuuaaucauaauucugugaggccacuauuauuauuucuacuucaaagacagagaaaaugaggauucaagguuaaauaacuugcucauggucguucugcuaacaaauggcagagauggaauuggaacacaaguuugucugauaccacauccaaaacugauuuuuccucuugcaacuccaaauccuaccauauuuucauuuucuguauuuaugucuuauaucuuuaauaguuauaacaaguauuuuucaguacaaaacaagguaaagaucaagagcggauaauuucugugugaauauguuaaauagauuucacaguaaaaugcaaagaggguguguuuaaaaacaaccguucaaucaagcagaacaaaucagaaacaaaauauuacaucaaaauaucaaaaauauaaaguacuacuggauuauggaaauaaaugguuaaagcaaaguaugcaaauguauugauucuuaauaaucaacagagcuaacaaguuuauaaacuuuuaagccaaaaacaggugagauaguacagccuucccauuucaccaaugagaaaacugagaccuaaagacuuuauagaaacaggccaggcaugguggcucacgccuguaaucccagcacuuugggaggcuggggcagguagaucaccucaggucaggaguacaagaccagccugaccaacauggugaaaccccgccucuacuaaaaauacaaaauuagcugggugugguggcgcaugccuguaaucccagcuacucgggaggcugaggaaggauaaucgcuugaaccggggauggggagguucuggugagccgagauugugccacugcauuccagccugggcaacaagagugaaacucugucuuaaaaacacaaaaacagaaacaaaacaaaacaaaaaaacagaaaaaacacuacagaguuaugagauacuuuaacacaaaagcauauaagccaaacacaauugagugaaagacaauucuguucauuaagcaguuuauaaugaugauauucaguauugucuaaauaaagacauuuuuaaaaugacugcucaucuaaauuuucuuacaaauucagaaaaaauaauucuaucaacacuaucaaagacaaucaacauucaugaauucucugauaaaacuauuucauaaaaauuuaaaacuucccuaugacaaaacaugccacaaauggcaaagacaaaugacucucuagaaaaaaaaaucugccacacauauggcaaaauguguuuuacaaauacagaaaaaauucaggaggacaaagacuaccaguucaaauucuuaaaaaaggcaaugaauauguaggcaauuuguagaagaaauaaaaaugacaacacauaaagagaagcuuaaucacacucaacuuuuuagaugaacauuuuuaaugcgcacuuaaaaauaaaaucaauuaaaaguucaagauuuaaaaacuuuugcacaucagauuaagacuugaaaggcugagaauacccaaugcugauaaggguuggggaaauaacccuuucaucuacuguacacagaaauguaaacugacauaaucuuuuaacaaagaaaucuggaaaaaucuauuaaaauugaccaaguaauuucacuuggaagaguguauuccuacaaaaauaaguaugugcaaagauaugucuuguagcauuauuuguaacacaaacaaaauuuuaaaauauucacagauaugugauauuauaccauauucaucaagucucaaaaucuaauaguaacaaacaucacuauuuugugucuaggaaaacauaaugcaaauuaaacucugaccagucauugauucuacagugcauucucauuucagaaauacuaaaauaugaaaaaaauguacauuuuauaauugaucaauugugguaguaaguuaauaagauaacauaaagcaggcaaaaagaacagaaugaaaaauguauauauggacacagaaagauguccuauacacacuaaagcaagguauaacauauuguauaugguaugacccuaucuuucacauaaacauucaaaaaaugaacauacuggcuuauauguguuuagaaagaagucuaaaaggauauauauucaaguuaaaacaaacauuauagccaaagagacugggauuaugaagaacuucucuuuuguacauuucuguauauauaaacauuucucauuuaaguauuuaauacuauacauuacuucuguaaucugauauugauuaaaaaaacuuuuaguaauauuaagucaguuuuggcucacugaaaaguaaguauaauuguuauaccauuuacucaaccuuaaaacuggagaauugggagaagaggauuaaggacauaguccuuaacuugcuauauuacagauuuuaaaaaacaacggccuucaauguuuuuuaguauguucacagaacugugcaacuacuguaauuuaauuguguaacaaucccaucaccccagagagaaacucaguacccaucagcagccacuucccauuuccccguucccccuggcaaccacuaaucuacuuucuaacucuauggaucugcccauucuggacauuuugcauaaauggaacaacaaaauaugugaucuuauaugacugguuuuuuuuuuuuuuuuuuuuuuuuuugagacggagucucacucugccgcccaggcugaagugcaguggcauaaucucgguucacugcaaccucuaacucccaaguucaagcaauucuccugccucagccucccgaguaugggacuacagccacaugccaccacuccuggcuaauuuuuguauuuuuaguagagacgggguuucaccauguuggccaggauagucuugaucucuugauccgcccgccuuggccucccaaagugcuagaauuacaggcgugagccaccgcacccagauggcuggcuucuuuuauuuagcauguuuucaagguucauccaugcagcaggugcauugucacuguagauuuauauguaauaaugucuucuagaaaaauacuccugcccauguagaauaguauauagacagaauagguucuuuaugaaaagaauaggaaaacauuucuauuaacuugcaaaacauacuuucaaucuagaaauugcuuaaaagcuaaauguacacaauauaaauuuauauucucaauagcacagcuuuggucuacauucgaucucuuuuaauaaaaaugacuauacaaauaauguauccacaaaaaguagauuucaagucagugcccagaauucgaaaacagcaucauuuaaaaugagaacagcuacuguaacaaaagccuuuaaaaagcaacagccuucaauguuuuuuaguauguucacagaacugugcaacuaucauaauuuaauuguauaauuaaaucccaaacugaauuaguuauacuuaaugucauuucucaaacuggugagguaagcugaggaaaaaagacuauuuugaaaaaaaucuaagguuuucaaagcuguauaaacacuuauauuccauaacaggugcagaacaaucuagguaaacugguuuuucugcaaauauacuuucucucaggauucaaugguauggguagcuugugagagaucacagguauagaagauauaaacacuuccuugaugcuuccuuuaaaaggaagaauugauaugaagccuauggaagucccagaagauuuacaguauuaaaaaugaaaaauacuacacuaaaaggaaaccuaaaaccaccacuguacccauuguuacaacaaaguugcacaugaucauuggcuaccugagggaaaaaacauaacuggugauucaaaagugggagagaaaauaaacaacaugucuacaagcaaccaagcuuuuuccaaaugaucuccgcuaucuaugaacaagaaaacgaaagcuaacaacaacaaaagcucacgcugacuaguugcuuagugccacaacagaaaaaaaaaaaaaaaaaaaagucacuaaacucuuuaaccaacuccaaaugaaacuuacagcauucucaccagucucuuaacuguuaaagaccaaaucaacccacuaaccagaaucugcaccuacacacucugccuguccccacaaugcucuucucaaaagcccauccccucaauuacacaucugucuaccucuuucuaugcgacaccgacauuuucaucagcauacucaaucuccuaacuuaauuuuuuuuucuacugcccccacuuccaccacuggcuacuacuccauuucuuuacuccucaccauggccaaaguccuccagaguuauccacugccuauaacucaccuauuccuaaaauccauuccaaucaggaugucuccaucccacagcugaaacuuucuuguccaggucaccaacgaccucuacucugcuaaguacaauugucaauucucagaccuuauguaauuuucagauccaauccauuagccaauucucuugguuuucaguuggauuuuuaaaagaaucauauuuuuguuacuauuauuuugggauuuuuaaaaauuuaacucuuuaauccaucuagaacuuacuuuacacuuuguccuaacaauauguauuuuaaaaaaauaaauaauaaagacucauuccaucacuauuuacuaaauaaugcggcaggguuuuuuguuguuguuguguuuuuuuguuuuuuuuuuuuuuaguagaggugagaucucauuauauugcccaaagugguguugaacuccuggccucaagcaguccucccaccucagacacccagagccaaauaaugcuucuugaagaguacuuuugaucgguaggguucaaauauuccuuggcuuaaaauuauuuucuauuauaauuuugauuucuguuuuuuccuagcauuuuauuaagggauauaaauagucuauagauuugguaucuauucucuaccucugaaucuuccaucaucucuuucaaaacaucucugaaaacuggaaugcauuuuauaauugaugacaccuuacuauggucaggcagcugucaugacacagcugucaaugccugcacaggagcgauuuguuaaagaaugagcucacugaaaaacucuugggacugaguugcuuuuccugaugaaauuuucauuuucgugauauugguuaacaucaugaaagugacaguaucaaacgugcacgauguaaucagcagcuuggagauuaaucccagagacauaauaagaguaaucuuaaaaaauguucuugaugacggagaagacaguaucacauagaaaaucaugggcaucagccucggcaaccuggcgaaaccccgucucuaccaaaaauacaaaaaaucagucgggcaugcuggcgugcaccuguggucccagcuacuugggagucugagguaggaggaucccuugagccugggaagcagagguugcagugagccaagaucacaccacugcacuccaaccugggugacagagugagaucaaagaaaaucauggcauccagucuuuaaaaaacugauuuaaaagguuagacucugaacaugaaauuuuaggaauaccuuaaucaauuuauauugcuuaucucauccuuuuuaggugugcaacaccuaaaaagagacacauauuaaaaucuaaguuuaaauaacccuaagagaucauucagugaguauaaaauaaaaaugcuaagugauaagggaggcauuaugucacaguuuguuaguuuuuuucccccuuggugucacagaugaugcagauuacaacugacagugccuuggguuugguaaauaagauacguggaaucaaaccucuaccgaagagaguuacuguaaccccuugcuugaauuucugcaauagucuucucacagguccccuugcuucuacccuuacucccauauaguuuuuuguuguuguuguuguuuuguuuuuuuguuuuuuuuuugagacagaggcuugcucugucacccaggcuggagugcaguggcacaaucuuggcucacugcaagcuccgccuccuggguucacgccauucuccugccucagccuccugaguagcugggacuacaggcgcccaccaccacgcccagcuaauuuuuuguauuuuuuuuuuuaguagagacggggguucaccguguuggccaggauggucucgaucuccugaccucgugauccgcccaccucggccucccuaagugcugggauuacaggugugagccaccaugcccggccuagucuacuuuucaacuaagcaaucacagugaucccauaaaaacugaaguccuaucaugacaaauaaaaguccacaaugucuuuguauuucacucagaguaaauuuccaagcccucccaauggcuugcccaggucuagaugaucuauuaauagcuuacccccaaccccauuauuaucucugaucaucugcuacuacauaugcucugcccuccucacuccucucuaccacacuucacacucuucuucaaacaagccaucugugcuccugccugagcaccuuuucucuaaccucccucugccugaaaacucuugcucuacauauccacuuggcagacucccucacuccuccaaaagcuucagcucaagucucaccuugagcaaaggggagcaacuuguacaaccuuguguccuaccguugguauucccauucucuguuuuuucccuuucuuuccaaaguauacuuaacacccuuaaaauauguucuacuuuacuuguuuuucauguacugcucauucucuuucacagcuugaauacuauaaaguccaagagggcagagaccuuuacuaccuguugaauaauauauuccaagcacuuuaccugccacauaguaggccucuauauagcuuggaugaauaaacgauuauaacugcuauacagccuucugcugaaaaguccaaggaaauacauuucaaaugaaugaauggugacauuuaaaaagacacuugagaaucaauucugauuuauuuuccuuuauacaaugaauccagugcaaguuggagcuuaauuucugagggucuacacccaaggugguuagagaaaagaucucuuucuuugcaugucauauaaaccuaauaaauaucaauaagacuguauuuuaaacuuucuaaauaugcccaguaucaguuucuuuauacuuccuguaauuaaaaauggaaaacugcuuuuaaaaaaagucuuaccgguaggucagugaaagcaauaccuaaaaagaaaaaaaaaaguggcauuagaagcuguuuuucaaagcagacuauacugacaagcugaauuucuaacuaaaaggaggaaacaaauggcaaaagaaaaaaacauuaaagccuaaauaaaaaauaacaagacuaauuuuuaaucaauaauacuaacauaugucugagugaacaaacgcuguccccuuucaagauaaucagccuugcuagucauacacaaauuuuauuucugagaugcugccauugucuccaggauuuuugaaauacuuuuagauauaucuucaaagcuacauuagaaaacacauuaagaaaguugguugcaaaauagucaguuuauuuuuuaaccccaaguugcaauuuguacccucaccguuuaauaaucaucaucuagauuuagcuuuuaaauaauuuuagcuggaaagaaaagaguuuuucuguuauaaaaggcaaacaagggaaaauacaguauauuuuugcuucuuuaaaaaauguuucuuaugaaaguaaauucuuuaacuuaugauuuacucgugggaaaaaucaauuccuccuucaaaggaugaacgauuuugcacaguuuagaauuucucuugaauaccuuuugacaguaauuacaacagucauguucuagauacaacuugagcaauggcaauaucauuggaauaagucuacugucaacucaacgugacaauuuaacgaccuccuuuaaauauuccaauauacaacuuagcugaaaauaauaaaguauuucuguagauauauuuuuaaagauuuagcucuagaauaaugggagagcaguauuggugagucagucagcugaucucaauucuuccagucuaaaacaaacauuaaaaccaagccagcaccacugcuucuacagucuugaucacuaucuuaaaacugagggaauuuccauuaaauuguuuuuaaggucucuuccuacuugacauuuuauuccucuaugacugugcuguaauaacagaaaacaucuaacucuauuuauuaauaaaguuaaaagacaaacugaaaauaaauuuuauacuuuuaaaauaauguguaaaauuaaugcuuuuguaguuaguaaagcccuguuuuuaugauuuuuaaaaacuaguaaauucaugguggcuuguuaaaaggaaagcaaaguuaggguuccuguuuuccccacguaaaacauuaucauuacauuuaacuucauuaauaacacagaaagcaaguacuaucagcccaaauaaaaaacuuucccaaaaauuucacaaaaguaaaaagaauacagaaagcaagagaauauuuuaauauacuauaaacuauacauauuucuaauauuuuucauaaaauaauuuuucucaaagaugucuaguuauaaucaacacuguauauucuaucuuuagcaaaaauccuuugucuguaauuacugaaaucuucacuuuaccaaaaacucuaacgaaaaauucaaaauuaauuccaaagguuaacauuuuuuaacacagccaaauauaguuaccacaacauguuuuugcucaaucagaccacgaaaagaugccacuuuaacaagauggcauaacuauuugaauuuuacacagaaagcaauuuucuauauucauaauuuccugauuugucaggcuuuuugaaaagugaucuucaauuggugaacgauauucaauaaaacaaaguaaaaaauuaucaaauuacauuaaccuauauacugcaaaguuucucuuauuuucucaaauaaaaccuuucuauuuuuccuuauauaguaaacaaauauacauucugaaaaucuuccaugagacagaaacuaaagauguaucaaguuuugggcacagauuauccacuuaggaaguauaagggaauaguaacuaaauauuuaacaguauuuuaucuuggaagaugccagaaccuagaccagagguaggcaaagcuuuccuaugaaggacuacuaauauguucugcuuuccaggccauauggucuuuaucacaaauauccaacucugccacuguaacaggaaagcaaccauaaacaauauuuaaguagguguggcugguugcuaaugaaauuuuauuuuaaaauaaacaggaggcuaacuuggccauagcuuguagacuccuguucuagagaaguaauuucugcucaucaaugguuuaccaguggaucccaggaaccuagcucaggggcugacaaacaaugauacuaaauaacauuuaaugguuauucacuagaugccagaacugugcacauacuauugcaguuuagucuaaccaccuuagugagauagguauuacagugauccuacuugacaaacuaagaaaacugaggcacagaaauguuaaguaauuuacauaugguuaccuggcauaggccgggagucaaucccaggcaagucugacuaaagaacucuuacuaaccacuguuauaccaucucucuaugugcuuaauacucauuaaauuuaagaaugaauaaugccaaacauucagguuuacuuaaaauuaaaauguaggcugggcacaguggcucacgccuguaaugccagcacuuuggaaggcugaggcggguguaucacuugaggucagagguucaagaccagccuagacaacauggugaaaccccaucucuacuaaaaauacaaaaauuagcugggggugauggcgugccuauaaucccagcuauucaggaggcuggggaaggagaauugcuugaaacuaggaggcagagguucugagccgagaucacaucacuguacuccugccuuggcgacagaaggacauuccgucucaaaaauuaaauaaauaaaauaaacaaaaaauaaaaauuuauaaugugacuccauuauuaggugcaccuuuuuaaagacacaucuuacauuuuaaaaauagcuuucuuagccaagagaaaaauuuaauuuaaauauuugugaaaauagggaaaaaauaaaaucauuaucaccugugauugucuuaucucccaaaaugaaauuucuucucuggaaaguuuaaaaaguuuauguuaaagagauugugguuuuuucaaaauguauuuuuugguuuuugagccaaaggucacaccuaaaagcagauuucuccggauucaaaacuuccaacaucuuaagcagucaagccaacuaagauuauaugaacagucagaauaguaacaacaaauaaauucaagaggccuguauuguucuuggaaaccagguggccacaacaaugaaaccacacacaaauauacauaauuugcaugggguccuuaacauuauuguacuagugagaaaaggaucucuuguggacuugagaaaaacuuuuaagucagauaauacagaaggacuucagaauuaaaaaucaguaaucagaaauagaaaugcuaagcugaauaugaaaaaaguuaacuuuauugaaacacucuuaaaagaguauugccaaugcagccagaaauucagaauuuucuuuuauacuaugaaauaacagaaaaaacagcuuuuguguuaaagaacaucuauuauaugucuaagcauacuacuuuaagucuaauuucuaaauacuauuuguaaauaguuucugccuucuaggguuacucaguuuaugcuuccuuucauuuuaccucauuaaaaauaauuugcuuugagucaaagauuuuuccagcaguaaaaggugaaaucuuuuuuuauaaaacaaaaagcaucaguguuauuauccuuuauauuuucuauaguuuaaaaaaaaaaacuucuaagaaaauggaauauaaugaccacauauaacuuuaaauuugaagugcuaugaguacaugaauaguccacugaaaaucuuaacuuacuauuagucuuacaauguauggguuucaaguuuuccauaaccuauuuuauuuucagaaguuuuuuauucucaguuuugucacuguuugcuuguuuaauucugcuuccuuccauagaacaaacuuguaguuaccaacuuagccaucuuuguuagcagaucugaccuuugaguguguugaugcccuucauaugcuuguggcaucaagcuuucccuuccuuuguuacuauuccccacacuauccuaacaacugacugccccuuuuucuuagcaccuguuacccagagaauuagauuauacuguguagcguuuuauuuaaaguagaaaacucuuggcauuucuauuucuagaauaaguaucucaguguggggauuauuucuacaguaacuccuauacauauauguauuauauagauggccuucacagaauauaaauagggugaauauaaauauucaccauuuccucagcuucugucugggaaaaagaaagaaaccauuuccagaggcauccaucuauaaaggagaaucacauaauaaauacaacuaccauccuggaaguauaauaaucuccauauuugguuauuuugcaugcaauauauuaucucaguaccuaaacuauguccauucuugguguaaaagcagguauuguugauaagauuaacacaacagccaaugacaucaccaguagugaaaguugguccauaagguuguccaguuccagaagaacaaaacgaauguccaucauccccaugguaaccauaugaaugcuuaucccaaccuaaggagaaaguuccggcauauuuacaaugaaaaguaagguuccucuguacuagguuuauucacuaagauuaugauaaaucagaacaguacaagauaauauaaagaugaaauucccaauguacauuuaaauucucaacaauuacacuacauaauuuauucuauauuaaaauacaguuuacaaauuuaagaaaaauagcuacacagaacacuaaaacaaauauuaaacagagagaacccccuaccagaaaaaacaaacauaaaugcaacaaccacaggaggacacauuuucugugcauauuccguuugcuaauacaccaaaauaauuuuguuuugauuuaaagaaacacauacacguuuuauauaacauaagagauuacauccuauucaaucacugcaaguuucucaagacugugauccaaauauaaaagccaaacaggguguggucuuaccacacuacagauauguuuauaucaucauuaagagauuuuuaccuuaucaguuacuucuauaaggaguuuucaaauaauaaaaaccucaauuaaacccucuuucaaguauaauuuuaagcaaaaggguacaaaacaaagcaugucaagguaacauaugugauuacaaucagaugcaacuacauugucuugguuuguuucuuuaagguacuucauguaguuugacauugacaguuuugccuuguacuucaaaaagucucgccaaaauuaauuuuuaauuuuagcaaagagaguauuagaagacauaauccaagaaucacuuccuucucauaagugguacugggaaacaggucuggaucucaauucaucucuuccuuaguuuacuuuaaguauuagucgauauucccugaauauuaagauggguuaaaagucaaaaaugugauggguagccaauauaacuagccacauuaaaauauuuaaaguagcugauauuacuauguacuaaaacuuaaaaauauaaaaauacaaaaaaaagcaugauauauauacuauauguuuuacuaaauagugugaaauuuaaauuuauuaaaaaccgcucagcaggcugggcaugguggcucacgccuguaauccuaacaguuugggaggccgaggcagguggaucaccugaggucaggggcucgagaccagccuggccaaaauggcaaaaccccaucucuacuaaaaauacaaaaauuagccgggccugguggcgcaugccugugaucccagcuacuugggaggcugagggcaggaaaaccgcuugaucccaggaggcagagguugcagugggccaaaacugcgccacugcccuccaaccugggugacacagugagacucugucucaaaaacaaaacaaaacaaaaaaaccccacucagcuuucacuuaaaauucauaaugaugauuaaaaacacagaaaaucaguaucuuuaaauauuacaauuucuuacuugaaaaauuuaaccagaaagagcuacucauaagacauaauacuguaauucaauuacaaguguaccugguagucuauucauguucacaccuugagcagaaagaccaauucccauguaacuguuggcggagguugggggagagaagaaaaggacauuauuacagucauauauguauaaauuaccaaacagucucaaacaauaucagaaccaagcccaaguuggaacuccuaagguagcaacaaaaauuuuauuacaauuuauuauguaacaacaacgggcaauauuaaguaccaguaauacucagacuucacagcaaacucauaugguaauaauucauaaauacacacaaagcauuaauauacagcuaugcacucuacugacaccuauaaaaaaucucgccaacuuauuuacagauaaauguuugggauuaagauuucucacaaaaaaagcacagagggauugcagaaggaaaaaaaauguuaaggaaacaaauguguuucccaagggacacaguacaaauuuagaccccacacacacacacauacacacacacacacacacacacacacacacacacacacggaaauauggauucauauuuggaaaaaauuucaaacucacauaaaaauaucuuaauaaaauuaccccaagguauguauuuucuauacuagcuuucuaaaacugagcaaacugacaaaaucuaccuaaacagaggguucuuuauuaucaauuuauaaaguuagaacaaaacagucuccacacaauacacaagggaagauuauuaagguauucaauuauuuuucaagugcuuauaaaacauuaacaacaaaaccugauaaauauaguucaaaggaagaaaacauaacacaauacacuuguaaguauuaacacaaaaggaaaaacaaaauaaaaagcaaacugaauccaguuuguuaaaaggcuaauugcccauuauuguuaucaagguuuuaaauggcauuugauaaaauucggccaccauuccuaauaagaacuccaauaaaauaagaauaaaaggaaauuauuuaacuaugagacuuuucccccaaauacagcaagcaagauauucaacaguaaaacacacugaaggcauuuccacuaaaaucaagaacaaagagaugccuauaauuguuaaauacuguuuuaggggcuuuagaaagcuuaauaaaauaagaaaacuaaaugacuagcauaaauguuaaaagauauaaaaguaccuuuauuuguaguugguaugauuauauacauagaaaaccacagaaucuaccaaaaccuuuuauaauuauuuaggcauucuggcaaagugacuacauguaagaggaacauuuuaauauuucuucuaguauagccagcuggacagccacaauaacuacagaaaacauaaaacaggaauaagguucucaaggaaggcucaaaauuacauauuaaaagcuguauauaaauggauauaguuaacuucuggauaacuggagagcauaaaaauggcaaucuuucagauaggcacagaggcucacaccuggaaucccagcacuuucagagacugaagcaggaggaucuuuugagcccaagaauucaagaccagccugggcaacauugggaaaccuugucucaaaaaaaaacaaaaccaucaguugugugcgguggugcacaccugugguccuagcuaugugggggacugaggugggaggacugcuugaccccaggagguugaggcugcagugagacaugaaugaucacaccacugcacuccacccugagugauagaccaggacucuugucacucaggcuggagggcaaaaacaaaaaaaggaggacaaccuuucuaaaaugauguagacacacauuuauacauuucaagacauauuccaacagaaguuuuaaaacugagcaaaauuauuucaaaguucauauguaaaaauauauaauuuugaucaagacaaaauuuuaaaaaagaaaacucagaguuuucccuacuagaaauuaaaacucagauucacaagagcaauauuacuacuaugagcauaugccaagugagacaagagugacaaaacauuaagaaacaacacauagaugucuagucaagaaggcucauuaaguuuguauuuugauucagccccuuugcuagaaguacaauauaaaauguuaaguauuacuuuuuauuuagaaaggcuaagucacaagaagaugagaagaaacacaaggcugugaauggggauauaagcuguggaccugcaaagcucugagucuaugagcacucaauaguggcucaaaguucccccuccucuggguaaacaaggacuaaaaauguuccauaagaggaguauuagcuaugcuuacugcuuaaagccaaaggcuggaauagccuucuccucuugaaaggaagcuaagaauauacugauauccccuguugccuaagcuagagcuuauuugacauugugguguaguuaaggggaaagagagaggagaaaccucuuaaccaggaucuaaaccaguuaguuauugaauggauccaugacagaaccugcaauacucucaauaucaugcugaagcaagaacccggaaacucuaauacaaaccuaguuuuggauugggaggaaugaauugaaaaucaaguaaaaacuguaagaaagaaaauaagcauagaaaaagacagaugggcaaaaugaagaaaaauguuaaacuucccaaucaaaauaaggcugcaaggacaaaauucuaaaauauaauaucaacaaaugugacacaacaggcaugugggaaaaaaaaugagaaaaaaagagaaagaccaauaaaauaaauggcuggaacaugaauucauucuagaugauaucacccaauggauaguaugauuuuaaaaaaacauaaaaauaaguauauuuaggaauauacuaaaagaaaaaaacauaaucacuaagauauaaggacagugguguaccaauauuugcugagauaauuuagauaguaauuuuccagaauugaaaaacauguuguugaacugaaaauacacacuacauacugaggaagauaaaaauuaagucacacauaagacacacuguagaauaucaaucacgggcauaaucuuaaaagcuaccagaaagaaaagcagauuaccuagcaagaaauggcaauuagacugacuucagacuucuccccagcaacaacugaugacgaaaaacaauggcacaauauguucaaaguauugaaaguaaaguaacugucuaccuagaacuuaggucccagguaaugcagcaagaaugagggaaaaaauaagauauuuuaagacacauaaaagcuaaugguuuacuauacacagacugucacaaaagaacuaucugacgacauacuuuagcagcagggagacaagugaaaauagaagaaaagcauggacaaggaaacaaucagcacagaaaaugacaaaauauaucacuaaaagucauuaucaauuuaaaaaauacuauucagaguuuuaaaaucuaucauccauacauaaugugcuagaacacaauuacccgacauacaaaggaacaaaaaauauccaugcucaaaagaaagcacaaacagggaauggcccugagacaauccagaugugagaauuagcagacaaaaaaauuuaaaccagguacuguuacaaugcacaagauguagggagaaauacucuugcuuugaaugaaaagaaauuccagaaaagaaaaagaaucaauaaaaagggacuacuauggucugaaugcgugugucccccaaaauucuuauguugaaacccggucccuaauauggugguauuaugagauggggccucugggaggucaugaaggcuccacccucaggaaugggauuuuugcccuaauaaaagaggcgugagaaggcuuguuugccccuucugccauguaaggacacauagguguuuucuaugaagcagagaguucucaccagaaacugaaucugcuggaaccuuuuaaacuugggcuuucaagccuccagaacugugagcaauaaauguaugcuguuuauacaauaaauuacccggccuaagguguuuuguuacugcagcccaaacaaaaacaagaaccaaacagaaauucuggagcugaaaacuguaugaaauaaaucuuuacugauguacuuaauggcagacugaagauggcaaaacaaauaguaacaugaaaacagaccuuaucugaaggacagagaaaaaaagguagggguauggggggaaagaguccuuggaacaguaucaaaauacauauaaccaaucccaaggaaaaagagaauaggacagaaaagaaauugaaaauaauuccccaaauuugguaaaagacaaaaacguauagauucaagaagcucagcaaacauuaauuaaauaaaaagaaaaccacaccuaggcacaaaucacagcugaacugcugaaaacuaacaaaaaagaaaaaaagugcagaaaacagcuagagaaaaacgacauauuacuuucacaggaacacugaguugaauuuccacugacuuauuagaaaauauaaggccagaagacaguggaaugaaaucuuuaaaagugcuaaaaagaaaaaaaacccaaaagccugccaacacaaaauguuauuuucaagagaaauauucuuaagaauaaaagugaaacaaacacauuuucagauaaaagaaaaacauaauguguugcuagcaaaccuacacuuaaaaaaaugcucuuaauuuuccuaaaacacgacucuuuaaagcaaaaaugguaacauguauuguguaguuuauaacauaccauagauguaauacauaugacaauuacagcaaggacaggaggaagugauaaauguagaaaugcaaguuucuauauuuuacauaaaaugguucaauauuaauucucaacagguuaugaaaaaagauacacaaaaucuagaauggcuaaaaauagcagagacauaaaggucaguaaauaaaaagaaauucuaauaauguaucaaaacgauaacauaugauuacuagauaguguuuaacccaagaacaaaagauugguuuaacauucaaaaccaaucaauguauuuuucuauacuaggggaaaauuccuaucaugaaauagcugcagugaaaacaccugauacaauuuaacaccauucaaaauaaauacacuuggcaaacuaacaagggaacuuccucaaccuguaccuacaaaaacucuacaacuuacaugcuuaauagugaaauacugaacacuauucuccaaggaccaacaaaaaagcaagaaggccagugcucaccacucguauucaacaccauacuacaaauccuagccauuucaacaaggcaaaaaagagaaauaaaaugcauaaaaaucaaaaagaaauaaagcuggcucuauguacagaugauaugacuguuuauaaagaaaauccuaaggaaucuacaaaauaacugcaauaagugaauuuaggaagguugcaggauacaaaguuaauauacaaaguccacuguauuuggcagcaaauacuagaaaaacaaaauuuaaaaaaccaauucuaucuacaacagcaucagaaaacauaaaacaucgaacaaaagccaugcagcccucucuacuaaaaauuaccaaacaucacuuugggaaaucuuaaaagacguaaauaaauggcaaaacauaucaugucuacgaauugggcaccucaacugcaauucucuucaaacugaucacagagucaacacaauccaaagcauaaccacaauaggcuuuucuuuuuuuuuaaucugaaaagcugauucuaaaguguauauagaagcugauuaaugaauguacauacacagcuuaauagaagaaauaagaccuaguguuagaucaguaagaugacuauaguucacaauauucuauugcacauuucaaaauagcuagaagagaguaauucaaauguuuccagcauaaagacaaauauuuaagguaacagauacccccaauacacugauuugaucuuuacaauuauaugaauguauuaucacuguacccccaaaacauggacaccuauuaugcagcuauaaaaaauuuaaauuaaauaaguaaaauguauauggaaaugugaaggaucuaaaacaucccaaaaaagcuuggaaagcuguagaaguuacacaaucugacuucaaaacauagcaugggcugaguaaucuaaacaguaugguacuggcuuaaggaucaacaaauagaucaaugcaacagauuaaggagucuaacaaagagacccacauuuauagucauuuaauauuuuacaaaagugccuagacaguccaaaagaggauggaaagucuuuugaacaaauaguaaaaagauaacugacauccauguggaaaaaaguaagccuuaaucucuaucucacacaauacacaaaaaucaaaugaagaugaaucacaguccuaaauauaaauguuaaaaacuauaaagguucuauaagaaaacauguaaaacuaucuuaaugacuugaggauaaagcaaagauuuauuaggacacaaaaaggaagacccauaaaagaguaaacucauaaauaaaacuuuagcaaaauuuaaaacuuaacaaaagacauagaugauccaauuuucaaaaaugaacaaaaggucugaauagauauuucacaaaauaagauacugcaaacagccaaggaguacaugaaaaagugcuccaaauugucagucaucaggaaaaugcaaauuaaaaccacacugagauacaacugcauaccugccagaauaauuaaaauuuauaaaaccaacaagaucaguguugccaagcauauggcacaacaggaacuuucauauguuuuuggugggaauuuaaaacaauaaaaccucugaaacaaaggcuggcaguugcucauaggacugaacaccugccuacccuacgacccagcaauaccacucauaagaaaaaugaagaugugucuaccaaaaaaauuuguacaaauagguucauggcagauuucuucacaacagugaaaaacuugaaacagccuggcuauccaucaacaagcgaacagauauacaaauugugguauauucuacucagcaacaaaaacaaaaauacaauuacugauaaacacaaauggaucaaucucaaaaugucaugcugacucaaggaagcuuuacauacaagaagagcauaugucauauaauuccuuuuauaugaaauuuugcaacaagaaaaaucaaucuaagguaguaaacaagucaaaacaguggcugccucugaaaggguggcucaagggccuaacuaggaaggagcaugagggaacauuucugagaaugaugauguucuauacuuugauagagguuuguauuucaugggcauacacaucugcaaaacuuaucaaagaguacacuuaagaugugugcauuucaccaaauguaaacuguaccacacacacacacacaaaaagagaaguaagcugacaucaaacucuaguuaaugauauauacaugcuguagugauuaggagggaaguauaccuacacugaaauguaucaaagacuaagacggaucaacugaugaaaagaggaauaaagagauaccuuauaaaauaauuauagucagguccgcuauaucaugacauacgaguuucaaaaaaaccacauuauacaaaaucaugcaauaaaagcuacaagguuuacgaaggaaaugggauuggaagcacagcaugcaaaaaugucaguaacacauuuuugaaaagauaagaacccaauaaaaacaauuuuacaccaauuaaauuauuaaggaauaggccaggcacaguggcucaugccuguaaucccaaaggaaaacaaaacugggaggccauggugagagaagcgcuugaguccaggaguucaagaccagccugggaccccgucucuccaaaaaaaaaaaaaaaaaaaaaaaaaaaagauuggcaggguggugcauugccuguagucccagcuacucgggaggaucacuugagccugagaggucgaggcugcaguaagacaugaugguacuacugcacuccagucugggugacagaggccuugucucaaaacaacaacaacaacaaaaaauuguuauggaauaaauacuacaagaaagugaguauuuuaccuugaaaaacaccuaaguuuaugccugggaaaugggugucauaagaguuaccacuugugaguuacugugaagugaugaaaggaggguuaucugacaaagggaaauuuguaauaccaguuguggcuggguguggcucaugacacacaguaaacugaauagcugguagauauauaaaggcuaucugacauauaaaaacaaacucaauccaacagugagggacaggcaaaauuuaugugaacaagaaauuuauuauugugguacuauguguuuaccaagagcaaugaacaugaagauuuuucagaucaauaugucaacguagaucaucacaaauuaugcauuuauuaacaguuauguaaguaauguuugugccuaacauacaauggagacuaacagcauucuaguuuaauuccuauuauugauaggcuuaagccuacuaucuugcuaucuguccaucuguucucuccaucuuuuucuguguucuuuuuaauucuuauuuuuguuuuauggccauuauuaguuuucugcuauaccuuuuggcaguauauuaaugacuaccuuauuaagauuuuaaugcaucuuugaucuauuacauucuugauuaaguuaguauauguaucacaugcuggcaaugcaagaaacacuuuuaaaaaccuauuuacagugauguuccacauaacaaauguuucggucaacaacagaccgcauguacaacaauaguccuauaagauuauaauggagcuguucuauacaagugugccauuuuaaaucuuuuauaccacacauuuuuacuguaucuuuccuaugugauguauuuagauacacaaaaccauuguguuacaauucccuauuguaacacaauaacaagcuauucaguuuuguagccuaggagcagagcaauagaccacacaacauggccuagguguuuaauaagccaugugguauggucuauaccauuuagguuuguguaaguacauucuaugauauuccuacaaugacaaaaucaccuaaccacacauucuucagaacguauccccauucuuacgcaacacauuuuuuguuacuguugucaaaaauuaaaauuaaauaaaaaagaaagaucucuaauuaguaauccaauuucuaccauuaagaaugaacuaaacccaaagcagguagcagaaaaggaauuauaaagauuaggggagaaauaagaggagagacuagaaaaacaauagaaucaacaaauucaaaaguagguucuacuaagcaagaaaaauaaaagaagacucaaauuacuaaacaucaggaauuacaagaguauuacuacuaaacuaaaaaggaucauaagaaaacaauuauuaaauacuaugaacaaugaauuacauaaccuccuuuaaauggacaaauuccuagaaagacacaaacuacugaaacugcauaguaauuuuaaaacacaaagacaagcccgugcucagauggcuucacuggggaaaucuaccaaacauaaaaauuaacauuaaucuuucccagacucuuccaaaaaagcuagaaauacuuccuaacucauucuacaaagccaguacuaucuuguuaccaaaacuagauaaaggcaucacaaaaaaacuacagaaaaaauauccuucauuaauacaaaugcaaaaauccucaacaaauuacuaggaaaucaaauccagcaacacauaaaaaagauuauaaaucaugaccaaaugggauuuauaucccaaaaacaugaaguucguuuaacaaacaaaaaucaaucaauguaauauauuaagaaaauaaagaacaaaauccauauaaucaucucaacaggcauagaaaaagaauuucacaaaacucaucacccuuucacgauuuaaaaaaaaucaugaaaaaucaugacucagcaagcuugaaacagaaggaaacuuccucacacugauaaagaacaucuaugaaaaauccccagcuaacagcauacuuagugguaaaagacugaauacuuugaccuuaagauuagggacaaaaaaaaggaugucuucucucaccacuucuauucaacauaguacugaaacuucuacccugggcaagagggcaagaaaaagacauaaaagccaucagaucagaaagcaagaaauaagcauccucuauugacagauggcacaauuuuguauauagaaaauccuaaagaaucuccucccccaaaauuauuaaaaguaaucaaguucaacaagacuacaagauacaagauuaauaugcaaaaaucaguuguauuucuacacacuagaaauaauuugaaaaugaauuuaagaaaauacuuucauuuggaacagaauaaaaaaaaagaauacuuaggaauaaauauaacaaaagaagugugaaaucugaacacuaaaaacgacauuguugaaaaaaugaaagaacugcuaaguaaauggaaagacuccccaugccauauucauggauuugaagacuaaaugcuguuaaaauagcaauacuccccaaauuaaucuagagauucaacacaaacccuaucaaaauccuaacuugcuuugcugcagaaauugacaaacugauccugaaaucauacacaaaugcaagggcccaguagagccaaaauaaucuugaaaaagaacaaaaaaguuggaagacucacacauuccaauuuuaaaacucaauaaaaagcuacaguaaccaagagaauguguugcuggcuuaaaaacagacauagagaucaaugccauagaauugagauuucagaaacucuuguauucacgaucaauuaauuuuguuauuguuguuguuuugcgacaaguaaggucucacuuuaaccaggcugcagugcaguggcaugaccacagcuuacugcagccuuuuuucucccgauuaggugauccucacaccucagcccccgaguagcugggacuacaguugcaugccaccaugccuggcuaacuuuuuuucgcauuuuuuguacagacaggguuucuccauguugcccaggcuagucucaaacuccugggcucaagcaauacuguccaccuuggccucccaaaguguugggauuacaggugugagccacagcaucugguagaugaauugauuuuugacaagcaggaaaaaacaauccaguggggaaagaacugguuuuuuuuuuuucaacaaaugguacugggaaaacauacaaaugcaaaugaaugcagcugaggucgggcacaguggcucaagucuauaauccccgcgcuuugaaaggccaaggugguggguggaucacuucaagucaggaguucaagaccagccuagccgacauagcaaaagcccaucuguacuaaaaauacaaaaauuagccaggugcaguggcacaugccuguagucccagcuucucgggaggcugaggcauuagaauugcuugagccugggaggcggagguugcagugaacucagauugugccacugcacucuggccugggugacagauuaagauucugucucaaaaauaaaaaaauauuuucaaaaagaauguagcuggaucccuaucucacaccauauauaaaaauuaacacaaaauggauuagagagcuaacugaagagcuaaaacuaugaaacucuuagaugaaaacacagauguaagucuuucugauaguggcuuaagacaauggucucuuagauaugacaucagaagcagaagaaacacaagaaaaaauagacaaacuaggccaggugugguggcucaugccuguaaucccagcacuuugggaggcugaggcaggcagaucacgaggucaggagaucgagaccauccuggcuaacacggugaaaccccgucucuaccaaaaauacaaaaacaaaauuagacgggcgugguggugggcgccuguagucccagcuacuugggaggcugaggcaggagaauggugugaacccgggagguggagcuugcaguuagccaagaucauaccacugcacuccagccugggagacagagcaaaauuccaucuuagaaaaaaaaaaaaaaaaaaaaguagacaaacuagacuccauaaaauuuaaaauuuuugugauuuaaaggauacugucaaggaaacuaaaagacaauucacagaauggcagacaauauaugcaaaucauauaucugauaggguaacuuuuuacaguauauauaaagaacucuuacagcucaauaaaaggaaaacccuacuaaaacaaugggcaaaggaucugaauagacauuucuucaaagauguauaaauguccaauaagcaaguaaaacuauguuaaucauuaguaauuagagaugcaaaucaaaagacacuaugagcucucauuuuacauacacuaggauggcuagaaucaagaagauauguguugacaagaauguggagaaacugcaacuaucauagcugguaguaaguaaaaugguacagccacuuuggaaaaccgucuggcagcuccucaaaaaguuaaucauaggguaucuaugacccagaaauuacacucccauuuucugcaauaaaaaugaaaacacauagccauacuauguuacacaauucuucauaacagcaauauucuuaacagucaaaaaguguuuccaccaaccaauggauaaacaaaaugugauauauuaauacaauggaauauuaauuuggcaacaaaaaggaauggaguauugauauaugauacagcauaaaucaaccuuuaaaacauuaaccuuuaaaacauguuaagauaaagaagucagaaacgagaggucacauuuuguauaauuccauuuauaugaaauguccagaauaaguaaauccauaaaaacaaaauaguuaguugcugccuggaacugggaggagugaguguuuugggguuccuuuuucaggugacaaaaauguuuaaaaauuaaauaguaaggguugcauaacucugugaauauaguaaaaauuaccaaauugugcauuuuuaaagggugaauauguacaugaauuauacaucucaauacaacucucauuaaaaaaauaaagaugacaacuuuguuccacucuauuacguaaacagcuuggaaaucaucacucccauccucacaagaaaaaaagcagaacaacugaaaaucaacuacucuuagaagcacuggaaaacugaguucacaggucacaacaccuccagaaaaacugaagaaacaugugaauauagacauauggagcuauauuuacucuaaagccaauaacuggaaggaacacuuuaaaaguaaguagcaaacugcuggagacugagagugaacuaacuugagcuuuaacuugugagggcucagucuuaaggaagaauauaggugagaaaaggagcuccaccugguuuuuauuagaguaaaaucccuccauuuugaguagggaaaagggaaaaguaaccauuuugaaaucugaccuagaguaagagcaauaauuccagcccccucuaaccugccugagaggagggaagaaaaaagcuuaagaaauucuuuugaagguccguucaggaacucugguccacuaaaaaacccaacagauuucaucauaugauuauagaacacuucuccucucuacuaaacagggcuccaauauaacagauuacaacugagaaaauuacaagaaauagacuuuuuuuaauuaauaaaaguuucuaaggaaacucaaaacaagacaaaaaccaggaaaguagaggaaaaugaaaugucuuauaccuacaaacaauauaaauaccuagugaacauuaaacacagccuaacucccagccagauaaaccuaaaaucucacauuaaacaccuguuuaccugaguuucuacuacucaauaagccauguccagauuucaacaaaaaauugcaaggcauguaacaggcaaggaaaaggucugaagagacaaagcaagcaucgaaaccaaacucagauaagguagauuuugaaugaucaaacuggacauuuuaaauaacucauuaaaaugcuaagggcuauaagaaagaaucaaaacaaaaugcuagaaauaaaaagcauuaacacaaauaaagaaugccuuugacgagcaaucagcagacuaaaaaaaacaacaaucagugagcuugaaaaaaaacuggaacaugguauuugagaauggaggacaacuauaaaaggugaaaaauauucauaauaguaaugcuagaaggagaagaaacaaagaaaaugaaguauuugaaguaaugaugguugaugauuuuccaaaauuaaugacagaucccccaaaccccaaauccagaaagcucagaaaacacuaaacaggauaaacaucaaaacaucaacaccucaucuucaaaccuaggucaaagacaaagaguaggucuugaaagaaaucaggaaaaaacaaaacaaaacacucacucuauauaaaagaagggcaagaauuauaucagauuucucuucagaaaucauguaagcaagaagagaguggagugaaauauuuaaguguugggaaaaaaccccaccaagcuaggauuuagcauccagagaaauuaucccucagaagugaaagaaaaauaaagacuuucucagacaaacaaaaauagagggaacuuguggcccacaaacuugccuugcaagaaauguuacacguucuucagagaaaaggaaaaugauauaggugagaaaauagaauccuuaugaagaaagggagaguccaagaaggaauaaaugaagauacacucuuuuauuuuucuuaaucuuaauugaucacauagauaaguauucaaaauaguaacaauaucuuggguaacugcugacuauggauaagugaaaugaauaacagcaaugcuauaagggacaggagggaggaguugguuauauucuguuauaagguaccugcacuaugugugaagcaguguaaaugguauuuaaaaaugaacuuagaugagcucuaagggaaacuaccaaaaaaucuuuuuuaaagaaguacaauuaguauuuuauacagaaaagaaaaauggaauaauauacaaugcucaauuaaaaucagacaaugggcuaggcacguagcucaugccuguaaucccuucagaaggccgaggcaggaggaucacuugagcccaggaguucaagaccagccuggccuacauggcaaaaucccaucucuauaaagaauacaaaaaauuagccaggugugguggugugcccuuguaguucuagccacuugggaaccugaagugggagaaucacuugaguccaggaagucaaggcugcagugagcugagaucccgccacugcacuccagccugggugacagagggagaccuugucucaaaaaaaaaaaaaaaguacauuuuaaaauaagcaacaaggaacaaguauaaugaguaagaaacaaauaugguagacacuaaaacccaacuuuaacaauacuuucaaugugaaucaucuaaauauaccaauuaaaagacagaacugacaagagugaacaaaaagacccaaauauauguugucuacaagaaacucacucuaaauauaaagacacagauagguuaaagggauggagaaauacauacaaugccaacacugaucaaaaggcagcuggacuaguuauauuaauuucuaacaaagcagaauucagaacaaggaaaauuaucggagaaaaacaggaauaguacauaaugaucaaggaucaauuaucaaacaagauauaacaauccuuaauugucaagggucgugaucaacucaguauaguacuggaggcuauaugugcaaacagcaaacuguuucucauaaaagcaggaugucggcaaacugacaaacugugucuguugcccagaaggaaugcugagggcagccaccacccaggcacaaguguuucuucugauuaggcauaacugaaaccuguuagcaauaaugugaaccugugaucaauccagcagcugaccaaucauuaccuccuccugcugcucuuucuacccaauacauauuaagggcuguagagucuuaggcagcugccuuugcucacuaaaagcagggagcccuuuucuucuucucuucuccuuccccauguuacccuuacuuuaaaguaguuaccuuugucuuaaguuuucauuucuaugucugucccccuugauucagucucauaaugauggucucaaguaguaacaguaauaacugucucagugacagucucaaguaguaacuguggcagucagccacacuuaaugugucugagccuaacaacaaagugucaaaagaugugagacaaaaacugauagagcuacgagaagcagcaguuaacuccacagcuauaacugaagacaucaacaccccuauaucaacaacuggcagacacagcaggcagaaaaccaguaaacauauagucaaacugaaaaguaucauccaucaacuggauuucauugacauuuauaguauacuuuauccaauaaccgcauaauacauauucuucuuaagcucacaaaaacauucaccaaaacagaacacauucugggacauaagaaagacaugccuuaacuaaagucauacaaacuaugcucucagacuuuaauagaauuaaacuagaaaucaacaaaagaaagauagcuggaaaauccccaaauaucuggagauuaaacaacacauuuuaaaauaacacaucaaagaagucuaaagagaaauuuaaaacuauuuucaacuaaaugaaaacaacuuaucaaaauuugugggaugcagugaaagcagugccuacagagaaauuuauagcacugaauguaauggugaucuaaaaaucaaugauuuaacuuuccgccuuaggaaacuggagcaauaaauacaaaccuagagaaagaagaagaaaugagaaauagagauagcaaugaaauuuuaaaaaauaaaauaaaauaaaauaaaaaucaacaaaauuaaaagccaguucuuugaaaagaucaguaaaauugauaaaccucuagccaggauaaccaacaaaaaaaaaacacaaauuauuaauaccaaaaucaaagacauaagaaacuauuauuaucaguaauaauaucaauacugaucccagacauuaaaaaaguauuaaagaaacauuuauaacuaacuuuaugcccacaaauuugauuauuuagaugaaauggauuucaaggcaauucccugaaagauauaauuuaucaaaacacacaaggagaaaaugaaaaucugaauaugccucuauagauuaaaaaauuaaaucaauaauuaauaaccuuuacagaaaugagaaagaagaggaagaacucugguaacuagaucgaauuguagugucaaaauaaacuccauccauugaaagagccuagaagcaaugauacccaagaguagaaagcacacccauaauaaaucuauuaaauaaaauucaagaauauuuguugcauaauguuuguccucagaauauauccaauaaggguguacgauauauuguguucaaaaguuaucugcauucauuauuuuuuuuuauugugguuauuguuuguaaaagcuaaauaaaaacauauacucagaaaaaaauaauaguaacaauuaauaaccuuccaaaaaaaacaaacacugggcccagauggcuucaggguaauuccaaccaaacauguaaggaagaaauaacacaacugucuccaaucuuuuccagaaaauacacucagaggguacacuuucuaagucauucugagucuagcauuacccuaaugccaaaaccaaauaaagacauuacaagaagggaaaacugcagacaaauaucucuuaugaacacagaugcaaauauccucaauaaaguauuagcaaaucaaauccaacaagguauacaagaacuauaccuccuugaagucuggauauuaaaauaaauaaauuaaauuaaaauuuuaaaaaaagaacuauacaccaagacuaagugggauuuaucccagguaugcaaggcuggcucaacauucaaaaaaaacaauguaaucaaucacaucaagaaacuaaagaagaaaaaucacgugaucagaccaauagaugcagaaaacgcaucugacaaaauccaacaccauucuugauaaaaacucucaguaaacuaggaauagagggggagcuuccucaacuuaauaaagaacaucuacaaaaaaccuacaauuaguaucauacuuaauggcuaaaacuagacacuuucucuuuaagaccaggaaaaaggcagagguauuuccuuuuacggcucuuauucaacaucauaggggaaguccuagcuaaugcaaugagacaagaaaaggaaauaaaagguauauagauugagaaagaaaaaauaaaccuacuuuuguagcugaaaagauuguuuaugcagacaacaucaaagaauugacagaaaaaaaccucuuggaaaaaauaagcaaucauagcaagguggcaggauacaagguuaauaugcagaagucaauuuccuacgcaccagcaaugaacuggaauuuuaaacacacaauaccacuuauauuagcaccaacaaaaaggaaauaauuaggcauaaaucuaacaaauauugacaaaauugauaccauaaaaacuauaaaacugcugaaauacucaaagaaaagcuaaauaaauagaaaaauagccuauguucauggacaggaagacucaaauuuuaaaauuucgaauucugaauaguuuauucauguauauaaguuacugacacaguaagagggaucuuuuuuuuaucuuacaagaccuaaaaauuacuuaauaccuuugaaauaaaauguuuuauuucugccaaauggcauuaugaauauaauaagacuuaagagcaccaaaaguuaguuacuacagcaagauacacuaguauacguauaucuauuuauauuaagaaacucagggcacuugucuauaauucacaaguuaccaaucuuaaacauuuaagcuuaugaacauauacccauuuuuuucucauguaaaagaacaaacuuuaacaucuuucaaccaucauaagugaaauaauauuaaaagugauauauaccaacuggugauucacauaguaguguuauaaaaucaaaccaaaaacauuccagcaacaacugcaggccaggugugguggcucaagccuauaaucccagcacuuuaggaggcugagguggguggaucacuugaacccaacaguuugaaacuggucugggcaacaaggcaaaaccccgucucuacauaaaauauaaaaaauuagccaggcauagugguaugugccugcagugccagcuacucaagaagcugaggugggaggaucacuaaguccaggaguucaaggcugcagugaacagugaucacgucacuguacuccagccugggcaacagagugagaucuuaucucaaaaaacaaacaaaaaacaauuacagaugcuccugugaaaauauuucaaucagguuacauacuugagacguauuucaguguuuagaaaaggcaaucacuaucuaaaagaaaugagaacuuauaaaaaauaauaaagaaccaaaaggaaagcaauuguugagaaagcuaugguucucaaagauuauuaacacagaaauuauuugacaagguaaacagaacuucagcuggccacugcauuuaaaacauguuucuuauuuacuauauuuuauuauguuuuggcuuuuuaaaagcuugcuggccagggcuagugcuuucuuagagauaagagggcucacaggagcaugucuuccauauacaaaccaaccaauccugagucuacagccaaauccaccuccuuaucuaacgcucacauacgaagccaguauuuccugcccuaaaucauuccagagucagguaccaggcaauuagagaccaccucuacagcucaaagccuggaggaaucauccaaacucuucaauccucaacuguuuacucugcccucccuugccuuucccaggaaaucccaauacucuggccuggacuuuuccguggcuccugucuucugcuuccugacuaaaaccuggugcuuccccuguguagcaugcagugacccucccugagaccugugaguauaauaaaauucuuccuucuaagccuuauucucauaucccccugcagcuacccagacuuuaccacaccguauccaacaccuacauucuuagaauagccacuauuaauauacaaaauaaauuuaaguauaugcaugcucaaaauauugcaaagugaaauauuaaucaccagaugauuaucugcaccaauggaacugagguaagaaacuuaaaacuaaaguaacagaaaacagaaauccuuuuuucaaaccuagaacauucugcugugauuaaaaaaaaaauuuguuccaauucuaauucuaugcugacaguaaagcagcuacuuaucucucucuacacugcaccuucucuaccacauucuucccaaagcauaaagaaucaugaaaaacagaaauucuuucuugccuucggaaaguucacaauaauauacaccaagcugcaucuuucuucagcugcaucuuucucccauuaccucucgaagagcuauaaaaauauaaauauacaauaccuaaaauuaaggccuggcuauauuuacuaagauggccuucaaaguaccuauucauuuauccugccuuuuaauaauuaagacaauaaggcucuaaaaacaagaaaagccuauuaguuugagaguuccucugacgauucuuugucgaauaauuccaucuguaguuaacuacuacaacaacaacaaaacacaaaauaacuuguuaaacuguuaaauguuaaggaaaauaaucuaucauaugcauaaaacaacauauucuacuuuucacccaacagacacaaaauuguuuauguuuccaauaaacugacauuuuugguuaauaaaauuauuuauauuuuaauccauauuuaaaaucuuguuuuucaacauaucccuauaagauuaauaaauaaaaaguagcaacuuuaaaucacacaaauaaguucagaagaaacugauuuacauuucaauucuauaaacauuacagguucuacuuguaccaaaugagauguaccuauaaaacuauggagacugagaugcguuuuacuguuuuguuuuucaauaauauuucucuucacaagugcuauaacuuaaaaauuacacuggauguucaagacuuguucacaggaagucuccaauuuuuaauauaaaucggucaaaaaauaguguucuuauuuacuuaagaauuacaaggaaaaaaaggaaaauuauuucagaaauaaagacaagcuaauuggaacacaaaguaaaagaccccacaagaaaagaggaaagagaauggaggaaauuuuuaaaauaacgaaguuagucaaguguuacagauccuuuagaauuucucuggcagguuuuccaguuuuuaccaaaaaacucuucaaaaaaacaaaauaauagaagaaguuagucaaagaagacccaacauacauucauaauuagagucccuaaaaaacaaacccauguaauggaacagaacaaauacugaaaaccaucauacgaaaaaacuuuucugaaauaaaacacuugaaccuacucuuaagaccauaccaagaucaacaccaagacauagucaaguaaugguucuuuaaagaaaaagaaaaaucuuucagguaacaggcaaaugaccaaauuucuuguaagaaaaaaaugucugaagacuuugaaaauguccauggagcucauaaaaaaacauggcuggguacagugguucaugcguguaaucccagcacuuugggaagcugaggugggaagaucaucacuugagcccaggaguucaagacaagccugagcaacacaaugggacccugucccaacaaaaauaaaaauaaaaauaaaaaauaaaguuagcugagcauaguggugcgcaccuguacucccagcuacucaggaggcugaggcgggaggaucgcuuggccccaggagguugaggcugcagugagccaugauugugccacagcccuccaaccugggcaacuaagugagagucugucucggaaaaaaaaaaaaaagaaagaaagaaaacaugagccagggauuuuacauacaaucaaagcuucaaauauaaugaguauaauggucacaagcaaauaguuugaaccaaaaggacuuaaaagaauauuguucccaugagcucacuuguagaaugugagcuucagauaaccaaaaaauccucgaaguaucuuugggauaaggucugaugaugaguauugaauauaauuuaaaauuaacacuaagugaucagaauaaagauaacaguauaguguaugcaaauguuauaugcucauaaaauauagauauaaaacaauuaacaaaaaagagaauuuacagaaaaagcaaugaccuacugauacacucaacuaccuggaugaguaucacaugcaucaugcuaagugauuacaaaauagccauuuucaaaagguuacauuuauauaacauucuggcuucaaaaggcaaaacuauagggacagaagacagaucagugguugugaggaguugggggugggaggaggguuugagauaaaggggcaacaagagagaguuuggcgugguuguuauguaauuuuaguugugguuguuauguaauucuauuugucaaaacucacaacuauacacugaaaaaaauguauuuuacugcacauuaaucaauaauacauuuuaagugcaaaaaacccacagacacuggggaaagggaagaaaaggugcugaagagguuacuagcuaauuucauuauugcucacaauacaagaguaccuuaaaaggaggggacuauagguauuaguauaaauguaccucucucaauguaaaaauauacuaaaccucucaaaaaaaaaagagcaaacaaaauagauaaaauaaaaaaauucaaaagcaacaaaaauguuucaaguuuccuuucacucccauccccauuuaaccacuuccucuacuuacagccaacuagugucaucagcuauuugugauaccucuucaaaguuuucgauggcauauuugcuuccauuuucaaaaggaaauaacaaaagaauaaaucaagaacuaaugaaaaugguuaccugaagggggaagaaaaaaaggaugacgugaaccuucugugaagugccuucuuuccuuuuuuuuuugagagagagucgugcugucacccaggccagagugcagugaagcaaucuuggcucacugcaaccuccaccucccaggcucaagcgauucuccugccucagccuccugaguaguagcugggauuacaggcacgugccaccacaccugguuaauuuuuguauuuuuaguagagaugggguuucgccacauuggccaggcuggucucgaacuccugaccucagguguuccucccaccucggccucuuaaagugcugggauuacaggcgugagccaccgcaccugggccaagugccuucuucaacagucuuacuuugaaacaauguaaauguuuuauauaauuaaaacaaaaauuuaaaaaucagucccuaagaauggaagauaauuuuaaguaagugaaacuaguauauaucaaguugguggcagaaauacagaaaaaagaauuacuucaagugacuuuaaaacacaguauuuugaauauccaucccuaaugggauauauucuaaagacugaagcaaaauuaaaaaaaaaaaaaaaaaagacugcaaaaaaacauacaguauucaauguucuuaauacauaauuuuuuuuuuuaauugauggaguuuugcucuuguugcccagccugcagugcaauggcacgaucuuggcuccaugcaaccuccgccuccuggguucaagcgauucuccagccucagccucccgagucacugggauuacaggcgcccaccaccaggcccagcuaauuuuuguuacuaguagagacaggguuucgccauguuggccaggcuggucucaaaacuccugaccucaggugacccaccuaccucugccucccaaauuacugauauuuuaauuuggcaauguaucaagauauucuaggcuaaagcaaauaaauauguaaauaucacuagaaucaaagauucucagaauaagaaaaaagaaguauaaaaugagagacuuuaaaacugauuuggaaacucugcaacucaugaacucacuuugaaaugcauuuuaaaaagaugggguguggauguacagaucuauaauaaaguaaauauagcaaaaucuuaauucuaaaaucuaggugguguguacaaggguauucacuguauuaacucugucuucuguauguuuguaaauguuggggaggaaaacuccuuagauucuguacuauacaaaucacaaagaaucacugggaugaaucucaacucuuaaccagucuguuuuuccaucugacaacaauuacuucucaucaaccauuuuaaaacauuucaaccacuccuccaaaaaacuauccauacuacuaaaucauccacaaagccaaaaaggucuaggaccaacagaucauuucuccuuaucuuggaauguuaaucaaccuaagugauuccagcaauaggcaaagagcaagaauucaauauaucugagauaaacauaaauagaaugguuauaaacuguuuuccugguucugaaaaacugaaauaugauuucaaguaauauauucaucaggacaaaacuauauacaaucuuaaaguuauaugacaugggugucuuuaagacauuaaaaugaaauuuucuuccugaauuuucaauuaaauuuauauuaaagugaaaguauaagaacugguacccaugagaauaauuuuuuuuaaucucucaugugacucaaauacaucuuaaaccuauuuuucuuucuuagacuaauguugaaagcaguuuuaauagagaaaaaaagcuggagagaauauacuccaaaaugucaacugccauuaauccaggugguaggauuguauaugcuuuuaaaaauauguuauuuuuuuucuauuucacaggauuuguuuauuugauuuucccuuuugcauuaagaaugcauuaccuuguaauuggaaaaaaaaauuucuugggaaaaaaaaaacaccuauacuuguuaaguauaaaauaacugacagaguaagagguaagggugauuugggauuuaaacugcacuaaagauaaccacuucaagaauaauuugagaaacaugaugguuauauaucuuuaggucacuuuucccauauuucauaccuucuuaaauaaccaauuuuucucuccaccaaaaauguggcuccuaccauucuuaaugguuuuuagaacauauccaaaauccaagacucacauucuguucauuccauaaauauugacuaucuauacucuguacuaugcacagcaagugcuaggggauuacaaaagaaaagauguuauuaucccuacccaccucuacuuaguuaacauauuuaugcagcaccuauuuugugucuggcauuguucuacacaacauggauauagcaguaaacaaaacagaccaaaaaagccucucugauaaagauuuucuucucuugucuuucauuguuaugcccuacacuuagccaaaugcagcaaauccaccucagaaaucccucugcaucuccuuaaaacucacuaaaaacagcaauauauaaaucucucauuuugucugaguauaucagcuccgugcugauuucauuuuuucccuacccagccugaacuaaaaugguccauuuagauauucccucacccguaaccucaauuacuacaauuguucuuccaacuuaccuaaccuauaguuucccauuuugcaucaaucauacaauucaacuuuccucucuaaccagcuggguauauaguaaaaaauuguaaguauguaaaccgcugucacaaauuugugguuuuaaaucucacaguuccucaauaccuucacuucucugaucaaugaacauuuacuaaauaucuauguguaggaugacacagauaaagcuguggcaaagacaaaagucugugcccucccuaaagggauacucuaacggguaggacagaucuuaaauaaauaauuaugaaggugauuaaaugcuaugaaggggaaguacaagaugcugugaaaggguguuaacagaggagccucaucuuguuuggaggugaaaaggcugucaagacaggcuuccagaaguagugauaagugccaauaaauaaauuccgcacagcaucccaccuuccuaauuuauacuuaaaaccccauaucccaccuacugggcaaagaaacuugccucauucgccuccucagccuucuccuggacucacuagugauuccuucuccucagcauauacauacaacaaggucucucccacccaaacauaaauugcaauaauuuuuccggagaguaauuuggccaugugcaucauaagccuuaaaaaugugcauaccccuucuugugauccauaauuccacuucaagaaaucuuuccuacggaaauaaagacaaauuucaugcaaaaaagaguauuuagaauagugaaagaauuaaaacaaucuaaauaacuggcaacaggagaacagcuauggaugugccuuaauaaacuuagacuaugccacagccaaaaauaaaaagauauucagagcuuuuaaucucauagaagaaugcuuauaauuauguaagaaacauacuauaacugcuacauagaaauaaaucaauaauaauccucuacaaaaaaauucaaaaauaagccaggcauaggauacaucucuguaguccuagcuacucgaguggcugaggcaggaggaucacuugaacccaacaguuuacagugagcuaugguuacagugagcuaugaaugcgccacugcacuacagccugggcaacagagaaauacccugucuccccaaaaauacuaaauaaaucaaugauaaacacaggauguaaaaaccuguauaaagaggauaccaggccgggcgcgguggcucacaccuguaaucccaacacuuugggaggccuaggugggaggaucacgaggucaagagaucgagaccauccuggccaacauggugaaacccugucucuacugaaaauacaaaaaguagcugggcgugguggugugcgccuguagucccagcuaaugggagggaggcugaggugggagaauugcuugaaccugggaagcagagauugcaguaagccgaaauugcaccacugcacuccagccuggcaacagagcgagacucugucucaaaaaaaaaaaaaagaguauaacuaagcuuaaaauauaaguguauauauaaaauccgaaagaaacgagcagaaguauugauagcaauuaauuauacaaaaaucaugguuuaguuuucucccuuacauuuuuucuguacuuuuuuuucuuuccugaauuuccaaaauuucuucccccccccccccccgccccccgaaauagagucucacucuguagccuaggcuggaguguagugacagaaacacaguucacugcagccuugaccuccugggcucaagcgaucuuccuggcucagccucucauauagcugggaccacaggugcaugccacuacacccggcuaauuuuauuauuuuuauuuauuuauuuauuuuuugagauggagucuggcucuguugcccaagcuggagugcagcggcgcgaucuuggcucacuacagccucugccucccagguucaagggauucuccugccucagccucccaaguaacuggguacaggaaugcgccaccacgcccagcuauuuuuuuguauuuuggguagagacaggguuuuaccauguuggccaggcuggucucgaacuccugaccucaggugauccacccaccucagccucccaaagugccgggauuacaggcaugagccaccaugcccagccuaauaaacagggucucgcuuuguugcccaagcuggucucgaacuacugggcucaggcaauccucccaccucagcugccaaaagugcugggauuacaggcaugagccaccacgccuggccuugaauuaucaaauuggcaguguauuacuuuucuaaauggguugugaauuauuguuucucacaacagcaacacagcuacuaaguccacuggcacauuaucuccauuccuuaccucucuuugacacacugcaccugcuaucaccccaauuuuaaggaaacugcuaucacaaggacuaauuaaccccccaaaugacaaaccaguggagacuuagcaguccuccuuugaacugacuuccuuggcuucugaaaacaccuaggaucugccuucuaauucucugaccauucuuuuauagaaucuuagaugauuauguaacaagaagaaauuguuuuaaaaaauucauaaguacaugaaaagaaucucagacgaauucccuccuucuauauguccuuuaaauaugguguuucagguguccacccuaggcccucuuuguuuuuguuacauuacauacuugggugauccuaucaauucccauggcuuuaacaacuuaaccuucugaccacuccaaaaucuaccuucagcccuacucuccuaaaucccauuuauuuuuagucaaagccuuugcuauuaauuuucugggauuccccuagcagcucaaacacuguucucaucaucaucuucuuuaaagauccacuuccuggccaggugugauggcucacaacuguaaucccaguacuuugggaggcugaggcaggaggaucccuugagcccaggaauuugaggcugcagugagcuaugaucacacaacugcacuccagccugggcaacaaagugaggcccuaucucuuaaaaaaaaaaaaauccucuucugguauuuucugauguauuuagucacaucacuauccauuuaaucuucuaagacaaaagcuagggagucauucuuaacauucucucaacaacuaccuuuacgugcuuacuacuccuacuuccuaaucaaggaaauaaagacagauuucauguaaaaaauuaaguccuaauuaguuaacaaaucugucuacuuuccucuacaaccccaccacacagauuaaacccucaauuuauuauuacaauaacccaacugaucucuagaagucagucucagaucuauuuuccauauuacccucagauaacccaccuaaaaagcaaauccaaccauauaauucccuugcuuaaaacuagcaccugaaagauaaaagguaacacccauuagcauuagaagucccuucaugaucaucuccagacacauuccucccacaaaacuuuaugcugagcuuccuccagcagcagcaguggcagcagccagcagcaacagcagcagcaagaagacacgaguuugcugugcaccaggcaucuuuuuucagagcagcaucaagcuaccuugaguuugcuucacaccagguacucuaauaagugcuuuaagugaguuauguaauuuagucuuaugagguuggcacuauuauuuccuuuucacagacugagagagucugucaaaaaauacaaaaccacagaaccaguuaaguagcagagccaagauuuacaucuccacuauauuucucaacaaaaguaacuagucagcuucuaaaacagcuacuaaucuuuaacaucucuguucauauccuaucuugugaaggauaccugagcaacugaaggacagagaagcuuauguuuaacuguauuccucuucuguaauuuuauguaagcuuccuagauagacuucccugaucaccacccugucuuccaacaguguugguuaccuccuccaacauacuucucuaauuuguuuauaugucuacuacuguguaucucauacuggauuuuauuaguuacuuacauguucauuucccuucuuaccugcaaacuucuggaaaguagguacccuuucucagccauguuuacagcccugucuccaucucugucaauccuagguucuuagcacaguaucuggcacauaacagguacucgacaaacuaaaucuccucgucuguuauuuuccuccuguuauuuuuuuuuuuaaaucucuaucacacucuauccucaggcaaccgccucacaaccuaacuccuagcccuagcccguaaacucuguagcagucuugcagaccgccaucacacacuucauccucuccccacuuuguauuaucuuucuaaagcagguaucauauaucuucccuacucaaaaagauugaaggcagucugggugcagugacucaugccuguaaucccaacacuuagggaggcaggaggauagcuugaggccaggaguucaagaccagccugugcaacauaccgagacccaucuccacaaaaaaaaaaaaaaaaaaaaaaugcugggcauggugacgcacacccauagucccagcuaccugggaggcuaagcugaagcaggaggaucacuuaaguaagggaggucaaggcuacagagagccuugauugugccacuguacuacagccugggugacagagcaagacucugcugcaaacaaaaacaaaacaaaacaaaaaacugaaagcucccuucuaccuauagaguauauuucacccuagaacuaucaucaaggcucuauaacaucugauuccauucucacuuuuuuuccuuuuuuuuuuuuuugagagaugaagucucacucugucgcuaggcuggagugcaguggugugaucucggcucacugcaaccuuuguauccuggguucaagcgauucuucugccuuggcuccccaaguagaugugacuacaggcaugugccaccacacccagcuaauuuuuguacuuuuuaguagagaugggguuucacuauauguuggucaggcuagucucgaacucuuuaucucaggugauccacccgcuucgggcucucuaaguguugggauuacaggcaugagccaccacacucagccuguucuuacuuuuauaacucuuccuuauaauccaaguccccaacaauacugaaccauguaucucugccaaagaccacaaaguugcacucuuccugugagacuauucuggccauuuaccauagucuggaauguucuuccccaaaaaggccucucaaauucuuacucauuuuguaaggucuaccaacuacuacuuccuguauaaauauuuccuugagccaaaauuaauuacucucuccucaguuuucccauacauggucucauuucuaaguacuuaguauauuaugucuuaagaguugcauauuucugcuuccugccuugucccaccauaucuuccaaacaccauauaccaacaguuuggucaacaaaggacuauguauguaguccucuguuggacagaccagguauguaguagguacagcccagguauguaguaggcuauaccaucuagguuuacauaaguacccuuuacgauguucauaaaaaaacaucgcccaaugacucaugucuuagaacauguuccguaguuaagugacauaugacuacacuaaauuugaucuuccucaagggcagggaccacauucaguucacucacuguauuaauugaguuucuacuaaaugucagguccucuaguaagaacuaugaauaagacaaaucaauaaaauaauuucuuauccccacucagcugcugacgaugugcuauaucauagguguucaacauauauuuguuaaauaaauauauugcuuacuuauaauaaauguauuguuuacucuuuguucacauuuacccugugcuuccauuugcugcuuacaacgaaucaaaccuagaaggaaagauccuucuaguuuucaaagcuagacaggaagaaagaccuuuguucuccucccccgccaagaaauaaacuagaaagucagcaagcauaaaaggaacauucugaaagagugcacuuuauuaucagcagaagaauuuaggaacagaacagagagacugaauuacuugccaguucuuacugaaacacugucaaagaguggcaucaauauuuuguuugaagagcuaaaaauaccauucauaauaaauuauaauucuaaaaacuuucaaauaaaaauuuuguucucucucacauuuagaauuaacaguauguccacugccucuauuaauaugcauaauuuaaaauuugaaugaaaucccugaacugaaaguaccuaagauacagacuccuuaaagaaauucaucucaacggucaaugaucacuaaaaagaagggaaaguaaacacacacccguuaaauauaugcccuaaagaaguuaugcagggccaggcaugguggcucacgucuguaaucccaacacuuugggaggccgagguggguggaucauuuugaggucaggaguucaagaccggccuggccaacauggugaaaccccaucucuccugaaaauacaaaaauuagcugggugcgguggggcauaccuguaaucccagcuacuaggacagacuaagacaagagaauuccuugaacccaggagacagagguugcagugagccaagauugugccacugaacuccaaccugggugacagagacuccgucucaaaaaaaaaaaaaaaaaaagucauguagauaaagugauuuaauuuuucuugugaaaugcauuagauuuuauuuuuaaauuaauaauauuuaaagacuauuuaguccuaauaaauuuauuuagcugcacauauacaaaacuuagguucaguuuaaaugaaaacucauggcagaaaaugaaauauauucuuucacucaauaaaaggaacuuucuucaggucucauuuucuaggcaauaaagaaauacaaguaacaaucaugacagucauauuccuaauuuuccaggguaaaccuagaaauaacguacaccauaggaauuaaaagucuuuacaagcacauaauacauuaacaccaguucuuucuacccuauugaaagaggcaauucacauccaacucuugccauuucaugagaaaauuuguugccaaggacaauuuauuuuaaaaacugagaucugggauaaacacuguuuaaaagaaaacucaguguuuuuuuuuuguuuguuuguauguuuguuuguuuuugagacugagucucgcacagucaccugggacggagugcaguggcgugaugucggcucacugcaaccucugccuccuguguucaagcgauucuccugccccagccccccaaguagcugggauuacaggugccugccaccacgccuggcuaauuuuuuguauuuuuaguagagacgggguuucacuauguuggccaaggcuggucuugaacuccugaccucaugauccaccggcaucagccucucaaagugcuaaaggcuagagccacugugcccagcgaaaauucaguuuuaaauuaagcagaauaaacucucagaugggcacacaucacugcaaacaaaagguuccuaacagcuacucuuucugguccauacuuuacaaagauguugagauuuuuaggaaauaaucuuuucuccagaaaaacauuaguuggccaaaauuagcaauaugaguugcuuuuuuuucauaaaugaauuguucuuugcuuccaaaaacaaugggcugggccuagaacuuuguucgacacguuuaccagagagauaaaugaaugugaccaaagaaguacaauaguuuggccaggcgcgguggcucacaccuauaaucccagcacuuugggaggccgaggcggguggaucaccugaggucagggguucgaaaccagcuuggccaacauggcaaaacacacuaaaagcacaaaauaagcuggccgugguggcgcaugccuguaauccagcuacucggaaggcugaggcaggagaaucacuugaaccugggaggcagagguuacagugagcugaaaucacaccaucgcacuccagccugggcaacaagagcgaaacuccgucucaaaaaaaaaaaaaaaaaaaaaaaaaaacacaaaaaacaaaaaggcagggcacaguggcucacaccuguaaucccagcacuuuggguggcagaggcaggcggaucaccugaggucaggaguuugacaccagccugggcaacagggugaaaccccaucucuaccaaaaauacaaaaauuagccagguguggugguacaugucuguaaucccagcuacuuggaaggcugagacaggcagaauugcuugaacccaggagguggaaguuacagugagccaagaucgugccacugcacuccagccugggcaacagagcaagacucugucucaaaacaaaacaaacaaaaaaauaguuuucuccaagaacauacaagaaauaguacuucuucuaauccauucauuuauucauaccuuuaaaagccagcuauaaguuaaguacuggaguuauagaaauuaaaauagucccuuacucuuaaaucuguagggucauguuggcaguaagcagacaauugaaacaauacaaauaucauaauuacagucuggccaaaauguaaaggaggcauagaaaaggcauauuccuacuuuaaggagaaaaugccauaagaaagguacuccuaaacuaggacuugaagaccaauuaauuagcuaggcaaauagagaaagggauaagagaaggugaaggaagggcaugcauaaggaacuagaaauauaagccagcaugcguagucagagaacuccaaaugguaccuuauaggugaagagcaggugagaauuagggauucuucaacauaauuagucauuagggaaauauaaauuaaaaccacagcaagaaaucacuagaaaccuauuauaauggcuaaaaauuuaaaaaaaaaugacaauaccuagugcuaagaucaacaggaacucucauacacugcugguagaaaugcaaaccagugggccaggcacaguggcucacaccugcaaucccagaacuuuuggaggccgaggcggacagaucaccugagcucaggaguucaacaccagccugggcaacauggugaaaccccgacucuacuaaaaauacaaaagauuagccggggguggcagcagauaucauaucccuccacagcauggcugguuucugucacucaacaagcacaugaaacacaagaacuaugucuguaaggaacuuacugucuggcucaggagaaaaaaauguauauaugaaaaacguauauauguaaaagcuagaggccggguguuguggcacaugccugcaaucccagcacuuugggaggcugaggcaggcggaucauuugaggucaggcgcucgagaccagccuggccaacauugugaaacccugucucuacuaaaaauacaaaaauuagccaggugugguggugggcgccuguaaucccagcuacuugggaggcugaggcaggagaauugcuugaacccgggaggcagagguugcagugagccaagacugcaccacuguacuccagccugggugacagagcgagacucuggcucaggaaaaaaacaaaaacaaacaaacaaaaagaacaaaaugcaaacuaguauagccacuuugugaaacaauuuggcaguuucuuacaaaguuaaaaauacacuuaacuacaauccagcaaucccacuccuagauacuuacucgugaaaagaaaacuuauguuuacacaaaaaccuguauauacauguuuacaguuccagccaaaaaacuggaaacugagaaguucuucaacuggggaguggguaagcaaacuuugguucacuuaucuacaaaauuagauuuaaaaggacuguucuaugaauauauacaacagggaggaaucucgaauguguuaugcuaagugaaagauaccagacuuaaaaggcuacaaacuauaugauuccauuuauaugccauucuugaaauggacaaacuauagagacagaaaaccagucaacaguuaccaggagcuagauauggggaaggguugucuacaaaagaguauggcagaauuuugggggaugauagagcuguucuauauaaagcaguccgcauuuaucugugguuuugcuuuccucaguguuucaguuacccacagucaacugagguccaaaaauauuaauuggaaaauuccagaaauaagcaauuuguaaguuuuaaacugcaugccauucugaauaacaugauaaaaucucaugccauuggauucagucccgcccuguccccaccugggaaucauuccuuugucuagcauaucaacgcuguauuuaccacaugcccuuuagucacugaguagcccucucaauuaucagacugaaaaaaaacauaguauauauagaguucaguacuaucugcaguuucaagcauccacaaagggucuugcaauguaucccccacagauaaggggagucucccauaucaacugcgaugcugguuauaugacuauacauguuugucaaaacucacagaacaguacacuaaaaagaauaaaguuuacuauguguaaaauauaccuaauuuuaaaaacaaaagaaaaaggguaagguauccuggcuacaaagagacugaaaaaugacccaagagcuagucagaucugagggguccuguuaagaagcucuacauuuuauccuugaagcaacagauaucucaaaaaacggguagaggcaacucaguuuuuuauuacuaagaacccugacaacaguuauagacuagaauaagagcaaaacaggcagcaacuggagacccaucaaccaacuaucugagaguaauucagcagauaaauaauugagaucugacaaagggagaggcaguagagaugaacagaaaaguuaaaagcaggaaauucucaaguuucuagcaauagugaaaccaccaaccaaauguuuuuuuuuuuuuuuuuuuuuuuucagaaaaagauuuuaaacaagcuaaauuuaaaugccugugggacauucaaaugcaaacauuugguuagacacauugucuggagcucgagggaauaagcuaagauguagcauuagauuugagaaucaucaggguauuugcagccaaauaugaggucaaguucauauaauuugaaguauaaaaagaaucagcuuacugauuauacagcuuguaaagugagaaauggugacaaucgugugccuauuucaauaugggccucucucaaccacucuauccuuggcaucucugauuuucucuuuggcuugauuacccuaagaaaacugaggcaguuacauaaaaagcugucacugaauuccaaguuuuuauuuucuguugcucauacuguugacaucgagaauauucagccgauaaaggaguaaucuacugaauacacuuauuugguuaauuaaacacaggaggaccacuaagagggguuugauuugagguccaucugacugaccucacagggcaacuuauccacacagcucaauaagcuuugucuugguaacucaacuaaagacccuaugacugcuuuaagagaccucugauaugcaauaaaguuaucaggaaauacuauaggauagauccaaugauucuagguaauuagugcuuaaccagggauaggcaccaaaauucaguguggagcuuucucaaaaugccuaucuugcccaaagcucuacuucugaaaauccuaauuuaggaacuuuugggguaaggcccaaaaauuacuauauuuuuaauagucucauaagugaauucugauacccauacaaaccacacaccaaucccaagcugaaaagcaaugauauaaaauuugguuccaggcccuaccauggaauucucauuuggaaauuucuaaaccacauccuaaaccuugaaaaucuccucuaguugagagcauacaaauacacauuucccagcugaaaccuaaaauucuaaguccaacaucuguaaaauaccuaugaaucaccaacugacuaugauuacuaguuugagaggauuuaacuucuuagcagaauucacgaaaaagcaguguaagaaaagucauggaaaaugagucaccaucccuucauuccuuaauuccaaauucuccauuuuaauaauaaaccuaccagaaaagcuuaguuaauaucaccaacucaagcuuuaacuucagcuaguauuuaagcauaaccagauccaaucuguuauacugaaauauucagauuccacuuuuccaauuagcaaaauuuccaggauuccaacuuuccaauuacaucauaaacauuaugaaccaaaacaaaaaaacuagcaaacgauuuuucucaccaaaauuuacuuacccaucucuucccuuacugacaauuuuuacuucaaaauaauaaaucccacaggcugcugguauuggaugcguggcucgaacugacgcggcaucuuuugggguuuugccaugaccugcauagaaacaggaaggaaaaaagaagucacaugagauauucacugaaagaugaaaaccuuaaacaauucaggaacauauagguuuuuggaaugauguauuauuucugcuccuaucaguucaaauacucaauaaaacguuuaucaucaccaugaacccaauaugcaaaauagcccaaguuaaccacagaacucuucacacuauuacuaguuuuauuaagauugcagaauccaaauauggaaauugaaccuagcagccuuuuaugcaaauuaaauaaaagacauuauagaguacacuauauuuuuaagaggaaaaaggcuguaugaagaacaugagagaaagaucucaauuuuaucaggucuaaauuugcauauaacuuauauaauuucuguacacucuugccaaaguccuggcucuuuaaaccagaagcaucuguauuguauauuucuaagugaaaucuuacacaauuagauugaauuggcaaaacagcuuucuuaagaauuuacaguuuuguucuuugguauagucuuauuaauuaaagcugauucauaaaaucucuugggccaauaauagcuuauugagaaauacaucuaauuucuaaacguauuuuuuucuuuuuaaacaacagaaguaacaccaugccacugcugacacuuuagaaaaucuuuuagauaauggcuuucaaacuuuuuaaaccagcuauuccucaauucuaaucccacaggguuugcuaaacucacaaucacuuccccuaccucucgcccaagacacaaauuaccuugaaagcuagcauguagacaauauuaagagaaaauauguccacaaaaccauggaagaauaaagaaagaaguugaaguagcaugucagaaaguacucauagaguaugagugagacaagucuccauauccccaaaaggacugcaugagaaacaauacucuaaaucauuauugggguguucuaguuaaauaugcuccacgcaauacaaacuucgcauuaaucuuucagucauacuauaaaauuaucuucauggguagcagaauucuccuuaaauuuaugauuguuuuaaaacuaaauaccuucuuguaagucaaaaauuguaucuuaagauauacaaucaucacacaugaaugagaucauauccucccuuaccacacacuugaccaaauuuaucaaauuuccaacacaugccuuauuacuauuaaacacuuaaguuuacacuugcaaugcaaauuaguacauguucacaccccccacuccccccacaaaaaaauggaaugaauucugccacuccuuccauuaccaugaaaacuuggguuaugggcagaaguucuuuuagccuggugaccauaaggagucaacaagcuuggcuaggcaagacaaaaauggaagcaacaguauuuacaugcaucaaaacuacuucaacauaugaugcagguaauagauuuacacugagcuaagcagcagaaaagaaacaauugcacaagucugugcacuagucacuuuuuaauaaaauuuaauuaugguggcaguaaaacacauuuuucagucaaaauauguucaaauaauuaaguuaccugagaaaaggccauggaaacuacauauuuaaaaauuagauuguuacaaauaaaucuauagaaaacuaucuaaacaaaaucuaacugcaguucuaaauccacugauuuuuuaaggggagugacccaaacuuuuagugauaaaguaaucccaaaguauucuuaauaacaaauaauaguuacauauauuuaauaccgugugaaaggcacugcucuaagagcauuaaguuuauuaacucauuuaauauccaaaacaaccccaugagguagguacuaucuauuaucauuucacaguugaggaauccaagggaagauaaugaaacucgcccaaagucauacugcuaaaagcgaauuccaaaccaggauuugugcugggauuuaaauucaagaaaccugaucuagugugagcucugaacccacaugaaggauuuaguuacaaugaacauucggggaucacuucacauauccccauguccuauucugacuacuucuacgggaaaagagaaagaaaccaauauuugaaaguaaacagucucucaaagaguugggugcuuuuguauggauuuuucucuuucaacauuuacgaaauagguauuauuuaaccucacuuuuugaaaugaagaaaucuguaaucugucaugggccuacagaaaaaaaaauaaaauguuuacacauuauauacccagccccaaauugguagaaacauauauuagauccaugcaugaauuaaaaucccauacauuuuuccauuaugcaaaaauuacuauaaaguaccaguuauaaaucuucaaggauccauuauauuuguuaggauucacuaauugcagauaaauucuguaaauauuaaaacuaaaaagauuuguuucauguuuaaauuaaaauuuaaauuagauguaaaagguauaaggaaaaguuuaaaugcaagauuauaagguuucauauuauuucuuaaaugagaccaguccaaguugaguaucccuuaucugacaugcuugggaccagaaguguuuuagauuuuuuucagauuuuacaauauuugugcauacuuaccaguugagcauccuaaauccaaaaauccaaaaucuaaaauguuucauugggcauuuccuuugagccgggcgugguggcucaugccuguaauuccagcacuuugggaggcugaggcgggcgaucacuugaggucaggaguucaagaccagcuuggccaacauggugaaacccugucuguacuaaaaauacaaaaauuagccuggcaugguagugugcgccuguaaucccagcuacucaggaggcugaggcacaagaaucgcuugaacuugggaggcagaaguugcaagggccugacagcgccacuacacuccagccugagcaauagagugagacucugucccaaaaauaaaaaaauaaaaaaucaaguuuugaauucugaaagcauuuugaauuucagauuugggaugcucaaacuuguaauaucagcagcaaagggccuauuucuaacaaugcucaucaccugaaaguuuauuauuaccucaaauucugugguaaccaaaaaacaaccucauacuaccaaaguuuaaacuuuuaaaacuacaaagucuucaguauuaaguguuuucuauguggcuuuagaagaaaacauauguaauacuuccuaauucuaaggcuagcaaguuuagcucuuuuuauucaaacaaucugauggaaagaguuugaauaaaccauucuacccuauucccacucccuuccagucgccaacaugcagccagccagugccuuucuggaaauauaaaucagccguccuucuaucaguagcccucaauacaacuaagauuccuuccaaagccuccucuuuggccuaggaaaaagacacgcuuccugagcaccuugucuggucuugcucuccaccugcacuuuccaccuccuuucugcuccagccgcaucagcacuauuucaauucuucacauugaucaggccagucuguaaacaugcuauucccuccaccuuuccuucuuagccugaguagguagguccuacucacacuuuaaaucuuagcucaagcuuuacuuccucaaauauucuuucucuaaucucuccaacuugguugaagcuccuuuuuacaagcccucauagcaacauguaucucuccugcacauuuacacacuuaacacucacguuuaauuauuuuuucccugcguuuuaauuccugaaccucuuuauucccgcuaacuuccacucuaacuucaaucauuccuucuugaagaagcaaaagcucaagacccagagucuaaagcugcaacagaccaagccaccuguaauaucgggcacagugaaaauuuaacugggcuuuuauuuuacuaggacuguaauuuuuguaguguucugauuaaugccuacaaaguucccaagguuuuaagggguugcuccagcuuuauaguuugcauaaguccuguuacuuuuagcgcauugauuuuguggaaaacaugguuuuccagccacgcauucaggacauuauugcagaaacaccgguaucuuccuccagaacacaccauccuguucuauccccuuucuaaagccuucacgucuauacuucaacaucaugggaacucuaauuccucaaacucuuuguguuuuuucucccuuuuuccucuuccaggacaggcuacaugguaaucacuuaaagcucucaaauauccuugauuucccucauaugcccaucauucuaucauauccaaccagcaaaaugacacucucaguaucauaaucuaccuuccauacucccacacuggacaguugacuuccaaugaauaaaguccaaaaucuuaugaacagccacugcuaugaacuaaugaugucaacugagcacucucaaugcuaccaacaauauuuuuagaaauguugucagcuuauucccuaucccucucaauggcuuaguccacauuuucaucauuuacuuuaaacuuuacauccucuacucaaauucaugagcaaaguaccucaccucuuaucaagaaaacaggaggccagcugggugcgguggcucacaccuguaaucccagcacuuugggaggccaaggcaggcggauugccugaggucuggaguucgagaccagccuggccaacauaaaaccccaucuccacuaaaaauacaaaaaguggccaggcaugguggugcgcaacuguauucccagcuacuugggaggcugaggcggaagaauggcuugaacccuggaggcagagauugcagugacccgacguuguaccacugcacuccagccugggcgacaagagcaaggcuccaucucaaaaaaaaaaaaccaaaaaaacaaaaaacgagaggccauuagcuauggucauauucaacucuccacucuuuuauuacaaagugaucuauguccacggcagucuucaccucuuccacuauuaucaaagaacagucuguacucuccucuccaagaccaaccauucuggacucuggaaccaguuuccucucuagaagccucucugucagccucucaagcuuguauuucauuaucuuccucucuaaucucuccuuccccucaaucuguaaagggacaauguccccaaaauguacacuuuucacaaauucuaugccuccgugcuacauauaaaucauugucaguaauguaccagaguuggugguauauaauuuuuuaccuuaaaaguaauaacaaggcugggcgcaguggcucaugccuguaaucccagcacuuugggaggccaagguggguggaucacuugaggucaggaguucgagaccagccuggccaacauggugaaaucccaucucuacuaaaaacauaaaacuuagccaggcaugguggcggguguguguaaucucagcuauucgggaggcugagggaggagaauugcuuaaaccugggauccggccugacaaagcgagacucuguucaagaaaaaauaguaauaauaaccagguaggcuaaucaauuuuauuuguuaaaauguuaaauuuuguauacauuuccuggaacaccauaccuuggacuaauauaauauaguauuuucauuuaauuuaugucgcuucaguuuuaccuauacaaccaaauuaaaacaagauugacuaagaaaugacacaguggucucuaacacaauacuuuccaaaggaauuuuuaaggauaauuuugguuauguaggauuuucaucuucuaugcugacauuagaagcuaaacaccagguaaaacguaacuccacuaucagccguuaaaaauuagaagaaaaaaaaaauccuaccuuaaccuccauccuccucuaggaaaugccucaucucuuccuucaucuauauuucucaaggauaaucucuauucacuauccucucuacuugguccuuucauuuacucuuucaacccacugaaaucugguuuuugccccaucacucaauucaaacugcucucccuaaagucacaaugaucuaauuuccaaacguaguggaaaacuaucugugccuauccuacuaaaccuaucuguugcaacagacacuaaauaucacuuccucauuucuagggaagguggggaggcuguuugagacagugucucauucuguugcccaggcuaaaaugcaguggcaugaucaccgcuggcuacagccucaacuuccuggguucaagcaguccucccaccucgacuuccccaaguuuugggauuacaggugugagccacugcacccucccgugcucagcuucugugacaccaaucuccuugaugucuggggaccuaccauuucuuuugugcucccucuagucuuucaauguugguguucuucaggguccccaucuuuggcccacugcuuuuucucacucuauucucccucucucuuucaaauacucugaguuucaacuaccaccuacaagugacuccuaaaucagucacgaccuagaccucucucccaagcuucagaucaauuaugguuaacugccaacccuuccuaggagaaacugccucacacauugccccuaccgaaagaagugagacccagacuauccuuguaccagcaggguauuuuguauuuuauaauuaccaccauuccuacagcugauucaacacagguuagcaccugacuugaaggccaccaauucacaacauagucuguauugaaaagcucugcccaacuaagaaucauagcaauuagccaggccaaucuguuaagucucucaggaauuugacauaggaaggaaaggauaagccagucaguagggaaaaagaaauaaaacaaccagaaacuagugauuggagcugagucauuuuaauagaauagaauuaagucaugacuauuaagaccaguuagaguccccuuaacuccaaaagaccuguuccuguucuuucuguaaggcuuguuucuuuggcuucuucugguuuccaugaagucagaucacagggcugagauucccauuuuuacuuaucuccaacuauacuguaauacagucuccuucacaaucauuauuuuauucaugguucacugcaagagccuaacagcuaaagacccaaacaucauccuaacagaguuggaaacccaaacauuuucuuugauuucucucacuaucauuccucauauccucucaguauuacuuuuaaauaucucacaaauauaucugccuuucucuggccuuaccacugacccagcugaggucaauucuaacauggucuacugcaauagucuucuaaaugaauuuacuauucccacucuuguaaccucuugaaucuaucuuccaaucagcugcguaaucugacaaaaaugaagauaugagccagucacuucccauuuaaaauccuuugaugauucuccaucuccuacagaauaagaucuaaacucaacaaaauauuccauagggcuccuaacugggccagguacaguggcuccugccuguaauccuagcacuuugggaggcuaaggcaggcagauggcuugagcucaggaauucgagaccagccugggcaacauggcaaaacccccuucucuacaaaaaaauacaaaaaauuagcugggaaugguggcacgugccuguaguugcagcuauucaggaugcugaggugggaggaucacuugagcccaggaggcagagguugcagugagccuagaucgcaccacugcauucuagccuggacaauggagucagacccugccucaaaagagaaaaaaaaaaaagccuccuaauugaucuuuucccagaugcuccuugucacauacucuaaaugccaacccaaaauugcuuguaaaaccagacacauaaaguaauucucuauguuuuugcuuuuccuucauuugcaacaccuagccccucccuuucuccuauauccuacucaucuuuuaagacugaccacuagccucgacuccuccaagaagcuaucccugauaccuacacuuccuucauucuuuccaaugucagccuggguuauacgcuccuccuauuuuccacaguacucucuauaauauuucccuuacuacucuauuuuauguccucugagcucucugaauucaaugacaguaucuucuccaccucugaguguccagaaccuagcacaaaguaaacauucacuaaaagcucauuaaauaaaugaagaaaugaacagugaaaaacacauauaaauugucuagucuagcagaauauauaucauuaggcugggugcagugguucacgccuauaaucccagcacuuugagaagccaaggcaggcggaucacuugaggucaggaguuccagaccagccuggccaacauggcaaaaccccaucgcuacuaaauauacaaaaauuagccaggcgugguggcaggcgcuuguaaucccggcuacuugggaggcugaggcuggaaagucacuugaauccaggagauggagguugcagugagcugacaaagugccaccacugcacuucggccugggcgacagagcaagauucugucucaaaaaaaaaaaaaaaaaaaaaaaaaaaaagaauauacauuauuauugucuacuguucugcaugauuauuagauuuacuugauucuugcaguuaccaacuggcauuuuuaaaccuaauuucccaaaaucuuggcaaguaauucuucaauuccuucauuuuaaggaacauuuuuaggccgggcgcgguggcucacgccuguaaucccagcacuuugggaggacgaggcgcgcagaucacaaggucaggagaucaagaccauccugacuaacucggugaaacccccucucuauuaaaaauacaaaagaaauuagccaggcgugguggcaggcgcauguagucccagcuacuggggaggcugaagcaggagaauggucugaacccaggaggcggagcuugcagugagcggagaucgcgccacugcccugcagccugggccugggcgacagagcaagacuccgucucaaaaaaaaaaaaaaaaaagaaacauuuuuauaucacccccguaaugcuuaacagacauuugcacuuguaagcaagcaugcugaaauaucuguucaaacuuaaaaagugcaagaaauuagauaagcaauuauauuuaggaaguguucaagcgcuaaugacuggggguacaggugggaaagacagaguaaguauaacaaaaguucaaccuaucacuccuguaaucccagcacuuugggaggccgaggcgaguggaucacuaggucagcagauaagagaccaccuuggcuaacacggugaaacccuaucucuacuaaaaauacaaaaaauuagccgggcgucgcggcgggcaccuguagucccagcuacuuggaaggcugaggcaggaaaauggcgugaacgcgggaggcggagcuugcagugagccgagauggcgccacugcacuccagccugggcaacagagcaagacucggucucaaaaaacaacaaaaaaguucaaccuauuugguuauuguucauaacauuucaauuaaaaagugaaauucuggcugggcacuguggcucacgccuguaaucccagcacuuugggagggcgaggcgggcagaucacgaggucaagagaucgagaccauccuggccaacauguugaaaccuccccucuacuaaaaauacaaaaauuagccaggcgugguggcgcaugccuguauucucagcuauucaggaggcugaggcagaagaauugcuugaacccgggaggcggagguugcagugagccaagauggcgccacuguacuccagccugacaacagcagagcgagacuccaucuuaaaaaaaaaaaaaaaggacaauucaggccaggcgcaguggcucaugccuguaaucccggcauuuugggaggccgaggcgggcagaucaucugaggucaggaguucaagaccagccuggccaacauggugaaaccccgucucuacuagaaauacaagaauuagccggacguggugcuaagcgccuguaaucccagcuacucagcuacucaggaggcugaggcagaagaacugcaugaacccaggagaggcugcaaugaguagagauuguaccaccgcacuccagccuggacgauagagcaagacucugucucaaaaaaaaaaaaaaaaaaugcaauucacuauuuauuuacuuauuuuuuuuuuaagauagggucucacucugucacccaggccaucauagcucacugaagccucaaccuccugggcucaaccaauccuccucccucagccuccuaaguggcugggauuucaagugugugccacuuagcccgguuaauuuuuagggguagagacggggucccacuauguugcccaggcuggucuagaacucuugggcucaagcgauccuucuacuuuggccucccaaagugcugggauuacaggcguaagccaccacacccacugaaauugacuauuucauugcuuccuauaauucccaacuuugacuuaccuuggauuucuucuaaacuguucuaaauuaguaaaaucaaggugucuggacuuuucugaagcacuguguuccaguuaccuuuuucccccagaguaaguauuuucaaucucaacuauucuuuaaaaguucuaaaugugaucacaggauuuuaucuacuugagauaauuaagucucauaugaacuuaaagaggcaauacuaugggauugugaaaagaacacuaaaucuggaguuagugaaaauuuucaauccugauuuacucaugacugggaagaucuaaccuccagguucuaccacucucuaaaauuuaaaaugaaaauuccaggaucuuguccagauccacuaguguguguauauauaaagcacucuauaaaauauccaaauagugguaauaacuagaaaaauauaaaaaugcaaucuguuguugaaacauuuaaacuaaguccauugucauauuuauuaaaauuauuuucccguuaucauuauaacuaagucuaaacuugucacauuuguacuuauucaauacugacaacaauuucaaaaauaagaggggcuaucccuggguuuuucaauaguuguugugugacugcuaagcaaaaggccuuuaaaaaaauuucacauauacuauacauacccuguuguuccucugcaauccaaucaaccuuaucugcaugucuaguauuaucuaacauuaaucucuucaaaucauuucaggaacaauacugcuuccaaaagcaguaauuucaauuuagaagaacaucuuaaaaacagaauacaggcuggacacaguggcucaggcuuguaauuccaguacuuugggaugccaaggugggaggaucacuggagcccaaacauucaacacuagccuaggcaacacaguaagaccccaucuccacaaaaaaaaaaauuacaacuuagcccagcauagugacaggagccuguggucccagcuacuugggagauggaggcagggggaucccuugagccuaggaggucuagacugcagugagccaugaucgcaccacugcacuccaucaaggcaacaaaguugaaauccuaucacacacacauacacaaaaacaccagaacaacaacaaaaaaccagaauaccuuuggagcaaaagaaagcaaaauacuucuauuucaaagauaaggaaaauucucgucacucuggaaaauaauuaaaaucauucuuuugaaauucuguaauacgugaauauaugaauaguaguuuuuacuguuaaaagugucucaugauacuuagguaaaaccaaugcagcacaaugauagguuaaauaaaaauucacucuucuuauucugugauuuuaaaguauuaucuacucucuaugauacuucuccuuugcuacugcuacugcuacugggacacaguugcccaccacaaucggcgugguccucucacaaaacacgcagaaaaucaacaguaacaacggaaaacucacacacacacacacacacacacacacagucuacaguaacaagacaagaggaagaggcaguagaaagggaaaaagacuuucugacaagggguaagagagagacaaaggaaagauagaagagaggaaaaauaaaaggauaacaacaaaaucuguucuuccagaaauaaugauuuauguuuauaaaacaguuauguucccagaaagugaaccuuaguauuacacaacagaaaguaauaaagaggccaagaauaaaaacaacugagacagcagugucagaaauauuccaaacuccaacuaauuucauauaaacguguauuuuucucugaccuaaucaucaauuuuauguaaaagacuaaaacuaaucaagacaccuuacaguacuaaauaaacaguaaucacgaaucuuagacaucacggaaauucagagcuggaaauuuccuuaccaaucguccagcucaacuuacacaccacucagaggaagaaacugaggcucagucuuguaaaauaucuacaaccacaaacaacugcagaacucaggaaaucuagaauucuuuguucaucuacacuggcucugacuuuaugagcaaauuauuuacugucaaccauaaauuuaaaauuauaaaauucugucacaucuaacaauagcuuucuggcagccagaucagaaguaaacaccucauaacauagcaccguucacacaaauuaaaacauaaaaguagaaauacuucacaaggaaauuaacaaaagguccuaacuugagaaaaaacaaagauuugauauugugaaugaaacguucagacguuuagauuaaggaggauaacacuuggaaguacuucuuuggauguauggcgagaauaaaaagaauguucaacaaggccuauuuuugugcgugauucuuugcagccaaaucauuugguagauuucuauugccauucgccuuucugauuaaauaguaacuuacuuaucaagcuucuucucaaauuucagucccguauaaguuaagaauuuaaccacaagguuguuuaucuccucuacauacaugucacuaggaucugaguagaccccuuuacagccaaucaaagugaggcugccgugaauguaaaagcuucugcuuuagguuuggggccuaaaacccuggauuuguuuccagacaagacugauacguuagguugauuuuuuuuucuuccacacaaguaaacuugauacaugcuauuaaauugggcuacauuucaauaguucccauagcaauucauaauuuuauauacaacugauuugcuuccagcuuuguuuuaaccuaggagagguaggugagggaggaaaggggcaagcacaagccuaagguuguuguuuuuaacugcaagugcaaaacauaagccaauuuucuucaaaauacuaagcugcauuuuguuccaucuucguuuucaacaagacuucaugugauaucaacaccuaaggaccuguauagggcacuuccaaucgggagggguagguuucugcuccccuaagaaaaaggguguuccugggguucccuucucuuacccucccgguugcuuuuacuaaaauauauugauggcaaacuugggccccuuguccuuuugucccccuagacaaucucuggccuaauuuugauuacuccucccccuguguaucccugcucucucuuaauuagaaaucauaccucagaaucgugccucucuuccccccuuguaagaggagaacgccugacccaccaccuggagaacaauguaacccaacuccgaguccauggauuccucuacccaagccccaagauuuaucucccagggaaaucagaaagccaguucuguccugucaucccggauucccucaagguguccugcuccuggucuaggauuaccagcuccuuucuacccuggggcauucuacucaccuuccuuuuccaagaaucucgccccucacccucggacccuucaccgcgacccccgcgcccacccggagcagcacaacaggcggcgaguggccuccgagggcagagcccgcgagggcgggggucgggggcgggucgagagcggcgcagcggcggccggccacgucgggucagugccccacucccaccgcaggacacacgcccaguaccuuuguagugcacccgcagguuguucugagagaggccgauguagcugaacuuguccuucgggcuccaggaccgaggcagcggcgucucuuguucguccacggccggguagagacgcuucagccgccgcugcaacuccuucuccugcucguucagggccgaguccccgugagggaagggggccgcggcgcugcugcccgccaccagagcuggggucggggcuccuccagccgggccggggcccgcugcaaggcccgggggagcgggcggcccgcuggcgggggcagccgcugaggcagggggaggcgggggcggcggcgggggcggcggggccgcgguggccgggggcggcggcggcggaggguggaggagcagggcggccgccgcggccccuaagccuucgccgcccgcaccgccgccgggcgagccggccggagaagagccggcgcugacggccgggggcgccggcaggacgacuccggagacuggggccaaggccgccggcgguggcggcgacagcugcugcugcuguugcugcugcugcggcggcggcggcggcggcugcccggacaucccggccgcgacucagccugcggccaccuccaccucuucucuccuuccuccucugcuuc

SEQ ID NO: 193001 - RNA, 36248 nt, Homo sapiens
uuauuaaaaaacuuuuuaauugguuuacaaaggaggcuacagacuacauugaaacuaaucuuuguacaaaaggccaaaaaaaaaaaaaaaaaagucccaaaacaccaagagacaaaagguaggaggaaagacaagaaaggaagauacaaaaggagcaggaagaaacuuacuuagggacaagauuagcaucauacauaccuaagaguggggggugagggggaagaacaagaugagagagcauuuaaaagcauuuacccacacagcccuggugauaauuggauuggaaucaaaacaaacacagcaugagauuauuaagagguuuuaaaaggcaacagugguguggacugguuauugccaguguuaagagagaaauaaacuuggguuuuuaggcaccagagauuggagcaccacccaucccuuccagaggaugacagacuuaggaaggggaagcaggcccuggggcagcugccacugguguguguagaugucuccucaggucaaucucaguguaucuuccccgaagucuuugugcccuagacucuagguaagggcuaugggauuucacugggagaaagggaugaucaaaaauaugaagaccugcccuuguccacaauguucaagagcaguuaccgggaaacuggagcacuggguagacagagcccauaucccuggggaaaaggcacaguguaauuccugaaggcaagauaugggaaagcacacaucccagcagagguaucaacaaaauccucacuacuugcagcccuagucuaaucccauuuguuaggcuuuuuuuuuuuuuuuuuccccugauacuuagcuaggacuuagggcaguugagaggcagaucaucaugccucuacuuucuuagcagagacaaggaagacuggggcuguuugauaaugaggaaggggaaaaugggacaaaauacuccucuuucaaaugaacacuguggagaaaaucuuucuggguuuggggaagucagaguaaagacuuaggggaguaauaaagccagagaccccccuucuuuuccuuucccugccuuggaucuaaggcaagugagccaaauuuggaagagggaguaggaauuuaagcuuaaggcugcuuaaugucuuccugggggcugguguuuugggaaggcagacaaagagaaacaggucaaccucaaagcuggucugcucauccucuuagaagaggucugguaucuguggaguagagccaagagaggcaccacagagagcacagucucccaaacagaaguaauaaccggcucauauuuuaucagcaguuuucaaaagcaauguuuuccgggguuggagaagugccauaucuuccucccuuuccccaaagcuacugcugcgaccuuucuuucauccuuguacauaaguuacuggcucucuucuaagggagauaaauucugagauuucacauuuucccucucaaccccaauaggcuacccagcuucagugagggggaaggagagcuaugcaaagggccccucacuugaggcagcuagacuguccuuauuuccuugguaccugaucuccaaaacucuugaucugaucccaagguccaaaaggcaucaggguacuuacacugaaaacuucaagcaaguagcaccagggcucccccuaagcauaacaggggccugauuagcaccccagaagaaccccucaaaaaguauauaaauuuauugcguccuagcaaagaucugcagcuuccaguauucacacaaugugaagauauuaacaauacaaaauauauuuugaaagucaaacaccuguaguucauagugcuuuuuuagauuuguuaaaaaaaauacaaugcuuaguuuccuauauaggauauacaaaagcaaaaaauauauauguauauaguagaaauaaaucagccauaguaauuuacagcuuuugucuccaacccuccccuaaucauaaucuuuaucccacacuucaguauauacuuucugggaucaaaggaucaauuuauucugaaccaggcugagaaauauccauuaaauugcauucuguguagcacccacagagugccaguuggaaaucccugaaggaagacgguguggguuguuacuguucuggguaaaaagugagacagucaaaugacauguaaaugaauauaaaugggcaaccugaaaaccugaaaggaugagggaauaaguguuuuacuaucucaccacucuucugggcauccccugcccugcaaguuuuggucaucuaaaaaauuuaaaaaacucauucaaaaaaaugaaaaaaacuuaggaaaaaaauuucagaaucaauaugcaugucaguuaaauuaauuucuguuagccaaaaguucagggaaacgggguuuuucuguaauaagcuccugacucaaggaauguaggcuccaaacuuccuguggaagagacugaguggcucacuacugcugggagacaaaagaagcugcuucuguuuugaggccaaacaagauacuggaucuggagcuuccuuggugugaagagaacagggcaaguggaaauaauuagauauaaauucacucaugguaaugcuaaugaauaggguugaggguaaaccagcagcuuuucauucgagaaagaaauaccaucaaauuaccuucuaaaagcuuauauccucagcaucauuacauuauuuuauaucugguaauuucauacuggagaagauuccauuccuugaaaugcacuagcaaaauacuguacauuccagugaguuauccugccccuuuccuccaaaagaugccaaaguacaugauuacagacauaaaauaacagguucugaguucugccuuucagugagaauaaaggguaugauaguggcugugcauggaugacuuguaucucagcguuaauagaauuugaucuggggaaaguuccuugccauaguuccugaguugaaaacauaauuacaucuguggagaaaggaccaaauggagugaacuauuguuuagaguauuaaguuacuauaguucagauuaaacaacacacuuacccaaaacuuaauuuggauggauuuuauauaaaauauauaauagaaucauaccaucaucuauuuguagccaaaguaaaaagauuuaugagaagaauaaggacucugcuauagaucuggauguugguuucacuuucaaacacaaaaauaguuucuuuuuaaaaaaguacaguagaauauccuccauucauaauuguaauuaauuuagcauaagcaaagaaaugaccuuaggaacauacccagguuuuaagauagauuucuagguaaugggccugaaaggcauuuugaucugaauuuauuuuccaacgauuucaaauauaauuugucaucuguguguagacauauacgggcaugaacacacauucacccacacauacaaaaacacuugcuuucuaucagaucaggguaauuuuuuuauugcaggucucuuuuaauauuggcuagcagaaaaccuauccccaaccuaacagauuacacacacacacacacacacacacacacacacacacagagcuauuuuuccacacuuccucacagugaaaagcucucuaacaagauaccagaaggucgagagagacaaugcuuuuauggcugggccuugaggacaauucugguugcauuuaaaucucagugccaaaugcacuagguucccugccguuauaauuuuuggaucagucucuucugaaaucaggucacagagaaaacaggaugauuucucccaaucucuccuauaaaacacugugguaagacaagauuucuuuuuguucugggcuaucauucccaugaucaugugcuucccuuucccuuaggaaccacccaagaacauacaaggaaaaguuaagggaaaacaucauaagaaccacugucuugccacuagcacaugcuuuggaggaguucugcagaauggaaaccugaaacagauucacuggcugaugcuccuuauugacaauggaaaagaaccuaguggggauguucaaaagaaguguauuuccuuucagaauauaaacucagaagcccacacaucaaaacuuagagcuaccuuggaagacagcaguaccaaaguccaaauacuccacuaacuccugaaccugacuacgagucauuuccucuucugagcacaugauuuuccuagugaaagcccccuaccuauuauuugaaaauuugacaguuuauacaaacugagccaagauuauuaucuucaaagggacucuuguacaauuccacugaaagacuucuaauucuugaugcucagagcagcuaaugaagggagaugccuuugacucuccagcgccaagaaggugccugcgucaguaguauuuugaacacucccuccacaguuacuucaagcaucagccugggcuucaaggauuuuuccauucugcugcuggaacuaagguccugaaaaaauugacagaagugccucauccaggcaguaacaaaaacaaaacaugaagugaucagaugagagaagaugagacggcaacaguugaguuagggaaggagugcaagaagcugaucccaaacaaaaagacaaaauuaagaaaggaaaaacauuauguauguauauaugaacuaaaagcagagcauaugaacgcuuaagcuggugggaagccaagacaacaucuacagaaaagcuugaugugucacaacaaggcucagccauagggaaauaaggcaauauaaaaaaaaugaccaagguauuuuggucacagaauggucuuccuccucccagccaaccccugugaaugcaucucuauauaucuuuauauauauauauauauauauaauaauauagaaucuguuuuuuguuaaaaaguauuucaaugaucauauauauuuaucaaggcaugauggcuuuaggaaaggggggggaauccaucauggaagagcugagaagagaaaugcaggaaggguaggcugggguaagaaguguaagaagaaacuggggucaaacaaaugcucaucaaagcguggcaccaacagaauuuucacuaauguuucccaccuucaaagaggcacugaugauacagaugggugccgggaccccaucuccucucuuguaucccucuccugauucuucucaacaccaugcauuuuaaugcuucauggcucucucuuccaugucucuuggacccaugcuaccuugcaucccgggguuaagggguauggcccauaugucucuggccccgggugccugaucucagaagccauugccacugauauuaauggacugcagaucugccaccugcaugacguugaugccacuguuggcaagacgggcaaugcccucuggacagauggccuccauggcuaccauauuggugguaauaagggcugaaggaguggcagugccacugccuucugaaccugccccacuguccaggggcaaagugcccacacucagagcuacaccugggccucccuucuuauucuggugggucuugauauguuuugacagguggucacuccucaugaagcgcuuaggacacucagggcaggcaaauuucuucucaccuagguaaaggaagaaaagauaagaagcugacauguuaggaagugagguuaccuuacccaauucagugcuuacucuacuaagcugaguaaggccaguaugagaaggugaucaaaaacaagaaaaaucuucaaguggcugggcgugguggcucacgcuuguaaucccagcacuuugggaggccaaggcgggcagaucacgaggucaggagaucaagaccacggugaaacccugucucuacuaaaaauacaaaaaauuagccgggcgugguggcgggcgccuguagucccagcuacucggagaggcugaggcaggagaauggcguggacccgggaggcggagcuugcagugagccgagaucgcgccacugcacuccagccugggcgacagagacucugucucaaaaaaaaaacaaaaaacaaaaaacuucaaguauauuuuccuuuuggcgggggcgugaggaagaaaacuagauaaagguuggggaguacucgguaaggaagguagaacuuagcaguuuuaaaaguaaggcagggcagagacuaagaguaaugguuucaaugcuucaccuucaaaaaucccacucaaaaucuagcuccuuauuuuauuuuauuuuauuuuuuugagacagagucuugcucugucgccuaggcuggagugcaguggcacaaucucagcucacuguaaccuccgccuccaagguucaagcaauucuccugccucagccuccugaguagcugggauuacaggugugcaccagcacgcuugacuauuuuguaauuuuaguagagacaggguuuccccauguuggccaggcuggucuugaacuccugaccucaagaaauccacccaccucggccucccaaagggcugggauuacaggcaugagccacgacaccuggcuccuuccuuuuuuuuugagacagugucucgcucugucgcccaggcuggagugcaguggcacgaucuuggcucauugcaagcuccgccucccagguucaugccacucuccugccuccaccuccugaguagcugcaacuacaggcgccugccaccaugcccggcuaauuuuuuuguauauuuaguagagacgggguuucaccauguuagccagaauggucucgaucuccugaccucgugaucugcccgccucggccuccaaaagugcugggauuacaggcgugagccacugcacccagccccuccuuccuucuuaaaaauuuuccagauuaacuccaauuccauuugugacccauauauucaguuucaaauuaaguugcucagaaauuuuaguuauuuuguagguauauuuuguguuuuucauucuagucuauuacuauuuuucucucccauaggcucuugcucaccuguguguguacguuugugccucuguagcucauccgaacgugugaagcguuucccacaguaugaccagguacacauaaauggccucucgccuguaugccagcgcaagugugcccgcaggugagaggucuugccauacacuuucccacagccuuggauguggcaaauaugcuguuucuuuuugccaggaucccccgagccccugaaagugaggacacaacuguuaaucauucauucuagagaaaacuaaagaaccacaaaguaucaacagcaaucacccaaucgacaccaaacuaacccaaacuuuuauuuuuugaaaaagucuucuuuuuuguuuuuuugagagagucucacucugucguccaggcuggaguacaguagcaugaucacggcucacugcaaccuccgccuccuagguucaagcgauucuccugccucagccucccgaguagcugggauuacaggugcacaccaccaugcccagcuaauuuuuauauuuuuagugcagaugagguuucgcaauguuggcgaggcuggucucgaaccccugagcucaggugauggaucugcccaccuccgccucccaaaguacugggauuacaggcgugagccacugcacuggaccaaggcuucuuuuuuuuguucguuuguuuguuuugagacggagucucgcucugucgcccaggcuggaguguaauagcgcaaucuuggcucacugcaaccuccaccucccggguucacgccauucuccugccucagccucccgaguagcugggacuaugggugcccgccaccacacccggcuaauuuuuuguauuuuuaguagagacgggguuucaccauguuagccaggauggucucgaucuccugaccuugugauccacccaccucggccucccaaagugcugggauuacaggcgugagccaccgcacccggccaagccuucuuuuuuaaaaagguuucuaggggcugggagugauggcucacgccuguaaucccaacacuuuuggaggccgaggcagguggauugaucaccugaggucagggauccgagaccagccuggccaacauggcgaaaccucaucuguacuaaaaaauacaaaaauuguucaagaccagucuuaucaacaugguccccaucucuacuaaaaauacaaaauuagccaggcgugguggcacaugccuguaaucccagcuacuugggaggcugaagcagaggaauugcuugaaccugggagguggagguugcagugagccgagaucgugccguugcacuccagccugggcaacaagagcgaagcucuuuuuuuuuuuuuugagacagagucucacucugucgcccaggcuagaguguaacggcacgaucucgguucacugcaaccuccaccucccaaguucgagcaauucuccuaccucaaccucccaaguagcugggauuacaggcaccugacaccacgccgguuaauuuuuguacuuuuaguagagaugggguuucaccauguuggccaggcuggucuuguacuccugaccucaggugauccgcccgccuuggccucccaaagugcugggauuacaggcgugagccaccguacccggaugaagaucugucuuaaaaaaaaaaaaaggccgggcgcccccauggcucaugccuguaaucccagcacuuugggaggccaaggcaggcggaucacaaggucaggagaucgagaccacccuggcuaacacggugaaaccccgucucuacuaaaaauacaaaaaauuagcugggcgagguggcgggcaccuguagucccagcuacuagggaggcugaggcaggagaauggcgugaacccagggggcggagccugcagugagccaagauugugccacugcacuccagccugggcaacagagcaagacuccaucucaaaacaaaaaaauaaauaaauaaauuuuuuuggccaggugcaguggcucacgucuguaaucccagcacuuugggaggccgaggugggcagaucacacagucaggagaugaagaccauccuggcuaacaaggugaaacccugucucuauuaaaaauagaaaaacuuagccgggcgugguggcacacgccuguagucccagcuacucgggagacugaggcagaauugcuugaacccaggagguggagguugcagugagccaagaaugugccacugcacuccagccugggaaacacagacugacuuugucucagaaaaaaaaaaaauuuuuuuuuuuuucauuuucucuuuuuauggccaguaaaauauucccacauaauuuuuaaauuuuuguagagaucggcucucgcuuucuugcugaggcuggucucaaacuccugggcugaagugauccuccuaucuuggccucccaaagugcugggauuauaugcauccagcucugagucuuaaauccuaaaaaaaaaaauuaaccuuugccgggcaugguggcucacgcugguaaucccagcacuuuaggaggccgaggcgggcagaucacgaggucaggagaucgagaccauccuggguaacacagugaaacccugucucuacuaaaaauaaaaaaagauagcuggguguggugacaggugccuguagucccagcuacucgggaggcugaggcaggagaauggcgugaacccaggagguggaguuugcagugagccaagauugcgccacugcacuccagccugggcaacagagucagacucggucucaaaaaaaaaaaaaauuaaucuucuuccucuuaucuccaaaucuauuaauuuuucuuuauauuuguaagaaacuggcugggucaacucaccuuccuucacugucuuuacaguaggggcaggugcaugcuucccgccggguccuccgaccggcuugggguugggcaucugggcuguuuucuccuuccucuccaccugcugugucaucauguauuccaucaccaccagccccauggagaccaagcugagcuccaugaucaccugaaauuaagagagaaaagggucaacaugugacaugggcagguuaucacuggcaucucagugauacccuacagucacaacaucauuucuuuugaacugacauccuacauucacaguaucacaaguuuugaagccuuuuuauguuuagccauuccauucacugacaccugaagacucacugaaaucucaagaaucaucauugaaaauaccaagaguggcugggcgcagugguucacgccuguaauuccaucacuuugggaggccgaggugggcggaucaccugaggucaggaguucaagaccagucugaccaauacggagaaaucccgucucuacuaaaaauacaaaauuagcugggaaugguacgcaugccuguaaucccagcuccuuggaaggcugagccaggagaauugcuugaacccgggaggcggagguugcaguuagcgagacugcaccauuguacuccagccugggugacagagcaagacucugucucaaaaaaaaaaaaaaaaaaaaaaaagaaagaaaauaccaagagccaauaaauacguaaaaaucugaucaaaucucauaguuguuuuuuuuuauuauuauacuuuaaguuuuacgguacaugugcacaacguguagguuacauauguauacaugugccauacugaugugcugcacccauuaacucgucauuuagcauuagguauaucuccuaaugcuaucccucccccgaucauaguuuuuaaaaugcaacuccacuuauaacgcauuuguaauuuuucaccuaucagauuaccaaaaguugaaacccuaauaacauacggcauugguaaggguacaggaaaacagacccucccucucucucuuccuucccucccucccuccuucccuccuuccuucucucucucucucuuuucuuuccuuucuuuuuuugagacagagucucgcuggcucuggaguacaguggcauuaucugggcucacugcaaccuccaucuccuggguucaagugauucuccugccuuagccucccaaguagcugcaacuacagguauaugccaccaugacuggcuaacuuuuuuguauuuuuaggagagaugggguuucaccauguuggucaggcugucucgaacuccugaccuuaggugauccacccgccucggccuucgaaagugcugggauuacgggugggcaugagccaccauguccagccggaaagagacauuuucauacacaaauagugauaaauuaauacaacuuuuugaaggccaguuugaaaauauuuaaauguacaucuaauuugaaccagcaaugcccauauauuuacaugugguucugccuguaaccucagcacuuuggaaggcugaggcaggagaacugcuugagauuaggaguucaagaccagccugggcaacauagggacacucugucuauaaaauaaauaauaggcugggcaugguagcucacgccuguaaucccagcacuuugggaggccgaggugguuggaucacuugaggucaggaguucaauaccagccuggccaacaugguaaaacccccaucucuacuaaaaauacaaaaacaaaacaaaaaaaaucagcuggguaugguggaguacgcuuguaauccuagcuauucgggaggcugagacaggaauugcuugaacccaggaggcagagguugcagugagccgagacugugccacugcacuccagccuggccgacagagcgagacuucgucgccaaauaauaauaauaauuagcugggcaugguggcaugcgccuauggucccagcuacucaggaggcuaaggugggaggaagauugcuugagccaagguguuuaaggcuacagugagcuaugaucacaucacugcacaccagccuggccaacagaacaagauuccaacucaaaaaaauauauauaaauaaacaguguaugcuaaaaugcuuuagacucucaucaugacucaguuggucacauuugacauuuucaaacacagcucuaggccacugguaaaaagugacagauaauauucuuuuuuuuuuuuuuuugagacugaguuacacucuuguugcccaggcuggagugcaauggcacaaucuugacucauugcaaccuccgccuccuggguucaagcgauuuuccugccucagccuccugaguagcugggauuacaggcacccaccaccaccccuggcuacuuuuuguauuuuguuguauuuuuuuaguagagaugggguuucaccaucuucgacaggcuggucucgaacuccugaccuugugauccgcccgccuuggccucccaaagugcugauuacaggcgugagucaccgcacccggcugauaauauucuucgcaaaaguaauaucuuauaaaguggcagauaauauucuucucaagacuucuuuccuuuuuuuuuuuuugagacggagucucgcucugucgcccaggcugaagugcaguagcgcgaucucggcucacugcaagcuccgccucccagguucacgccauucuccugccucagccucccuaguaggugggacuacaggcgcccgucaccacgcccggcuaacuuuuuguauuuuuaguagagacgggguuucacuguguuagccaggauggucuuggucuccugaccucaugauccgcccgccucggccucccaaagugcugggauuacaggcgugagccaccgugcccggccuuuccuuuuuuuaaggagaccgggucucaccauguuguccaggcugaucucgagcuccugggcucaagugauccucccgccucagccccccaaaauguucuguugugauuauagacauuagcuacugcugccuagccuuucucaaauuuucaaagcauuuacuauaaauaaguauuagucuaucacagcaucuuguaaacaaguuagcaacucuauccauauauuuaauaugucugggaaggcacgguggcucaugccuauaaucccagcaccuugggaggccaaggcaggaggauucuuugagcccaggaguuugagaucggucugggcaacacaguuaagaccucaucucuacaaaaaaaaaaaaaaauuagcugggcaugguggcgugugccuggagucccaacuaccugggaggaugaagcaggguaaucacuugagccugggagauggaggcagcagugaguccugauuguacaacugcauuccagccugggugacagagcccaucucaaaaaaacaaaaaaccaaaaaagauuucuauaaugcaagguguuaacuuggacugcuuuguuuuaucuauuuuaaaaggaaagaaaguaacuaaacgagguaggacagacuuaacaucuagaaauccagguucuugauuuuacuucuguaccuaaucucuauccuuuucagcucuuccacauaauuuugaguuacuaugccuaauaaaacucuccuugugcuuuccuuccaauucuuuuuuuuucuuucuugagacggagugggagugcaguagaaucuugguccacugccaccuccgccucccugguucaagcaguucuucuaccucagccucccgaguagcugugauugcagguagaggcucccgccaccgugccuggcuaauuucugcauuuuuuuuuuuuuucugagauggaaucucugucgcccaggcuggagugcaguggcacgaccuugacucacugcaaccucugccucccagguuccagugauucuccugccucagccuucuaaguaacugggacuacaggcuacaggcaugcaccaccacgcucgguuaauuuuuuacuuuuuuaguagagacgggguuucaccauauuggccaggcuggucuccaacuccugaccucaugauccgcccgccucgaccucccaaagugaugggauuacaggugugagccacugcacccggcugcauuuuuaguagagacaggguuucaccaguuuggccaggcuggucucaaacuccugaccuuaggugauccgccccccuuggucucccaaagugcuggcauuaccagccugagccaccuugcccggccuccuucucauucagucacuuuuacggagcaguccaggccgggcgcaacggcucacgccuguaaucccaguacuuugggaggccgaggcggguggaucaugaggucaggaguucgagaccagccuggccaagauggugaaaccccuucucuacuaaaaauacaaaaauuagccgggcaugguggcgcaugccuguagucccagcuacuugggaggcugaggcaggacaaucgcuugaacuugggaggcggagguugcagugagccaagauccugccauugcacuccagccugggcgacaagagcaaaacuccgucuuaaaaaaaaaaaaaaaaaaaaggugcagccuauggcacuaaaauaaauuuaaucagaacgucugagauuuucaugauauugguagagcugaaacuaggaaaauguacuggaguacaggguuaagaacagguuuuggaguaggagaaacuuagauaugaguccuuucacaaccauuugauuaaguuucugauaaugagcaaaaacuuuucuggucgucagcuucuccaucaguaaaacugcgaccaauuaucaacuucauaaaauuacugugaaaaacaaaugaagaggcucacaccuauaaucccaacacuuuacaaggccgagcuggacagaucgcuugaggccaggaguuccaggccagccuggccaacaugaugaaacuccuucuuuacuaaaaauacaaauauuagcugggugugguggugggcgccuguaauccuagcuacuuggaaggcugaggcaggagaauugcuugaaccugggagauggagguugcagggagccaagaucacacauuguagcuaacaguauuaggaaaauaucuuaaggaguggcaaaaccauaguaaguaaucaugaaauaagauauacaccaauauuuucuuuaaucaacacuaagcauggccccaaaucauauuuucuuaaaauaaguaaugauuaugaugaacauaucaaaauuuucuugacucugcaguuuacaucucaauaugucuugccaguaucauugcucguugugugcaugaaauagauaagagcauucaaagcuuuuuuuuuuuuuuuuuuuucccagauagauggagucuugcucuugucgcccaggcuggagugcaauggcgcgaucuuggcucaaugcaaccuccaccuccuggguucaagugauucuccugccucagccuccugaauaccugggauuacaggcgcccaccaccaugcccggcuaauuuuuguacuuuuaguagagacaggguuucaccauguuggucaggcuggucucgaacucccgaccucaggugauccacccgccuuggccugccaaggugcugggauuacggcacgugccaccgugccaggccagaaaaacuuaauauuucuaggaauuaaguaaaacaguaagacugccaaggauaguaauaaaauggggcaaccaauauguuuaagaucaagauauagacucacccagaugagguggcucaugccugcaaucccagcacuuuggucuuuaggagccugagacagguggaucaccugaggucaggaguucgagaccagccuggccaacauggugaaaccuugucucuacuaaaaauacaaaaauuagccaggcaugguggugggcaccuguaguaccagcuacucaggaggcugaggcaggagaauggcgugaaccugggaggcggagcuugcagugagcugagauugugccacuucacugcagccugggcgacagaacgagacucugucucaaaaaaaaaaaaaaaaaaaaaaaauuagcccaguguggugguacacaccuguaaucccagcuacuccggaggcugagacaggagaaucgcuugaacccgggagguggagguugcagugagccuagagcguaccacuccagccugggcgacggagcaaggcucugucucaaaacaacccaaaaaacaaaacaaaacaaagauacagacucgaacucaucacaacugaaucuaacccaguaacuccacuccuauguauauaaccaagagaaauuaaaacauacguucacacaaaaacguauaaacaaauauucauagcagcauuaugcaugauagcuaaaacacagaaacaacccaaauguccaucaacuggugaaugaauaaacaaaaugugguauauauacacaaugaaauauuauuuggcaauaaaaaaaagaguacuaacacaugcuacaacauggaugaaccuuggaaauauuaugcuaauugaaagaagccagucauuaaagaccacauacuguaagauucuauuuaugugaaauaucuagaauagucaauucuacagaggugaaaaguacauacauugcuuggggcugagagugaacgugagaauggggcauggcugccaaugggcaagagguguuucuuuguuggaugaucaaaauguucuuggguuguagugaugguugcacaauccugugaauauacuaaaaaugauuaagccgggaccgguggcucacacugguaauccaagcacuuugggaggcccaggagguggaucacuaggucaggagauugagaccauccuggccaacaugaugaaauucccgucucuacuaaaaauacaaaaauugccaggcgcgguggcucacgccuguaaucccagcacuuugggaggccgaggcgggcggaugaccugagguugagaguucaagaccacccugaccaacacggaaaaaccccgucucuacuaaaaauacaaaauuagccgggugugguggccuguaaucccagcugcuugggaggcugaggcaggagaaucgcuugaacccaggaggcggagguugcggugagccggagaucgugccacugcacuccagccugggcaacaagagugaaacuccaucucaaaaaaaaaaauaaaacaaauaaggcagggcgcgguggcucacgccuguaaucccagcacuuugggaggccgaggcgggcggaucacaaggucaggagaucgagaccauucuggcuaacauggggaaacccggucucuacuaaaaauacaaaaaauuagccagaugugguggcgggcgccuguagccccagcuacucucaaggcugacagaagaauggcgugaacucgcgaggcggagcuugcagugagcugagaucgcgccacugcacuccagccugggcgacagagcgagauuccgucucaaaaaaaaacaaaaacaaaaaacaaaaaaacaaaaauuagcugggcaugguggagcacaccuguagucccagcuacucgggaggcuaaggcucaaaaaaacaaaaaacaaaaaaguuuaaucaaauauuugauaaggauguucaucacaguauugcuuauaacagugaaauuuuggaaacaaauguacaucaauaagguuaaguuaauucuaguaauucuaauacaaauacccuauggaauuaccauaaaaucauuuuaaaugaugcagacuuacauuuacuuacacagaaaagauguucaugacacaguggucagugaaaaugguuacgaagcacuguggauaguaugaucauacuuaagagcauauugacaaaacuauauauagauuucuuuauaaauuguacagaaauguacaaaaagauggcuggaaggauguucaccaaauugucaacagugaauccauuuggacaaauuucaguaaauuuuacuuucucuauuaauuuugcauuguuugacuguuuuuaaucgauauuauuuauagauaauuguuacuuauuuuucccauccucaaaagaaguuugcaaauuuaaguucuacagaucuuuaucaaguaaaugcuuuuaauuuucucauuacccacacugaaacuguaauuugcaucagcaguccuuugugcacaaccacaguucuccuucacaucguauuuauucuguacccaaauguuuaugguagcaagaacauuuuauauuauuaaaacauaaaaauaaaaagacuggguuugguggcucaugucuaaucccagcacuuugggaggccaaggagggugaaucacuugaggucacaaguuugagacaagccuggccaacauggugaaacccugucucuacuaaaaauacaaaaauuagcuaggcgugguggugcaugccuguaaucccagcuaccugggaggcugaggcaggagaauugcuugaacccgggaggcagagguugcagugaaccaagaucauggcacugcacuccagccugggagacagagcgagacucugucucaaaacaaaaaacaaaaacaaaaaaagaggugguuccugcccuauaggcaguuaagaucuaaaacacugacaaaucuaaagugguuaaagugguacaaagaauagcuaauacuuagauauuuguucauauguauuuguauaucuauaaaucuacaucacaagaaauuaaguaguuauaaucauccuacuucuauaagcagaagucaagaaauuccacuaaauuaacagucaguucagaccaaaauaguuuaauuuucuacugucauuuugcacuagaagauuaaaguaaggaaguucaucuacacacacaaccauaucauugucugauaagaccaaagguucaguagcaauguuaaaaaguguuaacaaagggggcuuuuaugggcuuuacuaguauuuguaaugcauuguguuucaugaacuaggauacaaguaaaagauuaucuacggucgggcgcaguggcucacgccuguaaucccagcacuuugggaggccaaggcgggaggaucaucugaggucagggguucaagaccagccaggccaacauggugaaacccuaucucuacuaaaaauacaaaaauuaucugggcacgguggcaggcgccuguaaucccagcuacucaggaggcacagguugcagugagccgagaucaugccacugcacuccagccugggcgaagagcaggacuccaucucaaaaaaaaaaaaaaagaaaaaaaaaggaaaaagagucgcuugaacccaggaggcagagguugcagugagccaagauugcaccacugcauuccagucugggugagagagagagacuccaucucaaaaaaaaaaaaaaaaaauuacuauauuauccuauauaguguuuagaugucuuaaauuaccucauaaacauuuuugaaguguugggguuuuugagcggaggaugagaugggugacaggaauuagcugagaguaagaaaaguaaaacaguacuuuagugaaaccagggucuaaggccaggcgcaguggcucauauuuguaaucucagcauuuugggaggcugaggcaagcggaucauuugaggucaggaguuugagaucugccuggccaaaaagcugaagucuccucucuacuaaaauacaaaaauuagccaggcgugguggcaggcgccuguagucccaguuacuugggaagcugaggcagaacugcuugaacucaggagguggagguugcagugagccaagauugcaccacugcacucuagcuugggcaacagagcaaaacucccgcucaaaacaaaaaacaaaacagggucuagaaagguaaaugaaaaaggaaaaaaaaugauuuuuuuuuaauuuacagaaaacagaacaacucucaagaaaacaggagaggccgggugugguggcucacaccuguaaucccagcacucugggagacaaagguuggaggaucacuugagcccgaguuugaggcugcaguuagccauguucacacucuaaaaaaaaaauuguauuuuaauaaauaaucuaauaacaucuaacacaguacccagaagacuauaacauaaaucaaaacauuuauggcccuauuauuucauacauuugucugcaacuuucagaaacaggugagugaaaacuggucuccucucaaguacacuaaguaaagcuauagcauaaaagcaaccggagcacagaagcacacuaugaaggcagcaaccuuaucuguuuuuuguuuuguuuuguuuuguuuuugagauggagucucgcucugucgcccaggcuggagugcaguggcaugaucucggcuaaccgccagcuccgccucccggguucaagcgauucucuugccucagccuccugaguagcugagauuacaggcgcacaucaccaugcccggguaauuuuuguauuuuuaguagagacgggguuuuaccacguuggccaggaugcucuccaucucuugaccugaugauccacccgucucggccucccaaagugcugggauuacagacgugagccaccgccccuggcuuuuuuuuuuuuuugagacggagucugucacccaggcuggagugcaguggcgcgauguuagcucacuguaagcucugccucccggguucacgccauucuccugccucagcguccugaguagcugggacuacaggugccugccaccacacccggcuaauuuuuuuuuuugagacaagagucucacucugucgcccaggcuggagugcaauggcgugaucucggcucacugcaaccuccacuuuccagguucaggugauucucccgccucagccucuggaguagcugggacuacaggcgugcgccagcacacccagcuaauuuuuguauuuuuaguagagauggaguuucacuauguuggccaggcuggucucaaacuccugaccuugugauccacucgcuucagccucccaaagugcugugauuacaggcgugagccaccaugcccagcuacgcccaguuaauuuuuuuuuuuuuuuuguauuuuugguagugacaggguuucaccauguuagccaggauggucucgaucuccugaccuccugaucugcccgccuuagccucccaaagugcugggauuacaggcaugagccacugugcccggccuagcagcaaccuuaucuguuucaaggacuccaagaagcuagggcauuggcacauaauaaauguucaauaaauuuugcuaaaucugucuaugaaggaaguaccaaaaacuggaacucauuuuuacuuuuauacuuuucucauucuugagccugcuaguaauuuauuacuaaguauacugguguucagcaaaugccuauguaaguuaacuaaaucauaaguauaacugaauuucuuaaacagcacuuaagaaagguaaauaagaagccuuaaaaugugauaacaccagacacucuuuuuuguuuuuuaaugugacaagacagaagauacaaauauucuuuuguuuuuugagacggaguuucacucugucgcccaggcuggaguacaguggugcugucucaacucacugcaaauuccaccucgcagauucaagcgauucuccugucucagccuugggaguagcugggauuaaaggcgcgcaccaccaaguccagcuacuuuuguauuuucaguugagacgagguuucaccauguuagccaggcuggucuugaacuccuggucucaagugauccgcccaccuuagccucccaaagugcugggauuacagacaugagccacugcacuuggccagaagauacagauauucuuucaaagggacaccaaaccaaagaaacuugugcccauaaucccagcuacuggggaggcugagucggaggauugcuugaacccaggaguucaagacuacccuaggcaacauagaaagaccuuaucuccagccuggcgcgguggcucacaucuguaauccuggcacuuugggaggccgaggcggguggaucacgaggucaggagauugagaucauccuggcuaacacggugaaaacccaucuccacuaaaaauacaaaaaauuagcugggcaugguggcaggcgccuguagucccagcuacucgggaggcugaggcaggagaauggcaugaacccgggaaguggagcuugcagugagccaagaucgugccacugcacuccagccuggacaacagagcgagacugcgucucaaaaaaaaaaaaaaaaaaaaaaaaagaccuuaucuccaaaaaaaaaaaagaagaaaagaaaagaccacgcagcacaguggccgauauccguaaacccaacauuugggaggcugaagcagacccacuugaucccaggaggucaagggcugcaguaggcccugauugugccacagcacucugggcaccagagcaauacccucacaaaaaaaaaaaaaaaaaaaaagauacuuuuaaaaauaacacaaaaagaggagagagagaaagaaacuugauuuuuuggaaaauuuccaaacagguuucacaguuaagggcuuuuuaucuucuuuaaggcaaaugaucuacacaaaauuuauuuuuuucaugagugcaagaaaccagucaaagaauucuaagcagaguacguucuuuuuuuuucucgagacggaguuucggucuuguugcccaggcuggagugcaaugguucaaucuuggcucacugcaaccuccaccucccggguucaaaugauucuccugccucagccuccugaguagcugagauuacaggcaugcaucaccacgccgggcuaauuuuguauuuuuaguacagacggggguuucuccauguuggucaggcuggucuugaacucccgaucucaggugauccacccaccucggccucccaaagugcuuggguuacaggcgugaggcaccacaccuggcccaccuucugguuuucaaaggcuaauuaaaggcugggcacaguggcucacaccugcaaguguaaucccagcacuuugggagaccaagguggguggaucaccugaggucaggaguucaagacuagccuggccaacaugaugaaaccccgucucuacuaaaaauacaaaaauuagcugggcaugguggcccacaccugcaaucccagcuacucgggaggcugaggcaagagaauugcuugaacccaggaggcggauguugcagugagccaagaucgcaccauugcacuccagccugggcaacaagaggagaauuccgucucaaaauugaaaaaaaaaaaaaaaggaaaaugcaguccagaugcgguggcucacaccuguaaucccaacacuuugggaggcugaggugagcagaucaccugaggucaggaguucgacaccagccugaaaaacauggagaaacuccaucucuacuaaaaauacaaaauuagcuggcaugguggugcuugccuguaaucccagcuacucaggaggcugaggcaggagaaucgguugaacccgggaagcagagguugcggugagcagagaucgcgccugggcaacaagagcaagacuccgucucaaaaaaaagaaaaaaaagaaagaaagaaaaaagagauggggguuucacuauguugcccagguugguuucgaacuucugggcuaaaccaguccucucgccucgaccuccgaaagugcugggauuacagacuugagccacuaccugccuaagucuuugucuugaucuagguauuuuauauuuuaaaacuccuucuaggccaggcgugguggcucaugccuguaaucccagcacuugggagguugaggcaggcagaucacgaggucaggaguucaagaccuggugaccaacauggugaaaccccaucuguacuaaaaauacaaaaauuagccgggcaugguggcgggccaccuguaaucccgguuacucaggaggcugaggcaggagaaucgcuugaacccgagagguggagguugcagugagcugagauacugccacugcacuccagccugggcgacagagagagaccuuaucucaaaaaaacagcaacaacaacaaaaaacaaaaaacaaaaccuccuucuaggccaggcaugguggcucacgccuguaaucccagcacuuugggaggcugagguggguggaucaccugaggucaggaguucgagaccagccuggccagcguggugaaaccccaucucuacuaaauauacaaaaaaauuaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaauuagccagguguggcugugggcuccuguaaucccagcuacuuaggaggcugaggcaggagaaucacuugaacuugggaggcagagguugcagugagccgagaucacgccacugcacuccagccucugucacaagagcgugacuccgucucaaaaaaacaaaaaacuccuucuucuaagugguuaaauuauuuauuuuguauauaggugagaaggaggauucauaauaaauuagauaugcacauccaaaguugucaaacaagucauauugcccaauuuccacaagccauucagaguccaaaaaacacuggaacaaaaggacaaauccaaauuacagcacagauuugcaaccaacucaaagauacacuuagaaacuuucuacagaaacguuuuucaggauagccauaaaaaagaaugaaaucauaucuuuugcauccaugucuggaugcagcuggaagccauuaucguaagugaauaaacgcuggaacagaaaacaaaauacugcauguucucacuuguaagugggagcuaaacauugaguauucauggacauacagauggcaacaauagacaccggggacuacuagauaggggagggucggggguaauguuggaaaaacuguuggguugcuaugcucaugaccggacccggguaacaagaucauuuguaucccaaaucucaagaucauauaacaaacaaaauaaaaguugaaauuacuuaaaaaaaggcugggcgcaguggcucacaccuguaaucccagcacuuugggaggccgaggcggguggaaaccaaggucaagagauggauaccauccuugccaacauggggaaaccccgucucuacuaaaaauacaaaaauuagcuaggccugguggcacacgccuguagucccagcuacucgggaggcugaaggaggagaaucgcuugaacccaggagguggagacugcacuccagccuggcaacagagcgagacuccgucucaaaaaaaaaaaaaaaaaaaaagacauuacuuaaaaaaaaaaaguucucagucuucuaagggaaauaauucuuaaagucuaacacaguauuaacaauauagucauaucacagugugggcaaauauauuuuaaaguaauccuuuagcauaccaggcccugcauacugcuaaauguuaaagaaaaggauaauaauacuauuguaacacuuucuguaagaaauaugaaaaauaaugugcuugcuuuucuauuaaauaguaaaaugaaaaaacucaacuaauuauuaucuacuaaaguugacagacacccaaaaaguaacuuaaaaagcaugauauaauaacuuuccuacagauguucaucuuacauuuuaaaacauuuucaaagaggguaaaaaaaagcaagucaugagcagaauuauuaguugcacguuuacaugcuacuuuacaaaaugaaacaaagggaaagggagauagaacagauacuaaacguuucugaaacagaaggcacucuuguuauuuaauuaagaacuaaaauggccccauuacacaaggcaacgugauuuaacaaugacgucauuuauaaagagaaagccacuggaaugaauaaauaggagcaauggaaaaggucugaagacugucuucucauaucccacugauuuucaaaucaaagcacuuagauuuuuuuuuuuugagacggaaucuagcucuguugcccaggcuggagugcaguggugcgaucccggcucacugcaaccucugccuccaggguucaagcaauucuccugccucauccuccugacuagcugggacuacaggugcgcgccgccaugcccggcugauuuuuuguauuuuaguagagacgggguuucaccauguuguccaggcuggucacgaacuccugagcucaggcaguccacccgccuuggccucccaaagugcugggauuacaggcaugagccacugcacccagcccccucaaagcacuuagauuuuaaaugagaucuuuccuacuuaaacugaaauaaccauuuaaaaagcaccaaacacccuaagaaacaaguauaucuuucugugcugauaucucuagaaaauaaauuuuuuaaauuaaaaagagaaacaaguauaauacuagggaaagacaaaagacgcagaaacauucaacauuauauuugauaaaauauaaucuuaaaauagaaaauucuuucauaugaccuuuugcacaaaaaugauaacugguaagacauuuaaaucaucuaaaccuacuuuucauuaauguccaaauguacugcucuaaaacacaacuuuuuaacaaauuagcucucagcaaucugacuccaaguuuagugacacccuuggcaaaccaacccugguaucacauucaacuuaacuucuaagagaagacauuuuccugaccccaauaaaacccagcagaugugaaauuguuauuuuuaguaccugaaauuugguuugugaaugaauuauacccaucaaggaaauauguucuauucuccugccaaagcccagcccugcacucuuuauuagacagaacucacaagaagucauccaaacuuaaaucuuuaaaagccaacuccccgucaaccugcggcaagaguuucaggauucagcagcggcuaagaaaaacaucugaggcuuuaaaugaaaaguaaaauaaaauaaaauaaagaucugggaaaauaugacuacaaaaugaaaggaaaagcuguugauaaaagagggaggggugucaauuuaaaaaaaaagaaacaucacgccuguaaucccagcauuuugggaggccaggagaucgagaccauccuggccaacauggugaaacccagucucuacuaaaaaugcaaaaauuagcggcugggcacaguggcucaugccuauaaucccagcacuuugggaggccgaggcaggcagaucaccugaggucaggaguucaagaccagccuggccaacauggugaaacucaaucucgauuaaaaauacaaaaauuagccaggcgugguggugggcauuacucgggaggcugaggcaggagaauugcuugaacccaggaggcaaagguugcagugagccgagaccacaccauuggacuccacccugggcaacaagaaugaaacuccgucucccaaaaaaaaaaaaaaaaaaaagaucauuuuaaaaaauaaugaauguaaacagacuaagugaacaccauggaagcugcaaucuuccacaaucauguaauauaucucauuuuguacagugauauauacauguaucauacaacauuucacauccaauguucuuucuacaucguaccaagaaguugaacauacugcaaaaagguuaaauuuuacaguaaaauaacuaucagagaaggggguaaaauuagauacuuuuuuuuuuugacagggacucacccuacugcccaggcuggagugcuguggcgugaucauggcucacugcguccucaaccucccgggcucaggcaauccucccaccucagccucccaaguagcugggacuauaggcgugugcuaccaugcucagguaauuuucauauuuuuuguagagaugggggaucccuauguugcccaggcuggucuugaacuccugagcucaagagaucugccugccuuggccucccaaagugcugggauuacaggcaugagccacuacgccuggccaaaacaagauacuuuugccagcaggaaggcaaaagcugaaaaaggaguaagccucuaggaagugauuuuauuaucuuucuuuaaggaugaagucauaucaauuaaaggggaaauacuacacaauuauuacuagccagaaaggagaaaacuuggaucuucaaaaaccccuauuaaugaagcaaacaaucucaacucuuacaaaacagccugucaaugccucauuaucuccuuagugaaugucaagcuccucuuaccuuacagaaacacacacgcauuuucuucagcucaaacaccaucaguaacaacuagguagcccuagucuaugacauauuaaauggcagacuuccccagagcaugauuuagcaaugagaaugccucauaacuguucucuaaacccuaaguuauaagccuuuuagaaauugcaaggauccaaauuauuaacaggaauaaucccacaguuugcucugaagaagagcaaaaccgggcacuucaaucuaagagcaaauagaaaauaaacaugaugguguagguugcccagaagugucuaauuuucuacguuguagaggucaguuuuuauaaaacuuuucccauuucuauucccauaaauguuuaguuuauaaaacauuuuuauaaauguuuuauaaacaucugucaguuuuagagcauuaaaucuuaaaucaaaaacaccuuuucgaauacauuuuuuuuuuuugagacggagucucgcucugucacccaggcuggagugcaguggcacaaucucagcucacugcacgcucugccucccagguucacaucauucuccugccucagccucccuaguagcugagauuacaggcacccaccaccacgcccagcuaauuuuuuuguauuuuuaguagagaugcgguuucaccauguuagccaggauggucuugaucuccugaccucaugauccgccugucucagucucccaaagugcugggauuacaggcgugagccaccaggcuggcucgaauacauuuuuaacaaucuaaagaauuguucaagucccuaguuaaaacagguugcacccuagacuaguaaaacuagccucagcucuggcuguugucucauuaagugauucucuguaccucaauuuccucaucuagaaaauaaggcaguuguacuaaauaacuucagucccuuccagcucuaacuuucaauucuaagauuucaauuaacuaagaaaauuacugucuuguuaaagcucaacauguaguauuucuaaacacaccacaggaauguaagaaaucagggaacuuaagcagacuuucccccuagauuuaccaaaacugcaggaggcaggaaauaugguugccuauuugcuacccucacuuauguaagaaucaguuaaauggaaugagaacuugguaacaaaaguaaacaauuuauaaacccacauauauaugccaaaagaacuagaaguggccaggcgcaguggcucacgccuguaaucccagcacuuugggaggccaaggcgggcggaucacgaggucaggaguucgagaccagccugaccagcacagugaaauccaaucgcuacuaaaaaaauacaaaaaauuaaugggcauggugggacgugccuguaaucccagcuacucgggaggcugaggcagaagaauugcuugaacccggaaggcagagguugcagugagccaagaucgcaccacugcacuccagccugggagacaagcuagagucagucccaaaaaagaaaacgaaaaaaaaaaaaaaaacaaaccuagaaguugggugauauuauuuggugauauuaaacuauuuuccguauuuguauaauugugccagcauauaaagauguauguguauccuuuuauugugcuuuauuaaagauuagcuccauacaauggaauuuaaaaugauaaagucaggccgggcauaguggcucacaccuguaaucccagcaguuugggaggccaaggcaggcagaucacuugaggucaggaguucgagaccagccuggucaacacagugaaaccccgucuccauuaaacaaacaauuaggcgggcaugguggcacacgccuguaaucccagcuaccugggaggcugaggcaggagaaucacuggaacucaggaaggggagguugcagugagcggagauugcaccacuccacucacuacagccugggcaacagagcaagacucagucucaaaaaugaaaaaaaaaaaaaaaaaaagauacagucuacauagacuuacaucuguuuacuguuuuaaauuucaaauuaauagugaaacauuuaguucaaaaugaaagacccugaacauuauggucaacagauucaauauucuucccagacuguuuuucccuucaaugcucuccucauuccuaacucuucucaauccuacaucccccacuccauuccagaccccaacuuaccccacucccuuuccuucucccuuccuaaccacacacaguacuuucaaagcagucuaggaaguuagacugcuaccuagaaguaucagaaucaccuaggaugcucauauguuagugugaagggaagcuaugggauuuuguuuuucagauaacuaggaguuaaaaaaaaauucaauccugauuaaccagcacacucagagugugggauauucugguuaauacuaaccagggaacuuacuucguugaaaagcaacccguuagaucauuuucccuucaauuaggaguuacaguucacaagaaauaucugaugauuuaaucuguguucuacaaacagguaaaauucauaaucaauuuuuuuuuuuuuuuugagacggagucucacucugucacccaggcuggagugcaguggcacgaucuuggcucgcuccaagcucugccucccagguucaagcgauucuccugccucagccucccaaguagcugggacuacaggcuuguaccaccacgcccggcuaauuuuuguauuuuuaguagagacgggguuucaccauauuggucaggcuggucuugaacuccugaccucaugaucuguucaccucggccucccaaagugcugggauuauaggcgugagccaccgcgcccagcccauaaucaaauuuauuuuuauuuauuuuuuuuuuuuuugagacggagucucgcucugucacccaggcuggagugcaguggcgcgaucucggcucauugcaaccuccgccucccugguucaagugauucuccugccucaggcuccugagucgcugggacuacaggugcgcgccaccaugcccagcuaauuuuuuguauuuuuaguagagacaggguuucacaguguuagccaggauggucucgaucucuugaccuugugauccacccgccucggccucccaaagugcuggaauuacaggcgugagccaccgcgcccggccgccuuuuauuuuuauuuuuugagacagggucuugcucugucaaccaggcuggagugcagugaugugaucucggcucacugcagccucugccucccagguucaagcaauucuuggccucagccuccugaguagcugggacuacaggcgcgcaucaccaugccuggcuaauuuuuuuauuuuuaguagagaagggguuucgccaugcuggccacgcuggucuugaacuccugaccucaggugacccacccaccucagccucccaaagugcugggauuacaggcgugagccaccgugcccagccacccgacuaauuuuuguauuuuuuuuuuuuuucagagucucacucuguugcccaggcuggagugcaguggugcaaucuuggcucacugcaaccucugccucccagauucaagcaauucucaugccuuagccucccgaguagcugggcccauaggcauguaccaccacacccggccaauuuuuguauuuuugucgaagacaggguuucgccauguugccccagccggucuugaacuccugaacucaacccauccaccugccucgucuucucagugccugcauuacaggcgugagccaccacacccggcccauaaucaauuuuuauccuauggaggaguuggccuacaggccaaagaaggccuuagagcuaagaaugguuuuacauuuuuaaagggguguggaaaaaaaacauacaaaacagaaaauguggcugggugcaguggcucacaccuauaaucccagcacuuugggaggccgaggcagguggauucacaugaggucaggaguucgagaccagccuggccaacauagcaaaaccuugucucuacuaaaaauacaaagauuagcugggcgugguggugcucgccugcaaucccagcuacucaagaagcccaggcaagagaaucgcuugaacccgggaggcagagguugcagugagccgagaucacgccacugcacuccagccuggguaacagaguaagacuccaucucaaaaaaaaaagaaaaaagaaaaaaaagaaaagaaagccgggcgcgguggcucacgccuguaaucccagcacuuugggaggccgaggcgggcggaucacgaggucaggagaucgagaccauccuagcucacauggugaaaccccgucucuacuaaaaauacaaaaaauuacccgggcgugguggcaggcaccuguagucccagccacucgggaggcugaggcaggagaauggcgugaaccugggaggcggagcuugcagugagccgagaucgcgccacugcacuccagccuggaugacagagcaagacucugucucaaaaaaaaaaaaaagaaaagaaaaugugaccacaugaggcccacaaugucuaaaauauuuacguuacuaucuggcccuuuacagaaagcuugucaaccauuauucugcagcaccaaaaacacugaguauuacagacuccagaauauugcccagaagugcuccuuccucaaacuaacuggagaaguuuccuuuacuucaguuccaaauuacuuaaacagaaucucuauuucucaaauuuauuugccuaaaugacuaacccucaagaaaguguuaucucaaaaggcucuauuccuuucuuuagacucaaguuucagcuacgaugcuagaguugguucccaauaaaugcacaagauuggaaaucuuaccuggggcauuugcuauagccaacggcaggccuugaauugggugcaccuggauuccugaaguacccaaugcacugagguuaauggucuggaggccuggcauggaggagaguugagcagcauucacagugacugugccagcaggaauggaagcagcugaggcaaugggugugagagugguguugcugcugcuggucugccccaaggaaacacccugcauuggggcuaaggugauuguuugggcuuguggguucugaacuuggagguucugcagcuguagagucugccaacugaccuguccauugggccccacuguugguguccggaugaugaugggaccagaguuuggaacagccugaagcuggagguucuggaggguuuccugggagauggcuugaguuguaaaggucugcccugacaauggugcugcuuggagggccuggagggccugucccccuugaacuagcugaggcuggauaagaauuuguugcugcugugucugcugguuuugcucuccuucuuuuugcuggccugcuugcaaugagccuccagaugucugguuuugcuggauguucagagcaucagaccccuguagcccacugacccucuggggugucuggccuugagaguuggucccugaugauccacugguaguaaaguucauaauucccauguugcuggugguaguaguaguugaguagcuauuggcauuggugaaaaaggagcuggaacuggcuugugaugauaccaagcuggcagaacugaugguagucccugaggugacaggcugugagccacucuccugggacccagagcugcugaucgugacugccugagagcugggagucaagguagcugcagaaacgcuguugacagguagcaaggugauguucccauucagggccacugguacauuggucacauacugagucuguccugagaguacauuauuagccaggccuuggagggggacagccugcuggaguagguuuggcauagcagcaaugauguugccuccacuuccucgauuugugauaaucuguugguuugcaccugguaugaucuguauuugaccagaaccauccugcugcacuugggccccaguggcagcaaacugcagcuguugcccaucaacggucuggaacugugggauuacuugauacugaauauuaggcaucacuccagguaguccugucagaacuugcugguucuguaaguugggagcggcagccacaacauacugcccaccagagacugugcgauucuuggaagacucacugccauugcugccauugguacugcugccacucuguuccuuugagguagggguagccccagaggaggaagagaugaucugccagccauuggcacccugugaaaguuguguggcugugaggucaagcucaccuguucccccugacugacucgggcccugggaguuguugcuguucucauugggugacucaauucugcugcaaguugcugccagcagagccaaaggggauggcugggacuccuggccgaaaauaagggagaggaaaggaguuagugacacccagcugccagccuagggggcaguauacaacaaauaaacagcaacguagugcagacaaggagcaaaaaacagaaacaaaaagcugaccuaucuguauugcugaaacuccuuugucuuuggggaucuccauucucuuacuuccuuaucuauaaaaugguuuagucucucccuaaaacgcuuucugugaagaguaaggcaauuaucuaagaauauuuacaucuucucaacaccuuccccacucuaugauuaucacuuaccugcccuccuccuccagugcugcugcuacugccugugcugcuacuucgagccugugaaaaggcaccaccaccauuaccauugcccccauuauugccaccaacuccuuuuucaauuuucaccacagcugucauuucauccauggagugaucuuggucuaaaauaauuaaaaaacaaacaacguaaacuugagggaagaaaagaaaugaaguaggaaggauaaaaggaggcuaugaugaaauagcaaugacuaacaggaaggcgaaagccaccaguauaaagaaaauggauuggagggcagaggggagcugcagggcaugcaggacaugaacuagguucaaugugccaaaagugggccuuaauucucccuuguacaaaauuaaacuaagaaaacauucaaaaagugcuuuggggauaggaaaugugaaggacgguaggcauggugagaguuucuaaauaagaaaaaguauccuaagggaaaaaaaggaaaaggacagguaaggcauaaaacaacaugugggugcauggaaagcuugcuaaaauuaaguuuaaaagagauggagaggccaggcgcgguggucacgccuguaaucccauuacuuugggaggcggaggcaggcagaucaccuggggucgggaguuuugagaccagccugaccaacauggagaaacccugucucuacuaaaaauacaaaauuagccgggugugguggcgcaugccuguaauuccagcuacucccggaggcugaggcaggagaaucgccugaauccgggaggcagagguugcagugagccgagaucgcaccauugcauuccagucuggguaacaagagcgaaaacuccgucucaaaaaaaaaaaaaaaaaaaaagacaaacaaaaauccaagugugaaaaguaacgagaggggaaaaagaaguaaaaagugugaguagaaaaacauuugugaauacugcuaaggaacuaaagggaucuacagguuaguagucagaagguuucggggcggagggcgggcccugagggaaagggcgguuucggggugaggggcguggaaagggcgggacgguggggggcgggggggaagggaaaucuacggaaaguggggggaggagggccuuggagcaggcggcgaccagagggcggaccaggcaggcgguuggcccgggcggggccuucgcugcucgggccgcccccgcggcuccagcccccggcgggaggagccucaggcgggcggccgaguagugggggguaaggcccgucccccguggccggggcgggcagggggcgggcgaggccacgcugcccccucccccggggcgggcggcccaucccccuccuccucggaggccccgccacugccccgucucccucccuucccuccgccccgggcgggaccuaggccgccgccgccgccgccucccgcccgcccccgcuucacggcggggaucgcccggucggcccucgcgcgcgcccccucacucgccucccaccccuaagcuuggaguggacucauccuuaccgcucaugguggcagcugagggacaagcucaaggggguccuguccggggggguuggggggggccgggaaaaacgcggacgcugacgaggcaagcgaacccggac

SEQ ID NO: 193002 - RNA, 1134 nt, Homo sapiens
ccugaggccuccucauggaugggucaaacgugacaucauuuguuguugaggaacccacgaacaucucaacuggcaggaacgccucagucgggaaugcacaucggcaaauccccaucgugcacugggucauuaugagcaucuccccagugggguuuguugagaaugggauucuccucugguuccugugcuuccggaugagaagaaaucccuucacugucuacaucacccaccugucuaucgcagacaucucacugcucuucuguauuuucaucuugucuaucgacuaugcuuuagauuaugagcuuucuucuggccauuacuacacaauugucacauuaucagugacuuuucuguuuggcuacaacacgggccucuaucugcugacggccauuaguguggagaggugccugucaguccuuuaccccaucugguaccgaugccaucgccccaaguaccagucggcauuggucugugcccuucugugggcucuuucuugcuuggugaccaccauggaguaugucaugugcaucgacagagaagaagagagucacucucggaaugacugccgagcagucaucaucuuuauagccauccugagcuuccuggucuucacgccccucaugcugguguccagcaccaucuuggucgugaagauccggaagaacacgugggcuucccauuccuccaagcuuuacauagucaucauggucaccaucauuauauuccucaucuucgcuaugcccaugagacuccuuuaccugcuguacuaugaguauuggucgaccuuugggaaccuacaccacauuucccugcucuucuccacaaucaacaguagcgccaacccuuucauuuacuucuuugugggaagcaguaagaagaagagauucaaggaguccuuaaaaguuguucugaccagggcuuucaaagaugaaaugcaaccucggcgccagaaagacaauuguaauacggucacaguugagacugucgucuaagaacugugagggaaguuguggauaaaaaugguggaacacaggucauuuuuaguuugugcuuggaauaugacuuaaguaucuccuaaaugugauacagaagaacaucucaucccauaugcaugagauacuaauuaaugaugaa

SEQ ID NO: 193003 - RNA, 38096 nt, Homo sapiens
aagugacgaaguggcgcaguucgcugcgugcagcgacguggcggcggggccggcaccgggcagcggaaguggcuccggcggugggacuugaguguuuguguuuugguucgugaaggagccggcggcuggccuuaggggaggaggcagagggaggaggaggaggaagaauuagucggaacuccagcgccggcggcggcggcggcggcggaggaggagaaaggaaagaggaagggggagcggcgagaggcggagacggagcccgacaggggcggcaccacggcacgagccccgcacaguccagugugaggggagcggcgcuaagagcaggcgacgccgccgccgccaccaccaccgccauagauacacucucauccuacgggccacgccugggccuugcugccaggaagcuucggccccgcagcucggcuugcugcggucucagguaaccgaaccgccccuccuccugcgcagcgggggccuggaccccagguuauccgcgguccccagccuguccgcggcccugccgguacugagaccccccaccccuucucccucacgcgcagcagugcccuggaccagagaacuaucgaacccggcgucuuguucugccagcccuggugacucauccuccaggggcucuggagaccgggauuuggggacugacugagggagcgacgggugucacccuuucccuucucaagauggcgccguggaaaguguacuggaggccgcgguuccgccuggucuccguccuggcaguccugggggucucggucaaagcaaggcagguucgggggaggagguuggaaaggccaagggaccuggcgagugcugcuuauccaggcgaucuguaguuggcuauuagcuacucaggugcucuccaagcaggaaccugggccuacugcaggugucaauguggggagcuccgccuaucuucaacuuccaaagaugaguagugucggugggugggaggcucgucaaaauaggcugucuagagacuuguuuucuguuuggaagguagugaacuacagcguuaaauaaauucaagauaacaggaccgcugaacuccuucacuggguagagaccauggaacuugcucuggcguuaucuucccuggaagcugcuuaccucugagacuuucaaacuuguuaaguucugaacgucauaguucacauacuugguuuuugucuugcuuaaauggaaucaaagcguucaaucaguugccuuucacauaauaagaaaaaaacacuuguacaccucugggaauacucaagacugcucauaaacuuuauuccuaaaguaaaauggaagugauaacucagcauuuguauaaacaaaguaaauggaacagugccuggcacaaaauaagugcccagucaauuuuuugaucaaagaacccuuagaaggauuuuaacuauagaaugaauaacaguuauuuucaaaagauuacaaauguauauuaugcaaaauucuuguuuugcaaaacagaaguuucaguaagcagugaauacaaaugaaugcacguaauuuuuaaccuuaguguuaugcuaaguguauauuuaccauuaacuuuaguuauuuccuguuugagauccuuagggggaguagccacaauuaaguagcuuuaaaccuuaaaagucaaagugaaaucagaaucuuguuugauuuuuuuuuuuaaugggagucugauauuuucccuaaaauuuuggaagugccguagaaauuuggagcauauuguccuugauaaguaauuucuuguuuucuuaaauaaaaagacaaauggaaaauguuuugauuguguguaauaucugaagauguauuggugcauuuucaguauauaugauguucuauugauauuuuaucauuuucuuaucaaaggagcacauuauuggcaauuucaaucccuacuauguauauuagagauuguuuacauguauuguuuuauuuaauugucacaucagcuaugcaaguuagauauuaugggaauagaaacuuggaaauuaaagaguuugcccagacggaaauugguauagccaggauuacaccccuaaaucugguauguuuguggaggagggggcauuuuuauuuauaccuuguuauuuggaagcaacucagauauuacgucaauaaaucuguaaauauuucaguauguaaugguaaaagauaaggacucuaaaaagcugguguuuaguuaaggcaaggagguaguuucauugccuuaagaacuaagaucucguggacauguuagggaauucauuaugaagagcguauuauaagcucauuuuaugggaaaggcauauuucuuucuuuuguuuuuaauauagagacagggucucacuguguugcccaggcuggucucagaguccuccugccucacccccaaaguguugggauuuaccgguauaagccacucuguccagugugaaagacguauuucuuauaugagguagcuaaaugaaauauagcaggguuuuuagagagggaaucaucagguuuaauauauuagcauguauucggauuuugauuaaagauagaaggaaacuguuaagauugguuugugaguggauugaaaaagguucuucaaauauucacuaauuccuuagagauuaaaaauuagcauagaagucgccauucaggcuagauuucuuuaauguguuguuuaaauaaaaaauaauggccugcaggcugggcgugguggcucacaccuguaaucccagcacuuugcgaggcugaggcaggaggauugcuugagcccgagaguucaggaucauccugggcaacauagcaguuaagugucucuaccaaaaaauuagccuggcaugguucugagcgccuguagucucagcuacucaggagguugaggcaggaggauugcuugagcccaggaggucuagguugcagugagcugugaccacgccacugcacuccagccugggugagagagcaaaacccuuucuccaaaaaaauuuuuuuaaaaauggcauguauauuguucgucuaaagacuacaaaaaaguuacaauuauuguaaguaaauaagucaguaauaaucaccacauggagaacaacuguuagcauuucuguguauggugugcuugagcagaugaggaaacaguuuuaagucugccguuaggcacacaaaccugggagacugaaaauauuuguuguccaaaauuaccauuaauuaaaugaaaaaugcaucguuuaacagaaaacuucaaauaauacuaaauuuuaggaucuguucuaaaaguuucccauuuauuaauaacauaauuuuucucaaaacaauguuaauccaaguagccuggcuacagaacuugaacucgagucaucucucagguugccuggguuugaaacucggcucugucacuucugugacaauaacugugugaccucaauuaagcuucuuaacaucucugugcuuguuuccucauuuauaaggauuguaauaauaucucauuuuauaggauuguugagaaguuaaguacuuaaagcacugccuggcacaaacuugaagcuuugagguuagccuuuaaaaaaaaaaguaauuuuggacucacauccuauaccuuugaauuuccuuuaaaagauagugacauaaucuaaagggcauugaaggucuaguagaguuuaagauaaucaugcuauaggcaauauuuaaagugauuaauaguaaauuugcuuuacugauuuguauauuuaauucauaauuguuucuuuacagguuucuuuaccuccagaaagaagaauauuggccccuugaauucuggaaguucauugaagagucugaaauuagggacuuauuucaaauuuggacauggcuagucgaggcgcaacaagacccaacgggccaaauacgggaaauaaaauaugccaguucaaacuaguacuucugggagaguccgcuguuggcaaaucaagccuagugcuucguuuugugaaaggccaauuucaugaauuucaagagaguaccauugggggugagauuuucuuuuuucccugcuucauuuaaucgaaucauacauugacagaaaauauuuugauguuccaauugugugauuaugaauagcuaaauaagucauagagugaagaaaagagcuguucagcuuaccuuagcuuuaaaacuugccuuuaucuuuguuaaaaugauguguuuuuauauuugauuguuugguuaaucccuugugguuauauuguagcuaaaauacagauaaaaaacaugaguagaaucagugucucaaguaauaacauuugaccugauaccuauuucuagcuaacaacuagaagcuucuucaaauuaauacaguacauguuugugcucaauuauauugguuuaaaaugaauaguaaaaaagguaaccuuaaauucugaucuauauaacugaaguauuugcaaauaauuauacuuacuuguaaaauuaaauguaauuaaauacugcuagauguacuuuuuuuugguauuuaagagaugggaucuugcugucgccuaggcuggagugcaguguccggaucauagcucacugcagacugcagccugaaacucuaggcucaaaugaucuucuugccuuagccucccaccaaguaguuggaccuaagggugcaugccaccaugccaggcaaguuuuuuuuuuuuuuuuuuaagagucagagucucgcuguguuuccagguuggucuugaacuccuggccucaagugagccuccagccucaaccucccagguagcugugauuacaggugcucccugcugagaugcauauguaagaaugcuccuaagcugagggaagagaaaaagugauuaauggaaagggacauaacaggaaaauggaaccugaagaaaaagaugaaagaagaagggaaagaguaggcacugacaagggugguuauggugggacagagaugaggggaagguaagaugcagggugaaaaggagacaacaaacaguacaguauugucaagagaggacgugaaaugggaaaauugaauuuuagcuggacaugguggugcauuccuguagucccagguauuuggaggcugaggcaggauuauuuuagcuugggaguucaagucuagccugggcaacauaaugagaacccaucucuuaaaaaaaauugacuuuaaucaaagaaaccuauaauuauauagcagugggacaagauagccucuuuugggccucuguuucaucugugaaaugaugcuuuucaauuagaugauguguggcaagagccacacgguuugagauucacaauauuuugcaagugauauauaauuaagcaaugcuguuuucuaagguauucauguauauauuuuaaccccauccuguaaaauuaaagucaaacuuuggaaauaagacagguagauaccaacuggcauguggcaacuucuuggaaucugucuuucagaagcaaaacuuuauacugugcauuuagugaaugcucuucugcaaauauacuugagaauguuauucauaaucuuagacccauucuaguaagauaaguuacagaagucuacuaccuccuggccuuuguauaucuuguuaaaauguuauauuagaauguuuuauguuuuuucuaauggcugagcaucagaaagcaucauggagcuuuuauuuugagucagaagucuuggcauuuuaaaaaauguuaauacacaauauauuagacaucuuugugauuuuuuuuuucccugaaaguacauccacgugugauuuuguuguuguuguuguuauuguuaauacauuauauccaguuuaauaaugaaauacuacuucucaagaaggcuuugcuuccuccagaagugauuuggucaaagcuaacugucccaucuaguaggaaaaguuuaaagacugcuagaucauguccacccacuuauuucacuguuaauggaagcauuucccaaaguauaugugcauucuggguuaaauaaccugggccacguagguuugggacuuacuauaugcuacucuucuccucucucuuuauuauuuuauuaaaacaauaaaaacucugaaguacuguaguauaggacuuaauuccuggggagcuuugcaagagcuuaagauuagaauuuuuaucuuguuuuggauaaugcacuucuaaguuuauuuuuuccuaaugauagcucaagaaggauguuuaaaagaaaaauguaaccccauauccuguguaucauaaauauaucucugauauguguguaucucuauauaaucuccauguaacaccaguuagauugucuagauuucauuaaugaauuuuucauaaagauuuucauuucuauguguagagcuuccuguuuaaaaacaaaaaggaauuugcauccaaauuucuguuaauccuuuuuuuuuuuuuuuuuggagacaaggucucugucgcccaggcuggagugcagugguguagcccuggcucacugcaaccuccgcuucccaggaucaagcaauucucaugccucagccccccaaguagcugggacuacaggcgcaagccaccacuccuggccaauuuuuguauuuuuaguagagaugggguuucaccaugucggucggguuggucuugaacuccuggccucaagugaucugccuaccucgggcucuccaagugcugggauuacaggcaugagccacugccccuggcccaacuuucuguuaaucuuuauuggauacuuuuucacugugcugaccccaugugaauacuauucaggagguaugacaguaccauuaugguuauagcuguggacacuauucuuuuaugcucuguacucauagcucuucaccuuuaggaacuagaguagauguaaagcauuuaagaauuuuaagguuugagcuauuucaugaucaaccugaaagggccauaacuuguagguaauacguauuuuuguuuugacugucaugugguagaaguuaccugaaaaaugaagccaaccaacucuuuugcauuucaacuguugguuuauuuuuuuugagacggaauuucacuacguggcccagguuggagugcaguggugugaucuagguugacugcaaccucuacuucccagguucaggcaguucuccugccucagccuccugaguagcugggauuacaggcccacaccaccaaucccagugaacuuuuguauuuuuaguagagacaggguuuugccaucuuggccaggcuggucucagacuccugaccucaagugauccaccugccucggccucccaaagugcuggaauuauaggcgugaaccuccacgccuggccucaacuguuuaauuuuucacuuuacuguuuauaucuccuaacaugaguuauuguucugaagcacucaaaauuuuaaucucuauuugauuguguucgaagguggauaucauauguuacacucuugauuuguggauucuggauucauuaagaauaucaagauuucuucuguaauuugugugguucuuccuaaauacaauaacuugauuuacgaauuccuguugcgcugugugcgguggcuugcaucuguaaucccagcacuuugggaagcugaggugggcagaucgcuugaguccaggaguuugagaccagccuggccaacauagcaaaaccccgucuuuacaaaaaauacgaaaauuaaccgggcaugguggcacacaccuguagucccagcuacugagaaggcugaaaugggagaauugcuugaacugaagaggcggagguuacagugagccgagacugcaccaccacacuccagccugggugacagugagaacccugucucaaaaacaaaacaaaacaaagaaucccuguugccucaccauacuucaugcauccuaccccuauagcacuucugaugaaauugcgugccguagauuuagcaauuuagagaauucuagcuuguuuguauggguuuaaaguuugcaugacauuuauguuucuauuguuggucuaaaguuagcccagagauuagcagggagcaguaggcucagagaguugucuuccuucuuuacuugguacugcaucucuaggcuugguagcucuucaguaaauacucucaaaaaauacuuauuuuuaagaagacauuuaugugauauuuauaaacaaauuaauccucagugguuagaauaugcagugaaauagcaagcagacaauccuuuuuuucucuucugagaaaagugcuucauaccacaguuacaauuuuguaugcacuaaucaaaaaauguguuauaaacucuaaaguuuagaugauggaacuguacaugaaaauaacauuccucuugcugguucugugauuuuuguacauuagcuuagaacagugguccucaaagagcguucccacuuccagaaguagcugcauuaacuaggaacuuguuaaaauguagaaucccguguugaaucaaaacauuugggugggaccaacaaucuagguuuuaauaaguuuuccagaugauucuaauggcauguuacguuugaguaguugauuuuacauugguacuaacauugauucacccauacauggaauaauugggggguuuuuuugaggugugguguuugucagauuuuuaaaaacauuguugacugggcgcgguagcucauaccuguaaucccaacacuuugggaggcugaggcgggcggaucacgaggucaggaguucgagaccagcuugccaaugugaugaaacccugucucugcuaaaaauacaaaaauuagccaggcaugguggcgugcgccuguagucccagcuacuugggaggcugaggcaggagauucgcuugaacccaggaggcggaggagguuguugcaaugagccgagaucaugccauugcacuccagccugggugucucagcgagacuccgucuuaaaaaaaaaauuguucaugcaacuaaccuaguuugagaauuacauguauuauguacugcucacauuacauguuaucuguaucucuuuauaggagaaugccuuccuguuagccaccugccagacaucuuuaggaaaguaugaucccucuguccaaucaagaguauucugcuuuuucucuacuuagggaguacccauaguuuucagucaucuguaccacugcugcucuccuuucuugucacaaaugaucaaggccugauaauacacaaaauuaauuaagaaauuuaguguaggccgggcgcaguggcucaugccuguaaucccagcacuuugggagggugccagcacacuggcagaucacgaggucaggaguucgagaccagccuggccaacaugguaaaaauaccagaauuagcuaggcgugguggugggugccuauaaccccagcuacucaggaugcugaggcaggagaaacauuugaacccaggaagcggagguugcagugagccgagaucgcgccauugcacuccagccugggcgacagggcgagacuccgucucaaaaaaaaggaaauuuagugcaauuauuaacucuuaagugaagugcuguuucuacuuacauauuuaacauccaucuaaauugguuagcauggccaacuaguuguuuuuagucuaaaacaaccuguaacaggaauaaaaguuacuguuaaaaugaagaaaaacaaggcuuauuucaaaguuauuauuaacauacuauuuuaccuaacaauuuauggccaagucauucuaaagaauaaacuauugugguuaagagagacuguauccagauugaaguuuuuaccacaaugccuggcacaguaaaagguuuauuaaauuauagcuauuacaguuaccaucaccacuguuaacuuuuggcugaaucguuuugucauuguugauauuuuuguuguuuggucaugacauacuauuaucuugagaugguagcuguuacaccuagugcauagcguuugauuuagaaaauuugaagauuugaaaaauuuuguguuuuuuuuccuuuuuuuuuuuuuuuuuaaacagccugcucuguugcccaggcugguguacagugguggcaucaaagcucacugcagccuugacguggccucaagugguccucccagguagcugggacugacuauaggcaugcaccccacacuuggcuaauuuuuuauuuuuuuguagggacagaucucacuguuggugccuaagcuggucucaaacuccugggcuacagcaguccucccaccucagccucccaaggugcugggaugaaagguguaagccacugugcccagcccaacuguguuauuuguggaaguuucucagagggagaaauuacagggcuaaaguacuacacgugugcauauauuaaaguuuuuuccaguaacuacuuaauaauguguacuugaaaacugcuaaauucuuaaauguccucaccauuaaaaaauaguaagugccgggugcauggcucaugccuguaaucccaacacuuugggaggccaaaguggucagaucgcuugagaccagccuggccaacauggccaaaccccauccuuacuaaaaaaaaaaaaaaaagcaaacauuagcugggcguggucgcgcaugccuguaauuccagcuacucgggaggcugaggcaugaguauugcuugaaccugggaggcagagguugcagugagcccagauagcgccacugcauuccagccugagcaacagagugagacucugucgcggagguugcagugagcugagauagcaccacugcacuccagccugagcaacagagugagacucugucucaaaaaaaaaaaaaaagguaaguaggcgaggugaucaauauugaauuaccuugauuuagucaccucacaauguguacauguaucaaaacaucauguuaauauacauauguauauauuguaaauacauaacgauuuuuauuuuucaacaauaccuuaauaaagcuggggggaauaaaguuacuuccuaaacagaaaagcuagccagaaaauuuaaauccaaauaacucauguuuuuccaguaguagaaagcuuucuacaauugcccuucacuuguuagccuucagaaugacuucuuuguauaauuauaaucugugcauuuauuuaaugugcuuuuaccuuuuugcaugugcacauuguuaaaagugcuuuugagaaaggauagaagaccuagagaccaaaccaccagcaugugguuuuugauucgugagaaaaauuguguguuugaaguauucauucuacuuucugauacauugauaguuaaaauuuguggaaguuaaucauuugguuucaagcaaaauaauaauaucuuuguucaucauauuuucuccuaaaaaguacauauucagaauuugagagguuguuacccagagaaguugguagagauuugauauuucaaauuuauaucacaaccuaaaaaaaucuuucgguagucuuaauuauuccccaauuucuuagguuaaaauauuaucauauguggcuacuuaaacauucccgugagcugggagucaguaugcaugguucuaauccucacaugcuuucauaagcauuuaugugaacucuguuuacacauuuguaacacgagaguauugaacucuagguaaggauucuuguaggccaggugugguggcucacgccuguaaucccaacacuuuggaaggccgaggcaggcauaucaccugaggucaggaguucgaaaccagccugaccaacauggcaaaacacugucucuacuaaaaauacaaaaacuaguggggcguggugucaugugccuguaaucccagcuauugaggcauuagaauugcuucaaccugggaggcagagguugcagugagcugagaucacaccacugcacuucaaccugggugacagggcgcugagguaggggagacugagacaugagaauugcuucaaccugggaggcggagguugcagugagcugagaucgcaccacugcacuucaaccugggugacagagcgagacucugucucaaaaaaagaaaaaaggauucuuguagagcagauguucuuauaaacuguguacucuucucauuaaacaauacagucaauacaauuuaacuuuuguuuucuuaaaauguauuucaagauuuggaaucauuaugagcaucaguuuuugccuugccgugcuuaauguguugauguccucuggugcuuuggaaguauucaagcuguuugguagaaugauuuugccaaauagcucuuagugaacugcuacugauucacuaauuuacugcuuuuauuuguuauauaugggaaauauuagguugucuaaagcaaaucaaaauaaaaccagaaaucaucucugaugauucuaaaacuagaaaucagggacaacuucuugguauaguuugagagacagauugagugaacauuguaaucuggugcuauauauuaaagguuuuuaaaagugauauuauaugccacuuuuuaaaaauuaagccuaaaucuccaacugaucuucuuguuauguacuaauuuauauauauauauauguauguauauauaaaucaaucuccaaaagaagauauacauagaaaguggucucaguuacauuccgaggaaaucuguaaauuugcauaaccuuuagugcauggacuuugugagauuuauucuggcugcauuuacucuucuuuugcuagcuuucugguuguguucugauuuuuuuuuuuuuuuuuuuugaggcagggucuugcucuguugcccagggugaagugcaaugaugugaucauggcucucugcagccucagccucuugggucaagcagucgucucaccucagccucccaaguagcugggacuacaggugugcaccaccaugccuggcuaauuuugaaauuuuuguagaggcgacgucuugcuguguugcccaagcaggucuuaaaacuccugaccucaagugaucuccuggcuuggccucccaaagugcugagauauagccaugagccaccgcgcuaggcuguguucugaauauauaagguuuccagauaauugaucuuuuuggagacacacucagaggcacaugaaagacacuugguuuugaauaauaauugguggaggcugugggaugggaaguguuuuaaaauuuugcuuuuagaauagaauaagaauucuuacuugauagaaacaugggaaauuuuggcaaacuguuucucccuuuuuuaggucauauaccauaauaaccugacauugcauauacauaaucuuguuuaugaaguaugcugaguaaauuuaugauaggauaguaucauuuggaguuacaucaaaagccuuuucagcaaaccucuuugugaaggagaauaaagaugugugagaguaagaaaagcaauaagaguacuucuaaagguuuuuguuuuugagauggggucucgcucugugcuagacuggagugcaguggcaugaucauggcucacugcagccucaacuucugggcuccagccaucuucccaccucagccuccugaguagcugagaccacaggcaugugugccccugcccccggcuaauuuuguauuuuugguagagauggcuauucuccauguuucccaggcuggucgcgaacuccugagcucaagcaaucaaccugccuuagccucccaaagugcugggaauacaggcguaagccacuuuuucaggcaucauuuuuugucuuuuaauucauuggcuaccuugauguauauguaaacuuuaguuaccuaguugcuaaauuccucaagaugaaaguuaaguguuacugaagucauauguuggacuuugaaaauaagaaugcucuacaaaucagaauaucugaaguaaguguugcuaaacagcauucauccuccguuugaggaaagguagaagcaggaugaagaaccgguuaguuauucaugguuuuuuaagccuuaaguguucgcaguaguaguuguuggauauucuuugggccccaaagaagaaguggguaaucuugauacaugacuagucacugcauaauuaucagacaccuucagcuuuucucagucaaaaaacuguucuuuaucuuugcauaaaacuagagccagaauauauuccaccuaguuacuaucguuuuuauuugagguauaacaugaauagaauuuucuccucuauugcauucauaaguaauuuguaaauuuuagaaaaaugugacuucuaggaaauaaaggauaauuuaaagauaggacacuuauaauaauuacuuguuaugugauacauuccuagaacuuaaacaggauuuucagaaguuucaucuguaccuuaccauggcuauaugggaagguacuaauuuuauagacaaggaaacugaagcaauaaagguuaaguauaugcuugaaguuuugcaacuaggugacagcugggauuaaagacaucuuucugaaaugccauucauguucuggaauguacuguguauguguguauuucuccuugcaagaaccuaucagacuagaaaauuuggcucauaguuagaguacacaugacaaguguucuguuaaauaauauguaguauuugacagguaggggccuucuugcuauguaucacuuaaggaaaauaaugugaaaguauuuugagaacaaaagaauauaagacgauuauuuaaauuguccauauuccuaaauuaucaccaccauuuucauuuuuaugccaucaucaugugucacacgcuauauuuuaacugccuuuaaucaaaugcauuaauuuguucaugugagucaaaauucaagaaguuuauaagguuuacagugaaaaaucucccccucaucuucuaucuagcccacucaguucuuuuucccaaagaugauguuacuuuguuauauauccuugcaaaguuacuacuauacucaaaucuauauauucuugucucccuuuuuacaaaauuugaaauaugucagauguacuguaauacacuuuuuauuuuucacuuuaaugcuguucuaguuaucuauugcugagacacaaaugacuccuccaaaauguagagacuuaaaauuauuuugucaucuccaugguucuggugagugggcuuaguaggugguucucacucugaucuuuuccuugcucuugcaguucauuacggggcaagaaucaucucaacacauccggcaguuggugcuggcuauugguugggaccucagauggggcuguuagcuagaacacaccuacauguaguagccuuuuaugacuuugcuccagaagucacauagauagauagcaucuguucuauucuagucacaggccuguacagauucaagggaagagugucaacaucacacuguaagaagaaugugguguagaaugucuuguugcagcugccuuagaaaauacaaucuacaggcugggcgugguggcucacaccuguaaucccagcacuuugggagacugaggugggcagaucacgaggacaggaguucgagaccagccugacuaacauagugaaaccccuucucuacuaaaaauacaaaaauuaaccgggcaugguggcgcgugccuguagucccaguuacucgggaaggcugaggcaagagaauggcuugaaccugggagguggagguugugguaagcugagauugcaccacugcauuucagccugggcaacagagcgagaguccaucucaaaaaaaaaaaguacugucugccguaagaccuaucuauaucaaaagaacguccgcauuuuucuuggcuguaacaguauucccuugcaugggucauauuaguaauaucaguucucuaguuuuagauaugcacauuguuguaucuuuggcuauaauaguacuguacuaaauaacagcaguaauuucucacauauucugaguauaucugcaguauauauuuuuagagcccaguguguuugguuucucuuuucuuuuuugauuuuuuuuugaaucggggugucacuugcccaggcuggugugcagugacgcugucauagcucacugcagccuugaacuccugggcucaaaugauauuuccacuucagccucccaaauagcugggacuacagguaugcaccaacacacuuggcugauuuuuaaauuuuuguagagaaggguucucauguugcccaggguagucucaaacuccuggccucaagccauccuccuaccuugaccucccaaaguguugggauuaaaggcaugagccaccaugcccagccuguguuuaguuuuucugugaacuauucauaaccucauguuacuucuauguagauuucuuuauaauagucacacuacuguguuccauuugauuuauuaaugguaauauuucucaguacaucuauauugucauauuuuaguaucuggcaaucuucucuuuuuauuauuuuuuaacuguuccauuguugggcauuuaauguuugcuuuuuuguuugcuguuuuagguaaucaccuaauaggggauaucuuagaauuucaccccccccccccccgacuuauuuucguaagaucaauuucuagaggugauuacugaacccaaaggaauuuuauccuaauaaaauuguuuuguaggaucaaaagaauucuaaucuucauccuuuuucaucccuuagagauacauccaguuucuuuggggguuggcauagauaauuauauccuaggauuacagguuuccucuaacuguuaauaggaguuuaaaguuuucccucucuguuuagucuucuuuucuauuauguuguaaaauucucagauaucagaacuuuuguuuuuguuuugagagacaaggucuuccucugucacccaggcugaagagcaguggcaugauuauggcucacugcagccuccacccccugggcucaaaugauccucccaccucacccucccaaguagaugguacuacgugugcaugugccaccaugccuggcuaauuuauuuuuaagauggagucuugcuauguugcccaggcugguuuugagcuccuggccucaagcaaucuuccugagacaggaaucccaaagugcugggauuacaggugugagccacugugcccagccaaauauuagaacuuuuaaauucauuuaguauguaagcuuacugccaagcaugaaagaaucacuuugaaggccaguaauguuuuaaaggucuggaagauucucuugagggcuaggaagcauuaugugcuagguucuugaaccaggagaaaagggguaucacuaagaagaagggaaggaauccugguaugcaaaauagcuugggcgcuauccuugcacauuugacaaguuuagugaaguacuauugaacuguucaguaaaguaucuguugccuauagauaaaaugucuuuuguagauacuuauauaucuaccuaccuauagauaucuauauaucuguaucuauauaucccuuaaagcuaagcuaauuuccuuaaccuuuucucuguugauauuuguuugguagccuuuaucugauucuaguuaauaacucguacccugucauuuuuuuaaaaauacccuuuguuuuuguaauguguucuuucauucuucuucccaauucaguuuugguacguuccuguuacguaaaucuaaucuggugagcagagacuuucuuaggauuaugccacuuggugaggcaaucacagggucuuagcccugaaggcgcccauacugacuuuaucaguuuauucuagggagaucagguuuggggcacuaacuuaauacuaacaaacuccuaagauuaauuuaauuuuauuuauuuguuugagacggagucacccaggguggagugcaguggcgugaucuuggcucacugcaaccucugccucccugguucaaacgauucuugugccucagccuccugaggcugggacuacaggcgcaugucaccacgucuggcuuauuuuuguaguuuuaguagagacaagguuucaccauguuggccgggcuggucuugaacuaccucaggucccaccuuggccuccuaaaaugcuagaauuacacagacgggagcuaccaugccuagccaaaacuccuaagauuuacuuacuuacuuacuuuauuuauuuauuugagacggagucucgcucuguccccuaggcuggaaugcagugguguaaucucagcucacugcaacaucugccuccuggguucaccugucucugccucucagauagcugggauugcaggugcaugccaccaugcccgacuaauuuuuguauuuuuaguagagaugggguuucaccauguuggccaggcuggucucgcacuccugaccucaagugauccacccgccucggccccccagaaugcugggauuacaggugugagccacugugcccggcccuaagauuaauuuucaaacaaugugcaucaguauguuagaaauaccuaguguuagccgggugugguugugugugccuauagucccaacuacucuggaggcugacuugggaggauugcuugaggccaggaguucaagggcgcagugaacuaugauuacaccacugccccaaccugggugacagugggagacccugucuuaaaaaaaaaaaaaaaaacuuagggcgacgauguucagcuggugacauguggcugacugucuuauguacugguuagugaauucccuuagaguugggugucccguaaggguugcugucaagcugugauaguaaaaagcauugacuucucaauauccuuuauccuagacaguguuggagaaaugcuaauuuuuauucuuuaccucacucuugacuucaugcaggaucuucccuguguaucauuaauauucuucaggauuuuaaauuguuucacaacuauuaccuuuagauguugcucauagauuuuuauauuuguuuccuuccuuccuuuauuuuuuggggcagggguugggauggggacgggaugacagggucucacugccacccaggcucaggugauccuccugccugagccacaaaccucucccaccaaccccccgcccaguagcugggacuacaggugcacgccaccacaccuguuuuguauuuuuguuaguagaaacgauuucuccauguugcccgggcuggucucgaacucccgggcucaagcagcauacccgccugggccucccaaagugcugggacugcaggugugaaccacugcgccuuacccagauuucuuuuuaaaauugcgguaaaauauccguaacacaaaauuuaccauuuuaaccauuuuugaauauacaguugagugguauuagguacuuuuaacauuguuguguaacuauccaaaacuuuaucuucccuagcugaaacucugcacccacuaaacaauaacuaccccuucuucccgugucuggcaacuaccauucaccuuuuucucucugacucugacuacucuagcuaccucacauaaauagaauuguacaguauuuguacuuuugugguuuccuuauuucauuuagcauaauguccucaacguuccauccauguuguaaagcaagugccagaauuuuccuuccuaaaacuuuuuaggcuggauaauauuccauuguauguauauacuucaucuugcuuguccaucauuggacacuuagguugcuuucaucuuuagcuguuaugaauaauguugcugugaacauugguguacaaagaguguuuuaaguuccugcuuucacuacuuuuggauguaugcccguaagaggaauugcuggaucauauggugauucuaucuuuaauauauuugagaaaucucuauacaguuuuccauaccagcugcaaagcaguuccaguuucuccacaugaucacccacacuuuaccuuuuucucuugguuugaucauagccauucuaguggcagugaagugguaauuugugguuuugauuugcauaucccuaaugauuggugauauugaacaucuuuccaugugcuuauuggauuuauuuauuuauuuguuucgguuuuuuugaaauagggucucacucugucacccagacuggagugcaguagcaugaucacagcacacugcagccugaccuccugagcucaagugauucuucugccuguaccucccaaguaguccagcgcauacccccaugccuggcuauguaaauuuuuuauagagacagagucucacuauauugcucaugcagaucuugaacgccugcuuaagcaguucuauugccuuggccuuccaaaguccugggauuacaguugugaaccacugugcccagcucuuauuggucauuuguguauauccguuggaucaauguuuauucaaguccuuuguccauuuuuuuuuuuuuuugagauggaguuucagucugccgcccaggcuggagugccauggcaccaucuuggcuugcugcaaccuccaucuccuggguacaagcaauucuucugccucagccuccagaguagcugggauuacaggcaaccgccaccacguccagcugauuuuuguguuuuuaauagagacaggguuucgucauuuuggccaggcugaucuugaacuccugaccucgggugauccacccacuucagucucccaaagugcugggauuauaggcaugagccauugcgcucggcccuuuguccauuuucuaaucagguuuuuuguuguugcugaguuguaggaguuccuuacauuaauauguucuagcuuucagucccuuaucagaugcucauugauuuuuaagagugaauuguagauaaacuaguauagaucaccucuuaagauggauuaauuuggggaagauugcugucuuucuguaugcuaucuacauaauaauuuuuuauuuucuuguuaggcuuuuggaauauucucuuuuuggguuuacucacaguguguaugcuuuacugugccuuauuuuuucuuuuuucccuccugggugcugaguaauacuuagcccuauucuacuuuuauuucuuacucuuccucacauuaauugcaauguaacucuucccuaacuacacucacgacugucgcuucugcaguccauucacugggugcuuccuguauacacacacuuucauaggaaauaaaaauggccucaguuuuuauuuuuccuguuuucggcuauguaugauucuucucuguguguaauuuuaucaucugaaguuagugcuuaucugucugagaaaaucuguuaugucggauuacugcuguuaguacucauuuucccagugaaccaauuucugucuucacugauaacuuuaguaccugauucuaacaaucucuaacuugaauuuuuuuuuaucacaaagccucauucuauuucugaaauuuugaacaagacccuuucuccccucucuagucacugcaugcauccuuuccuuuuaguuuuaauuuaauugcuacuuaauacuuaguuacuaguauuuuuuuucacuuacacauugggauuguuuuuuuaaagguacucaaauaugacagucuauauuauuguuucucuauacacauuuauuuacuaccgaaaauugaaaaaaauagcacaucgaaauuuccuuuuacugcaauucaaauuuuugaaaaccagaaaaucugauuuauuauacucuagccaaacuacccaguguuuucuuuacauucuuuccccacaaguuacuuuacuucugauucuuucuuuugagacagucugucacccagacuggaaugcaguggcauaaucucagcucacugcaaccuccgccuccaggauuuaagguauucuuaugccucagccuccugaguaggugguacuacaggcacgugccaccaugcccagcuaauuuuuguauuuuuaauagagagccaggguuucaccauuuuggccaggcuggucucaaacucugggccucaagugauccuccugccucagccucccacagugugcugggauuacaggcaugagccacugugcccggccuuacuuccaauucuugaugauggauuucauuucacuaacaagguuguuuuuaauuauuaaauaguuuuaaauucuuugagcauaaaaguuuguucuaccuacucuccugcccucacacuaucuuuuggaauuuuagugagauuauuagguuaaaaaguauuagcauuuucuugccuuugcuacauguugccaaaauccuuuccaacggaguuguacgaaaucaccagcugugcuuggguuuuuugcaaauugguguuuuuugguuuugguuuuuuuuuuuugguuuuuuuuuuuuuuuugagauggagucucacucuuguugcccagacuggggugcaaaggcacgaucuuggcucacugcaaccuccgccuccuggguucaagcgguuuuccugccucagccucccaaguagcugggauuacaggcgcccacauccacguccggcuaauuuuuguauuuuuuaauagagacaggguuucaccauguuccuggcuggucuugaacuccugaacucaagugauccaccugccucggccuccuaaagugcugggauuacaggcgugagccaccaugccugcuguauuuuuauuuuuucauuaugcuaauuuaggagauaaaaauuguuuugacuauguggaugauuucauugacuacuggucuccuuuucuguucuuuugugaauugucuuuacacauuuaucccugagguucuaaaguuuuucuaaacauuuauaauagcuuucuacacauugaaaauacuaaucacuuagcauccauuguagaaauuuuucucauuagguuugccccuuuguuauggauguuaugacacaaguuuugcaaaccugaaguuucauauuuuuguguaaucaaaucuguagucuuauauagaauuuuggucaauuuuaauaaagcaauucuuuccugucaauuuugauaaauaauaaguuugggcuugaaguuguaugguuucucaguuuuuguauuuuuccccuuucuguuuaauucauguagaaucauuuuaguuaugggguggcgguuacuuuguuuuucuuuuuuuucuugagacggagucucacucugucacccaggcuggagugcaguggcacaaucucggcucugcaaccucugccucccggguucaagugauucuucugccucagucuccugaguagcugggauuacaggcucaugccaccaugcccggcuaauuuguauuuuuaguagagacggguuuucaccauguuggucaggcuggccuugaauuccagaccuugugauccacccaccucggccaccaugcccggcuaauuuguauuuuuaguagagacggguuuucaccauguuggucaggcuggccuugaauuccagaccuugugauccacccaccucggccucccaaagugcugggauuacaggcgugagccacuaugcccagccacuuuguuuuuuaauuauuaaucuuugguuuaaugccaucaauuugaauauccuuucccuugcccaguguguuacagugucuuccccuggcuuacuguuuaagucuugcauauuauaauaggccuuugguauuugcagauuugacauuuaaagcuucagcuauucucaccugauuccagggucugugguaaaguaauuuguaguuuugcugaggcugaaauguuacuugcuugcugccaggcuugcaaauaggagcugaucacguagcucagagggagccuaucagacaggccagcacccacaucucaacgcagcuuuguuuuucucuacuugucaucgcguacacaguaacucucgaagugauaaaagcuguuucuuugugaaauaugggcccgaaaagaaaaccaacugcuagugcuggugauggaagugaagagaaaaugaagcggucuaagagugaugguucuuagccagaaaauagacguuuuggauaaauuaaagugguuuuacagauucagguaaguuugugguugguuaauguugcuacaguauugauguaguaguuuuaucuuuucaguggcagaauuuguuuacguaacuuuauaaauuacuaguaauguauuuuuaggagcacugaggauuugaagaugucaccuaaaugucaguuacacuucaccgaguuuuauaggggaaauuaaacacuguaguggaauuuggccaggugugguggcucaugccuguaaucccagcacuuugggaggccaaggcggauggaucaccagaggucagggguucaagaccagucuggccaacauggugaaaccccaucucuacuaaaaauacaaaaauuagccagacguggugguggccaccuguaaucccagcuacucgggaggcugaggcaggagaaucacucgaacccaggaagcggagguuucagugagccgagaucgcgccauugcacuccagccugggcaacaagagcuaaacuccaucucaaaaaaaaaaaaaaaaaacacuauaguaguauuuuaaaacuuuaggacuuugagaaaucaugaacgucuuaggguguauuauguauaucaagaguuuauuauagugggcuacacuauuccaguaauauuucuguucauuuaguacuguagcacuuuucauuuuuuaaaguauauuauaaaacugauuuucccuggccucuaauguuggucuuuucucccccaaaauuaugcuuuaucauaccacaugaacaguaguacggugguggugguggugguggugguuguuguuuugagacagaguuacacucuuguugcccaggcuggagagcaauggcacaaucucagcucacugcaaccucugccucccgaguucaagugauucuccugccucagccuuccgaguagcugggguuacaggcaugcaccaccaugccuggcuaauuguuuuuguauuuuuaguagagacgagguuucgccauaccggucaggcuggucucaaacuccugaccucaggugauccaccugccucggccucccaaagugcugggauuacagguggaagccaccgcaccuggcccaguacaguguuaucaggugaaaaauaucuugauguuguuuuugagguuguguuacaacuugaguagauaccuugugaaauaucuauuuuuucacauuugggagcugccucucucuacauucaaauguuaucugaaguagccucuaaaugguuccauguaucuuuuugaacuuccuucuuuuaguagacauuuuugaacaucuguaugaacaaggauuuauauuaaauguugguacagagaggagcuacuacaaguugagcaucccuaaucugaagucugaaaugcucccaaauucuucgagcaucaauaugaugucacaagugaacaauuuccacacuuaacaccuuugcuuucugaugagucaguguacauaaacuugguuuaaugcacaaaauuauuuuagcuucaggcuauguguacaagcuuuaugugaaacaaacgaauuucauguuuugacuuggaucccuucccaaaaauaucucauuaugcaaauauuacaaaaucuuuaaaaauccaaaacauuccugguuccaagcauuucagauaagggauacuuaaccuguggucauugcucaaguaacucccaaucaaggagaagaaaaagauauaaaccaaugauuauaaaaggugugaaacguuauuacacagagaacucugggagcacagauguaggagauauuaacuaggguggaaugaaggaagguuucuaagcagaguugaggaaugaauugauuaucuucuuuguuaaucugaaugggauccauuccuguucagcaugauuucccuugguuuuguuccuagauuuaggaaugaugcccuguuuugccauaaggaagaaucucguguguuuauuaggaauggauauugacucaaaugccuuuuuguaauuuguuuaaauaaaauggauuuuucuucauuagccuguuaauguaauaguuuuguauuucugaaagaauguacuugguaaugggcauuuguuugucuuaauguauuuguugcaauuucuuuguauuuggcauuuuuguacauguaugguguacauguaugguggccucuugugucuuuaacuggcuugagaauuggaucauauuuucuuuaaggcaacaucucuaauacaguuggcccucugaaucugugaguuccacauuuauaaaugcaaccaacugcaaguugaaaauauuaagggggaaaaaauuaacuuagcuccaaaaagcaaaaauuaaauuugccacacacuuaauacuauguugaaucuauguggaugacgugaggugcaggcauuguauuagauauuauaaguaaucuagagaugcuuuaaaguauacaggaggaugugcuuagguuauauacacauacuuugcaauuuuauaucggggacuugagcauccucagauuuuguuauccauuggggauucuagaaccaguccuucaugauauauggggagguccuggaaacaguccuccacagauacugagggaugacuauaguuauuucccugagccugaaguuuacuuauggacguauaagugaauguuuuuaguacuaguagacuuugugaucauaguaugucugaaaaaugaaacagucugugcacauuuuaauuccuuuuuuuuuuuuugcaagucugcaucaaacuauacuugaaaaaaggcuuauguauugugacuuauuuuccucuuuuccuuuuugguaagaguacugucuuagggacuuaauuuuaguuuaaaauuuuaguuuaaaaacauuuuuugauccuacaggagaaccucucgugaccuucaaaaagugacauagugcugucuggauauccuuuaccauaaauacaauauuuuagaaaauggacaauucugcuaauuguugguuaaaaaaaaguuugaacuggauuagaauauauuuacaaugugauuaaugagaauucauaaaacuauuaauuagaaucuagguccaaaugaagauguuuacaguauuguuugcaaaauucagaagauuuuaguuguugauacuaaagccagcaaccaguuaaccuaaaagagcgugaaaaauaaauguugugucuaacguaaaagagauauaucucauuagacuuuguuucuuuagcacauuugauacugguuaguacaucucuaucaacgucacuagauaaacggcuguaauuuagagaaauauaucauaauucuuuugcauaauaugacaguuuuagaaaaugguaauucaagugcauaccaauuuggaaauagggcuugaauaucacaccuugagcuaaauguagaaggaagggaggagcauaccaauuuacagugaaugauagagcagcagcagagggcggucuaauggcuguguguaggucuuuuaauuuuaacaauauuguaucauuuuauaaugcuacuuuuuuuuuuuuuuugagacagagucucuguugccaggauggagugcaguggugcgaucucagcucacugcaaccucugccucauggguucaaacgacucuccugccucagccucccgaguaaccggaaccacaggcaagcgccaccaugucgagcuaauuuuuguauuuuuaguagagacaggguuucaccauguuggccaggauggucuugaucuccugaccucgugauuugccuuccucagccucccagagugcugggauuacaggcaugagccaccacgccuggccuauaaugcuacuuuccuaguguuaaaauuagaaucagggaaaguacagauccaaaaaauucuuauggcagggaaugaaagguaggagcaaauauugaaucaacugaacaaauuaaaucuagguuaagguaauaaugacuaccacaauuaaagugucacaauguuuuaaaaaauaauauagcaagaggccugguacgguggcucacgccuauaaucucagcacuuuugggaggcacuccagccugggagauagagcaagacugugucucagaaaaagaaaaaaaaagauaauauaacaagaaauacuaauuuggugguaacugacugggacuaaauugccagugugcgccaauaaaaacuaguaaaauggaacaggacauggugucagcaguauagaugguacuuuuaggcacacuggguuucccccaacuucauuuuuuaagacuaucagugcauuucuuuaauuguagagcaauuuugaaaugcagucuucgcugggcuugguggcuuacgccugucaucccagcacuuugggaggccaaggugggcggaucaccugagaucaggaguucgagaccagccuggccaacauggugaaaccccaucucuacuaaaacuacaaaaauuagccacgugugguggugcaugccuguagucccagcuacucaggaggcugaggcaggagaauugcuugaacccgggaggcggagguugcagugagcugagaucacgccccugcacucuagucugagacucuuguaucaaaaaaaaaaaaaaaaagaagaaggaaaagaaauguagucuuaaguuuauuuaguauuauaacaagcuuuuuuaagaugcagaaguuuuucaaucugugauuucacuacaaaggcccuauauguaagcauauauguaaauagcuuagaagcacagguuugccaguauuuaaagcuauuaucagcuguggguaugcaaucugucaaguuucuagguguuuucuuuuuuuuuccccccucauuuauuacuuuuaacugacacauaauaguuguacauacuuacgggguacagugugacauuuugauagauguauacaagcagguguuuucuauauuaugaaaacauuuggagaaaaaugauugacuuauuguaguccuuuucuuucagcugcuuuucuaacccaaacuguaugucuugaugacacuacaguaaaguuugaaauaugggauacagcuggucaagaacgauaccauagccuagcaccaauguacuacagaggagcacaagcagccauaguuguauaugauaucacaaaugagguaaguauggaugcauuccacaguaaaacuaauuugaguacccacuuuugguguucagaauuuugauuaaauguuuuggaaaaucuuuuucugauagucaugaccuuucugcugaagcuuuugugaauuagaaaaucugguuuuaaaaaaaaacgaaaaugucucauaauacaauaguccuaauaauuucuuucccacagucacuugggacagucuuuuaaagccuuguaucacaaagaugcuugguaaccauuuuuugagccugugcucaauggcuguuucuuuguuuaacaggaguccuuugcaagagcaaaaaauuggguuaaagaacuucagaggcaagcaaguccuaacauuguaauagcuuuaucgggaaacaaggccgaccuagcaaauaaaagagcaguagauuuccagguauguuaaauuuaacucucauuugaaaggcacuuuuuuccuguauguuuuucuuucaugucaacacuugaauuaguuauaaugucaaaaccaugcaaguaauagaaaauacugauuuuuaaaacaaauauaaaguacuacauauaauaaaauguuucugauaaaccuaaauuuuuaaauagauuauuguaauauauaaacugacccaaagauuuuguagacuuaaacaauaaaggccggguucaguggcucacgccuguaaucccagcacuuugggaggccgagguggguggaucaccugagguugggaguucaagaccaaccuaaccaacuuggagaaacccugucucuacuaaaaauacaaaauuagcuggagaugguagugcaugccuguaaucccagcuacuugggaggcugaggcaggagaaucucuugaacccaggaggcggagguuguggugagccaagaucacacuauugcacuccagccugggcaacaagagcaaaacuccgucucaaaauaaaaaagaaaaacaguaaaaguagucauuguucacagugcagaaagugauuguauccugcccuaauuccuccaucccacacauacuuuauguccuaacccucuucuacucaugugcaaauauguaucagcacauguguguaccccacauauguacauacgcaaacacuuaugugguuguucuuaaaggggcauucaaacauaaagguucugccaaucuguauccagaguuggaaaauaauaagcuaaaaacuaauaauuaaaaaaaauuuuuuuaaggcugagaaaauccaguuuuguauuacgauugcuaauucagaauguuugcugcugcaaaauaggcaagugcaaucacuuaaaaacaaagcaaguccucuauuuagacuuuuuuuuuuuuuuuuaagauggagucuugcucaguugcccaggcuggagugcaguggcgcaaucucaagcucacugcaagcuccaccuccugggcuuacgccauucugcugccucagccucccaaguagcugggacuacaggcgcccaccaccacuccuggcuaauuuuuuguguguuuucaguagagacaggguuucacuguguuagccaggguggucucgaucuccugaccuugugauccacccgccuccgccuccaaaagugcuaggauuacaggcgugagccaccacgcccggcauacuuagaccuuuuaaaacugugccuguucucuugcucuuuggcuucucuacuagaagggcgguuguggcuguucuguauauaucagugaugaaauaguuuucuuuuuugaugacguagauggaauccauguauucuugcaucauuagguauuaaguugggcauguuacauuuguaauuuuauuuaauucuuaggacaacgaugugagauguaguauccauuacucuuuccaaaauuguugccuucccagcacaagaguggcagagaaaacacuuaaauuacagucagaaguggcccugucacauaacaguucagaggaaccucaguuguuucuuuguccaaugggaaagaucauugguuaccccucacaacagcuaugaggaucaaaaguaauaauauauguaaacuguaaaagcaugacaaaaauguagggcagugauguaauuuucaaaggaaugauuuaugauauauucaagauuauaauauugcuguagaagucauugaaaauuaaauaugagguugucauuuaguguuugaagccaguguuagauauuugguuucccuuugucuucauugcagacaguaagugcaaauaaaaauugccguugagaucaaagagaguuuuauuuagaauaagauaauucucccccaucucuggaacucaguauuugaaagcagauuuaauguaagaaaagauuaaucaaggugggauaaugcaagaauuucagacaaaaaaggaaauaguccauuauaaaauuaucuugcacagugcucuuaccucuguuguagcuuauuauauaguuguugauuauagaugauuauaggaaucagguuguaguaauaagaaagucuccuuuucuauaacaaguuuaaagcagguguaguguauuuccaagagauauaucucauauaucucauuuuuuguucuguaaacaggaagcacaguccuaugcagaugacaauaguuuauuauucauggagacauccgcuaaaacaucaaugaauguaaaugaaauauucauggcaauagguaagauuaauaucucuuuuuaaaugaucaauauaagcaaaacaagugugaagcauauuugguuugacugucucuuuuuuaaaaaauuuuuggggguggguuuguguguauguuuaugugugugugugagagagagagagagauuauaccacuuuucuaagucccuuccacaaaacaauauuuuguugguaauauuguuaaauuugaaagaugauuaccuauuagguuguaauacugucaguuuaggcagcuucuuccaggugaguuaagccuuaaccucuuaaccugauaguucagacagacagauuuugcaaagguuucgcugggaaauuuggauaaauauuuuuuuuauuagauuauacuuuuuaaaaaucaaauuauugguaaauauaacucagaagaacaugacacauaaguauacagauugacaaauuauuuuaauguaaacauuauaaggaagaugauuucaaagcauagaggcguaaggagaaaaaaggaaaacaaaacaacauccauacuuuauauuaccucagauggucauuugaucuuacacaauguucuugcuguugcuuuaagguacuuuuuuuuuuuuugagacagucucgcucugucgcccaggcuggagugcaaugguacgaucucagcucacugcaaccuccacuucccggauucaagcgguucuccugcuucugccuccugaauugcugggauuacaggugcacaccaccacgcccagcuaauuuuuguauuuauaguagagacaggguuucaccauguuggucaggcuggucucgaacuccugaucucgugaucugcccaccucggccucccaaagugcugggauuacaggcgugagccacuacacccagccuaagguacuuucuuuuuuuuuuuuuuugaaauggaguccugcucugucacccagguuggagugcagugggacgaucucggcucacugcaagcuccgccuccuggauucacgccauucuccugccucagccucuccuguagcugggacuacaggcacccaccaccaugcccgacuaauuuuuuuuguauuuuuaguagagacgggguuucaccauguuagccaggauggucucaaucuccugaccuugugauccgcccacgucagccucccaaagugcugggauuacaggcgcgagccacugccccuggcccuaagguacuuuuaacugaugguaauugcuguuucaguuauaaguaaugaaguuggaguaguaauaagccuccuuuuuucuauaacaaaaauaaagguugguuuuguuuuuugguuuuggauuuuuuuuuuaacccuuuccucuuuccagugguuuuaauguauagauucuaccugaagggucuguuuuggugguucucaaaguuugccgucugugguuuucaugugcccagcacucuucucaucccauaacaccuuuuauuuuacagcacugauucuuaacugggguguucacaguccuaaccccaaguaagaaauauucuuaaauugaacucauaaauaguuaauagcugaaucagagaauaaugaaaacccaguaaaaguugcaaguauuuuuauuauuuuucacuaggugacagaguuuaaugguacuucauucgaaaugggaaagaacuugccuuuucucauguaaacuguuuuccugaaaaacucaaguuugcaguuugcuagggaagugcuggcacaguugcgaaggauugugugauaauauacucauuuuacaaaugugacagaugacacccagaaucacaucugaaaaguuagaggaaacaaugaguuaauaggccucucaaaucagccugcacuguaaaccuuucucacaauauuuaaacucuaccagaugggcuuuaguuuguaccuuuuuauucaaacaugcuaauaaagucauuuuucgaguuagaaagcagccuacauauuuuaguuuuuuguuuuuuucugaaaucagaauguugcacuucuuaaaagaaaaucuauguuguaaauggaauuguggccuuuccauuuccuucacuagguuaguaaauuuuuuuuucuuuuuuuuuuuguuaugaaggaacacuuugauagauuaguaacuuaaaucacacagugcacucauaacaacucuaaucaaugcaaggacuaaaaaguuacucguucuaguuuaccuccuucauccucuuaaucucacucaccucugauuuaaacacuuagggaacaugcuaaagggauacaugauugauuacucaaucuggaaccuaaguuguuauuauauacaauauauagugcuauuuugugucccagguaccaguguucaacauuucuggggcuuugcuuguaaauacauuugacuggagauuuaccauuauaaugcuauuuaugcuaccagcccagagccagucccagagaaguggcccaauugaaggcuuucuuuccaaacuucagugcuccuggcucccaaauccauugcccaacccagcaucuaggauucuaaaaaugauugaugcugauguagaauggaauguguagaacaaauaaaggauaaaagguucacaaugcaacuaggcaauccgaucucaaagcagaguguauucaauuucugaguaaccugagucaaagcuaugguaaaguuagagucuuaccauaguggucuguccccaagauugauagagaucagugugugcagccacucuuaaaaucaguacucuuagucaucuuuaauauucugccuccccucaaaaaaugaauuuagcacaucaaggaucuuauguauuaaaacaaacuacagcaaucuccaacuuuacagugguuugacuuacgauuuuauaacucgauggggugaaagugauaugcauuuaguacauucuuaacuuacuacgggauuacauacagaaacccaucauaaauuaaaaauaucauaaaucaggcugggcgcaguggcucacuaccuguaaucccagcacuuugggaggccaaggcgggcuaucaccugaggucaggaguuggucaggaaacaagccgggccaacaugucgaaaccccgucucuacuaaaaauagaaaaauuagcuggguguggugguaugugccuguagucccagcuacuugggaggcugaggcaggggaauugcuugaacccaggaggcagagguuguagcgagcugagaucgugccacugcacuccagccugggugacagagcgagacuccgccucaaaaaaaaaaaaaucauaaaucaaaaacauacaacuuaggauggauauaucaggauguagccccauuguaagucaaggagcaucuguauauccagcagguaaguuuuuuuaaucagugggaagcacacuccagagaacagccacuagcuguauagagcuuggcagagguaaagccguaacugcugguugagaguguugucugaauuugacaagccacacucaucggacucaaauaaaauuaagaaauaguuuuuggagaugaggucuucaggauaauucuaucuggauuagguacagcuacuggucagucagauuaggauucaucagcccauaaaaggagaaaaugagguugguugagguggcucacuccuauaaucccaauacuuugagaggccacggugggaugaucuucaaggccaggaguucuagaccagccugggcaacagagcaagacccuaucucuaccaaaaaaaaaaagccaggcaugguggugcacacccuguagucucagcuacuuggaaagcugaggugggaggaucuuuugagcccaggaguucaaggcugcagugagcuaugauugaugcaccacacucuaacuugggcuacagagggagaccuugucuccaaaaugaaaagaaguauggcugcaggcuacauucaaacuaagaucacaacgaaguguugaguauguauaaauguauguggauauguuugugucuaaguguauuuccacuagcaugcuaagguauguuugugugugaguauguuuccuccaguaugcuaaguuuugacacaugcaggcaucuaacuuggguguuaucuguccuuccuuugcccaaagcauagauuauaauuguucauucucaaaaaugcaacucuuaucuauuuccccuuuauuugaaggcagcugaugguuacucugcaagguguaaguuucucuuuuaaaaacuaagcggucgagcaugguggcucaugcuugcagucccagcacgugggagucugaggcggaagaguugcuugagcccaagaguucaagaccagccuaggcaacaaagugagaccccaucucacuuuggaacucaggacugcaguaagccaugaucauaccacugcacuuaauccugggugacagagugagaccuugucucuuaaaaaaaaaaaaaaagagagcauguauauagauguuuuaaggccaaaggcuguggaagccaggaaggaaauaguagauaugaucuaucacaauucggggugauaauuaguugcacaguagaggacaaguuuuguuggggugaugauugcaaagguauuuguauccugacuuguucuaaaaaauguuuguggcagucuagagaacgcugauaugagcugagcuucuuuauaaacuuacuggcuggccaucaucuuuauugacuuagauuuuauuuaauagaaguaauaaugaggccaggugccauggcucacgccuauaaucccaacacuuugggaggcugaagcagguggaucaccugaggucaggaguucaagaucagccugggcaacauggugaaaccccgucucuacuaaaaaacaaaaauuagcugggugugguggggcaugccuguaauuccagcuacucgagaggccaaggcacgagaaucacuugaacccaggagguggagguugcagugaacugagaucacgccauugcacuccagccuaggugagccugggugacagagugagacuacaucucaaaaaaaaaaaaaaaaaagaaguaauaaugaguauaaaauaaaauagaacuuuucugguauuauugagugaaucgguauagagaauuacauaaagcacuaguuaggcuuaaguuuuaauuguaucuacaaccaguccccaucuaccguucccccaacacaauuaccccagaaaucaaacucccuaagacagcaaccaauauuuuggcauucaauacucaguaaacauuugaaaagaaugaacauaugguuauaugauacuuuggggguaaccuaacuggaaagaaaaauuauagauaagcaggugaaacugauauuaauaugaguauucaaauauucuauuuauuugaucauuuucuuucagcuaaaaaauugccaaagaaugaaccacaaaauccaggagcaaauucugccagaggaagaggaguagaccuuaccgaacccacacaaccaaccaggaaucaguguuguaguaacuaaaccucuaguuugaacuagcuggaauagucuucugcuuccuaaauguuaauaacaauggaauuggagcauuuaaccagcccaguaugacuuccaaaagaagagacuuaugauagagucaaguuucuaauacagaauuauuuuaaguguuuugaacuuaauuuuuaauaacaugcaugggucccucucacuaauguuucaacaauagggaaaaaugagaacuauguggacacuuguuucauuggaagguuagggggaauaauuucucaucacuaggaauauagacaaaugacugucugggcccacacaguuaaccagcccauuucuccacacugguacaguagucaccugugaaaaaaaaauuggaacuuacuaauuugggcuuuucaaaaacauucuuuguuuagaaggagauucuaaaguuauuuaugaugcuuagccauaguauucaggcaaauguucauuucuccugguaccuguauuuaaaauguacauuccacauuuuaauaaauuaaccacaagaaaauaaucccacauauacaaggucagggguggggaagaguauuaaugguaucuuaauuauacccagucugguuuuuuuuuuuuaaaugggguaaaaaucaaaugcaaccccaucuuguuuuaggaauuuugagaacuaauaaaugcaccuuaauggucaguguuccuuucaaacaugugaguucuuuaacaaaaaugaaauaaaccaggugucugugauuucuaauuaaucaccgcuggccauuacacagguuuuguuguuugggguggggagggggcuuuuguucccuuuugacauaauauagucaaugcacuaacaauuauguauauucaaacuugauuauuuuaaauucgaucuucagcuguacuguaaauaggguacugcauuguagucuccauaucuguauuacuuuucuguaauauuuaagaguugcuuaaaagcauacaaaauguacuguuacuaaaacagcuaauuauuucucucucccccuuugacaggaaggggcuucaguuguuccuccauggcuagaaccauaauaaacaauguacccguaauuuguaacauaaaguauugcaauauguuaguaacaaucuugcagccuuccuuuccaaaguucauuuuauuuugaucaguucaguauauugcacuaauuauuuuagguauuuucauuauaugaaagcuaccaugugucagagaugauuuaaucuauuuaaguguuggacugcuaggagaacuuguacauuuaugauaaugcagaauuaggaaaacgguucaccaguguuuaguuuuauauugaggugcucagguuggaauaaagugguauaaaaagcaa

SEQ ID NO: 193004 - RNA, 14877 nt, Homo sapiens
aacuagggcccggagcccggggugcuggagggaggcggcaggcccgggucaggggccucgagaucgggcuuggggugagaccugugcgccgucaccacgggcggggcggggccuggguccaccgggguucugaggggagacugagguccugagccgacagccucagcucccugccaggccagacccggcagacagaugagggcccaggaggccuggcgggccugggggcgcuacggugggagaggaagccagggguaccugccucugccuuccagggccaccguuggccccagcugugccuugacuacguaacaucuuguccucacagcccagagcauguuccagaucccagaguuugagccgagugagcaggaagacuccagcucugcagagaggggccugggccccagccccgcaggggacgggcccucaggcuccggcaagcaucaucgccaggccccaggccuccugugggacgccagucaccagcaggagcagccaaccagcagcagccaucauggagguaaguaccccaccaccuccaccugccgggacaccucacccccagcccacuggcucccugcaucccaguugcauccacaggcacugaaugcuuugggucgguccccaaacucucagagccccaguuuccucuuucguaaaacagcaauuaauaaccaccauuguaggacuguugaguuaauuagcaggaacauauaggaugcacuugauuacagagcuggugcacauuaaagcuaaaaaaugguugcugccgggcgugguggcucacaccuguaaucucagcacuuugggaggccaaggcaggaggaucgcuugagcccagaaguucaaggccagccugagugacuuagggagacuccagcucuuaaaauacauauauauauauauagcagcuauuagugugggguuaggacagaaaucagugacaggcaggcagugauccgaaaaggaaaaggggccugccuaaggccacaccuuccugguguuucuuuccuuagaaugugggggcuggaagccuccuuggugcccugccccaggcuacaugcuuucccugggauuaggccuuccagcucccagauguguucuuucuugcccuguggcucguacccacagcaggacuguccuggcacaguggccaggggcagaugaccucaaggggcagacaguccucccagacagcagggcuguguggggugagaagcacaggcuccaagauggaaggauggacacugggguucuauguccauuucucaguaggcucuagcaccccugugcccagcacuggccuuggcaccuggaacaacaacagauaucuucugaacacaaaaaccaggucaagcugggugggguggcacaugucuguagucccagcaacucaggaggcuggcuugagcccaggaauucaagaccagccugggcaacauagccagaccccaucucuaaaaauagaaaacuaggucaugucacucuggcacugcagcuuaaaagaccuccuccccauuuucaggauuaagaaggcuuaagaggccucuuuccccucgcucucuuacggauaaacacccacacucgauucucucagauuggaccccauagcuugcuuucuuuuuuucuguuuguuuuguuuuguuuugagacagggucucgcucuaucacccaggagggaguacagaggugcgaucucagcucacugcagcccggaacuucugggcuuaagugauccucccacguaacugggaauacagguguguggaccacacccaguuaauuuauuuuuuacuuuuucuuuuuuuuuuuuuuuuuuuccugagacggagucucacucugcugcccaggcuggggugcaguggugcaaucucggcucacugcaaccucugccuccuggguucaagcaguucuccugccucagccuccagaguagcugggacuacaggcgcgugucaccaugccgggcuaauuucuuguauuuuuauuagagaugggguuucaccguguuagccaggguggucuccauuuccugaccucguaauccacccgccucagccucccaacaguguugggauuacaggcgugagccaccaugcccagcauuuuucacauuuucaugagaugagggcaggggcggggucuccuuuuguugcccaggcaggccucaaacuccugggcucaaacgauccuccugccucagccuccagaacagcugggaccacaggugcaugccaccacaccagcucauuuuuuauuuuuuguagagguggggucuugcuuuguugcccagucuugucucgaauuccugggcccaagcaauccucucaccuuggccucccagacuguugagauuacuggcgugagccaccaugcucagccuccacagcuuucuuuaacuuccugagcuugcacuuggccauuuuucugcucacaaacuuccccugcucucugccccccacacacacucagcauucacucgcgccacacagugagugcucaccgugugacacaggcuguuccaguugcuagggggccucggugaacccaagcgucaggaauccuugcccuuguggagcuuaccuucuagugagcugguggggccaugagcaaacaagcacaaaagcauccuaucaugcgugagaagauuuguaugggggcagcauguaaaagaguuaagagaggccgggcgcgguggcucacgccuguaauuccaacacuuugggaggccuaggugggcguaucacaaggugaagagauggagaccauccuggccaacauggugaaaccccaucucuaccaaaaauacaaaaauuagcugggcaugguggcgcgcaccuauagucccagcuacucgggaggcugaggcaggagaaucgcuugaacccgggaggcggagguugcagugagccaagaucgugccacugcacuccagccuggcgacagagugagacucaucucaaaaaaaagaguuaagagaauccggagucacaggggcggggggagugaugguagcagagguggucagcacucaccuuggugagaagcaccacuggagccaaggccacagggaugaugggaagagaguuccaggcagagagaagggcagaugguaaggccucgagggcaacaccugcuccuggcuagggugggccuaggggaggggguuuaggaaaggguauuuggagaccuaaaguugaaggucauucuaaggacucuggcauugccuuugaguaaaaaccuggaaaggauuugagcagaggcagcauggucagauuuagacauucagagagucaccagggagguggugagaaguagcugaucccuggauuuauuuuuaaagcagaacuggcaggaucugcugauggacuggauguggggugcgagggaaagagaggagucaggaugaugccaaggaauuuuaaaaaaacuauuaggcugggcgcgguggcucacgccuauaaucccagcacuuugguaguucgaggugggcagaucaugaggucaggagauagagaccauucuggcuaacacggugaaccccgucuccacuaaaaauacaaaaaauucucugggcgugguggugggcgccuguagucccagcuacucuggaggcugaggcaggagaauggcgugagcccgggaggcggagcuugcagugagcagagauugcaccacugcacuccagccugggugacagagcaagauuccgucucaaaaaaaaaauuauuauuggccgggcgugguggcucacaccuguaaucccagcacaucgggaggcugaggcaggcagaucacuugaggucaggaguucaagaacagccuggccaacuuggugaaauccugucucuacuacaaauacacaaauuagcuggaugugguggugggcgccuguaaucccagcuaccugagaggcugaggcaggagaaucacuugaacccaggagguggaggucgcagugagcugaaauccugccacugcacuccagccugggugacagagcaagaguccgucucaaaaaacaaaaaauaaauaaaaauaaaauaaauuaggccaggcgcgguggcucacgccuguaaucccagcacuuugggaggccgaggcgggcggaucacgaggucaggagaucaagaccauccuggcuaacacggugaaaccccgucucuacuaaaaauacaaaaaauuagccgggcgugguggugggugccuauagucccagcuacucgggaggcugaggcaggagaauggcaugaacccgggaggcagagcuugcagugagccgagauggugccacugcacuccagccugggcgacagagcaagacuccgucucaaaaaaaaaaauuauuauuauuauuauuauuauuauuuuauuuuauuuuugacauggagucuugcucugucgcccaggcuggagugcaguggcaccaucucagcucacugcaagcucugccucccggguucacgccauucuccugccucagccuccagaguagcucggacuacagccucccgccaccaugcccagcuaauuuuuuuguguguuuuuaguagagaugggguuucaccauguuagccaggauggucucgaucuccugaccuugugauccgcccgccuuggccucccaaagugcugggauuacaggcgugagccaccgcgccuggccaaauuauuauuaauuuuagagacaaggucuugcuauguuggccaggcuggucuugagcuccuggccccaagugauccucccaccuuggccucacaaagugcugggauuacaggcaugagccacagugcccagccaacaccaaggaaucuggcuugagcacccgguaggaugaaguugcuuuuaauggagaagaaacacugaagggugagggaggaucuggaggcuacccuagagggugggauagagggggauuuuuuuuuuuuuuuuuuuuuugagauagagucuuacucugucacccaggcuggagugcaguggcacgaucucggcucacugcaacuuccaccuccuggguucaugccauucuccugccugagccuccccaguagcugggauuacaggcaugcaccaugcccagcuaauuuuuguguuuuuaguggagacggggguuucaccauguuggccaggcuggucucgaauuccugaccucgugauccacccgccucagccucccaaaaugcugggauuacaggcaugagccaccgcgucuggccgcuagagguggcuuuuaagcaucuggugggauuuuuagcagggugcuagugggagcuggcagggacuuggagucugaaccagaguugugcuugucucaguccaguuagggguaggggcuucaggugugugcaaaggaaggaaugguagaugugggguccaagcuggcugagcuucagggaagggagcaagcccugggaagccgcagcaucguuggaguuggggucccgggggcaugauccacacagguugggucagcuggugggaagcuugggauggaguuauuugauggugacaaggccuagguuaugucccugggaaugagucugaggggagagugggacaagaucaugguagaaggaguagcaagguacagaaaggagacagggugcugguggaguggcagaggacaggaguaacauucugcacaggccagggacgacaccuccccccagccccagcugcagacccguaggaaagagggcugcgggagaagacagcugccaggugaggacagagcuggauuucuuaaccuuuugauuuaguuuucagugucuccaaaagcaagugguuucccagaaaagaucagcaagugccagugccccgccagagccacggggccucugcccucucuaccugcgcagagcaacucacacuugguucggucacuccucauagucccugccaccaggccccccugcuggauggcugagguguccccagggcagggacugcagccaccuugugcugugacagcccacacagcccagugucugaaacagguguggacaguggagaggcagaaagaagcagcccagugcuagccccugggccagacugcaggguucaaacguggcucuacccuuccuagcagguugagcuugagcagguuaauuaacuccaucugccugaguuuccucaucuguaaacgggaauagaacuagucccaccucgcagggcuguggcgaggaccugaugaguuaauauaggaaaagugcuuggaaacagugccuggcgcagaggaggggcuaaguguuugcggcucuuauuauuagaacugccauuguuauuauuuauguauauauauauuuauauauaaauauauauauauaauuuuuuuuuccaagauggagccucacucugucgcccaggcuggagugcaguggugcaaucucgccucgcagcaaccucuaccucccagguucaagugauuuucuugccuuuauguacauucuuggcuuuauauauuuauaaagccucaaauuucugggcuccagccauccucccaccucagcuuccuaaguagcugggacuacaggcgcacgccaccaugccuggcuaauuuuuuuauuuuaauuuuuguagagacaagggucuuucuguguugcucaggcuggucucgaacuccuggccucaagcaguccuuuugccuuggccucccaaaguguugggauuacaggcaugagccaccacauugggccuauauuuuuaaguuauggacaaaaauccaaagaacuauauuuuguaacgugaacauucuaugaaauucaaauuucaaggucccuaaagaaaguguuaguggaacacagcaaggugcaguguauucauuuacacauugauuaugguuuccuuucagcucuggccacaaaggugagugguugucacagagaccacguggcccacugaacccccuuuauagaaaacauuuucagcuaacuuaggaaaagggaaaagaaagugaacaaacauuugccagccagccuuucauaccuguaaucccagcacucugggaggccaaggcaggaggaucacuugagcucaggaguucgagaccagccugggcaagauggcaagacacuucucuaaaaauuuuuuaaauuaaaaaauuagccgggcauggugaugccuguaguccaagcuacucaggaggcugaggugggaagaucgauugcgccuaggauuuugaggcugcaguaagcugagaucgugccaccccacuccagucugggugacagagagagacccugucgcuguuuuuuaaaaacaaaaaggaaacauuugccaacuuuagaguacuuucugauuuuaugagcucugagcaagguuggggguguucucugcaggccugaaggggcuucuguaccggaaggcuauagucaaggcugaggccuacaggugccggaggcggacaggcugcgagugucugcccagggugggguggcagcacuggccacugugcuggccacugacgucagccucccccggcagcagauuguguguggucggcaugugguaggggcaggauccaaacccagcccuugccugauggcagagcuucacugcuccaaacggucuggaacaccacuguuuuaauuaagugugcaauucagugugcaagugucuuguaauuaagugugccucuguuuccucaucuauaaaacagggagaacuucguauucuccuucuugggaaucugaggacucugaaaaucccagugcagggaugcucgcggaagcaucagcagggauguccgccccagccgcugacucagaagcccaacacgcagagaauguaaagcuagaggugccaugcuggggccuggggcacuucuagccacagccacuacccuccacuuccacacccagcuccgggccaggcucuaggcggauggcaagagugggcaggccugggcacccacccacguucacacccaaggaggagccacaccccuucccuuccccagagaagggagagucuggcccaggcccugccccagcccucuccuucccccagggaauucacagacacucccccaggguuuuucccuguaaauagaacacuuuuuaaaaauucaauuuagggcugggcaccguggcucacgccuguaaucccagcacuuuggggggccgaggcacuuggauugccugaggucaggaguuaaagaccagcccgaccaacauggugaaaccccgucucuacuaaaaauacaaaaauuagcugggcaugguggcgggcaccuguaaucccagcuacccaggaggcugaggcaggagaaucauuugaaccuggugagcagagguugcagugagccaagaucacaucacuguacuccagccugggugacaaagcaagacucccucuaaaaaaaaaaaaauacauauauauauauauacacacacacacacacaaauauauacacacacacacacauaaauauauguauauuuguauuuacauauauauaauucaauuuacacaaauggguaucaucuugauaacaacuagcuuggcuaaguccacgaauuuggugaaaaacucccaccccauaggacagguuccuggcagaacuggugcuagcagaaggcccaaaggggccuuccccagccuaggccuccaaggcagcccaagguacagcuggaaggagccuggggcaugacagcuaagcacacagccccugaagccacauugguuggguugggaucccagcucugcuaccuacuagaucagugaccuugggcaaguuaccuaugcucucugccuuaguuucuuccucuguaaaauggcaaccaugaggaaccucccugauaggguguggcaaggaucaaaugaaugaauacacagggagggcuuccgaccauccaccauaccugcccagugucuucugcuuguucugaucccugggcaaggggcagugcccaggccaagugccugggugcaagucacucaccuuccaccuguggggccuuguguccggcaagcguagugguccuguggccccacucagagcuaguggaggagaacagcugccguuuccugcguauuuagguggcuaagcaggcugucccagccacacggccucaggcaaguucuuaaccucugccucuguuuccucaucuguacaacagggagagcuggauauucaccuggcugggacucucagaggccucaggcuaugaggggccgguagggggcuuuccugcucucauuuguugucauggcgauccuggcagauggggaacugcccccauuucacagaagacacuggggccccaaaggguuggagaaugggcuaaggucagagcaggaauguggccagggccuggcccaccuagcugaccccugcuccacagucaccgcaccacagaacuggaaauuacucugcagacaggccuguuccgucagugccccuucuguucccggcucuccugccccuauccgaaauccuucagccucccaaggugcugggauuauaggcaugagccgccacgccuggcugucaucuguaaucuuuacuccugaccuaguaugccucuccccacugccaccucacuccuccagggucuugagguauccccaccugaccugggggcagcucugggcuuuggugaugcucagaaugcccaggcacucugaucacagccuaucuuacccuaggccuuuccggauuccguccucucguucccuuacucgcuuuuuuuuuuuuuuuuuuuuuuugagacaaagucucacucugucucccagacugccagacuggagugcaauggugagaucucagcucacugcaaccuccgccucccagguucaagugauucuugugccuuaaccucccuaguagcugggacuacaggcccacaccaccaugccuggcuaguuucuuuuuuuuuuugagacagagucucacucugccacccaggcuggagugcaguggugcaaucucggcucacugcaaccucugccuccuggguucaagugauucucccgccucagccuccugaguagcugggauuacaggcucgcgccaccacaccuggcuaauuuuuguguuuuuaguagagacaggguuucaccaugugggucaggcuggucucgaacuccugaccucgugauccaccugccuugggcucccaaagugcugggauuacaggcgugagccaccacaccuggccuuuuuuuguauuuuuaguagagauggguuuuugccauguugggucaggcugaucucgaacuccuggccucaagugauccaccugccuuggccucccaaaguguugggauuacuggcgugagccacugcgccuacuugcuuuuuuuuuuuuucucgagguagaguuucacucugucacccaggcuggagugcaguggcgugaucucagcucacugcaagcuccgccucccggguucacgccauuguccugccucacccucccgaguagcuggaacuaaggcgccagccaccaugcccagcuaauuuuuuguacuuuuaguacagaugggguuucaccguguuaggauggucucgaucuccugaccucgugaugcgccugccucggccucccaaaguguugggauuaaaggcguaagccaccgcacccggccaccuacuugcuuucuuagucaugugucucauuuauguguccuagcugggaccccuggaggcccugcacuggcccacaggccagguccucagguccucugaggggagaagagacauuccaaugguuaucccccgccuucaguuccuggccuguaauuuaccuccuccaaagagccucccugacagacauaucuugccauaaacacccagcauguuucccuaccugccucucuuuuuuuuuuuuuuuuuuuuuuuuugagaugggugcaguggcgugaucuuggcucacuguaaccucugcugcccagguucaagcgauucuucugcuucagccucccgaguagcugggauuacaggugccugccaccgcgccuggcuaauuuuuuuguauuuuuaguagagacgggguuuuaccaucuuggucagucuggucuuaaacuccugaccucgugaucuccccaaccucggccucccaaagugcugggauuacaggcgugagccacugcgcccagccccccaccugcuucucacucugucauugcacucugaguguuugcucaggggagugguucuaagucuuuaucggucuggguagaggaguggaguuggcaggaguugggagauggcacagagcacaguucaaauagaccauaguaggcgggccucugaauaauaacccauagugcacuugcagccuacaaagcacuuucuuuuuucuuuuguuauuauuauuauuauuugagacagagucucgcucugccacccaggcuggagugcaguggcacaaucucggcucacugcaaccuccacccacuggguuaaagcaguucuccugcuucagccuccugaguggcugggacuacaggcgugaaccaccacaccuaacuaauuuuuguauuuuuaguagagacggaguuucaccagaguuugaggccaggcuggucucgaacuucugaccucaggugauccaccugccuuggccucccaaagugcugggauuacuggcgugagccaccacgucuggccuucuuuuauuaauuuuuuaaauuaauagagaugggguuuugcaauguugccuaggcuggucucgaacuccugaacucaagcaauccaccugccucagccucccaaagugcugggauuacaggcgugaggaaucacgcccagccacaaagcacuuucacauuuuuuaauuuuaugugauguucacacagccacugggagucagggcuaggauuauccccucauaaaggugaggacacaggcuaagagagucgaaggcuggcuagacaaggggagagacacagagcuccgcugaucaucacuggacucuggauuccaccaaaccuuuggaaccuuccagccucaggccuccacagcuucacagaaacugggcaagucuuaacucucuaagcuucugucuucucaccuaagcauguuugguacucaccucccagggugguuaggaggauaauaagggaaugucucggccuacacguaagugcaccaucaaugguaccuaaaaacgucaacaguuccagacacugucuccagagaaggcucugugggggaugcggacauguagcggccaaguucuuguucuccaggggcucugcaggucccuugcagaggaggcauucaauccugccggcuguggcaggacacuuuccuauccaagggauuggcuuccuccgauguagaacagacacuaugaaauagcuaccaacccagggguugccaggaggccccaugaaggucuugcacuaauaauacuucuugcuuuuuuuuuuuuucuuuugagaaaaaaagccugucgcccaggcuggagugcaguggcgugaucucggcucacugcgaccucucccuccuggguucaaacgauucuucugccucagccucccgaguaacugggacuauaggcacgugccacuaugcccagcuaauuuuuguguuuugaguagagacaggguuucaccauguuggccaggauggucucgaucuccugaccuugugauguaacuaguauuucuuaugcccuuauuuugugcuaggcacagggccucacccauuauuggcacucgguaaggauucgugggauuaaugagaaguuaaccuaaaucuucaccaaaggccccugagcuuccccucgauucacauacaagggacuggggcucugagaggugggcugugaugcgccccuggaagacccacgagugggccugcagagcugauggggaggguucaggcagggccaggggcuuagaggagcugagauuaacgucgccccccuacccacugacccucugcaggcgcuggggcuguggagauccggagucgccacagcuccuaccccgcggggacggaggacgacgaagggaugggggaggagcccagccccuuucggggccgcucgcgcucggcgccccccaaccucugggcagcacagcgcuauggccgcgagcuccggaggaugagugacgaguuuguggacuccuuuaaggugagcgccaguccccagcgugccaggaccugaaguaccaggccgccccccgccggucugucccugccuugucccaaggcacgcccggaucuggagucccacgaccccuccccaaagccguccuguuccuuccuagcuccagagcauucugggauuuguagucacaagacuuccccgcccccacuccccagcucuucccccgccuggugugugugugugugugugugugugagucacagggcaugcugggaucuguagucuagaucccacuccaggcgugugugugugugugugugugugugugugugugugugugagagucacagggcaugcugggaucuguagucuagaucccacuccaggcgugugugugugugugugugugugugugugugugugugugugagucacagggcaugcugggaucuguagucuagaucccacuccaggugugugugugugugugugugugugugagagagucacagggcaugcugggaucuguagucuagaucccacuccaggugugugugugugugugugugugugugucagucacagggcaugcugggaucuguagucuagaucccacuccaggcgugugugugugugugugugugugugugugugugugugucacagggcaugcugggaucuguagucuagaucccacuccaggcgugugugugugugugugugugugugugugugucucacagggcaugcugggaucuguagucuagaucccacuccaggccaaagcuccuggguuccccgaauucuuggaagaccaggcaugcugguauuugugcuccuugcuggcaccugugcgcucugucgcccaggcuggagugcaguggugcgaucacggcucacugcagccuggaacuccuggccucaaaggauccucccgcuucaaccucccaaagugcugggauuacaggcgcucaccaucgcucccggcccuuugauucucgaauugcggucucaucuucugggugcuaggucuccagcucuggccuuuccauuuagggcccuaggcauccucucuucccgucuccggcacggaguuccugggaucuaaccaguucccauuccugggggcccaugcguccucgcgagcgucccugaccgcccggcguggagccuccugggaguuguggccuucauuaucucccccccgaucucacuuagaggaaggcucacggaaguggagagccuggcucgagcugccaugguaaucuaacucauguaacccuuuucucccuccaccagaagggacuuccucgcccgaagagcgcgggcacagcaacgcagaugcggcaaagcuccagcuggacgcgagucuuccaguccuggugggaucggaacuugggcaggggaagcuccgcccccucccagugaccuucgcuccacaucccgaaacuccacccguucccacugcccugggcagccaucuugaauaugggcggaaguacuucccucaggccuaugcaaaaagaggauccgugcugucuccuuuggagggagggcugacccagauucccuuccggugcgugugaagccacggaaggcuuggucccaucggaaguuuuggguuuuccgcccacagccgccggaaguggcuccguggccccgcccucaggcuccgggcuuucccccaggcgccugcgcuaagucgcgagccagguuuaaccguugcgucaccgggacccgagcccccgcgaugcccugggggccgugcucacuaccaaauguuaauaaagcccgcgucugugccgccga

SEQ ID NO: 193005 - RNA, 14877 nt, Homo sapiens
ucggcggcacagacgcgggcuuuauuaacauuugguagugagcacggcccccagggcaucgcgggggcucgggucccggugacgcaacgguuaaaccuggcucgcgacuuagcgcaggcgccugggggaaagcccggagccugagggcggggccacggagccacuuccggcggcugugggcggaaaacccaaaacuuccgaugggaccaagccuuccguggcuucacacgcaccggaagggaaucugggucagcccucccuccaaaggagacagcacggauccucuuuuugcauaggccugagggaaguacuuccgcccauauucaagauggcugcccagggcagugggaacggguggaguuucgggauguggagcgaaggucacugggagggggcggagcuuccccugcccaaguuccgaucccaccaggacuggaagacucgcguccagcuggagcuuugccgcaucugcguugcugugcccgcgcucuucgggcgaggaagucccuucugguggagggagaaaaggguuacaugaguuagauuaccauggcagcucgagccaggcucuccacuuccgugagccuuccucuaagugagaucgggggggagauaaugaaggccacaacucccaggaggcuccacgccgggcggucagggacgcucgcgaggacgcaugggcccccaggaaugggaacugguuagaucccaggaacuccgugccggagacgggaagagaggaugccuagggcccuaaauggaaaggccagagcuggagaccuagcacccagaagaugagaccgcaauucgagaaucaaagggccgggagcgauggugagcgccuguaaucccagcacuuugggagguugaagcgggaggauccuuugaggccaggaguuccaggcugcagugagccgugaucgcaccacugcacuccagccugggcgacagagcgcacaggugccagcaaggagcacaaauaccagcaugccuggucuuccaagaauucggggaacccaggagcuuuggccuggagugggaucuagacuacagaucccagcaugcccugugagacacacacacacacacacacacacacacacacgccuggagugggaucuagacuacagaucccagcaugcccugugacacacacacacacacacacacacacacacacacacacgccuggagugggaucuagacuacagaucccagcaugcccugugacugacacacacacacacacacacacacacaccuggagugggaucuagacuacagaucccagcaugcccugugacucucucacacacacacacacacacacacacaccuggagugggaucuagacuacagaucccagcaugcccugugacucacacacacacacacacacacacacacacacacacacacacgccuggagugggaucuagacuacagaucccagcaugcccugugacucucacacacacacacacacacacacacacacacacacacacgccuggagugggaucuagacuacagaucccagcaugcccugugacucacacacacacacacacacacacaccaggcgggggaagagcuggggagugggggcggggaagucuugugacuacaaaucccagaaugcucuggagcuaggaaggaacaggacggcuuuggggaggggucgugggacuccagauccgggcgugccuugggacaaggcagggacagaccggcggggggcggccugguacuucagguccuggcacgcuggggacuggcgcucaccuuaaaggaguccacaaacucgucacucauccuccggagcucgcggccauagcgcugugcugcccagagguuggggggcgccgagcgcgagcggccccgaaaggggcugggcuccucccccaucccuucgucguccuccguccccgcgggguaggagcuguggcgacuccggaucuccacagccccagcgccugcagagggucaguggguaggggggcgacguuaaucucagcuccucuaagccccuggcccugccugaacccuccccaucagcucugcaggcccacucgugggucuuccaggggcgcaucacagcccaccucucagagccccagucccuuguaugugaaucgaggggaagcucaggggccuuuggugaagauuuagguuaacuucucauuaaucccacgaauccuuaccgagugccaauaaugggugaggcccugugccuagcacaaaauaagggcauaagaaauacuaguuacaucacaaggucaggagaucgagaccauccuggccaacauggugaaacccugucucuacucaaaacacaaaaauuagcugggcauaguggcacgugccuauagucccaguuacucgggaggcugaggcagaagaaucguuugaacccaggagggagaggucgcagugagccgagaucacgccacugcacuccagccugggcgacaggcuuuuuuucucaaaagaaaaaaaaaaaaagcaagaaguauuauuagugcaagaccuucauggggccuccuggcaaccccuggguugguagcuauuucauagugucuguucuacaucggaggaagccaaucccuuggauaggaaaguguccugccacagccggcaggauugaaugccuccucugcaagggaccugcagagccccuggagaacaagaacuuggccgcuacauguccgcaucccccacagagccuucucuggagacagugucuggaacuguugacguuuuuagguaccauugauggugcacuuacguguaggccgagacauucccuuauuauccuccuaaccacccugggaggugaguaccaaacaugcuuaggugagaagacagaagcuuagagaguuaagacuugcccaguuucugugaagcuguggaggccugaggcuggaagguuccaaagguuugguggaauccagaguccagugaugaucagcggagcucugugucucuccccuugucuagccagccuucgacucucuuagccuguguccucaccuuuaugaggggauaauccuagcccugacucccaguggcugugugaacaucacauaaaauuaaaaaaugugaaagugcuuuguggcugggcgugauuccucacgccuguaaucccagcacuuugggaggcugaggcagguggauugcuugaguucaggaguucgagaccagccuaggcaacauugcaaaaccccaucucuauuaauuuaaaaaauuaauaaaagaaggccagacgugguggcucacgccaguaaucccagcacuuugggaggccaaggcagguggaucaccugaggucagaaguucgagaccagccuggccucaaacucuggugaaacuccgucucuacuaaaaauacaaaaauuaguuagguguggugguucacgccuguagucccagccacucaggaggcugaagcaggagaacugcuuuaacccaguggguggagguugcagugagccgagauugugccacugcacuccagccuggguggcagagcgagacucugucucaaauaauaauaauaauaacaaaagaaaaaagaaagugcuuuguaggcugcaagugcacuauggguuauuauucagaggcccgccuacuauggucuauuugaacugugcucugugccaucucccaacuccugccaacuccacuccucuacccagaccgauaaagacuuagaaccacuccccugagcaaacacucagagugcaaugacagagugagaagcagguggggggcugggcgcaguggcucacgccuguaaucccagcacuuugggaggccgagguuggggagaucacgaggucaggaguuuaagaccagacugaccaagaugguaaaaccccgucucuacuaaaaauacaaaaaaauuagccaggcgcgguggcaggcaccuguaaucccagcuacucgggaggcugaagcagaagaaucgcuugaaccugggcagcagagguuacagugagccaagaucacgccacugcacccaucucaaaaaaaaaaaaaaaaaaaaaaaaagagaggcagguagggaaacaugcuggguguuuauggcaagauaugucugucagggaggcucuuuggaggagguaaauuacaggccaggaacugaaggcgggggauaaccauuggaaugucucuucuccccucagaggaccugaggaccuggccugugggccagugcagggccuccaggggucccagcuaggacacauaaaugagacacaugacuaagaaagcaaguagguggccgggugcgguggcuuacgccuuuaaucccaacacuuugggaggccgaggcaggcgcaucacgaggucaggagaucgagaccauccuaacacggugaaaccccaucuguacuaaaaguacaaaaaauuagcugggcaugguggcuggcgccuuaguuccagcuacucgggagggugaggcaggacaauggcgugaacccgggaggcggagcuugcagugagcugagaucacgccacugcacuccagccugggugacagagugaaacucuaccucgagaaaaaaaaaaaaagcaaguaggcgcaguggcucacgccaguaaucccaacacuuugggaggccaaggcagguggaucacuugaggccaggaguucgagaucagccugacccaacauggcaaaaacccaucucuacuaaaaauacaaaaaaaggccaggugugguggcucacgccuguaaucccagcacuuugggagcccaaggcagguggaucacgaggucaggaguucgagaccagccugacccacauggugaaacccugucucuacuaaaaacacaaaaauuagccaggugugguggcgcgagccuguaaucccagcuacucaggaggcugaggcgggagaaucacuugaacccaggaggcagagguugcagugagccgagauugcaccacugcacuccagccuggguggcagagugagacucugucucaaaaaaaaaaagaaacuagccaggcaugguggugugggccuguagucccagcuacuagggagguuaaggcacaagaaucacuugaaccugggaggcggagguugcagugagcugagaucucaccauugcacuccagucuggcagucugggagacagagugagacuuugucucaaaaaaaaaaaaaaaaaaaaaaagcgaguaagggaacgagaggacggaauccggaaaggccuaggguaagauaggcugugaucagagugccugggcauucugagcaucaccaaagcccagagcugcccccaggucagguggggauaccucaagacccuggaggagugagguggcaguggggagaggcauacuaggucaggaguaaagauuacagaugacagccaggcguggcggcucaugccuauaaucccagcaccuugggaggcugaaggauuucggauaggggcaggagagccgggaacagaaggggcacugacggaacaggccugucugcagaguaauuuccaguucuguggugcggugacuguggagcaggggucagcuaggugggccaggcccuggccacauuccugcucugaccuuagcccauucuccaacccuuuggggccccagugucuucugugaaaugggggcaguuccccaucugccaggaucgccaugacaacaaaugagagcaggaaagcccccuaccggccccucauagccugaggccucugagagucccagccaggugaauauccagcucucccuguuguacagaugaggaaacagaggcagagguuaagaacuugccugaggccguguggcugggacagccugcuuagccaccuaaauacgcaggaaacggcagcuguucuccuccacuagcucugaguggggccacaggaccacuacgcuugccggacacaaggccccacagguggaaggugagugacuugcacccaggcacuuggccugggcacugccccuugcccagggaucagaacaagcagaagacacugggcagguaugguggauggucggaagcccucccuguguauucauucauuugauccuugccacacccuaucagggagguuccucaugguugccauuuuacagaggaagaaacuaaggcagagagcauagguaacuugcccaaggucacugaucuaguagguagcagagcugggaucccaacccaaccaauguggcuucaggggcugugugcuuagcugucaugccccaggcuccuuccagcuguaccuugggcugccuuggaggccuaggcuggggaaggccccuuugggccuucugcuagcaccaguucugccaggaaccuguccuauggggugggaguuuuucaccaaauucguggacuuagccaagcuaguuguuaucaagaugauacccauuuguguaaauugaauuauauauauguaaauacaaauauacauauauuuauguguguguguguguauauauuuguguguguguguguguauauauauauauauguauuuuuuuuuuuuuagagggagucuugcuuugucacccaggcuggaguacagugaugugaucuuggcucacugcaaccucugcucaccagguucaaaugauucuccugccucagccuccuggguagcugggauuacaggugcccgccaccaugcccagcuaauuuuuguauuuuuaguagagacgggguuucaccauguuggucgggcuggucuuuaacuccugaccucaggcaauccaagugccucggccccccaaagugcugggauuacaggcgugagccacggugcccagcccuaaauugaauuuuuaaaaaguguucuauuuacagggaaaaacccugggggagugucugugaauucccugggggaaggagagggcuggggcagggccugggccagacucucccuucucuggggaagggaagggguguggcuccuccuugggugugaacgugggugggugcccaggccugcccacucuugccauccgccuagagccuggcccggagcuggguguggaaguggaggguaguggcuguggcuagaagugccccaggccccagcauggcaccucuagcuuuacauucucugcguguugggcuucugagucagcggcuggggcggacaucccugcugaugcuuccgcgagcaucccugcacugggauuuucagaguccucagauucccaagaaggagaauacgaaguucucccuguuuuauagaugaggaaacagaggcacacuuaauuacaagacacuugcacacugaauugcacacuuaauuaaaacagugguguuccagaccguuuggagcagugaagcucugccaucaggcaagggcuggguuuggauccugccccuaccacaugccgaccacacacaaucugcugccgggggaggcugacgucaguggccagcacaguggccagugcugccaccccacccugggcagacacucgcagccuguccgccuccggcaccuguaggccucagccuugacuauagccuuccgguacagaagccccuucaggccugcagagaacacccccaaccuugcucagagcucauaaaaucagaaaguacucuaaaguuggcaaauguuuccuuuuuguuuuuaaaaaacagcgacagggucucucucugucacccagacuggagugggguggcacgaucucagcuuacugcagccucaaaauccuaggcgcaaucgaucuucccaccucagccuccugaguagcuuggacuacaggcaucaccaugcccggcuaauuuuuuaauuuaaaaaauuuuuagagaagugucuugccaucuugcccaggcuggucucgaacuccugagcucaagugauccuccugccuuggccucccagagugcugggauuacagguaugaaaggcuggcuggcaaauguuuguucacuuucuuuucccuuuuccuaaguuagcugaaaauguuuucuauaaaggggguucagugggccacguggucucugugacaaccacucaccuuuguggccagagcugaaaggaaaccauaaucaauguguaaaugaauacacugcaccuugcuguguuccacuaacacuuucuuuagggaccuugaaauuugaauuucauagaauguucacguuacaaaauauaguucuuuggauuuuuguccauaacuuaaaaauauaggcccaaugugguggcucaugccuguaaucccaacacuuugggaggccaaggcaaaaggacugcuugaggccaggaguucgagaccagccugagcaacacagaaagacccuugucucuacaaaaauuaaaauaaaaaaauuagccaggcaugguggcgugcgccuguagucccagcuacuuaggaagcugaggugggaggauggcuggagcccagaaauuugaggcuuuauaaauauauaaagccaagaauguacauaaaggcaagaaaaucacuugaaccugggagguagagguugcugcgaggcgagauugcaccacugcacuccagccugggcgacagagugaggcuccaucuuggaaaaaaaaauuauauauauauauuuauauauaaauauauauauacauaaauaauaacaauggcaguucuaauaauaagagccgcaaacacuuagccccuccucugcgccaggcacuguuuccaagcacuuuuccuauauuaacucaucagguccucgccacagcccugcgaggugggacuaguucuauucccguuuacagaugaggaaacucaggcagauggaguuaauuaaccugcucaagcucaaccugcuaggaaggguagagccacguuugaacccugcagucuggcccaggggcuagcacugggcugcuucuuucugccucuccacuguccacaccuguuucagacacugggcugugugggcugucacagcacaagguggcugcagucccugcccuggggacaccucagccauccagcaggggggccugguggcagggacuaugaggagugaccgaaccaagugugaguugcucugcgcagguagagagggcagaggccccguggcucuggcggggcacuggcacuugcugaucuuuucugggaaaccacuugcuuuuggagacacugaaaacuaaaucaaaagguuaagaaauccagcucuguccucaccuggcagcugucuucucccgcagcccucuuuccuacgggucugcagcuggggcuggggggaggugucgucccuggccugugcagaauguuacuccuguccucugccacuccaccagcacccugucuccuuucuguaccuugcuacuccuucuaccaugaucuugucccacucuccccucagacucauucccagggacauaaccuaggccuugucaccaucaaauaacuccaucccaagcuucccaccagcugacccaaccuguguggaucaugcccccgggaccccaacuccaacgaugcugcggcuucccagggcuugcucccuucccugaagcucagccagcuuggaccccacaucuaccauuccuuccuuugcacacaccugaagccccuaccccuaacuggacugagacaagcacaacucugguucagacuccaagucccugccagcucccacuagcacccugcuaaaaaucccaccagaugcuuaaaagccaccucuagcggccagacgcgguggcucaugccuguaaucccagcauuuugggaggcugaggcggguggaucacgaggucaggaauucgagaccagccuggccaacauggugaaacccccgucuccacuaaaaacacaaaaauuagcugggcauggugcaugccuguaaucccagcuacuggggaggcucaggcaggagaauggcaugaacccaggagguggaaguugcagugagccgagaucgugccacugcacuccagccugggugacagaguaagacucuaucucaaaaaaaaaaaaaaaaaaaaaaucccccucuaucccacccucuaggguagccuccagauccucccucacccuucaguguuucuucuccauuaaaagcaacuucauccuaccgggugcucaagccagauuccuugguguuggcugggcacuguggcucaugccuguaaucccagcacuuugugaggccaaggugggaggaucacuuggggccaggagcucaagaccagccuggccaacauagcaagaccuugucucuaaaauuaauaauaauuuggccaggcgcgguggcucacgccuguaaucccagcacuuugggaggccaaggcgggcggaucacaaggucaggagaucgagaccauccuggcuaacauggugaaaccccaucucuacuaaaaacacacaaaaaaauuagcugggcaugguggcgggaggcuguaguccgagcuacucuggaggcugaggcaggagaauggcgugaacccgggaggcagagcuugcagugagcugagauggugccacugcacuccagccugggcgacagagcaagacuccaugucaaaaauaaaauaaaauaauaauaauaauaauaauaauaauuuuuuuuuuugagacggagucuugcucugucgcccaggcuggagugcaguggcaccaucucggcucacugcaagcucugccucccggguucaugccauucuccugccucagccucccgaguagcugggacuauaggcacccaccaccacgcccggcuaauuuuuuguauuuuuaguagagacgggguuucaccguguuagccaggauggucuugaucuccugaccucgugauccgcccgccucggccucccaaagugcugggauuacaggcgugagccaccgcgccuggccuaauuuauuuuauuuuuauuuauuuuuuguuuuuugagacggacucuugcucugucacccaggcuggagugcaguggcaggauuucagcucacugcgaccuccaccuccuggguucaagugauucuccugccucagccucucagguagcugggauuacaggcgcccaccaccacauccagcuaauuuguguauuuguaguagagacaggauuucaccaaguuggccaggcuguucuugaacuccugaccucaagugaucugccugccucagccucccgaugugcugggauuacaggugugagccaccacgcccggccaauaauaauuuuuuuuuugagacggaaucuugcucugucacccaggcuggagugcaguggugcaaucucugcucacugcaagcuccgccucccgggcucacgccauucuccugccucagccuccagaguagcugggacuacaggcgcccaccaccacgcccagagaauuuuuuguauuuuuaguggagacgggguucaccguguuagccagaauggucucuaucuccugaccucaugaucugcccaccucgaacuaccaaagugcugggauuauaggcgugagccaccgcgcccagccuaauaguuuuuuuaaaauuccuuggcaucauccugacuccucucuuucccucgcaccccacauccaguccaucagcagauccugccaguucugcuuuaaaaauaaauccagggaucagcuacuucucaccaccucccuggugacucucugaaugucuaaaucugaccaugcugccucugcucaaauccuuuccagguuuuuacucaaaggcaaugccagaguccuuagaaugaccuucaacuuuaggucuccaaauacccuuuccuaaacccccuccccuaggcccacccuagccaggagcagguguugcccucgaggccuuaccaucugcccuucucucugccuggaacucucuucccaucaucccuguggccuuggcuccaguggugcuucucaccaaggugagugcugaccaccucugcuaccaucacuccccccgccccugugacuccggauucucuuaacucuuuuuuuugagaugagucucacucugucgccaggcuggagugcaguggcacgaucuuggcucacugcaaccuccgccucccggguucaagcgauucuccugccucagccucccgaguagcugggacuauaggugcgcgccaccaugcccagcuaauuuuuguauuuuugguagagaugggguuucaccauguuggccaggauggucuccaucucuucaccuugugauacgcccaccuaggccucccaaaguguuggaauuacaggcgugagccaccgcgcccggccucucuuaacucuuuuacaugcugcccccauacaaaucuucucacgcaugauaggaugcuuuugugcuuguuugcucauggccccaccagcucacuagaagguaagcuccacaagggcaaggauuccugacgcuuggguucaccgaggcccccuagcaacuggaacagccugugucacacggugagcacucacuguguggcgcgagugaaugcugaguguguguggggggcagagagcaggggaaguuugugagcagaaaaauggccaagugcaagcucaggaaguuaaagaaagcuguggaggcugagcaugguggcucacgccaguaaucucaacagucugggaggccaaggugagaggauugcuugggcccaggaauucgagacaagacugggcaacaaagcaagaccccaccucuacaaaaaauaaaaaaugagcuggugugguggcaugcaccuguggucccagcuguucuggaggcugaggcaggaggaucguuugagcccaggaguuugaggccugccugggcaacaaaaggagaccccgccccugcccucaucucaugaaaaugugaaaaaugcugggcaugguggcucacgccuguaaucccaacacuguugggaggcugaggcggguggauuacgaggucaggaaauggagaccacccuggcuaacacggugaaaccccaucucuaauaaaaauacaagaaauuagcccggcauggugacacgcgccuguagucccagcuacucuggaggcugaggcaggagaacugcuugaacccaggaggcagagguugcagugagccgagauugcaccacugcaccccagccugggcagcagagugagacuccgucucaggaaaaaaaaaaaaaaaaaaagaaaaaguaaaaaauaaauuaacugggugugguccacacaccuguauucccaguuacgugggaggaucacuuaagcccagaaguuccgggcugcagugagcugagaucgcaccucuguacucccuccugggugauagagcgagacccugucucaaaacaaaacaaaacaaacagaaaaaaagaaagcaagcuaugggguccaaucugagagaaucgaguguggguguuuauccguaagagagcgaggggaaagaggccucuuaagccuucuuaauccugaaaauggggaggaggucuuuuaagcugcagugccagagugacaugaccuaguuuucuauuuuuagagauggggucuggcuauguugcccaggcuggucuugaauuccugggcucaagccagccuccugaguugcugggacuacagacaugugccaccccacccagcuugaccugguuuuuguguucagaagauaucuguuguuguuccaggugccaaggccagugcugggcacaggggugcuagagccuacugagaaauggacauagaaccccaguguccauccuuccaucuuggagccugugcuucucaccccacacagcccugcugucugggaggacugucugccccuugaggucaucugccccuggccacugugccaggacaguccugcuguggguacgagccacagggcaagaaagaacacaucugggagcuggaaggccuaaucccagggaaagcauguagccuggggcagggcaccaaggaggcuuccagcccccacauucuaaggaaagaaacaccaggaagguguggccuuaggcaggccccuuuuccuuuucggaucacugccugccugucacugauuucuguccuaaccccacacuaauagcugcuauauauauauauauguauuuuaagagcuggagucucccuaagucacucaggcuggccuugaacuucugggcucaagcgauccuccugccuuggccucccaaagugcugagauuacaggugugagccaccacgcccggcagcaaccauuuuuuagcuuuaaugugcaccagcucuguaaucaagugcauccuauauguuccugcuaauuaacucaacaguccuacaauggugguuauuaauugcuguuuuacgaaagaggaaacuggggcucugagaguuuggggaccgacccaaagcauucagugccuguggaugcaacugggaugcagggagccagugggcugggggugaggugucccggcagguggagguggugggguacuuaccuccaugauggcugcugcugguuggcugcuccugcuggugacuggcgucccacaggaggccuggggccuggcgaugaugcuugccggagccugagggcccguccccugcggggcuggggcccaggccccucucugcagagcuggagucuuccugcucacucggcucaaacucugggaucuggaacaugcucugggcugugaggacaagauguuacguagucaaggcacagcuggggccaacgguggcccuggaaggcagaggcagguaccccuggcuuccucucccaccguagcgcccccaggcccgccaggccuccugggcccucaucugucugccgggucuggccuggcagggagcugaggcugucggcucaggaccucagucuccccucagaaccccgguggacccaggccccgccccgcccguggugacggcgcacaggucucaccccaagcccgaucucgaggccccugacccgggccugccgccucccuccagcaccccgggcuccgggcccuaguu

SEQ ID NO: 193006 - RNA, 30128 nt, Homo sapiens
gcuuucugcgcacgcgcaucucggugcaucuguugggcgggaccgcggggccugugacaccgcacgcugagcucugugauguagccgcuugcggagacugcaagcagccgcggcgcgcccggcccucccucuuccgcugccgccgugggaauggaaacaucugccccacgugccggaagccaagugguggcgacaacugcgcgccacuccgcggccuaccgcgcagauccucuacguguguccucgcgagacaagcucaccgaaauggccgcguccagucaagguaagggcgggcgcgcgcgcggccggcgccgcggggagccgccuuccugggcuccggaaggggaagggcuccgcgcccgccagucgcgaccgagcuccccggggaguccaagcggcgcggggacggggagggcgcucggggaucgccccuggcucagccgcucccaggguccggccaaggucacgcgcgugucuggggccuaaccacccuggggugucgucuccaguggagcucacccagccuuccggcgccgcccccggcgcagaagcccgaagacauucuguccccguucucggaagcggucuggcuucuuugucccuuuggacguucaucucaaaugccucguggcgucauucuguguacaaggcaccuccccaacugcuuuauuguugguuuugaaaaacuagcacauaugggaugguacuuaggaauagccuucuguuuagucggcauagucaaagauuccguguaauucgcaguggagcacgucuuuaaguuaugcgucuuacccuauuuugaauguuuagguuguauuuaauuuaguacugacucacgggaucccauugcuaaacagagccaucauugaaaacucaaucauauaaacguaaaauuacguaaauuauguuaaaaacaaaggcagugaaaauacuaaaaacucaucacuuuuauuauuuaccauguuuuauuguuacuuuacuuuugagguuauuuauacaucuauuguaucuuuguggaggagauacuauacuauggugcucuacugugcgucucuucccaucucuggguucaguaguuucacaauucaguaaugucaugcucacgaugaaugaauacgcaauggaaauuggcuacacuacaaaucagcccuugccuaaagccgacuguuaagcauuucaccagcacgccgcuaaauuuuagaugacucugggaagguggaaugugcaaugugauaauuauguauuuuccugcagagcagacugcucuuauagacuuuuauaagagcagacugcucuuauagacuuuuauaagagcagacugcucuuauagguugaucagguauuugcaccuaggaaauuguugugagaaauuuugagguuaagaugaguuucaauuguuaucacagugaugaucacauaauaacugugaucauugauuuugugggcucauaaacgaagcuauuggcugacuuuugucugucauagugcuuagcaguguuugaccaaugacugaccaaauaucucgcauuuaaucuaccuuccccccuacucccuuuuuuagggacuagaucugucauucaggcuacagcacaguggcacaaucauagcucacugcagccccaguggagccaccuguugaucuaaggggcuuggucaaauuacguuaaaacuguaauguuuuguuguuacauuagaaaaauaaauuauuuaacuacuugagaggccauggaguacccagguacucagacauccauauuuuguucugcuaaaugggcgucugugauguauccugaaugaauucuugaauuauauuuuguguaugguuuaagguagagguugagaguaguuuuuuuugaaacacaaauauauaguaguucuaacaucauuuguuguuuccuucauugaguuaccuuggugcuaaguuauuaaaaaucaaaugacuauauguguggaucuauuucuggauucuggauucucuuccauugcuauauuuggguauccuugggucaguuugacaguguugaaugucauugcuuuauaagccuugaaauuaagauaguuguauauuauacuguagcuuuauaaugagccuugaaauuccuugaacccuccucuuucccuugcccgccuccgcccccaggauuauuguggcaguuuguauuuuccugauugcagcaauauuuuccauuccuuauggucuuuuuccuagugacuuugacacuccucccacccaggggugggaucuauauucccucuucaugaaucuggaugggaguuugugacugacugccuguuccuacagaaugcaguggaaguuaacacugcauuugcucucucccuuucuugggacuuucaccuccugaacucagcuccuaugcuguaaggaagccuagacugacucacauagaguagcagccuaucuaucugugugaguguagagucuucagacccagccuguaagucuucuggcuaaagccucagacaugaaacaaagacaaaccacagugcuguggcugaauuccugauccacaaaaucugagagcauaauauaugauuguuuugcuucaugaaguuuuggaguaauuuguaguacagccgaaguaacuggaacacugcuggguuuuuuuguaucuucauaugaauuuuagaaccaguuugucaauuacauaaaaaccuacuuuuuugccgggcgugguggcucacuccuguaaucccagcacuuugggaggcugaggcaggcggaucaccugaggucgggaguuugagaucagccugaccaacauggagaaacccugucucuacuaaaaauacaaaaaauuagccaggcgugguggugcaugccuguaaucccagcuacuugggaggcugaggcaggagaaucacuugaaccugggaggaggagguuguggugagccgagauugucauugcacuccagccugggcaaaaagagcaaaacucuaucucaaaaaaaaaaaaaaaaagaaaaaagaaaaaaccuacuuuuuaauugagauuguauugaauauauagaucaauauauggagagaaugaacaucuuaaaaauauugagucuugcaaaacauaaacaguauaucacuguuauuuuaggucaucuucaauuucuuggcaguguuuuguaguuugcaguguuuucuaguuuacagugaacaggucuugugcaucuuucauugaauuuacuacaacauaauuuuugcaauuaaaauuauuuuguuuuccaauucaucauuucuaauacacaaaaauucaaaugacuuuuuaauauuggucuuauaaugugugaccuugcuucugguaccuuuuuguagauuuuucuggguuuucuauauacaccguuauauuaucugccaaugaagacagaauuauuguuguaccuccuuucuaaucucuuugacuuuuauuucuuuucuuuuguugcacuggcuaggaacuccaguacagugcugggcgagguggcucacacuuguaaucccagcacuuugggaggcuaaggagggaggaucacuuggggccaggaguuccagaccagccuaggcaacaaagugagaccuccugucuacaaaaaaaaaaaaaaaaaaaaaaaaaucaguuggucauaguggugcacagcuguaguccagcuacuggggaggcugaggugggaggauugcuugagcccagaaguuugaaguugcaguaaucugugauagugccacugcacuccaaugugggugauagagugagacccugucucaaaacaaaacaaaaaacaguugaauagauuuuagggaaagaaaaguguuccauauuucaccauuaaguaugauguuaguuguauauuuuucauagauguccuauaucagauugaagaaaucccuuucuauuccuauuuucuacuuuuuuuuuuuuuuuuuuugagauggaguuucgcucuuguugcccaggaaaaugggcaguggucugaucucggcucacugcaaccuccgccucccagguucaagcaauucucccaucucagccuccugaguagcugggauuacaggcgccugccacuaugcccggcuaauuuuugguauuuuuaguagagacgggguuuuaccauguuggccaggcuggucucgaacuccugaccucaggugauccacccgccucggccucccaaagugcuuggauuauaggcaugagccaccacgcccagccccuauuuucuacuuuuuauucugauuuuuuucuuugauuuuaaaguauaaaauuucuguaauuauuauuuuuuuacaguaaguauucauuuagauuuauccaccuauuugcccauuccagugucucauuccuuucugcauuuccauauuuccauguggcaucauuucuugucggccugaauaacuuuuguguaccucuuugaauauuacuucuaucccauucuuucuaaucuucuggaacuccaauuacauauauguuuaaucuuuugagcaguuuuugaucauuguuauuugcuuacuucagcaucuugaucaucacugguucuguuucuguuucuguuucuuuuucuuuuuucuuuuugggacugagucucgcugugucacccaugcuggagugcaguggugcgauccuuggcucacugcaaccuucgcuacccgcguucaagugauuuuccugucccagccucccgaguagcugggacuacaggcacaugccaccacgcccagcuaauuuuuguauuuuuaguagaaacaggguuucaccauguuggccaggcuggucuugaacuccagacuucaagugauccgucccccaggcuuuccaaagugcugggauacaggcgugagccaccgugccuggccugcuucuauuucuuuuauuuaaacaaauuuuguuuccuuuauauggcuuugccuuugcauggguaguagucauuuucuauuguuuguuacauuaugugugaaaagauuguacacacuccaugccagaugaaguugaucauuugaggucaauuuuacaguaaacagcuuugaauaguacauugcugacauuucauaucagacauuucuuagugcgguguguuuccagggaaacagggcuggguauaguaggggagccugacauuaucuucccacagagaaagggauugacauuuuguuaagucuuucuccaugcuugggcaaaucauuuaacuuuggaaccuucauuucauuuuuuuuuuuuuucugagacggaguuucacucuuguugcccaggcuggagugaaguggcgcgaucucggcucacugccaccuccaccuccccgguuccagugauucuccugccucagccucccaaguagcugugauuacaggcgcaugccaccaugcccagcuaauuuuuguaguuuuaguagagacgagguuucaccauguuggccaggcuggccucaaacuccugaccucaggugaucugcccaccuuggccucccaagguguugggauuacaggcgugagccaccacgccuggugccuucuuuuuuuuuuuuuuuuuuuuuuugagauggagucucauucuuguugcgcaggcuagagugcaguggugcgaucuuggcucaccgcaaccucugccccucagguucaagugauucuccucccgaguagcuaggauuacaggcaugugccaccacccccggcuaauuuuguauuuuuaguagagaugggguuuuuccaugcuggucagguuggucuugaacucccgaccucaggugauccaccugccuccggccucccaaagugcugggauuacaggugugagccaccaugccuggccuucauuucuuaauuauaaaauugaguuaauaaguaguaccuaccuuauucuguggauuaauuagauguacaugauuaauguuuagcacauugccugguaaauaguaagagcucaauuaaacauuacccucucaucuucauuaucacuggagauccacguaguacuuagaaaauuuguggauuacugaauagcauugagcuacuucugaagagaaggggcaaauuuguuucauuugggaugcauuacuggcaguuuuuuauaggucuuuuuggauuuauuuauuuauuugagauggagucuugcucuguugcccaggcuggagugcagcggcacuaucucggcucacugcaaccuuugcuuccuggguucaagcaauucuuuugccuuagccuccugaguagcugggauuacaggugccugccaccacgccuggcuaauuuuuguauuuguaguagagaugggguuuugccauuuuggccagacugguuucgaucuccugaccucaggugauucgcccaccucggccucccaaagugcugggauuacaggcgugagccaccgcgcccagccuuuuuuguuauuuuuaaauuugagaggacaaacuagaggacuaauuugagauuuucuagguuuuucccuguaauauagacauuaguauuugcugauuuuagucugauuuuccaaaauugcaacuuagaauaaauuuacuauuuaaaauagaauauuuggagguuucuuauuacauuuaugucuguuucuuuaaauaucucaaucuaguuagguauaaaaguaaauauuuucuuauuuaacguauuacuucuuguaggaaacuuugagggaaauuuugagucacuggaccuugcggaauuugcuaagaagcagccaugguggcguaagcuguucgggcaggaaucuggaccuucagcagaaaaguauagcguggcaacccagcuguucauuggaggugucacuggaugguaagugaugugaaagauguccacugucuuuugugcaugauuuaguauugcaguuauagguaccaucaucuccuuuaaccagugaaaacacauuggcuucugugaaauuggucacuuaauguggagcauguaucuaaacaucaucuuaaaguaccauuuaaugguuacacauaaugauuguuuccuauaugccagguucuguuugaaguauuuacauagauaucucauuuccuucucacaacucuggaauuaguacuguuauuuucuauccucauuuuauagaaacugaggcucagaaagguuaguuugcccaaggccacauagcugguaacugguagaauaaggagcuaacuacuuauuagcuaugucagaugauaacuuaaugugacacagcuuaugguuucauuuguaauaaauucaaaaaguaauagcaaauuucauaggugaauauugaauccauuaaucucauagacucuuuacauuugaaaaauuuuauagcaccauauagcaaauauagaacagcacauuuaacagguguacauuuuagcaaauacuuggagugaacaccuauguaacaacugcuaagguuaaaaaaaacguggcuagcgcccuagaaacucgagagguuauuaagcaguuauuucauugcuuuucuuuguaguuuuaacaccaguuaugucacuaaauaacauacugugguuuaccugcuuuccaccuuaaaguaaaugcaaucaguauguauucuuuugagucuugcuuuuuucgcucaaccugauguuucauauauucaacuacauuguguauaguuguaguuucuucacuuucacuuguauuuugaguuccauuaugugaauauaccacaguauauccaguugaugacugauauuggaguuguuuccauuuuuggcuaauacuaugcuuauaugaguauuagauuucccaguguauaugugcauacauuucuguagggucuguaccuagaaauugcuagguaauggguauagguaucuucagcuucacuaaauaaugucaaaccaccuuccaaaacuguuuuuaacaguuuacagucccagcaaggaccaaaugaaccuguuguucuacaugguggcacuugauuuugccaggcuauuaaauuuuuaaaaaauuaguuaauuuuuccuuagcgagguaaucaaguuaaauccagacuauaaaaauuuuaccagucugguaguuagguaguaguauuucaugguggcuucauuuacauuucccugaguaggagugacauugaucgacuuuuacguauguuuguugaccauuuggaucuccucuuucaguuccacucuaguuuuuuuccucugaaguugucauucuuucccuuguuaagcuguaagaguucuuuauauauucugaauauucucaguccuuuguuaguuguguguauuauagauauuuucacucauucugugguuaucuuuucguuuuaugguaucuuuugaugaacugaagaucuuauuuuuaauauagucaauuuuaucaaucuuaaccuuaaugguuagugauuuuuguggcuuauuuaaguaaucuuugccuaccccauguuucagaacuuuuauuauuugaccuuucacauuuagauuuauuauccaccuggaauuguuauugugcucaguaugugguagauuccuucuuuucuuccccauguggaauacccauuugucccaacuuaauuuauugugaaagcuaucccuuuccccgcugcuuuaugugagugugugugcgcaugcauaugugugugucugcuaucuuguucuuuaggaacaucuuggcuauuuucuuuaucucuuaguuuuuaaauuuaauaaauagguauauuauaaguugcacauauuuaaaguauaaaauuugauacauuuuuacauauguacaugcccauaaaaccaucaccacagucaagauaaugaacauaccuaucacuucaaaagcugcuuuguaccucuuuguaauuccacgcucuuuccuucaugccauccucccgccacugaucugcuuucuauuacuauagauuauguuuucuagauucuuuuuagaaguggaauuacauaguauauauucuuuuuugucuggcuucucuuauucaccauaauaauauauuuuuuuguuuugagacggagucuugcucuguugcccagacuggagugcaguggcacgaucuuggcucaccgccuccuggguucaagcaguucuccugcaucagccuucaccauaauaauuuugagauaaucugugcuuuucuguuuaucaacaguucauuccuuuuuauugcuaaguaguacuccauuguauggauguaccacaaucuguuucuccauccaccuuugauggacauuugaguuuuuuuuucacuuuuuagcuguuacagauaaaacuucaaguuuguauacaaguguacaagucuuuguaugaacauaugcuuucauuucuuuuggguaaauaucuaggaauaguauggcugagucacguaguaagugaauguucuaaauuuacaaguaccugccaguuuuuaaagugccuguaccaucuuacaucuccaccagcaaugugugaggguuccaguuccucugcauccuuacuaacacuugguauuaucuuuuugauuacgaacaucuuaguggguaugaaguuguaucucauugugguuugaauuugcguuucucuaaugacuaaugauguugagcauuuucacgggcuuauuuuuugccauucauauaucuuugaugacuuauuuguucaaaucuuuuuccacauauuuuuauuggguuguugguuuucuuucacugcugaaucgugagaguucuuuaaauauucuggauagaagucuuagauaugugauuugcaaauauauuacuucucuguagcuuuucauuaucugaacuguaccuuucaaagagcagaaguucuuaaucuugaagugcagcucuuuuguagcuccagcuuuuggugucaugucugagaauauuugccuaauccagggucaccaagauuuucucucgcuuuuucuagauuguauauagguucggauuuuauauuuaguucugugauccauuuugauuuacuuuuuguauauaguauaagguaggaauccaaguuuuuuuugcguauggguaucuaguuguccccacauuuguaaaaaaaagacugucuuuuucuccacugaauugucuuuacaccuauguugaaaaucaguugacuauauguuuuugagcucuuuguacugccaaauugaucuaggugccauuaucaugcuguuuugauuacuguaacuuagguaaugcaagucuugaaauuuuguuuuucaucaaagcuauuuugaguauucuagguauuuagcauuuccaucugaauuuuaucuuguuuuuauacacuccuccauaugaauuuuagaauuagguugcugccaguuucugccagacacccgaugagauuuugacugggauugcauugauccauaaacauugguguaucucuccaauuuguuuagguuuucuuuaauuucucucagcaaugcuuuguagaucuuacacaucuuauaucagauuuauuccuaaguauuucauauuuuugauaccauuauaaaugguauuacuuucaaaauuucaaguugccauuguucauugcuuguauaguauauagaaaugcaauaguuuucuuuguauauugaucuuguauauuguagucuugcuaaaagccacuuacuaguugcagaguucagggguccccaagaccacugucauguuugauaguucucuaggagaauucacagaacucagagcuguuccacucaggguuauuuuuuuauuuuuuauuuuuuuaacagaaaaugauacagauuaacucagccaagggaagaggcacauggaauaggguauuguggagucuuuauauuuauauuuauuuauuuuuuuugagacauagucucgcucucucacccaggcuagagugcaguggugugaucuuggcuuauugcaaccucugccucccagguucaagcaauucucucgccucagccucccaaguagcuaggacuacaggcgugaaccaucacaccgggcuaauuuuuguauuuuuaguagagucaggguuucaccauauuguccaggcuggucucaaacuccugaccucaaaugaucugccugccucagccuuccaaagugcugggauuauaggcgugagccaccacacccagcugagucuuuacauguaaaguagguuucuuguagguuccauauaggugguuguuaauuuuuuagaauccaauuugacagucucuuccuuuaaauuagggugguuagacuauuuacauuuaaguuuauuuuuaaaauucuuuuaauugacuaguaaaaauuguaggcugggugcaguggcucacaccuuuaauaccagcacuuugggaggccgaggcagguggaucauuugagcucaggaguuugagaccagccugggcagcauggcgaaaccccaucucuacaaaaaauagaaaaauuagccgggcguggugguaugcgccuguagucccagcuacuugggaggcugaggugggaggauggcuugaaccugggagggggagguuguagugagccaagaucaugccacuguacuccauccagcaugggugacagaaugagacccagucucaaaaaggaaacaaaacagcaacaccaaaauuguauuuauuuguggcguacaugauguuuugauauauguauacauucuggaauggcuaaaucaagcuauuuaacauguauuaccucacauacuuaccauguuuuuguggugagaacacuuaaaaccuacucuuauagcaauuuucaaauauauaauauguuguuauuaacuguagucaccaugauauacaguagauauccuaaacuucuuccuccuaacuggaauuuuuguguccuugaccaacauuuccccaaccgccccaccccacaaccuuuggucaccaccauucucuguuucuaugaauuugacuuuuuuuagauuccacauauaagugagaccauuugguauuugucuuucugugccugacuuauuuuacauagcauaauguccuacagguuaauccauguugucacaaauaucaagauuuccuuuuuaaggguugaacaguauuccauuauguaauauaccacauuuucauuauccaucuguugauggacacuuaaguugucucuaucuuggauauugugaauaguugcagugaacacgggaaugcagauaccucuuuaauguacugacuucauauccuuuggcuguauacccaguagugugauugcugaaucauauguuauuaguucuacuauuuuuaauuuauugaggagucuccauacaguuuuccauaauggcucuacuaauuuacauuccuaccaacaguguacaaagauuuccuuuucucuacauccucaccaacacuuguuaucucuugucuuuuugaugauagccauccuaacaggugugaggugauagcucauugugguuugcauuuuccucaugauuagugauguugagcauuuuuuucauauaccuuauuuauuggccauuuguauguuuguaugucuucuuuugagaaaugucuauucagguccuuugcccauuuuuaaaucagguuguauuuuuacaauugaguuguuuaaucccuuguauaucuuuuauauuaaucucuuaucagauauaugcuuugcaaauauuuucucccauucuuuagguugucucuucacucuguugauuccuuugcuguacagaagcuuuuuaguuugauguaaucccauuugucuauuuuugccuuuuguugccucugcuuuucgggucauauccaaaaaauauuugugcagaccagugucauggagcuuucucccuguuuucuucuaacaguuuuacaguuucaggucuuauauuuaaguauuuaaucuguuuccaguugauuuuugcaaugguuugagaugagggucucuuuugcauguggauaaacaguuugcuuaggaccauuuuuugaagagacuauccuuucccuguuguguguucuuggcaucuuugucaaaaaucaguugacuguaaauacguggauuuauuucugggcucucuauucugauccguuggucuauguguuuguuuuuaaugccaggaccauguuguuuugguuacuauagcuuuguaguauauuuugagaucagguaguaugaugaugccuccaacuuuguucuuuuugcugaagauugcuuuggcuauuaggggucuuuuguacuuccaugugaauuuuaggauuuuuuuuccucuuucugugaaaaaugucauuggaauuuugauguggauugcauugaaucuguagauugcuuugggagguauggagauuuuagcaauuuuaauucuucccauucaugaacauggaauaucuuucuguuuauuuguguugucuucaauuucuuucaucagccuucuguaguuuucaguguauggaccuuuugccuucuuggcuagauuuauucauaaguguauauuuuuuguaagugggacguuuguuuuuguuauuacuggguucaaaauuaccaucuugguauuuaaucguacauauauaacauauauacugaggugaaauucacauaacauaaaacuaaccauuuuaaagugaauaguacaacuuaguacauucacaauauuguacaaccacuaucucuauaugguuuuaaaauccuuuuaucaccuccaaauaaaacugaguacccacugagcaguuacuccuaauucuuccuuccuacaacuccuggcaaccacagucugcuuucuguccuuauggauugaccuauucugaauauuucauauauauugaaucaugcaauggcugaacuuucguguuuggcuucuuucacuuagcauaaugcuuuugagguucaugcauguuauaguguauauauauugcuacuucauuccuuuuuauagcucaauaggauuccacuguauguauaugccacaguuuguucauccagacaucuguugguggacaucugggguauuuccaccuuuuaacuguugugaauaaugcugcuaugaacauuggguauaaguauuuuuucaauaccuauuuuuaggucuucuauuuuuuuguauauacccaggaguggaauuguuggaucauaugauaauucuauguuuacuuuuuugaggacccaccuaacuuuugagcaucuuuucauguacuuccuggccauuuguauaucuucuccagauaaaugucaacucaaguccuuugcccauuuuuuaauuggguuuaucuuuuuguuauugaguuguaagaguucuuuauauguucuggauucuagacccuuaccagacacgauuugcaaauauuuuguccuguucucuaacuugucuuuuucacuguuuugauaauguucuuugauacaagaaaguuuuuaauuuugaugaaguccaauuuauuuuuaauuuugaugagguccaauuuauuuuuuuuguugcuuagaucaaauauuuucaauuccauuuucauaauucuauuuuuauggauauuuucauaauuauguccuuuguuggcuuauuagcuauaacuguuuguuguguaauuuuagugguugcuuuaggguuuauaggagacaucuucuacucguagucugccuucaagaaaucuaacgcuucauauaugauauaacaguaugcuuccauuuuccccuucccccuuuguuuucauugcuauaaauuuuacuuuuaaaauuauguaaauucauaauacauucuuauuauuuuugcauuaaauguugaauuuuuauaguuuuuaauaacaagaaggaagccuuucacauuuuacuccauaguuucuauuucuugugcucuucaugccuuuguguggauccugauuucuauaugauaucauuuuccccugccugaaagacuuccuuuaacauuucuuauauugcuggucugcuggggauauuuuuuuuuucagguuuuguaucugugaaaaaggucuuuauuucauuucuguuuuugcaagaucacuuaguguagaauucuagauugacaggguuguugcuuuuuuuucaguacauuaaaaauguuauuucauugucuuuuggcuuuguauuauuuucugugagaaauguguucacuucagacuuuauuccucuguaccuaaugccucuuuuuuccccccuucaggcuccuuuuaagauuuccucuaggucgggcaugguggcucacgccuguaaucccagcacuuugggaggcugaggcggguggaacaugaggucaggagaucgagaccauccugacuaacauggugaaaccccgucucuacuaaaaaauacaaaaaauuagccagucgugguggcgggcgccuguagucccagcuacucgggaggcugaggcaggaggauggcgugaacccgggaggcagagcuugcagugagccaagauugugccacugcacucuacccugggcgacagagcgagacuccgucucaaaaaaaaaaaaaaaaaagaaaaaaaagaaaaaaaagauuuccucuuuaccauuuguuuuaagcaguuuguuuauguuguaccuugcuauaguuuucuuuuucuaucuuuuuuuuuuuuuuuuuuuuuuuuuuuuugagauggacucuuucucugucacccagacuggaaugcaguggcaugaucucagcucacugcaaccuccaccuuccagguucaggugauucucgugccucagccuguggaguagcugggauuacaggugugcaccaccgcaccuggcuaauuuuuguauuuuuaguagagaugggguuucaccauguuggccaggcuggucucgaacuccugaccucaggugauccuccugccucagccucccaaagugcugcgauuacaggugugagccaccaugccuggccuucuuuguuucuuuugcuuagauuucauugagcuuuuuggaucuguggguuuauaguuuucacgaagcuuggaauauuuucuguuguccuucaaauauuuuuuucuguccuccuucagugauuccaauuacacauuuauuagggugugugaaguuuuuccacaguucauuaauacuguuuacuuuuuagaaacuuuauuuugagauaauuguacauucacaugcaguuagaaauaauccauagaggucuuauacccauuccccaguucccccuaugguagcaucuugucuaacuauaguucaguaucauaaccauuuucauuuuuuugucucuuuucuguuucauuuuugauaguuuuuauugcuauuucaugaaguuuauuaaucuucuacagugucuaaacugcuauauuuuucgucucggacauuguaguuuuuauuucuauaaguuugauuugcaucuuuuuuuuugagacuuucuuguucuguugcuuaggcuggagugcaguggcacaaucacagcucacugcaaccucuaccuccugggcucaagagauccucccaccucagccucuugaauaguggaacugcaggugcaugcuaccgugccuggcuaauuuaaaaaaguuauuuuuagagagauggggacucacuauguugcccaggcuggccuuaaacaccugggcucaagcaauccucuugccuuggccuccuaaaguacugggauuacaggcaugagccacuguacccagccaagauuugcauguuuuuaaaagagcuuccuugccucuacuuauuaugugcaaucuuuucucuagcuucuugaacauauggaauauaauuguaauaacuuuuaaugcuuuugucuacuaauuuuuucaucaguaucauuucuggguuucuuuuaguuuauuuuuuuuugaucgugguauuuuucugccuugcaagccugguaguuuuuaauuagauggcagauauuaugaauuuuacuucauugggugcuagauauuuuuuauucuuauaaaugugcuugauucuuguucuuggaugcaguuacuuagaaaucacuugaucuuuuugggucuugcuuuguuauuaggcuuuauuuaaaauguguguuuuguuuuaaaaagagaaaaagccagguguuguaaacagugcaacaauuuuuguaacagcaaaaaucuguaaccauucuaaauaugucaguuacucugauuauacuuuaguaagucugaacaguggaaugcucuuaaaauggacccuuaucauuuauuuacugguccuaccacccuuccaauuucagagucgcuucagaaauauacugccugacaucuaacuuuuguuuaaaaaagauuaaaagucuuaugagguucuccaugcauuguuguauuuguaauucuuucucuuacugagcugaaauguaauaaggggagaacaguagacaaugaggguagugagguaaugggagacaagauguuaaguguaaggcuuuaacuuucucucuuagugaggagggaagcuacuggaagguuaugagcagaaguguaccuugaucuuacauuuuagagcaggggucagcaaaguuuuucuguaaagagcccauaugguaaauauuguaggcuuuauggaucacacaaucucuguugcaacuugauuuacaaagagacaucuggcaggauuuggcucccaggcugcgguuugucgaccccuguuuuaggacuguaugagcugcuauauugagaauagauucuagggggugaaaguggagguaagaaguccagaugaggagcuguaacaguaaccuacaucagagaucaugguauagacccagcagauagaaagugaauacacagagcaaagagguucuaggacugagccucagaacaaccuaacauucagaagucagaaagaggaggacucagcaaaauugucugauaaggaauggccagugauauaugaggaaaaccaagagagaaugguauuccagagcaaaaagaugucaagaaggagagaguacaauagcagaacaacaaauaaccugauuuaaaaaauggggaaaagacgugaacagacauuuccccaaagaaggcauagaaauggccaccagagguauaugaaaagaugcuuagcaucaucaauuaucagggaaaugcaaauuaaaagcacaaugagauaucaacuggcacuuguuagaauggcuguuaucaaaaagacaagagauaauuguugaugaggguguggagaaaaaggaacccuaguacacuguuggcgggaauguagauuguuacaaccauuauggaaaacaguauggagguuccuaaagaaauuaaaauuagaacuaccaugcgacccagcaauuccucuucugaguauauaccccaaggaaaugaaaucaccaccucauaaagauaucugcccucucauguucagugcagcauuaauuuauaguagccaagauauggaaacauccuaaguguccaucaauggaugaauggauagagaaaaugugucuacaaugggauacuauuuagccuuaaaaaaggagauugugcuguuugccauagcauagauuuuggaggacauuaugcuaagugaaguaagccagacauagaaagacaaaauacugcaugaucucauauguguggggaaaaagucauauauacaguuguauaauauaauaaauauaaagaaauaaaacugguuaccagggauaggaugggaggaaaugggaagaugugggucaaaggauacaaaguagcaaauauguaagaggagcaagucgagagauccaauguacagcaugaggacugcagcuaaugcaauuguauugccuuagggauuucugugaauuaaguggauuuuagcugcucuuaucacaaaaaaguaacuaugugagaugauagauauauuaaucugauucauuauaguaaccacuuuacuugucuauauguaucccauaacaucauguuguaaaccucaaauauacacaauaaaauaccuuuuuuaaaaaaaggagagaguaaucaacugugucaaaagcugcuguaggucagaugagauuaaagcugagaagugaacacuagcauuugguaaggucaagaucagugguaaccuugauaggaaugguuucauugaagucaugggacaaaagccugaaugguguaggugugagagaauauggacacaggacaaaagagacggccucaaaguaguuuugcuguaaaggagagcacagaaaagggaagggggcuggagaauuggagucuagggaggauuuuuucaacaaugguuaaugauuacagcugauagguguucagcaaugaaacaacaaaaucucugccuucaugaagcuuacauuuuaguaucgggugggggcaggaagauagacaguaauaaagaaacacauaauuauauuaaacuggcuacaagauguugccacucagauaucauauggacauuuugcauucaacauauucaaaaugacauuaucuccuccccucccuucccccaccuuuuccucuauuccucuuccuuguuuuuauauuguaaaaaaugccacauucaggacagaaucuugugccuuaucccuugcaaccauccuguccucaaacucaggaguguuuuuuuuuuucuucacaaacaguuccucaggucugcucccuccuugccaucucuaccucggcccauuggcauucacuucucuucuggaucgcuaccucaccgucuuaacuagagucucugccuucguccucccccuuuaaucucuucuccacaauguagccagagucaucuuuuaaaaauauaaccugagaguuuuaagggacuuacucaagaccacaagauucauagagccaagauuugauuuccuuaugucaugcuccucuuggggcuggcuuuauguaggggguaggaaggagcuaggucaucuuaagcuaaguaagauaugaacauugccagaaaugcauguuuguauguaacugacagcucaucaauuugucugauguugguuuguuuuuguaggugcacagguuucauauuccagaagguuggaaaguuggcugcaacagcugugggagguggauuuuuucuccuucaggucuguaugugaaauguucucagauguuuggaaauuccaccugcccauuaaggaaugugguguggggaguuguaauacaguccuggcuaugucacacuagacuagccuuagcacuuguuuucauguacuauuuuaaaugcuagugaccguuugagucaaauuuuauucauuauacuaguaaauguuauuugccagucccauuuuauuuccucauguggcgacagaagugcaaauuccuuaucauagcucccuuaaaagaguuuuuaagaccagcugaauuauuaagcggaugugauuucaaaaauacaagugugcugugaugauuuagugucauaugcuaauauuauagcuagcuuucacagaggggauguugagcaugugaugagaaaugggagcuaagugacaguacagucagaugucgucugcugucuccuugacccauaguuucagaaccagugguugccaguucucugagacugcuuaggagagacuaacaagcaagacuugaaaaagggagcaguuucuccaaaaacaaaagaaaacugacauuugauuguauuaggcauacauuucuuagcucuguggcauugguauucaaauuuggcuccacauuggaaucaccuaggaguuuuuaaaagagccaacgugugccacuccugacccacagucugauuucauuggaaaacuuaaaacuccugaggugauucugcugugcugugggagccauaacuugcugaaucaugccagagucucugaauucacagccguuugucucuucccacaguuggcaacccucacuuuugcaagguaaguucugcauuagcaccaugauuggagugaguuuugcagauaggucaggugaaaaucaaauguaucgaagagggaagcugguaacuggcuguagcuggguugagugugguauugcugcaugacaaauucccccaaaccuaauggcuucaaauaaugaucacuuuauucucucucaugguuacaggaguuuggggaggguuaagguaggugcuuguggaucagagucucaugugguuacaggccagaugaucagaggguuaggguaggucuggacuuguggggccucuuugugucucugucucuguuugucuucccuccuccucuccuuauuuccccccuguccauagucucagugcucuuccauguggucccugugccaguauaggcuuccucacacuaccaugaccucaggacucccaagcacaguucugcagaaacauggugcaaguugcaucuccuuuguugcccaagccucacuuuuguuggcugcuucccugugggcuuguuacgugcuggcucuguugcuagacaggucagacucccugcaagguggggccccuccucacaccucucucuccuuccccuugacccuucagguggaagugcaguaacaucucuaucccugugguuucccuuauaugcugccccaaacuucauaaacauuuuaauauugcuuugaaaugucuuaauuugaguguguccucuguuucguuuuggggcccugacagaaauaauugguauugaaaaugucuccagaaaggcaccucaaaaugagauuuugggguuggauaauuccaauauucaagggguacagggacacugcuuugcugcagaggugagacauggagaaucuguggcaggcacucauguuaucugucaccaggggagugagagcaggaggcaagcauaauguugggagaucaguuauaucacaaguuauaguuugacauagggauccaguuuccuuuuuuccauacugauaauugagcagaauuuagugaauaauucuucccuuucccaacauuugcagcauugucucuuucauauaucagaacccauguauguguggcugugacucugguuucuguguucuguuccacuggucaacuuucgaucuuuaugacaguacuaaagcuuaauauuugguaaugcaaauuccuccaccuuauucuucaggaguguugcagcuacuuuuguguuucugcucauucaucuaaauuuuagaucagacuugucaguuauuuucaaaaauccuguugaaauuuuuaucggaauugcauuggaaccauguagauaucucuuaugauauugaguauucuaucugugaacacgggcuuucucuccaauuauuuaggucuucuuuaaugccuuugaauagacuuuuuauuauuuuuccguauagaucuuguacaucugugauucaguuuuauuccuggauaccuuauaacuuuaguugcucuuguggaugauacgauuuuuaaaacuacacauucugauucaugcuaguguguugaaauacaguugauauuuuauguugcucuuucagccagccaccuuguuaaaaaagucuugucugggauucuuuuggguuuugucuauaaaaucuuuuuaugccaucugugaacagugaaauuuuuccuucacgucuuuaugaauguaguugcuuuuucuuaccaagcuguagaucauuuccagcacuuuuugcagcuuucagagcccagcagcaacgcuugccaguuuucaguuuauucggcucccucuacuuguugugcugcaauggaaguaggauguugagcuuugucaguagagggcgcuggagggaccuugcagcgggagaggcugcuuuucccaguucugguguugcuuugccccugcagugcagucccccaguaaugccaaggagagcaggaagucaccucgcaauccuggccugggccacccaggggacuucaccaccaccauuacuacuuuugcccccuugugaaaaaucaguuuguuguaguuguccacguccguuucuguacuuuuuauucuguucuguuggucugugugucuaucucuucuucaguaugacacacugucuugacuacuguagcauuauaguaaaucuuaaaucagguagugugauuuccccaacucuguucuuuuucagauucauuuuggugauuccaguuccuuugccuuuccauauaaaucuuagaaccggcuuauuuauguaucuauaagaaauccuacugggauuugugauuugggauugcaguaaaucuauggauaauuuggagagaacugggcaucauuucuguguugaguauuccauuccauguacaugaugugucucuccauuuauuuagguugucuuugaguucuuucuucagcauuuuguaguucucaguauacagauccuguauguuuuauuugauuuguaccuaauauuuaauuauuuuuugcacccauuguuguaaaucauuuaaacauuuuucauuuccaguucaaauugcuagcauauagaaauucaguugguuuugugugaauuuguguccugugacccugcuaaacucacuuuuuuagucuaggaguuuuuguuuuuuguugaagucuaugaaauuuucuauguagacaaagaugucuaugauuggagacaguuugaccucuuccuugugaaucaggaugccuccuaauucuuuuucuugccuuguugugcugacucugaauucacuucugguacgauauuuaauaggaguggagacggcggacagcuuugccuuguucccugcauucguucuuucaccauucuguacaguguuagcugcaggguuuuuuauguagauguucuuuaucaaguugaggaaguuccccucuauugcucuuucucugagaguuuuaucaugaauuugcguugaauuuugucagauguuucuugaguccugccuugagguuaggccaggcgauacugcaggaaaagcaggaaacacgccaccaguuugguggugcuuugaauucuggucuucuccaaucugcacgucgcuguuuuuauguaagagccuucaaauagcuaguccauguauucucucaguuuaauagcaggauuuugugggauaaacaggguggaguaaaugaaccagagccuucuuuuagauacaaauguugauacucaacuaugugguugcuguaaguaauuuguucuuuuuaguacuaaguaauauucuauuguguaaauaugauacaauuuguuuauccauucauguguugauagacuuuuguguauuuccaguuauagacucauaaauaaagguacuauggcuugauuacuugugaaguugaacuuuuuccuuuuuguggacacuuuccucugaauugcccuuacccauuuuuaaagugaacuuucuuacugaucucuauaagaaguucacuuuuuugaguaucaauguuuuguuuaugauacacaucacaaguauuuucucuagucuguuugggugacugguggugccauuagcuaaaauagggccuagaggaagagcaacaaugcaggaggagacucuagcaaggugaagacuuuuaguuucagauauuuugagauugccaaaaauuugguagagagaagugauauugauagggcauugauugauuggcuacagucauucucuucauuccuaggaugauauuaauccaucaucaaaaucuacaugcuugaaucagauuuacacugaguuuuaguguuugugccugcuguuuuuaucaagggaaauagguauaugcuguaggugucuuuggaugugguucucuuaauauccguuuauaugaacuugcucaugagaaaucucuguggggccagaugcuagauuucuuccuguuaagcaacaguaauaacugccugaaugcuuugcucuguucacauugucaggaaacugacacucaugggcacauugucagagucauucucuggaaacauuuguauuggcuguaagguccaucucuucacccuacaucuugaccccccaccuugauuuucaucuuauguaacucuuuguaaaaggguuguaagaguauaaauaauuuaaaagaauugccaguaguuauuucuagugccaggcauauggcuucgcauauaggggggaugcugaguagaugucaucaugauacaaagaaucaaauggcagaugucuccaaaaauggaaagucagaggguuucgagagucuacuucaggauuuauccugacuaaaagaaauaacaaaucuguuucucauuucuuguugucauuauuguugauacuguagcuugcaaaccauacuggguacaucaaaguugacuggcaacgaguggagaaggacaugaagaaagccaaagagcagcugaagauccguaagagcaaucagauaccuacugaggucaggagcaaagcugaggaggugagacuugcauuguucacguguagugugugaacagugcagacaaaaacagggcuuaacccuauuguaccauaucucagugauggacagggcuuaagcauuacaaagaacuuagaguaaugagacaaaacuaacuuggauuaucaucacuucagaacauuuuuaaaagcuggauaauuguuuggugaccuuugucugugcacauuuguggagugauuaucccuuuaaccaguucuuguaggaauguggggcagcauaguaggugggaaggauauauggccaguauaauuauuuugagucccauuuugucgcuauacacgcauaucucugaaacauucauacucugcuuguucugcauauaacuaguggaaaugucacaaguauucaacuccacuguauaucaucaaaauagccauagaugauauguuaaauaaguggauguggcuguguugcaauaaaacuuuauuuaaaaacagguucagauuggauuuggcccaugggcuguaguuugcuaaccccugaucuuguucauuaaagccaaguuagauuaugaccuggcacugcagggacaggagaaguccuuccuuuuuaaaaggauauuuuuugcugcugcuuuauuaccuuuagaaauaugucagauguugcaaauaaauaaguacacugaacuggggagaaauaaacaaggaucagggugucaagaagauagcugguacuuucuguagccuggagugaugagagauucucccauuagcucacucuagccucacagggaaaacagacagauugagugcaggggaggagaaauacccugugugcgccucaggcuucucauguugugaguggcucuucgugcuggugauuggcaaguggcuggucaaagcuggugccuuuacccagagugggaagguggcagagauggguaucuacaggagcccagagcccagauaguuucucuuuccuuucuuccuucugucucuccucaaaguuaggaaaguuacauuuuuuauuucaugaaaacuuuauuauucaaauguuuauaaaaauaaugcauggcugggcacagugacucaccacagugaguaaaaaaaaauuuuguaagagaggucucacucuguugcccaggcuggagugcaguggcacagucauggcucacuguugccucaaccaagcgauccucugaccucagccuucugaguagcugggucuauagguguguaccaccacacccggugaaguuuuaaauuuuuuggagagacagggucucccuguguuguccuggcuggucucaaacuucugggcucaagcaguauucccaccucggccucccaaagugcuggcauuacaggugugagccauggcaccuugcugaaaacuuuaaaaauaauacuggaaguguauauaauaaaaagcauaaaguuaauauuugauuagaaccaacuguugacucacagagggaguuuguuauaaaguaaccagauaauuuggaauugaguucacugucacaggcccuggggauguaguggcugguuuuccuacucauagagccgguggucugauuugagaaacaggaugaagauuuaguucaguauuuaccaacaagaugacuucagugagaacaguuugguggggugguggaguugaaagccaaauuagcaaguugaagaaagaguaguaaaaauaauaaacgaaaccaauuuucucaggaaguuguaugauuuuuuuucuucaccccaauggcagaugacaaaagugcuucauuuaaggaaauguagagguccaggagagauggaggaggaguggaaaugaggcaggaagacauaggcaucguuggaguaagggcuuacuggaggguuagaagacagugguccuaggaggaugggguugguagugugaaaaauguuaggggaaugucagggugugaguagcuuaggugguuuggggauggaagucaccguacuugaguucaagaaaugaucaggccaggauguuggaugucuuguucauaugaacacuuucuaagguggugaucacacuuaggagaaagaggaagucugagccacuuaucaaaauugucucugaaauuggaaggguggggaguggucaggagauugguagagcacagacuaaggagccauaaagagugucugaauguaugcacugagucucagaugaccgggagcuauuccaggaggguagaggggaggugggaagcuuugggaacuuaaggaaauaagaacgucaccuguuaaucaucuuagauguggugaagugugagaaugagaauuuauagcaucuaccugggagcagguuucaggggggaaugcauggauggagagauuuaggggagagacuucaggaaaugagaagccucuauuggaggguagaugccaaagaggauggaaggagcaaaauuggaaacagaauugccucuguaaccaguuuauuuagugcagcuuuacucuuucgccauaacuguccccaugaacucuccuucuuuguccuugauucaaagagccauugucucuaccuccugaugugcauccuccuucccaucaggcucccucuagucuuauucuccccacaccagccaguagucauuuucauauguaagucuauuuaauuauuauuaaauagacuauuaguguaaguccauugcccuuuggguaaagugcaaauuacguaaccgaugaggggauugacauuguuaagacuggcauagguauaauagagaugauucuuaauauuauuaacauccuuagcaaaacaacccauuguacuaucuucuguuuucagguggugucauuugugaagaagaauguucuaguaacugggggauuuuucggaggcuuucugcuuggcauggcauccuaaggaagaugaccucauguucauuguuccugguuuuuuccagccagcagccucuacacuccaucauaggacaucgagucccuccuccucuucucccaugccuucuucccugccauggcaaaucugaguggcuucucuaagcaucugcugguacaagucaauguggcaccaugagcuucaugguggcagaagagacaauaguccuuagcucuccucccaguacacccccuacuuggccagucuguaggccaacaagaagguuccuuuacccccaugcaagacacuuaugagaacacauuacaagauggcugaccguggaggaugaguggauccugaaagguugucccaaacuguugauuuggaaaagaaauaagcacauagauaaccuuauugugugcugcauggaaaggaacugaauacauuugccuuuaagcaugaaagauuuugguaucuuggugucuacuuucuuuuuuaguugguuuuacauuacagaaagcuauuuaaauguguuauaauuaugccgacaaaauuggcagcauaauuacuguaauugaaaaaucugauauuguccaggaaugcuuucuaccguacaggauaauguaucucauggcuguuuccaaaggguuuauuuauuguaaaacaagugauuuaggugggaaagggaagauuuuggauuuuuauuuuguagaaaagguuuuaagcuuugaaaugugaaugaaauauccuuaucaaaacauuagggguggccauaacuccucugugccacuucuacuauuuuuuuuuuuaaucuaguuaguaugaaauacaacauuuaaaccggaauuuuaaagaaguagcuuuccagggauucagaauuaagaaagauagugauaggacaugagaaauaaauuuccaucaaguguaaucuaccgucucaugaugaccacaacccugagaauuauucuuuaaaagcuuacacacacacacacacacgggcacacacgcacacacagaaucuuaccacauuuugcuguaguggcauguuaccaugucuacagucccuacuagaauaucagucagcuuucagagggcaagacuucugucuucaccauuauacucacagggccuagcacuuaauaggugcugaguauuugaauaaugacuuuauagaaagaaaacucacuauuaaagguuaguuuuacucagaauuguuaaucuuggagaugaucucuugugaaauaugaguguguuucuaaggccauacauuuaaaaauguuugcauuuuaacccgucuugagaaugauguauugaauuugaaaaucaaaacuaccaguggauguguggaacuuuacagaaaccaccuauuugcguuuuucuccuuacauuuaaggaaacauaagccauuuugcuugcaauauguaugaaucaucucaaaaccauaaugguaugagccucuuugcugcauauuuugcuauaagaacuuauuuuuuuucacuuuuuauuauggacgcuuucaggaauauauaaaaguagagaauauaguacaauaaucccccuguguaucuaucacucacucacaacaaucaucaaauuauagcucugcugguuuuuaccaguuauugugaaacaaauaucaaaaugucauuuuaucauauuucaguauguaucucuaaaagguaagaauuauuucuaaaaaucauaaauaccucaucauaucagacauuaacaguaauuacauaauauccaaaaucugaucaguguucaaaauuuccucaaguguuuuauauuuaguuuguuugaaucaaaauucaugcaagguucacaucguauuugcaugauuuggauaagucucuuaaccuuauagauccuccucuauuuuuuuuuuuuugcuugcuauauauuuauaucucuauauauauugauauagacauauguagugacacugagucaucuguuuccugcuuccccacacucugccucuccugacaucugggucucuggguuaugccauauauggugauaguggcugcagccacuuuaccugugugacuuacccacagcaaugggaugguaacagcaaagcuaaccaaagugcucugugccccuuuggguugcauguggggagacuggccacccaaugccucuccagugggguagggguugucuuuuggugcaucuguuuuuccugugauuauuggugagggcagcaaagauuagcaggugguuguaaacuaccuugaguagguuguaauaaauagucuggccuca

SEQ ID NO: 193007 - RNA, 92009 nt, Homo sapiens
ugaaaucauuuguucauuuauucauuaacuugucaaauucaguuuucuauacacuaugauguuuauuccauuuuguacuauuagauauacauauuuaaaaaaauauuuaacuuauuuuuaugaagaaauuaaauauuuucugaaaaagaauuauuuuauuauuguucucuagcaacaaaccucaaacaauucucauccaacucaacuaacucauuuaaauaacuuugcucaauggcaacuucucuaaagaucuaguuuacacaauucuauucuacauaacacuguuuacccuguuacauaguauauaguuaaagaacauuuuuguaauaaacauguuucucuuugauaugauacauaacaauauuuucacacuucccagcaaucacucaaauauauuaaaaauguauccuucuuuaaaaggcacacacauuuacagguucaaaucuuuauuguuuuaaaauuguacaguucuuuuacaauacaauauuuuguuauuuaaaugaccucuaaaugguuaaugugcaaugaauaucuuuuguucugaaacucaaccaugaauuacgauuucaucaauaugauuauucuagagucauaaagauguugggaagguuugagucugcauuugaaaugguuaguagcacagacucuucccuuuagaacccagaugaccaauccacugaaagugcuuuugaagauugcugauuacuuauggcugaucuuaaaaucagucaaucaaauuacaguuccuuuuuuuuuuugaaacaucaaagggcauuuaaaaaaacugaaacaauuugcuuuaguaucuacugaggcaaacucaaaaugauuaucagcaugcaauaacacuccucuuuauuuuaaauaguucugaauaauuuauacauuuuauaaagaauguguuaaagagugcaaguauucugauacugauuucacaaaaggacaaaugcugguaauaauaacauuuaacaucuaaguucaagcuaguguauauuuaacaggcaauuaauauggcucaucauaagccacaaugcacaagguaugcccuuugagaaaaugaaguaguuugguccgcauuucuagaguugucuggguaaaaaaaaaaaccaaaaaacaaaaaccauuuuaauucagccaaggauucugaugaauuuauuauuccuaaaaugaagccaguuaaaaaguaaacgauguacaccagugaaguauauugucacgcugacuuuugcauaaaaagauggccugcuguuuuuggagugaugaaugagcacugcaggacaaaucagaaaaaaaugucauagaauguauuaauuuuguccauaaguuauacuuucuuauuccaugauacggcuuucacucuguaaaacuuuguccccaaaggaacuuuaaaucuguuuugugccuaagagggaaagaaaaaauggaaucacuagagugauuaaaccacaucucucucucucacacacacacacacacacccaaaaaacaaaaagaaacaaaaaaauaaauaaaccacaucacacaaguacccuccuaucauauuacucauugcugaguauugagggguuggagggaugugggggucuuuaucaaacuauguaagaucuaccccucacgaacagggaauauauugagugaauaggaaagacaaaguugguagccacugcuaaagaauauaauacaaagugggccauacaucauuguuuuaaguaucaaagaaaccucaauacuauaugguucaaguucuauucguauuuuguacauugaggccccaaauuauagugagucaggaagaaugcucagaagacuucacugacucuagagcacugauauuguuauacaaucaguccauuuguuaagccaccaaauacuuuacacuaccuuucuucaaugggggcagaguaugaaaauaauaaaagaucaacuguauuuauaaauaaaauucccuuuuugucucuaguuaugcagggauuuuuuuucuugcaaauuaguuacacuagcaacccaacagucauagaacacagacuucguaguaguuuuccauuauauguugauagcuuguaguuaaucuaucucuacuaucuaagggcagcaugaauacuuauaaauugccaguucaaacucacucucauuaaauucaagcucuaacugaaaugagcauaaaggccaagaacagcagugguaaugauuucuauauaaagcaguauuaaaaucuucuuuacaguucccaggcuuaguaucacaugaugucguuuuuaccuuuuuggcuugacaguauucuuuuuccauuacuuuuccaaguacccagggucuucuagaugcaccugaagcuaaugaaauuaaauaguuaaucucuuuuugaaaguaugauuauaauuauucauggaaacauaacugccagaauuaaaacagacuaaaaaagcucucaugaguggaagaauauguaagacuuuaaaaacuaccgaaaucacugaaaugcuuaacaauuuacaaaacuaaauucauguuacuuuucaaccaguaaugugugcguagcucuuguuacucauuaaauauacaugauaugucaaaucacagaaauaacaguucaggaaacacuaauaaucuaaauacaaaucaugaacaaauauguaggaauucuaggcuaacucaguagugccaucuauugaaagaacuaauaaagaugaccuuucccauuucuuuaagcaaacaaaauguauagguucaaagcaaaacacucauuuuugaugggcaguauuuuuaauacaaguucucaaaggcagcaagugaacaguucucacaucuguaugccacagugcuuggcacagcaguguguauacaguugguacucaauaaauuaauaagggcuaagaaccaaaaaauucuagaagggcaguacuugugugaaugaaggaaagcugaaaaaugugagagaagacaggauaauccuaguccucauaaagccaaaaugugacaagccaagugguacccauucucuuuuuaaauucaucagaaaagaagcugucuuauuaaaguugacuucaaaaguauucaggcaauaaacuacagaugccuuucaacuuaugauaagguuauguccagauuaaacccauccuauauugaaaauaucuaaguugaaaaugcauuuaauacuucuaaucuaccauacaccauagcuuagccuagucucagaacauuuacauuagccuucaguugggcaaaaucaucuaacaaaaagcauauuuuaaaguguugaaugucucauguaauuuauugaauacuaaaagugaaaaacagaaugguuguguggauaccgaaaguaggguuucuaugaauguguaucacuuucacaccaugguaaagucaaaaaguuuuaaguagaacuaccauaaguugggaacugucuguauuguguuuaggcuaaagccuuugaaagaaggcauacggauuuuuauuccauacaaauaauuugggaagauauacacgaaagauaucccaaauaaauaaucagaaaugaaccugaagaauacgaucacaugacagaaacagaaaagccccuggacaauaggauguggugaauucucugaagagcaaacuagcacuucacagccaauuacuaacauccaaaaagaaucaucuaaaaauaaaugcuuguaugaugccagaagaguaaugagccccacuaacaaaaggcauaaaaacacucugguaauccgcacucucccaaggcaacaacacagggguagcaugaucccaacuggcauuccucaaaggaaaaaaggaacggggguuuauuaaugguuaaguaagacugcuaaauaaauaaauucuuuucugcaguacuugugaaagccuuuaaaauggcagugugcauuuuuaaaaaaguuuuuuaauguuucccagauuuaaacacugaagucuucaaaaugaacauggaaauguugaaagguaaugggcuaagauguaacuuaucaucauacgguucugggggaaaaaagugugcacacauuuguguauauuuauaucuuagauacauacacauaaaaagauauugcaagugggguaaaauguuaacagaugaaucuggguaaagaaauauagguuuucuuuguacuauauuaaucuuugcgacguuuucuaaguuuaaaaaucauauucaaauaaaagguuuaaacaacugaaaaacaaaaaaccccauaaaagacaaaagaaauaucagguucauuauuuucaagguaaaaaguacuaaguaaaaauaguaaguuauaagcuaucuucucauuuuucaugguuacaugauuacuguuucauggauacucuaaacagccaaccacaaauagccaugauggaguugucauggggaaaguggccuaguucaagacuaggaauuugccagccuggccaacaaagugagacccugccucuacaaaacaaaacaaaaaaugggcauagugguggugcaaaucuauaguaccuagucccagcuacucaggaggcugaggcaggaggauugcuugggcccaggaguucaaggcuacagugaccaaugaucaugccacugcacuccagccuggguaacagagcaaaaacuugucuuaaagaaaaaaaaggccggguacgguggcuuaagccuguaaucccagcacuuugggagccugaggcaggcagaucacaaggucaggaguuuugagaccagccuagccaacagguaaaaacccgccucuacuaaaaauacaaaaauuagcugggcgugguggcacacgccuguaauuccagcuacucgggaagcugaggcaggagaauugcuugaaccugggaggcagagguugcagugagcugagaucgugccaccgcacuccagccuaggcgacagagcaagacuccguuucgaaaaaaaauaucuaccuauaaauauauagauaagauacuugacuuuguugcgagucaguccaauuagauuaggaacaucaaucuaaauggacuuacuucguuuuaguguuaaaaauaauucuacuuaggcuaaguacaccaggauaucuauucuguucuuuuuuaguauuuuaaaaaucaaauagauaauagacauuguuacuuaguauauuuuaacaaagcuuauuuccuuuuuaaaaaaauaaguguauagaacaguauaaugauaaacaagguaggaacauaggaugauauaggauagacuagacauuuuauaauuuaagaaaguuuuuuuugccaaaaaauaaugcuuuuauauaaacaaauaagcauacauuaauuuugaauagucuguacaugagaacuuugacaauauaauuauccaacugcuaggguuaugagauguccgaaucacugcacauucugaucaacuggucccuuguauaagcuacacuccuuaauucugaauuguaaauggaauccaugaaaauaaucuagauaauacagauuuuauaaaaaagcagauuacacaggguucccucuuagugacuuaauucuuauguaauuaaacagggaaaaaaaaaucuuuacuuauauaauuuccuccauuccagguuuauauuuuagucauggaaugacacuuaccacccucaccugguuugagauccagggcagguagagacucugaauguagaaaauauaaaguaggacuaacaguaaauaacacauaauugucauggcguucgucuaggaugaugaguaccaaaucucccaccugaaaacugaauaaagaaaugcaauuuuauugacuuagaguuacuuucaaucccccuauucugaaaacuuagcauauauacuuaaugcucaacuacauauuaagauauuaaugcaauauuaaauuucacauuuacaugauacucuuuuugcauucugcccagguccuaaugggacugcuggucaugcacagauauucaaaggaugaugucaggggcugucaaaaaccaaaaauuucuuuaauaaaguuuccauuaucuaacguuaaggaacuggaugaaaagcagaaaaagcacccauuacaguuuauccagucauagcaagauuuuuuucuccuaaucuuucauuucacaccaaaaauucagagagacaucucauauacagucacagugucaaagaaaaauuagaucuugucuccaagcguagugcucuucaauuuacaagaaaaagcaacugagcuagguccagaagucaggugcuuaauuaggucuaaacaagucaacagauauuacuauuuugggguauaagcccgaaagaagacagggaaagagagaaguggguacaaccaauuacaugcuuaagugguguuugucucuuuacagccuuuuucagaacuguuguucaaaacaucaaaaggccuugaaaaucaaucucauauuuuucaguugucaagaucauuuaaauugguagauccuauaccuaauaaaucaucaaaaucagcuggggaaacuuuuaaugucuuuuauuuauuaaguuacccuacaaauacuuagugauuaccuaacaaccauguggcaggcacuguuuuggcuaaaugccaaaagcuaauaacuuaaaauggggagaugggaaauggggccucuaugaggcaguauuuuuggagcuccucucucucuagucucugaaagaacauuaaugaacggcccauugacaugacauacagcugguaaagacagauaccacuaagcccuuucaaaucacugagagaagcugaaauuuuaaugagacaugaaaagucagaaucacagauaucugacaaccaaaaauguggucaacaaauuuagaaauuuagaaauaaaauacaagaaguuaaauaaagggucuuaacuuucacaaccuuccugucaggauaaaaggcugaacacuauucauaaguugcuaacaaugcuuuuauuauuccagagcuccauuuaaauaaccaaagcuaaagaaaaauuuuaacuaugggguaauacagugcaggaaaauuauuaaaccauucaauugauaaauucuguaaaccaaaaauaaaauuugaagcccccccaaccaaccaucugaaugaacuuccuccucuaggccagugcccuauaaauuuaaccugaaagaccgguucaggccaugacaaaaggcagggguuggacuugccucaucauguccucuucccucuuagaauucaggaaaagucaacaagaauuuaacacuaacacagagguuaagccugauaagaaacauuuacaaacuauuaucugucaagccugcuaccuggaggcuucaucugcaugacaaaacuuuggucuccacaaccucuuaucuuaaccuagacauuccuuucuacugacagcucuuucaaccaacugccaaucagaaaacuuuaaaaaucuaccuauacuuuggaagcuacccucccagcuuucauuugucccaccuuucuggaccaaaccaacuuguaucuucaaugucucaugucucccuaaaauguaugaaaccaaguuucccccucaccgucauccaaucaccuugggcacauguucucaggggcuccugagggcugugucacaggccauggucacucauauuuggcucagaauaaauaucuucaaauauuuuacagaguuugacuuuuucauugacaauuuguuuauuaugaauuuguagaauauuaauaaaaugaaaucuaaaaacuaaaaaugaggaaacacugcaacuuaaaaacaaaucaaaacucuccaauauagauuaacaagacuaaggagauaaaugggauuuaaaagagguagcacaugcugaaaaguuaacuggaggaaaaggcuucaaggauauuuauguuaaucauaaugcuauaacuggaaaguuuuggcaaucuaaauguuuccagaauaacaauuuagaaaaauccugcuuuccaguaaaaaacuuuuacuacuacugagugcaaaacacucagcucaaugaaccuggaccugaauuacugucacugaaauacauuuucauuaacaauucagugaauguuuuucacagaaaaauacucacaaaacuaaaauacuuacucucuaauagcuaucuuuucagaaugccuugaagauacugaagacaugcucugagacaucuaaaaaaaaaaaaaaaguuuaugaacuuacacaauuugaguaccacaugcauucuuacugcaaaaauuucacccacuguuauacacauucaagccuguguccagcuuuaaagagcccaaacuaauauaguucuuauguucauuaauaauuccuuuauuucaaccauuaguaaauuugguuagauuaaaaacugauuuuugaaucacauuuuauuuauauuacauauuuaaucuuaaaaauaaaacacagagaaaaggacagauuuuucaagaagacuuugaaaauucuaaugcauuagauucaaaaucuuucauuuuggaaaaacaacaauguuggaaacaagugcucaguguagccaaaagaaacccacacuuagaaaauuucuuggcaaggcaacuuuacuucugcagaaggcugcugcucacagccgucacaauugcaagagaacaccaaacaaaggaaggaagggguuuuaucucuaaugcaguuucuguuucuguguccuuccccuauuggcugggguuggaccacacaaucuaagcugaucccgguuagcuuagaccuaaacuuuuuccaaauaggguaaaugugcgauuugugagaaaaggagaaggcagaggggagaaggggaugggguugauuuacaaucuuacaacuuaugaccaggaaguugagucuuugaagaggaacuuaguugucccaacgaacaacaacaaaaaaaccaaaaagauuuaaaaucuccagccugggcaaaauggugaaaccccaucucuaccaaaaauacaaaaaauuagcugggcauaauggcaagcgccuauggucccagcuacucggaagucugaggugggaagaucacuugagccuggaaggcagagguuagaaguauaaugcagcaagcaaagacaccuggugaccaucaaacaggccaucuggaggcagaacgcugaggaauuuagaaguaauuaaacuuuccuagcaugugguuacaggucucuuucaaaaauguuguaaguaacuagaauuucuauacaucucuggaauguaugcaugccaaaacucacugagcaacccuugcugacaucaagacacaaaaaugucuacaaauguaaucauuuaucaugaccuacacggccaacauugguccaaacuaccuuuaagauccugccuuaagguccauauaugcucgucgggaaaauucaccacagcgugcucaguccucucuugcugaggcaccccgcuacacucuucagcaucauucgcucuaauaaaacuuuccuuuuucaaaccuauacuguugucaguaaauucuucuuaccaaaccagagucaaccacuuugcaaugccagcgcucugacaccuugccuagcaaacacuacuacucugguuaaacuggggugggagcauaaaguucugaaggcugagaacaaaccucuuuucucaucuucaaugaaacuucugagaugucucaguuuaaaaaaauuugugaacaaucacgaaacaaugaauuuugugauagccacccacuuccucuacugaugaugagcacaaucaaaugguacuugcuagcugauaagcuauagccauggcuuagccgggacuguucuccucuucaaacaagcuucaauccauuuauccacaccaucucauaagaccugaagcauggaaaccaaggucuuugaagcuugaaagggugauaaaaacaccuauuuuucccaagcaaagugagcccaaugcaugguugcacaaaccaaggacagauaaggauauuuuguuuauuaagucaaauuuugaugcucugaauuuccuccacuucccucugaacgcuaucugguacaaugcaggguuuuaaaaagagaaauaacacaacaaauaauaacuaggaaggccuaaaacuguauagcaacuuacuaaaauuauccagacaaauggucuauauccugccagugaagauaagauugaccaucauuuuuaagaccauaauucaacuuuaguuuuuuaaaagcuuaaguuuuuuauauauuacaaaugaagacaauggaagaaaaaauuuguuaauauagcuguaauucuaugugaaagugugauuuacauuuggacaccuuucugaaugugacugugaugcucucugggucugaaagacaauuuauucugugaaaagaaaauaaaucuugggaaccaaaaaucacuaaggaaaagggaggucaagcugggaacuacaucaagcaaaccugccucccauuuuauuccuaaaauaagauagcuacaaagaccucacaauuugcccacaagaaaauuccuuguggacaaaaaacagacagaacuuaaagucaucccucuguuccucugcucaugugagacaaaugcguauaugauugcuuucucggccccacugcuucacuaagucagacugaagcauaagugacaauuccucuaccauccucugacauguaaauuguguauucagugaaaggcuaaucacaguuucaaaauaaugcaaccauuugucucuuaucuaccuaugaccuggaagcccucuucccagcuuugaguugucccaccuuuccagacagaacaucuuacacauacugguugauaucucauguuucccuaaaauguauaaaaccaagcuguguccugaccaccuugggcacacgucaggaccucccgaggcugugucaugagcucguccuuaaccuuggcaaaauaaacuuucuaaauugauugagaccugucucagauacuuuuggguucacaauuaaucuacaaacauaugccaagcaucuauaguauaccaguuaccauucuagaugcuaagaauguagcggugaccaaaacugauuaaaaucguugccaaacagagcuuauauucuauugaggauaaauaaagcauacuacauaaaacacguauugagucaugucugagauagaccauucuucuaagucuuugugauaaaauuaaugauucacaguauaaucacuacaaaauaugugauuuuugcuguucaaguuaagguauaaagaagaaaggagaugucucacuacaagauauuuuuauuuuuuaaacaaacuaaauucuaaaaaguauuucaaaacuuuucaaaagcacugaacagaagccuuaaacuguuccuacuaccuuguaaacuguaauuaauagaacuugaaaaaauaaaguuauugcuuuauuaaaacauauaauuggcuguaaaaugggcuguucaaauaauugguuaaauucacagguuaaagccaaggcaguuugguugggugcagcaaaauuccaggcaauuccaauuugccuggaaucccagcacuuggggaggcugaggcaggcggaucgcuuaagcucagcaguucgagaccagccuggacaagauggugaaaccccaucucuacgaaaacaaaaaaacaaaaccuaaaaccaaaacaaaacaaaaauuagcugggugcagcggcacucgccuguacucccagcuacuugcugagcugagacaggaggauugcuugagccaaagagguugaagcugcagugagccaagaucgcaacaccacacuucagccugggcaacagagagagaccuugucucgauuuuuuuuuuuuaauuaaaaacgaaacaaaacaaaucaauaaaaaccagggcaauuuacaguaccacaugggaucucuugccuuucaggcacuuucacuuaaaaauaagauucaugaaaagggcugggugcaauguuucacaccuguaacucccagcacuuugggaguccaaggugcgcagaucaccugaggccagggguuugagaccagccuguccaaaauggagaaauccugucucuauuaauuauguaaaaauuagccgggugugacggcgcagcacacuuguaaucccagcuacucgggaggcuaaugcacaagaaucacuugaacccgggagguggagguugcagugagucgagaucacaccacuccagccuaagcuacagagcaagacugucuuaaaaaaaaaaaaucaugaaaagauacaauguauuaaaauuacgcacacuugugaguaaauauauuaaucuucaaaagacuuaugaaacauaacucaaaacugauuuugaugauuuuaagaaucuuaggugcuucaacuggucagaccuacagccguaaauucgccaagacauuauuuaauuucacgcuaaggaaaaagucugacucuacagucaggagauaacucuggccugacuucagcauucugaaaaucaauaggauucaaugaccaacacggaccaacaaaccuacuauagauaagucaaucaaagcauacauccucugauggaauaucuucauaaugaaauauaaugcaaaucauuuaaaaauguuaagaccaauuuaccaagaagaaaaaucuuaccagucuuugauuuaaccguuuauuuucuucuucuuucaauugcaaugucugcagguggaaaaaagagaccugugguuuauccuuguaccuacucaaauaaaucuaaacagugauugucaaaguuuucaucagacaaaaauguuugguucggguaugaaaaguugauggggauauuauuuucuaugaauucuuuccaaauguuuucauuaucuacuagcuuaaaugagaaccagagcaauuuuagauacauuuaccaaggacugucaaacauuaauaugcguuagaaacaccuguggaauauauaaauauguaguaaaaaucugagaucuauccccagagacuuuguuaacuaagucgugccuaagagaauacaucuggcaucuguaacauacaucucagguuaugcugagguaggaaaucacauaacccuuucauaauagaaaacaugcuauauucaaaugaaguuguacaauucugaauuuggauuuuuaucagacaauuacacuuguaaagaaaaaaaggcauuguugaaaaucuuauaggccuaaagaaugaaaaguaaucuaugaacaaugaucugccaaauguguaccaauuugaucuuauaguacccuuaauaaaggaaacccuuuauuaucaguuuuuucuuguccauuucaauucuuuauuuaaaacauaacucccuucauuacuuauuuuuguuuuugccaauuucuaaaaaguauuuaauacuuuguuuuugaaauagauguuuaaaauugccauucauguuauuuugcugaauucucaacuauuagguaaaacuauuacuuuacacauugauuuaauaaaaacuaccaacuuuuuccucucauacagacuucauucauugggaaauuacaacaaaugggagggcugaaauacugucaacuguuuagcuaguaagaucauaaaaugacaagacuucccaaaacagugaccacaaaaauaaguuaaucauaaaaaggcuuaauuuauaaacacaaauagucuauuguauguuuccagaaugaaguuuaacuguauccaaaagugaacauauuaaacaugguacuucaagaagauaauuuacuuacucguucuaacagcauuauccgcuguuuuucuucagacaacauaugaauauuuucucuaaaagugagaauaauugaguuucaguuugaaauucuaaacuuuacauucuucaagauuuuagaaauuaaaauauuaauacagaucacuuuaacaauuuaaggguuuucauaaauuuucaaaaguagcuuauuucaguuagcauguaauuucaauguuguauauucucuguagcagaccuagaucuauaaaccuuuugaaauaauaaguaaaacucuguguaugcauuuaucuagagaugucuuuaaauuucuuauuuuucccaggcauuaagaaccacucuucuuaauauuugugagugaauccaugauaaagucguaguucuugaguggcuaaagacuucaguagauuuacuaaguggaugcuauguacucacuaguuacuaugccaggugugaauuugcccaauacacuaaaacauccaaaaacaaauuagaaaauuuuaaaaaaugcuauaaaauuagaaaagagaaaaacaauuauuauuuagguuuuaaaauucaucuacagguauaauccccaaauuauauuucaaguaacuugaugcaaggcagguauucugucuucuucaacaugcuacuucuuuaggaagacgcuuugccuaauauaaggucauaaagauugacuucuguaagaguuuuauaauuuuagcuuuuacacuuaagucuaugaucuauuuaagucaaccugcgcauauggugaggaaaggguccaacuucauccuuuugcaucagaauauccagcuaugcuaucccugcaccauuugcugaaaaagcuauuuccuucacggaaccgucucagcaccuuuaaccaaaaugcaaggguucaaccgaccaugaauacgagggcuaauuuuggacucucaauucuauuccacugauacagucaggcuagcacuacagugucuuauuacccuugcuuacaaauuuuaagauuagucaaacagugugagacuuuguuauuuuucaagauugcuuuggcuauuuugggacucuugcaauuccauaugaauuuuaggaucagccugcccuuuucugcaacauaacacaguucagauuacgauaagaauuguguugaacuggcagaccaauuuggggagggcuaccaucuuaaggcgauuaagucuuccagucaguaaacacaggaugcccuacugucuuaacuuuuuuccauguuuuguaauuuguacaaguauugaacuucuuuuguuaaaucuauuccuaaguauuuuuaccuuuuugaugccaucagaaaagaaacugucuuuuaaaucucauuuuuggaugauucauugcuaguagaaagaaugacaauuuuuuaagagacagggucuuguuaugucaucccuguucacaaaccccuaggcucaagggauccugcugccucagccuccugaguagcugggaccacagcugugcaccaccacagccagcuccaauugauuuuugcacacugaaccuguauccuccaacauuacugaacuaguuuguuaauuacaguauuuuuuuagaggagaccuuaggauuuucucaauaaaagaucaggcuauguaugcaaauaguguuuuuucuuccuuaccaaucuagaugcauuuauuuauuuauuuauuuauuuauauauuuauuuuuugagacagagucuuguucugucacccaggauggagggcagggucgcaaucugcaaccucugccucccagguucaaucaauucuccugucucagccucccauguagcuggaauuacaggugcccaccaccaugcccagcuaauuuuucuauuuuuaguagagacuggguuucaccauguuggccaggcugaucuugaacuccugaccucaggugaucugccuacuuuggccucccaaagugcugggauuacaggcaugagccacugcgccuggccaaugccuuuaauuucuuuuucuugccuaagugcccgugauagaacuuccaaguacaauguugagcagcaguggcaagagcaggccaucuucaucuugauuuuaggggaaaagcauucagucuuacaccauugaguaugauguuaauuguggguucucacagaugccuuucaauagguugaggaagucaauuccuaguuuguugaguguuuuuaugaugaaaggcuguuggguuuugucaaaugcuuuuucuucaucuauugagauaaucauguguuuuucuguccuuucauucuacugauauaguguaugacauaaauugacuuuuagauguuaaaccaaccuugcauuucugaaauaaagccaauuggaauuccuuuuguauucugccagacuggaucuauuaguauuuugccgauaauauuugugucaauaguuauagaagauguauuuucuucuuuugauauauuugucugauuugguauuaguauauaauacuggccucagaggauaaguugggaagaguucucuccuauuuuuuaaaagagauuauaaaaaacuggcauuauuuaaaaguuugguuuuuaucuuuuauuuauuaaaaauauuaaccaccagacuucugcuguuuguuuucuguuguacucaagcuuuaaauuucaauguaauauugauuauuguuuuccaagugcucuccuacucugauuucagaguagucuuuuauuuucuuuaagaaacucuguaaguucaaaaaaaaauuuagucuuuacuacaucuaucauuuuguuuauauauacaauguaaaauauggcucaccucucaccaauagaucaacaaugccucuaaugucccauucugaggaguccauccuuuuaccaaacugauuuaaaaugcuacauguagauuuccauauauauccacugguuuguuucaagauuacuaacucuauuaaucuauuugccuguggcuauaccaauaauguacugcauuaaauacuaucuauguaguuuaagacuauaucuuaacaccuagcaggacaaaucucuacucucugaucuuuauuuagaaaugcuaucaauuauuuuuacacauuuuucaauaugaauucuagcaucaaacaucacuuuuuaaccuaacauauuguuagaauuuuaauugaguaauagauuaaaucacugaauacaucugaggagaaaaaugauaucuuaauaauacuccauuuccaucuaucuuuccacguacagcuuucaggccucuucauaaaauuaguuuucuucacgaagucuugcgcauuuuuguuaaauuaauuacaaguaaguuauuccuuuaaauuuuuauugggaucuuuuauacauauuaaagucagcuuuugcugguaaauaugcaaacuacuccucuuuggauauaucuaugaucuacacucugauguacucuguuaauucuaauaugucuuuaggucuuugugguuuguaaaggauacugucugaaaaugaggacagaaaaaguuguuuccaaauuuuauuuauugucuugcugaauagcaauggugacagcuggcauuguguucuuccugaauuuaugaaaaauacuucuaaauguuucaauaugaaauacgaugcuugcuaugucucucccauauacuuacaaauaaaaagaaguucccaucuacuccuaguuugcuaaggauuuuguuaaauuauuaaauaaaugggcacugcauuauaucaauugucauuucagcuucuacugacaugacucuauaaaccuucucaaguaaucagugaguaugguuagguauuguacuguuuaguuauuacucuggcauuccuaaaauacuccacugggucaugaugacuauaucaucauaaaaccacaaggcauuugauaagcuaaaauugucuucaggauuccuuguauuuauaauucacaggugagauuaacuuguaucauguucucuguaauuuuuaaaacuauaacuaagguuaugucccucuuuucauuacauauauuuauuuguaccuucuauuuaucccaauaucuacuaaacaacuuuuauuuuauuguggcucauuuguuuuuauuaauucauuuaaaaauaaaggaacuacacaguucucucagaguaccacuuucgucauaucuguuuuugauacuuugguucugaauaacucaauuuucauauuuauaaaaaaaccuacauaugaucugacuaauaugcagaaucuuaaguuuaucucauggaggcagagagcagaauagugguuaccagaggcuggggagaguacagaggagaggagaugaggagagguuggucaacggguacaaagcuacagccagauaggaggaauaaguuuugguguucaauaauguacugcgcuaucucaaaauagcuagaaaagagcauuuugaauguucucaccauaaagaaaugauaaacguuugaggugauggauuacucuaauuugaauguacacauguaacuacaucacacuguaaaccauaaauauguauaauuuaugugucaaucaaaaaagccuuaaauuccuaaagcuuuuuaaagccuuuugcuuugaauugcuuuuauauuuuucccuucuauaucuuucugaaucauauuauaguaaacuuucuguaucauuuggcucuagguaccucuccuauauguagaaugaaguuggauauauuuuuuuaaagagguuuucauacggugguucacuuuuuucacacauguccggacauauuuaugucauucauguuugcuaaauaaccauguuuucuugauuugcuuaaccauguuuucuugauuugcuuuuuugaauuacuuuuuuuguucuauuuuauuuuuaauauacauucuuaagccuuauaccuuucaaagucuaaagguaaccaguuucuauuauuuuccuuucaaccagacagaaaccuaaguaauuuuauuuuucaaaaacaaacaaacaaaaaacuccccuaccaaaguuucucaaaggucaggcagauaaugggcuuauaugaagaugcaacuaacugcguuccucugagugggcaggggugggguacgaaggacccugcacuuacugguuucuuacuguguaccacaccuucucacgggugcucauuaaauuuaaugccuggccgggcgcgaugacucacaccuguaaucccagcacuuugggaggcugaggugaguggaucaccugaggucaggaguucgagaccagccuguccaacauggugaaaccccgucucuacuaaaaauacaaaaauuagccaggcgugguggcaggcgccuguaaucccggcuauucaggaggcuaaggcagaagaaucacuugaacccaggaggcggagguugcagugagccgagauugugccaucacacuccacccugggggauaagagugagacuucaucucaaaaaaaaaaaaaaaaaaaauuaaaauaaaauaaaauaaaauauuaaugcccaaagcaacccugcugguguaucauaacuguugucuuguuaucauaacuguuaucuugauggaaaaauaagggaugaugacuugcucaaguucccaagcaggugcuagacucaggacuugaaccuggaucuguuugaacgaggggaccacgcugauucuaugauaucuuuugguaaucacuuguucgaauuacuucaucucacauggggguguaguguucacugacccacugggcauaauucuuuguguggcauaaugaucuggacuuucugcccuuggaaucucaguucccauaucugaaaucccagaggugcaacuagaaaugcaaacucuacuugcaacguccuuuggagaggagcacuuucuccucccaauucugucucucccauagauauaauuguaagcacaauuuuaguggucuuucacuauauucaaaggagaacugguaagaaaguucuaaauuccaguaagcucugccacgauuucaauguaaugcaguaaacauuugcuauauaugaauaaacaaauaauaauaauaauaauaaaaaacccuucccugcuuuuccucaccaaaaugaauauauucauuacuacaauaaccccuuuauagguaauggaccccaaaaugucaacauucccuguaaauaagaauggcucaauacuacugccaugauccuuaucuuggcaguaugggauaauucuggugcacauacuuuguauaguaugagaguaccccaaaauaauucauucaguaauguuuucucacacuuacaguuuaaagaauuaaaauagcacaacuuucagauacaugggcuguggacaaccaguaaugcuaaaaauauuuccucucuucagagcuuuauaacucauggaauugcaacagccuuaaaaacaguugaaaacagccauacuuacuguacagacaucaugcuugucuccauugcugaauccacucuuccuucaucugcuguuuccacagcggaucuaucugauucaccugggaguucaggugcacaagcuccauaaaguucuggggcuguagcuacauauggugaaggaacaaaacugcuacuacgcaacuuacugacuucuucuucaagcuuuuucuuuuccucaagcaaacgagcucgaucuucagaaagugacucuaucaaaucugaaggacacccaaauuuaaaaaaguaucauguaauuaaaaaaaccacuuugcaugaauguaucuuuuccacuuuaaaaaauuaaaaaaaauaguacaaaacaguacaaaccuuuaucccguucuuguugcugcauuguacuuuucaacuuaucacuaagaucauuuauuauguuuucuuuucucauuuucucucuuguuaaaacaguguuaaaauuggucuggaacaagagaauaauuauuuaaauuuaucuacauguacuuagcagcuaggacuuagaaaauacacuugcaaauauucuuuucuguggcacauuuguacauggagaugaugggguaugauucaugaaauguuuuaaaaaugaaaauguaacauacuguggcaaagguucuacuuucuugguuccaauuuaagucucuugaaagcaaauccuauuuucuuauuauuguccauauauuuacugucagagauuuugaaauuuugaagaauuagaagcaucaauaacuuagagugcuguuagacacuuacuuuuuuccuggaguaaucauccugccucugaaaccuuccuuuugucuuuagcauuugaucaccacccuaacauuuuagauaugacucuaucuuccuuauuucucuuauuuggauaucugcaauggucacuggaaugcugauuuauauuggcuagacuuauuacucccccacuuuuauaaacucuacuaugaagcucacauauccaacugccugcauggaucucaugagacaaucuggcaauuuuaacugcacaguuucuuuaauaaagaugacugaaucuguauaaaaauuuugcuuaggccggacuugguggcucaugccuguaaucucagcacuuugggagacugaggugggaggacugcuugagcccaggaguuugagaccagccugagcaacacaagaucgagucucuacaaaaauuaucugggugugguggcacaugccuguagucccagccauucgggaggcuaaggagggaggacugcuugagcccaggaguuccagguuauagcaugccaugauugcaccacugaauuccagccugaaugacagaguaagacccugucucuaagaggcaaaaaaaaaaaaaaaaaaaaaaauuuacuuacaagauuuuugagcuucuugaaauguaaaagcaauagaugaaugaugaaaugaucuaaacugacucuucucaucugcccagcauuucuaauuccaaaauuuuaagagcucuacgguccuuggaucaaugaauaaugcuaacaaugcuggcaauagggagauuuaggaaaaguaauacagcauuuuuaauaaaauuuuaauaaauucauuaaauauuuaauuaaauacaauuucuggccacaaagcauacaggaagaucucucaaaaagaaacauuuaugauauggcuuuguauuaagccaucucuauguauuuuauuuauauauagaaaauaaacacaaaaacauauaaaccauuauguuuauuuucaugauuuuugccauuucuguaauuugaaaugaauuuuuaggaagaucacaauuuguaauuggcauaugaaaaaagggggcuaguuaagaaccaauuaguuccaacucagaaaucaccuauacagagcuagguacaaauaaccuuaaauaaauacaacuuaacauacacaucauggaaaauuggaagguaccuuagaagucauuucucccacucuuauuuuauaaauauuaaaagagacaucaaaacaugaagaaguaaauuagacagcugucaauacuauacuuuugguuucaguuaauucauucuuuacuuaauuuuagaaauuguacaugugcuuauaagagaacacacaaagagacaaugcaacacaaggagauaaagagaucaauaugcagaaugaaucauagagaagaaucuauaaauccagauucuuagagagagguuacuacugaccuccucauuguuaauucuuacuuaaaacuuggcuauuccuccucccugaacacuuaacuuuccuuggcuucccuuaagccacacacuuuuuuuucugguugugcuuuucucauucccuuuucccaggcucuucuuucuuucccuaggccuuaaaaaucuaaaauuguuagagguuucaacuauacuuuauuuucuuucuguucucugauuuacauuuuuucaaauuccacaaagacacuaauuaaucauaacauuuuaggaaaaggaaaaauaccacauaauauuacauguguacaauaaccauaaauaugcaguuucagaaauguaucccucaaaauguauaccccaaacugcaauauuaucccuggccugaauucuagcaguagcuaccaaauugcucuuccagcugacugcuuugcaguucuccaaucuuucuccauguuccagugggugaucuucauuaagcauaaaucuaauuaugccauuguaauuaguugcuguccgguacuuuagguaaaguacaagcucucuaacaaggcaucugguuuuuuaucuaaccccaauauacuucacaagcacuaccucuuacuauugaccaacaacaguaaguacauuaacaaaauucaauaauauuccaucuuaaucuaccaccagccuaucagaaggauaagaauuacagaaaggguaagauauuuauguugaucugaauguaauuuaggauaacaaaguuuagagaauuugaagcuuagagaaaaaauaaaaucauuuuuuaaauuaaaaacaucauuucauagaaaacuaaucuuaguucucaagagguuaaaugaucuacccaagaucacauagguagcgaagaaaccaggaacagaauuuacauucccucgcuucuaaucuaagacuaucucauuuugaagcaccugguauugucaugugacauguuaacaugaaaaauauuauucuccagaugaguaaaaaaacuaaaaaaaauucuuaaaaauacacgcuuuugucaagaggaaauuuauuaacaggaucaauguaaggaacaucacaucuaagauauaagaaacccucagcuacauaaagaaauuauauuuguuaauuuaugucuaccuucuuuaguucucaaaugaaaugggaaaagagauacagaccuguuguuccgcaaucaaagauguucgaacauuuugcauuucuucauucuuucuuuuuucuugcucuucaaguuguucuagaaacuuagcuuuuucuuccugaagcuuuucuugaaguucagcaacuaagcuugaagaaucuccucugguagagucaauggcaggacuuacaaauuaaauacagcauuaaauuaaaaaaaaaauuacagacacacaaauauaccaaauaucauauuugggaaauuuaucuuccuuaagcucaauaauguagcaugaaagauaucugugugaacccucucuuugaaucuaaaaaguaaagggaaauaaguaaaaguuuaauacagauuagaugcugacacuaacaagguuuacugauuuuuaucaguauagcagauaaauuccagauaauuugcuuauaucaacauacauaaaaaucaagaggcugcucugcccauggaguagccauucuuuuauucuuuggccgagcucuguggcucacaccuguaauccuagcacuuugggaggcccaggcgggaggaucacuugaguccaagaguuugagaucagccuggcaacaaagugagaccccgucucuuaaacaaacaaacaaacaaacaacaaaaaaaaacaacagccaagcacaguggugcaugcugagguaggagaacugcuugagcccagaaguucaaauccugccugggcaacauaaggaaaaaguauuuucugguaagggacuauacacauaagagauagguaaacucaacuucaaaugucaguuuugcuauuccuauacaugaaauuuacacaaugacuuaggaaaaaagaaacaccuaaagauugcauauguugaaaugcuuuaauuuccauaaaauagucuuugguucauuucugcuagcaaguagguaacacaaagcuaaaacugaaaagcgcuuacacgaacaaaucuacauauuccugaacucauacucauuuuccucaagacuuacuaaccucuuagggguugcugacaaagugcuagagaugagaauaggacaauguaagaagaaaugaacaaacacugguuaaugauuaguuuaacuucuaauuaauaacucauuaacuucuaauuauaacuucuaaguauuaaucuuaucuacuuucaacuuaauccuuagcauuaaaaaaagguuucuccaagaagcagaugaaaaaucccauuaguauuaaaacaugcuaagccucaaaaaguugcuguuacuaaaaaccacuuuaccaggucaauuuuuaggcuuaaaugucccucuuuguuuuuaaaugauauuuuaauguuuuugaaaucaggguguguucugcaauuaauaugggcauguauuuaaaauguucacucuacauguuucuuauguaauuuccucaucuaauuauaugacaagaauacacuauaucaauaaucauacaaaaaauuauuggaauccuuuuauucaugcuuccaaauuuccugauaaaaaucuaauaacuuaaacuugcugcucagauaaccuuuccuccaaagggauagcuuuauacagccaaaugcagaauaugcaguuugaaacauaauaucucuaucaaagucugagacuccuuacuuaguucccagaaaggcuggaauaggaauccccuauuucauaauauaguuaauuaaaggaaggaauauauauuccauaauauaauuaauuaaggcgaaggauuuacuuuuaaaguuucuccuuuggggcugaagaagagggggaugugcaaguuuaaacuacuccauggcuggaaaacugacauacuacauaaaucaaaggcuuacuaaggaacacaaagagacuuacaaagagacucagacuacuaauaaugaagugcuugggauaaaaauagguauaggcaggguuuacaaagaauccugcuuggccgauuucuuccuugaagaaaucuccacaguucuaagguaagcugaaacuuuuaggaauaaaaaauaaggccagguuuuaaggaggaaaucaagagagcacugagguuggagaugugaaggacagauagugaacaguaaagguuaugaauuuuauugcaaguaccauauaaagucauugaaagguuuggucuagagaaugauaucgugugaaucuaggcuuugaaaagacuauugugagaaaggauauuaguaagaaauguggcacaguaaagaagccugaaggagagcuuucaacaugauaaaggauccuagaauuguacuagaaaaagugugguucaaauugugcaagagaggaaggggaggccaugcacaggcaguacuuauaauuucuagguguccugcaucuuuggauugcuugggguacuccauuucagggucagugcugugcugagauaauacagggacaagaggacacaguuccagguacacaaacagauauagacaccccugacacucucuguaaacaccauauccccaaaaccagaauaagaacacuagaugauuagcauaggguaucucauuuacugacucaaaguaaaagcaaagauugcacagguuaugacaugaaaaauaaucauuauccuguacugaagacagguuucuuguggcuguauuaauccggccaaaaguacauacuaugccauauuguuugaagcucccauuagaaaauguuccaagugacuauccgccacacaacuuuaauuuuacauuacccuaggaucugaaauggcccugcuaucaggggaauuaacccuagcaaugaaaggcuaacagcuaaaauagguuuuguguuuuaacuagcaucacugccuagcuuucuauggggagcaagaagcuguguagaggggagggaggucaugaagaaaagguuacagcguaucacaguucaguuagaaaaauacaguagucccccuuuacccacagggaauauguuccgagacccccaguggaugccugaaacuguagauaguaacaaacccuguauuuuuuccaauauaugcacugugguccuaacuuuugcaguuugaggugugauggcaaaaagagaaugaaugggcuccuccugcacaguuucacagauagguugggucuuacuguagaucuuugcaaucucagcauuugauuuuuuuucuuacuaaaucaagaacuuucaucuuuucacuuaaacgaagcacuucaaggcuucuuuuuggcauauccaaauugucgacaucauuacucuugugcuuuggagccauuaaauaaagguuacuugaacacaaggacugcaauacugauaacccagauggcuaacaagugacuaauguguggagagugcccacaguguggauacacuggacaaaucaugcuacucaaaacaguguccaauuuaaaacucaggaauuguuuauuucauuuaauacuuucgaaccaugggguaagugaaaccauaagagcgaaaucacauaaaacgaaacuagacaagagggaaugacuguauuuaaucuaacaacacuaccacagaaaccuaagaaauucaucaauaaagguuguccaacuaaaagaaacuugcauaauccugucuuugcauaccugaauacuuuaaagaggccuggacauugaaacucaaggaagcagauacauuuguuaccagcugggaacuuuaguaucacggaaacuugaaaaaaggcaucucuaaaggcugacaguuuuucccaccauuaaaaugucaguucuagcaaaggacuguauuauauccaaauauuucuagcaacuagaaaauuuacauugaacauaaacuagauugucuugaugcuugaacucuuaacacugacugaauuaaaauggggccuaguaaacaauuaguucacuguuuuuucaaaaaaaucucuucuaucacuugaacccuggaggcagagguggcaguaagccgagaucaugccacugcacuccagccugggcaacagagugagacuccgucucaaaaaaauaauaaaauaaaaaucucuuuugaaauuagaauuacaaaauuaaaaugcucccacccauacucacucagauccacaucacuacuuccugggagcaaggccaucaaucauguaguagguagauuucccaacccacgcaaaccacauacacacguuccacucuuauuucuuuguacaaagguacaggagaaagcuuucuccuauauuuucaaaacuaaacauuucaaaacuaauauaaacuuuaauaauuccaaauuaaauagaagauauucugaucuugcauuuccuuaaucacaaguggaccgaacaguaucuacauguuggccauuuguauuucuucuuugaucucuucauauccucuguccauuuuucuaacagauuaugugccuuuuucuuauugacuuacugugggagcuacagacauagcuaauauacauaucuuagaaauguuucuccuuggcagcuggccccucaguguugcuucuggcauauguagaaccaaguggugaaagggaaauaugccggacuguguguccucacauaagcaucuuucuucuucaaagguuuccucugcaugacagagaagccagggauauuauccagaauucccuccucgguagguucuauguuugagauugccaaugcaagauacccacaccugaccugggaugcugaagagagagacucuggaggugguuguagccaaacaugugggcaaugugagauucguaagagacuuccaaguaaaccaccuguuugggggucuugguagacaacugacgaaagucuucaaagaacuguaucaguuuccuaagccaccaacuuuggugcuucagaugacuuucuauuauagaucucuuggccuucaccagauuacuauccagucuccuaguucucccaacauucauguaaacucuaaaucuaguauuaaucccuuuaauccugaaauauuuaaaagugguuguuuuauaagcucaauccugauacaaaaaaaugacucuagaggaaaaaaaaaucccauaaaacauggaaacugagauuaauucucugaucugaaagcaguaaugaccucagugccagugcaaaauagaacacuggaaaaccagggcaguacauggcauaacaguacacacuuguaguuguuugaaaaaccagugacuaaggaaggcaaggcuuugagacaugucccagcugugccuccaaaucccaccaaaccuuccuuccuggaagcaacagccuuuuucuaccuugucugaggaaaucagugucccuucacuugagguaguccucuucucaaugagaugauccuuuucaacaaccucucccaccauuuaauuacuuccauacucauugcuacacucaaauugccagaucucuggagaguuaaaaaucuaacaaagaaggaauugcaaagcaauuacagaaucuuuaauauauuuuggcagaaaaauggaaaauacauaugggaauagaucuaaugacaguuacaagaggagggacaauguggagugaggccaaaauuauuuauacggguguaaugaccacagauuccagacucaauauuggcuauuaacacuuugccaaguugacugccuggaaaguagacuuaagaauaaccaacauuaaaugaaaaugagauggcaaaaugagauacucuagaucaagggcagguaaauccaauccgcuuuuuugcggaacacagccaaaaccauucauuuauauagucucacugcugucuugcuaaaaugguacaguuggguaguuuggauagaggccauuuggcccacaaaacuuaaacuacuuacuaucugggccuuuauaaaaguuugccaaccauuucuuuaggcuaaugauucccaaagagugauccauagaagccugggguuaaccaaacacauucagaggacaagugaagucagaacuguuuucauaguaacaccaaguguugccuuuuucaccuuguugauauuggcacugaugaucaaacugcugguaccugaacacaaauuaaagccauuagcaccaaacuuuacuuguagucguuuucuuucaccacaaagcacucaaaguggggaggaaaaaggggaggcuguuuuuucuuagaauauucuugaauaguaaaaacuacuagcucuaaaauauguuaacauuuggaagaucugcauuaacuccgugaacucguguuuuccaaaugaccaacucaugacgcuauaaaaucaugcaugaguaaaaaaguacaagagauguaccaauaaauguuaagauuaugagaaaauccacuaauagcugcauauuccacaauaaaaacuaauguucagaaauuaccacuugcugaauuuugauuuaguaacaaagaagaauaucgacaaucaucugaaaaggcuauuuaaauauuccuuuccuuuuccaauugcauucagcauaagguuggauuuuuuuucauauacuucaaucaaaacuuaagagauuugcaaauacauagaacaaugguacucuucuaacuaguuuucauuucagaaaguuuuuauuaaaaaaucuuauguauggccaagcaugguggcucacgccuguaaucccagcacuugggaggccgaggugggcagaucacaaggucaggagaucgagaccauccuggcuaacauggcgaaaccccaucucuacuaaaaauacaacaaauuagcugggcguggugucacgcaccuguagucccagcuacucgggaggcugaggcaggagaaucacuugaaccugggagguugcagugagccgugauugcgccacugcacuccagccugggcaucagagcaagacucugucucaaaaaaaaaaaaaaaaaaaagucuuauguaugccaccauguaaugagguuauuugaaaaugacuaaguuucaauuucuugccauuaauuuuuaguacagaaauacugacauaaucccuaugaacaaaaucagucuggagucaauuuuugagagcguaaaaagauacugugacagaaguuagagagccacuguucuuguuuuucacauauuuaaaagaugguaaacacgcaugcacacagauuauaugaauaagucugugugugaccugcaaaugcuaaaauuuuuacuaucuggaccuuuaaaaaacaaguuugcuggccaggcgugguggcucaugccuauaaucccagcacuuugggaggcugaggcagguggaucaccugaggucaggaguucgagaccagccugaccaacauggagaaacccugucucuacuaaaaauacaaaauuagccaggcguggugguacaugccuauaaucccagcuacucaggaggcugaggcaggagaauugcuugaacuugggaggcagagguuguggugaagagagaucacgccacugcacuccagccuggguaacaagagcgaaacuccgucucaaaaaacaaacaaacaaaaaacaaacaaaaaaacaaguuugcugacuccugaucuacaaggaaggcauccaaaggcagguauacuggaagggauuuauuacuuauacccucagaggucccagagaauauguucuuuaccaaggcuuugcaaaauacaagcuuaaaaggcucuguaguggugcucugcaggaaacagcagagggagaugagaacacugaaauucaaugaauuuaaugggaaugacaggcuucuggaguggcagaggccaguuaguggcacuucaccaccagaaacauaauguggcucuaucacaagcaacagagccagagcaguaauuagaagguuuugacccagagaaaucugugguagugguuguccguaggcccuaauagaaugaaccgguuaaagaccuacuaaaacuguaaaaacaagacaaaacagaaaacucuagaucuaguauucagaggcuuaacuuaccaagagaauucuaaccuucacccaaacacuggcucugagaagacugaagugacugugguccacuaggaggaggagauuauuggugcucaugugacagaguuugggcccaaugguucccucaucgagacaggaacaagcugaauaacccuuaucggaaaugcuuggcagcagaaguggucugaauuucaguuucuggaauauuugcauuauauuuaccagcugaauaucucaaauguugaaaauccaaaauccaaaaugauccaaugagcauuuccuuuaagcaucaugucagggcucaaaaaguuucagauuuuggagcauguuggauuugggauacucacccuguacauccuuagauccagaaucguuacuggaauagacagaagaaacuggcagaauccccauguugcuucccuuacucguggaacaaggacuauuaugguagaaaaggccaaguaaaauuccuaaaacucucacuucacgacacaggggagggagguuucuaccauguucuuauucaacauuaaguauguguccuguccagaagacauggagacaaacaauggauuuuaaugaauuucuucagguggugucuucaauccaacugcuguuuccuauuuuaagugucuuuauuuggaagcucaauaugggcaaaagacauuuaucugucuaaaugcugaguuuuaaaugggguauaaagugcuggacugucuaguauuccauaggcuuugcccuugcuccucuuuuaugaucucauaugcacugcaauacagagauccaacauuucccaaaaucccagguauagcuuccaguuugccaaugaaaagaagaugugcaagguuuuggaaggcagaaaagcagcacagguuuauucuccagagguggcuguagccagaugcaguuucacaguagcuuccuggcaaguaacugagaacuauccauuuugugaugcagauugagucagacuggugcuuugaagagauucuugaaucuuguagcagcuucccagugagccauggagaaccaucagcuuucaugggugcuucagccucuguuuuccucuuauuucacuuugagcuugaaaagggcucuccugaacuaaacuucaaucaggcuccucuaggcuucgaccuugacaucuauucuucuugggccuacgcuguccagcuguaucaagugucuugcuaacucaguuuagagaguaucucuccaucaauaucugaacaaauuaucguccccacccuugguauuuuauugcccuggccugccuucaguaagaauccuguuagaucaauuuaaccaaaauuccccuuauuccuuauguuuccucuuaguaauuuuccauccacugaccccuacccuccuuagcuauaaaucucaacuuguucaugcuguauucagaauugagccuaguucuauaaugaggucuauuuuccauacugcaauagugucugaauauaaucuguuuuuacugcuuuaaguacuguccaucucugauucucuuugacaagcucuccuggccuuuggcagugacucuguuaaccuucucucauccagcuuuuaaacauacaugcaaacccuaauuccucuauuaaacccucuaaugcccccucccccagaauaccuaaagagcuucuaauuuuaagccaaaaggggagguuuaacaguauaccaauauaugaguauuauagagcagacaaucacaagagauuguauaaaagugauaaggcaagacacagguugaaauauauauguauucacuuggagaauucaugauagaaugaauugacauauuaauuauguucuagaaacuguuuacugggucacaaaacccaauuaaacccagauuaaaaguaaaaauacuaaaaaccaucuucugugaucaaaaggcaguaauaucagacaguaacaauaauaaacauguaaaaacaccaccaauccacaaccacaguaucaaaccugcaguuuaaaaacaucuuucaagcacagaggaaauaacugaaacuguauuaagaaaauaacaauaaggaacacucuacauguuccuaugauuuagccuuuaguaaacaauauacagaacaaaauuuuagucuuuaauauauauacuaaauuuaaagagaauauaaguaauuuucuacugaagaguuuagaaaaaaacugcaaauaaaucaagagagaaacuuaugaauuaaaaaaggaaaaacaaagagcucuuuaaaacauuucaaacuuucaacaaaaaauuucucugaaaauccaaacugcugauucauuuuuuaaaagccacucauggauuuagucuguuauuucuguuugcaagaaacacugacuaaaaaguaaguuuuuacuucaugaaaauacccuaguugcuacauuuacccaagguaaaugaguaaaucaagguacugugauuacacacaaacgaaucacugauauuuuaauuuuauaauuacagacuaaacuuaauucuuaccuuuuugcuauuugauucucaagauguuuaacuuuuucuaauaacucuuucucaacaacuucucucuccaauuuaaauucuuuuagggcagucugaauagcuucaucuuuuucacaauuaagcuucugaauuaacuguucucugucuugcuccuggcugcugaccaauuuuugucugucuuucucaagguucuggauaauagcuucguauuucucuucuuguuggguaauuuuuucaucuuuuugucuuucaagagcacucaauucugaauccaauuuacucugcaguucaauuauuuguucuuuuagguuuuuuucuauuucaaaugcuugguuaugcaaagauguuacuuuguuuaauucagcuuuaaguauauuagauucuucuucaugucuacuaauuaacucggaaauacacugaucuuuuucaauugucauuaaaguucuuagcucugcuaagcccaccugauaauuuucauuauuauccugaaucuuuugguugaguuuacuaauuucuguucucaaauuuucugucucuuguucaagaagagauuucaaggucuccuucugcugggcucugcuuucuuccagcaaaauuuuuauuucaucaguuucugcuuccuucaacgcaaguucaaccucuaacuugcaucucgugucugacaaaucagaaaccuugaguuuuaauuccuguaacuguuuuucuuuuuccuggauaauuucagcaugagauucuuguauuugauuaauuauuuguugguuuuccuuuuuuaauuccuccaaagaaacucuguggucugucauaaccuucucaaacucuuguaugugccuaaccugaaguguguccucuaauuccuuuagaugacuuugcuccaaggacugaaguucugcccucaauaacuguaacuucucaucauuuucaacauggagcuuuuuuaagucuucuaacacuauuucucgugacugcuucaguucuuuaauuucacaauuuugagagugcauuauauuuuccaucucuaacaacuucugauccuuuucauucugcaggcagauuacagcuucuuuuucauguuuaaccaaagcaaauucauuaucuuuauuuuguaaaaccuccucaaggcauacuaacucucccuucaauuuuuuaauuuuguuuucauucucuucaguuuccuuuauuaguccgucaaguuuaccuucauauucauuuuuuaaagacaguaguucuuuuugauguuuuucuuuuaguguuauuuccagagaacauuuuacuuuuucaauaauguuucuuauuucuacugcuguacauuuuaaugaauuugagaagucacacuguucuuuuuguacaaauguucuaaaguggcaaaggucuuccuuaaugguuuguauacugaagugagagucuugggcaacaacucuacaucuuuccaacuggacauucagagaaguaugaucuccaaaauccuccuuaccacauacauuuguauccugcauucgucuacugucuaucgcauugauaacugaugaauaaagugauuccaccaucauuucugggcuuuguggaucacuuauaggauuaggagacgacaaauuuucuucuauuacaaacucauucacagcagacauaaaaucugauucaggacuuucugcuaaugaauccaagucuaaagaaacuuggugaauagucuguucuauguuuggauggggaauaguuucaaaaucaaacguaugugcaucaauacuaucuggagauaauucuucuaagggacaaacugcaggacauaagggauccugaacagucagugguggaggaguucucggugagguaguaguuguaauuccugcuguacuuuccauccuuggugaagaagcagacuguggggaugucugacucacagaugccuggaaaacagaaagaaaggcuuaaagagcugcaggaacacaaacauuuuacacuaaugacgaaaacuguuugaaagaauugaauuugccuuuuguucacucaguagaucuguaauggucugugacauuucauccaaacuuugugcugcuuuuaccaaauuauguagagcaaguacaugcugguguagagguucaaagucacaaaguaagggaacccugaaacagaaugcaaugcaauuagacuucugauuuuuuaaugaacuaguagauaacugcuaccaaauauuuuaauaugucaaaaauaacaagagccuuaucauuccuuuuuaaauuaauaccagaaguauuuuaagaaguuugugucauaaucaguaaaguaaaaacuuagggccgggcgugguggaucacaccuauaauccaagcacuuugggaggccuaggcggguggaucaugaggucaggaguucgagaccagccuggccaacauggugaaaccacaucucuacuaaaaauacaaaaauuagcagggcaugguggugggcuccuguaaucccagcuacucaggaggcugaggcaggagaacugcuggaacaugggaggugaagguugcagugagccaguaucacaccauugcacuccagccugggcgagagagcgagacuccgucucaagaaaaaaaaaaaaaaaaaaaaaaguaaaaagucagaaauuucccaacagcaugcaaaaaguaacuacuagaaaaaaauaauuacauguaaggcaugucuuccuuuacuuuaccuucauuuuccaucauuuuuuauuccccagaaauuucucaaagcagucacaggaaagccagucuaucuuaaauauuucuuaucuuggcaccucuuaagauuacugguacuaccuggcacaacuccagaauaauaaaaacauuuuaagguuauaaauuaacugaaaauacuaaugacauuuaccugaggaauggcugaacuuccgaaggacaaaaugauugcagaaacuguaaaucuuuuaaugaaauaucuggaaguucacagucaaacuuucgaggcuuuugagucuguaccaaaaaaauuaauuacuuaaaaaauuuuuuuucaaccaaaaacagacagcaaauuuauaugauuucuuacuauaauuaaauuuacuauaccaaacaaacuaaagugcuuuaaaugauuaagaaacaaaaaaagaccauucaauaaagauauggcauauuauuuuccugagccuuuaguaaacugcgacgugaacugcuagugaucaagggaugcacuuguuccuccccuucucugcuuuuagcaucauuuuaugggaauuacaauauuccuauccuguauguguauguauguacauauacauaugguaaacacauauguaagugugugcguauauauauaauauuuaccauguuaaagccacuaauauauuaaaaugcacacauguauuuuuuuuccauguaacacuuucuuauuugcuuuugccuugacuuuuccauuacauuuuccagaagacaaaguuuuggucaauuuuagcuucuguaaaaaauauuaaccgguaaauccuaccaauucauuauuuauaaaauugccaagaguugcauuaaaaaaaaacuuguuuuaaaucauuacucaagcagauguggagaugccaagaugcucuucauaaaaaagaguucucggauaaauaaguaugggaaucgcuaugucaccaauucuuauguauuaaaaaaugcauacauuuaaaacacuaagaaauccugcaguauagaaacauguuuaacagcuaagcauggcugggcgugguggcucacgccuguaaccugaacaauuugggaggccaaggugggcagaacacuuggggccaggaguuugagaccagcuggccaacacggugaaaccccgucucuacuaaaauacaaaaacuuagcuggaugugguggcaggcaccucuagucccagcuacuugggaggcugaggcacaagaacagcuugaacccaggaggcugagguugcagugagaugagauugugccacugcacuccagccuggacaacagagcaagacucuugucuccaaaacaacaacaacacagcuaagaguacaucugauggggguaaaagcccccauauugcuuugaucauggaaacguuucuucucauguaauacaauuaaugaccccagauaacaaugguuuagaaacauaucaaacuaacguuuaauuccagugaagucuaacugaggcuuuauuauucugauuugucaaaauauaaagggggguggugugaaaagaaauauagaagggcaaggaggagguggaggcuguaaaggaggagggagggagaagagcaguggaagaaagaagagggaaggguggaaagaaaaaaaggaagagacaagaaaacaaaaaaaccaagugaaucuauuucuaccaauccuaacagugcaguauaagguaucuuccuguguuaugaagauucuuuauaaaaaauuaugaauacaaauaucaaucuuaaagcuuuaugcuaacuggcuuuuaaagccaaaaacacuuuuauuuugauuuuuuuuaaaccacaacaauuucugcaaguuucugauaaaugucucuacuucuggaaaaaagguuuuaaaacauauggaauuuagucaugguuagaaaauaaauacauacacaaaaggaagggggccaggaguccaguccccuaaacagacgauuucuuaaaaaagacuucccuguauaaagaaauuaacaauaugguuauuuuagagcuuuauuuaaggcaaaaaauuaucucugguuuuugaaaagguaaauuaaaaguugacaguacuucaaguuuaaaauuuaacaauggauucaauucuauacacuuuaaaaggaauauuuccuagauaucaauggcaauuaacagcauauacaugaaguaugcuacagaaaauccaagcuuauaaaaacuuuuauccuuuacaaaaguaauuaaaauuauuaaugaacacuuacuaaauaauuucccaaaggauucccuuuuugauuuuucugcuucauauaaucucuuuccaucuuugacuaaagcaccagcccacuagaagaggaaagcuuauguuaaacauaaacauacaccaauucguuaaaguucauauacaguuaaaauagaauucaacuugcauaccucccuguaguguuuuaugaacauuuuucuucuuacaaccucaacaacagcuaagcaguacaucugaggaacuguacuaagagcuucaacaauuuugacucuuucuaacagcucuauuacgaggcggagcaaagcuuguaacuucucuccaucuugaucagcaugaagcauuacaaagcaacaccaccuagagaauaaaauccauuauuuucaacauucacaaaacugguacuaacuuaguuacuuacuuaguaagcuuacuaacuuaguuaagccaaagaaaucaagauauauaagcucuacaaaaauagucuaauuccaaaguucaucaauaagguauuucaauaaaaugguagggaaaaaucacuccaucauuugggagaaauaaauauaaauaccaauucuaaacaucuuaaaacagauauaaaugaaucacuuacuucagucugacauguagguuauuugcuaguucuuguuuggcagugguacacuucugcuuaauaucuaacaguuuucuaugauuuugcaacauaaucaucaacugauuugcgugacucaggcauaaaucagguaauacagaugcauccuuuaaguuuucagcucucuucugauuagcuaaaaaucccuuugagaaaaaaaauguuucaaaggacauuaauuuuguuucaugaaagguauggacauucaguuaaguggaaaaucuuuauguuaaacacaacccguuuugugccuucuaacaauauuuuuaaauccucuauuuuucucgaauguaguagaugcauaaauggcacaagaccuagaauuuuuaagaauccuaugcucaucuuuaauuuuucaaacuagaagaaaauaaaggcuagaaagauaaagccccuuagccaaggacauacuuaauagucaaugagaauuagaagcuaugugucuagaauccuauaacacuaucggucagucacagcacaaacaaaacaaggucacugaaaaacaauaagggauuuaaucuagcaaacauuauacaguaguauauuagacacuuucccaaauauaaaaauaauaaaaugcccuuaaaauauuuaucgaaaagucacugcccucuccaguuaucucuggacuauauuuuguuccacugaucugugcucccauugcuaggacaaugacugaauugugugauuuuacacagaguuuauacuuuauuauuugguagaaaaacauuuuuucuguuuuucuuaacuguccuuacucauuuguuuuuguaggugaacgguguaucugucaaguagggauuaaguuacuaauuaauuuagauagaucugccauaaucuuccuucauuuaucucucaaguauauuuaguuuucuuuauaugugguccaaagauaacuuaauaagguuauuacuacauacuuuauugcuaccacaaaguuuuuuccuaugcuauauaccaaguggcuuauauguaauaauguuguagguuuuguacauccaucugauugcuguauugauacuguaaauaaaucauuauccuucuaggaacuuaacuuuaugaccagcuaaaggacaagugugucuuccaauuuucugguaguucucuguuucauguuuuccuaaauaucaugacauuuagauuugaaugauauauacugaagucaaacugguucaauaucugaaaggaagacaauuuucauaguaacuguaugccuuuuuuuucccuuucaauauacucuuugguuaacugcaacuauaauuuuucuauaauguaaucuauuaaaaaacaauuugcuacuuuuaacuccuuucgcaaagucugguuuucaauuacuuuuuauugaauccaugaaaaauauagaaucaaucccaaauuuaaauucuagaccauuaguaaaggauuuccugacaccaaaagcauguaaguacuguauugcuaaaagaaggaaaaaauaaaguuuuucaauaaauugaauuucauauuugcucaaccauacucaauauaauucagacuaaauagaaaaaauccucauaaaucaucuaguacuaauucauuacuaauauuuuuacacgcaaauaagguuugacagcuacaugagcuacaugauagcacuguaguacucacaaucguguuccagaugcauucagccaaauuugguucaggaagaaaacucccugauauuuccuaauuuugcugauaacccucaaggauacgaauggcuagagaaugaauauucagggcuccaguguuacacagcuucauagguuuggugagugagguuuuuuuuuuugccaaaaccauguagaagggucuacaacaauccucauaaauguugugguuuuaagaaauuaccccuucaaaggcauuugaaauggucucuaucuuaugagauguucaggcaauaaauaauaaaucccuuuccacaauuucuuuucccuuuuaauugggagugguuuuaaguuuuaauugcuauguagcuagaauguauuauacuacguuguaaauguguuuagcaagauguaaaaucaacuccuaaaauuggauaaucugaauuuaucuacuuuucaccaaacacauucuaaaggaaguacugacaaacuaucugcaacagggaaauaccauuagcagcaacaaaaguaacugaugagacaucuguaaauaaaaauuccagaccagccaaagacuagauagaauugugacauuucucaaauucaaaaaaacacaaauccaaauucucauuuuauuaaguauugauguguuccuacuauguauguaucaggaaugugugguaagaccuuguagauaaagcaauggaagauagaguaguguccugccuccuuggagcuuauauucugggaagagacuguauuaaacagcauguaauuaauaauuacaacugugguacaggauaaguacagcauacuaagagaaaaugaaccugaugaugugaccaagacuucaagaucaggaaaguuuggcugaggaagugaugcuucugcuaaaaccuugacucuguacaucccuuggcggcagccaaauacaugacaauauaggugugaaaaguugucucacucaccauauaccuccuagcuucaacuggguaucccuuuucucuaaugagcucacugaaaauaaucuuauuaaacugaauccuaucacauucagauucauucaggcacacucaauugaaaacugucuaccuuggggucuauauuucugucuuaaauuuugcucccaauauacaaccagacaauguagaugacuucuuaugaauacuuaggaguaccaaaaaauauccauuggagaacuuaaauaauuaaauauuuaauugucucgaaauguuuaaaaggacuauaccacucagguaucgaagaaagaaaagauauuuucuaaaaguaacaauauuaccuauaguauucuuuugguauauuccaugagcuaccauaguuuaaaacaauagcaaaauacuacaaauaaauuagggggaaugaagauguugaaagaggaugcucuaugagcacaagacaacaaaaacuaauuuuguaauauccauaggaacagcauaagaaauuuucacugaauuuuacuucaguuuggauucagggagguuaaauggucagauuuagaaagcaaacaagaaaagcucaaaucgcaaauaaugcauucuuccauuuugagaaaacaguauuaucaccccaaccauacucccagaaaaagacuuuuccuuguaugacaaaacuccauuugcugaaaccaaguagacuugagggcaauaucagcaauaaauaucuuuuuauauuacuaacaaauauaaaaccauccaauguaccugccugauugacuguucaagugauauaaagcaggaggacuaauagcaauauuuuaauauacugagagauuaaggggagcaaagaaaaaguagagagagaaaaaucgagugucuaagguaagauaauugaaagcccuaguuuauucaaucugagaaacaguuauaaagaaaucuagacgauuuuauagaaugauggguucauaaaauuuaauaugaauaaauauacgaaugaauuugacugcaucaaaauuuaaagcuucuguuuuucgauccagauaaauuaucaacagagacaauaucuguaugaucuauaauagacaaagaacuaucuagacaauauaugauaaauucuaacaaaaacaugaaaaagaaaauguggcgaaugacaauucagaguaaauacauggcaaacgcugaaaacagagaaauuacucuucuuacuuacuggaaguguugacugauuuugcuucuauggcaggcauuagaacauuauuaauuaauauuuaaaaugaacaaagaccuuaauccaacaaucccauuauugaagauugugccuaaagaaauacuagaacaugcauguaaaaauggguguauugagauacucaaugaauauuucuaauauggaaaaacugaaacaaacuaaauaaucaccaaaagaaguaugguuaaauaaauuuuguuugauucauucuauggaaguuaaaaaacaacuacacugcagaagaagcaaaagaucaggaaugcagaguucugucucuaguaaugguagccuguaaugucaacaagcucccuguggcucuaggaaagcagugaagaagccaggcacagugaaagggcuaggauccaggagaagaacgaaaccaagagagagaaauuaggugacuaggaaugccauuugcucugaagaauucugcugauucuugaagaggaguccaaaauuaaaaauaaguagucagcaguccugacuucccugaagagcuagaaaauuaaaaguugaagaccagagccagccaagggaagguacaauggaacaguuuauuugcguucagauccuuaaaaccuauauccuaugauuagggguaaacuaaaaguagaauggccaucccaagaacuagaauaccaauguccaaucauccaaaucucugaaacugaacuaaaguaauuuacgaugguaacugcccaaagcacauaccaaaagcaaacauaaauuaucugcagaagaaaacguuauccuaggccucacaauauuucuuugauuuuucuuauuaaaaaaaaaaucagguacaugaaaaggcaagaccauaagagugagaauuauaagaaacaccaccaaauauacggcugggcgccguggcucacaccuguaaucccagcacuuuuggaggccgaggcaggccugagguuaggaauuugagaccagccugaccaacauggaaaaacccugucuccacuaaaaauacaaaauuaaccaggcgugguggugcaugccuguaaucccagcuacuucggagacugaggcaaaagaaucgcuugcacccaggaggcagacguugcagugagacgagauagcgccacugcacucuagucugggcuacaagagcgaaacuuccucucaaaaaaaaaaaaaagaaagaaagaaagaaacaccaccaaauauaaacagacacacaggaacaggcaauacagugaacagauacagacuuuuaaacugcuaugugcuuaaugugaucaaagagaugaugaauggcuaagacuaaauauuuggguagagaauaugaaacuauauacaaaagaaccaaacugaaacuguagagcugaaaaaugaacaaaauuaagaaaugagcaagugguuagcuacaguuagccacuaaaaaaagagaaaaaguuaaaauguagguuaaaggaaaauaucuagaaugaagcacagauagauaaaaagaaagaaaauacaggaaacaaguguaaaugaaacggauauggugaaaggucuaacacgucuaacuggaaucacugaaagagaaggaaaagcaagugagggaaaagcaagaucugaagagaaacugacucagauuuuucccaaaugguauaagucauuaaaccacagauucaagaugcacuacaagcccaaaguaggauaaauacaaagaaugccacaucuuggcaccucauacuaaaauugcuaaaaaccaaacagaaggaaaagaccaaaaguaaaaugcuaacaacccagaauuuuaaaugaaccagguaaaaauauccuccagaaaucaaggugauuuaagagauuuucaaacaacaaaauugaacuuaucacuaaaaggaaauacuaaaggacauucuaauuuauaucagccuuaacuauaacaucaacgaaguauguuuugccuuaaaaaaaaggaaaaguuaauaugggggauguaauuauuuauauguuccaaugaaagaacacaauuagaggaaaaauauuggcaaggaaaauuaaacuagaaaaacagcugucagaaucugauuaugacauucaacuauucagcuaugggugguuuugccacaaugcuagccauggugggugaaggacaggcaaucaugaauuuaagagaggcacugguuugcuuagaaacguccacauuuaccacucuuacuuagccauuccaucaccuuccuuugguuuaaaauccacuuuuucaacaguucuaggauuauggcauuaaaucagaucuaaaaccuagguauuacuauuagaaguauuaguaaauucuucaagauuucguauucuccuauucuuaaaaaauuucauuucuuauccuucguccuaugggggguaguaggaagcauugaaauuuuuagcacaauaacugauaugaucaucugcuuucaacauaucaaaaaauguugauuucugcccccagcuucaaguagcaguuucaugguuuaucuauaggaaacucaaucauuaagaacaugcuuuucuguuuuauuacaaggaaacaauauuaauacauuaaaaauauucaaggaaaaagugaaaauauggugcacaccaaauugauacugcauauaaaacauguguacaaaaaaacuauaaauuccuuuuccugagaaaagucuaaaauagguaccugagcaagcucuuucuguucauucaccagucggccacagcuagcaaucaucugguccagggcguagagccgaucuucaaguccuuuaauggcuuucauauucugauuaucaaguuuggcaauaguuugacggcauucugcuauaaauggucgaauaauccuuggaucaagcuaaaugacaaggaaacacauacgaauacaauuuucagcaaauaguuuaaaauguauuucaugcuauucugacauacagcuugagagaaaauaagugauaaaagauauaaaaaagcaaaagcaugggaacucuaaguuauacuuucauaagaaggucaaguacaggauaaauauccuugacaacacugaauuuacacuagaauacauaauuaggaauacauuuucaagaaucacacauuucaaucagugcuacaauuuaaucacuugucaauaucucucagaaaaagguauuuucaaugucagcauaauaucauuaauucucuuaucaaugcaacuucucuuuaaaacauauaaacuucuucggcaaauuuaucucccuccuggagauagaagauaaaacuuccuuauucucuauuucuaucuccucaacgaaucggcuugcucaauuaugcuuucucacucuuccaucucuccuguucccuggcucuaauucuacacauuugcugaaauucauggaaccuauaaaauuuuccgauaaugcuccuggucccuuaaaaaaauauuuuaccuggcagccuuucugucugcguuuuccauaaaaacugcucagccaaaaacuaccaaugaccuugcuucacuugaggcucuucaacaguuagcauggcagauaaccuuuucccaaccuuaaaggcucugggaaguuacuucuacugguuccuucacagcauccuuuucuggcuccuuuugcucugucuaaucuuucuaaaacagaugauucagaaggauuuuguccuuagcccauuuuuacuguucucaauaugauuucagcauuaaguauaacuuuucuggagauaacucccaagucuacuucaaucacugaucagucucacagauucucaaacuguguuucugacuguuuacuaacaucuacauuuggguagcaaccaugaaaccuucuauuauugacuuacuaugcuuguuccuaauaaaacccucaaaugacuuucuucugcccacagauaauauccaauaaauguagaauauaauaaaggcuucauugaucugauaucagaaaaaaaucuuucaagccucucaucuuuucaagcugaaaugucuaucauuucaagauaaaccguguuuuucuaucucugaucuuuguucacaauucuucuauuaacuguuuaagucaaccucucccucuaaagauccuagucaaauaccuccuucaugcugccuucucuacagucggaaaaaacugauuaaugcauagagucuuguacacagagaacauacaaaagcaauuaaacuaaacuauuuuauuguuauuaucaagaauccaguguaguuaagagggugcaugucuaacacuaccgaaaaaauuaacaaaaccauuauuucagaauaggcaccacuaguuuugcacaauguugucucaacugcuacuuguacauuugugaacauuuucucacuuuucucaauuuugugguaacugaguccaauguguauguauuucuacaccagaguacuaugcacaucaaagccugguuacaaauuauuagcaugauaaagaugaaaacugguucaaauguucaaccuaggcaaaauuacaauuauacauaaacuuaacauaccaacaacuuaaaccaaaaacaagggcuccugaauacaacguaucugaauuuaauaauucauugaaaguauaacugcacugacaaacauaggagaguauuuuaugauucacuaaauaguuuacacaacuuccuaaaaaaaauuuauuuuugagccacguucuggcucuguugcccaagauagagugcacuggcaugaucacagcucacuacaggcucaagcgauccuacggccucagcaucccuaacugcugggacuacaggcaugugccaccacaaucagcuaauuuuuuguagacauggguaucgcccuguuaccuaggcuggucucaaacuccugggcucaggcaauggacucccaccuuggccucccaaagugcuaggauuauaggcaugagucaccgugcccagcugacuuccuaaaaucucacugcacuuaauauuuuauuccauuuguucacagauaauaaaaaucuuugaagaaauguuuuaaauuacauauauguaaaccacagaaucucauuaguaauuauuuagccaauuuucaauaauuaacagucagugauacauuaauuuuuacucuugggcucuuuggcaucuacaaaggcuaacauuauuuuuaacugagaaagaaacuauaaaacaaaguuucuuacacucucuauucuuaagccucugaccuuuaaacccacuccccugcauagauuccuuaagaucacaaguugucugaaagaaaugcuaaagcucaauaaauuaugcugcauuaaccuggacaguuuagaaaugugcuaaaugcagacacuuccaauuauuaaucguuagaaacacaaaucagugugccuuuuguaguauaaacugaaacagaacacucaagagucaucuuaaggccgggugcaguggcucacaccuguaaucccagcacuuugggaggcagagccaggcaaaucaacugaggugaggaguucaaagccagccuggccaacauggccaaacucuaucucuauuaaaaaaaacaaaaauuugccaggugugguggcgggugccuguagucccagcuacccaggaggugaaggcugcagugagccgagaucgugccagugcacgccagccugggugacagagcgagacuccaacucaaaaaaaaaaaaagagucuuuuuagcaagaauacacuaaaaucuaaaaauaugagucuacgaaaaugcagcaacaauucuaaauuuuuucugacagauaaaauggggggaaaaacaauaauuuacaaaacuagcaucucuuaauccacaaaaauauaaaacuaggaaucccauguuaagugacuuauggaugacagauaguaaaugaaucucaaugcccagauuugagccccugcuauuccaauuccaaauccuaauuuccaaaauaccuaugucucgacuaauuuccugagaaagacauuuuaauuugccaguugaaaguacauguuacaaaauacuguuacaauuggaauuaaucugcaaaaacgauagauuuaaacugaauuuccuuuuacggaaaaaaaaucuuggcauauauuuuuauuacuucauuggaaaacagugcuacugcgaucagauaucagguagguuaguuguuuuggacaaccguuuaauaaaaugagaguaaaaaaccaucuccaaucagagagaaaucucauacucgguucaucuucagaaaugccccuagucuuaucaagaaaaaguauaguacuccugagaggagaaaaauacugaucuaauaaaaacaucaugguaaagugccauucauuacgcaauacaucacauuuacagaucauauacuuuguaaaauauaaauaaauuuuuccaaauuggauuuuaacugcuucagaauaauauauauuuuuuaacuucaaacauuuauuuuaaauucuggcauacacgugcagcaugugcugguuuguuacauaaauguguaaauguaugccauggugguuugcugcacagaucauccuagcaccuagguauuaagcccagcauccaauagcuacuccuccugauagaguaaguaaaaaaaaaaucuaaugggcauauacaacuaaugaguacuauauuauaggcacuauuuuaaagucacguuagcuaauuugauaacaaacaacaauaaccaaauacaaguuuguauuuugcuuuuuuaauauaauggucauguaaaauaucacaaagacuucagauguuguugcuaugcccuauucaauguagcauuaacuucuaaaaagaaaaaagugauugcuuaguaauaacacuauagcuaccuucuauuuucugaagguauaaauauuucugacauuuauucuuucauucauuauuuagagauagagucucacuauguugcccaagcuggucuugaacuucuuaccucacgugauccucucgccucagccucccaagucacugggauuacugguacaggccacugugccuggcugacuuuucauuaagucagagaaucacuguuccuuuccuuuagucauacaaauugaaaaaaaccuaagacuccgugaaauuucacacugaacauggaaauacaaagccgauuucagguucgcuucauauauauaacucuguuuugacaucuggcacagcuuaauuacagaaaaaaugauaggccaggugcaguggcucaugccuguaaucccagcacuuuggaaggcugaggcaagagaacugcuugagcccggcaaucugagaccaggcuaagcaacauaggaagaagaccccgucugugcaaacaaugaaaaaauuagcuggacaugguggugugugccuguggucccagcuacucgggaggcugaggugggaggguugccugagccugggagguggagaaccaaugagcuauaaucaugccacuguacuccggccugggcgacagagugagacccuaacucaaaaaacaaaacaaaacaaaauaccuuaauuauucugaucacaaucauguaagcaauuaucuacaaucauaaauggaauuuucaggccacuacauugucaauaguuuaagcaggaacacuaacuuuaauucauuuuuggcagugaucaaucuuugcauaacauauuacauacuucucuggcaaacaugucuuaauugaaagaaaugcuuagccuacagaaugucaucaagaaacuggauacugaaagaaugacaaaaccuagauuuuuuguuuuccauuuuacuauauccuauaacuuuaacagcaauguauguauucuuuuuuaggcaucccagacaaugugcuauccugcucuaaauagugaaucaaagaugaacucuucuucgacugcaugcuccuugaaaaguuuaacuauuuuuaacaauuaucuuuugacaacagcagccuucacaacauuauuuaacauuucuguaacaaugaaacaugccccaucaacuuccuuccuggugucaaagauuuugcaucaguuugcagaucagauaugaagggguauuuauuccucagguuuaaaagguuuucaggugugcuggagaagaccuuaauccaaaauacaagcucacuauaacuauaaaacacaacuaaaaaauacagugucuacguuucgaauuuuaaagaucucaggcagaugcagcauuugaaauuucuucuuuaaaagucagaaagaaguugccucuaaggaaauagugacuggaaagagucacacggggacuuucugggcaaugaaauuuucauuaucuuaauuuguguggugguuauuucuugcaugaaccacucaagaccuguguaguuuacuguauguaaauuauucuuauugcacuagaaauuuuuccuauuaaucucaaauaaccuucacaaauuuacaaucaauucauaaauaaaauuaugaauuaaauugauucaaccuauguuaaaaguuucacuccaagacucauuuauuucuacuaaaagguaauacccauucucucaguacauaaaauauuuaggauaaauaauauaaaguaguaaaaugacaaaacaaacaucaaauuaacguuacuuacccugcucauagaaucaaagcacuuccugaccaaagauuccacaucauuaggucuaucuugaacauuuauccagucuaacaaagagacauuaaaaaagggcagaucaccaucuuuagugucaaucguaguuucaucuugcugaugaacaguacuuugacaagauucccuaauuucuuugccacuuucagcaucugcgguaucuggggacacauguuccacugacuugggaaaugagguuaacaaagauucguuaguuguucuaggcauaucaggagagagcaccaguucaguggaucuuuucaucucagcuuuuucugagucuucauguucagguaaagaauccagucuucccaaacauucucuguaacuaugucugguuaggcacuccaacaguggaaucuuggccauuacugaaacugcaguuccuaaacuuaaaauacaaaagaucugucaguaaaacuaugagacugcucuaauuaggaauuagcauguuugaaugaaaucacauauuauuauacacacaaaucucaccaccucuccauaacauuauacauacauaaacuagucuaugagcuagcuauucacuaaaagucuaguuuagcagagagaggcuaucguuaacccauuaaaauaucacucuagggcugggcgugguggcucacaccuguaaugccagcacuuugggagguggagggcagcaaaucauuugaggucaggaguuugagaccagccuggccaacacggcaaaacccaguucuacuaaacguacaaaaauuagccgagugugguggcaggcaccugcaaucccagcuacucaggaggcugaggcacaagaaucgcuugaaccugggaggcggaggcugcagugagcugagauggugccacugcacuccagccgccugggugacagagcaaggcuccgucucaaaaaaaaaaaaaaaacacucuaaaguaaaguagcuauacuaaacaagugaacacuaggcuuuuacaaaaccuuaaagauguaacaaauuuaaauuuacaaaaagauucaccauagcaguaucuuagaauauaaccuuauggccuuaaguaaaucaaauauauuugauauauucaaagcacaggauaaaaauaacaauccuaaugaagauaacucuuguacucauaacacccugaaaacagguuuauguugucaaaagcauagggaaaauaugaaauccuggugauuuaacuucuauaaaaugaugugcaauaugauguaggucccuacuuuaaacugauacagcuaacagaacccuuagaaaguuacuggaaaagguucucauuuaaacuuuaaaaagaucuuucuagucuuaaugaauccuucucuuuccucucaagauuuuuccauuuuuaaggccaaaaacuaauauucauaccacaaaacagagaaaucugaauuuaaaagguuacccaaauuuaaaaaaaucaaagaaacaaaaagacaaagauuaaaaccagaacaugcuacuugccucuaaugcaaggucaagauaauuaaaagaaaaaaaaaucuacagauccaaaacaaaaaaccugaacacaaaaugcuaaaagcauaugcacacacacacaauaaggguuaguuucaugcugaauuaccauuauauuuucagguuaacuacagcccuuuuaaaaaaagaaucaauguguauuaaauguacuucuaugcaaagaacuaaaacuugccaucuuaaugagcauugaaaacacaugggcuggccaggugcaguggcucacgccuguaaucccggcacuuuggaaggccaaggcggguggaucaugaggucaggagaucgagaccauccugccuaacacggugaaaccccaucucuacuaaaaauccaaaaaaaaaaaaaaaaaaaaaaauuagcugagcgugguggcgggcaccuguagucccagcuacuugggaggcugaggcagaagaauggaguaaaccugggagguggagguugcagugagcugagaucacaccacuguacuccagccugggcaacagagcgagccuccgucucagaaaaaaaaaaaaaaaaaagaaaagaaaacagacaacacaagggcuuuuuuuccaccucaucaaaccuguaucaggauggcaauauuuacaaagaacuuaaaauuuuccuccauuguccaguguuugauaaugugccuauuucuguuagauguuauuuuucacaucuugccuuuuguuuaguggacaagacauaagcaaagauucuugguuuuauaaaugauuucaaaaguauuuggagccuuauuacaaguaaaacaacccaagagaaagaaaugugggagacucauacauguaaagagaauuaucauuuuuuaaauuaaaaacuauaaccuacaaaucacuaucagaaaaggcucaaagaauaaaccucaguuacaauaaauauauggccuauaagaaacaaauuugcaguaauuaaaccuacugauaaauuucaaaggcauuuuaaacaaauauuauccauuuuaauggcaaacauacugaguaaguuuuaacuugaugucuucuauggacugcagauaauuugaauaaauacuuucaaacuugaaaaguagcuuuugguaugaauuugaacaguccuccagguuggccaugauugcagcccagccuugguguugaagauguucaucauguacaagaccuucacaaaaagaacaaaguuucuuggcaacuucauacauuuccuauauugaaaaagaauacaaaagaaaguaaaagaaggcaaugguuuguuugcagaaguuugcauauguuuacaaacauguacguguggaugcguuguagagcacauuuaacaaaguauuucaaaggacuguuuuaguuuaucucuguucucuucuguaaaagacagccuaaacauaagugagguguuuccgagcagguauccuaagagacagucaaaagaagaauccauaagacgcuaccucugaaaaacaaaggaguagggcuuucaauuauuugacuaaugaucaacaucugccaucucaaaugucacuguccucugguauuaucucaagacauucauguuaaaaacaauuuuuggugaaggcaaagcuaaaauacgucaucuacuucuagauuaguauaacuauaacagauuuaguaacccuaaaugagauucuagaaaauauuuaagcagugaaaauaccuucagaaaauagacaucugacauucaguuccaaacaaugaaguacaaaaauauuuauuaaggauaaauuacaaggcagcaauguagauugcuuuauauauggagauauauaaagaaguccacuguuauaaaauauuuuaguuggcaaggaaauaagacagaucauucuaccuuuguuaacugguaugagacagauauaaaagucacaaaagagacaggaaaugagaagucaaaguuaacugaaggcauuuaacuuaaguauaaagguaugaaaagaauaugaacaaagauagggaaagaaguacuucaaaagaguggaacacgaaguggcaaagacaggaaauaugaagcacuauugguuaagaacaaauggucuggaggaaaaagcgagagaaagagggccagaugaucaaagacccagaagauacuaagguaaggaaggaggaauuggacuuuacucagaaaagaccuccucaagaacucuuuaacaugaagaauguaaucaaauagaagcuuuaagaagacugauaauacagaaaaugucauaagguggaacgggaaggcaccugaaagaauggauguaaaaugauuauuuuuaaguuguccaggcaaacuguaaaaaagcuacuguaaguuaucuaguuaccaaaguaaauaaguaagauggucuuuaugggguaggaaugucaguaaaaugauuaugugccaugucaauuaaugucaauuaaucaaucaugcugccacuaaaauagaguggggaaaaaaacucuggaauuaugaaauaacaaauaaaauguuuucagauuuuuuuaaacagaugaaagagaggugacacccuugaaaugacgaguaaaagagcuguuggguacauuaaagcaagaaguucuugcagcgcauguagaaaauguaggaggaagauucuuaaacacacaaaagauggaggauauaaaauauucaaauguuucaauuuuaugaauuguuaaaauuuauaaauguaaaauaaguucaacuguagcacuguuuacuaggaaaauaaauuuaugauauuucaaaaaugggaguaccuugcaacaaugaaaaaggaauaauauauauaguaugggccgggugcaguggcucucaccuguaauccuaguacuuugggaggcugaggcgggcgaucaccugcggucaggaguuugaggucagccuggccaagauggugaaacccaucucuaccaaaaauacaaaaauuagcugggugugguggcacguaccuguaaucccagcuacuggggaagcugagggaggagaaucacuugaacccaggaggcagagguuacagugagccaagaucgcacaacugaauuccagccuggguggcaagagcgaaaacuccaacucaaaaacaacaacaaaaaaaguauaguaugcuuucauuuauuuggggaggcuaaggucaguuagaaaugugaaacaacagagguaugagagagaaaugcauuuuguguguauaucaaagucuaggaaaaugcaaaacaaauguuccaccaucauuaagauggagugggggaugcaacgaaagaggaaguauuuucucuauauauuuugcugauauauuugcugauauauuuggcugauaaggaugccaaaauuaugaccauucuguuuuagaagauaauauuguuaaugaacaaauuuaggugaaaagaaauaucuuuacagguaaaauaugaaaguuuacuuucuggaaguacaaugauaugaauguaaagagcacuggccuuggagaaaagagguucuucuucucccuggcuaucuggccuugaagaaaugacuuaucuucaccuguucuuaauuccauauguguauaagaaagggcuaauaguuucaguuguaagauaaugaaguaaagaugucuuugccugcuucuccuucaugaaaccaaccaaauacaaaagggaaacaagacaccaucuugaugaaaccaggaaacaacuaccaccccacacauacaauauaugcagcaaaccugugaagaauaugaaaacugaucaacuugggucaaauaaaaagggcacccacugugaaagaauaacaaaucucgggaacccaaaaucacuaagccaauggaaaaaucaagcugggaacuaugucaggcaaaccugccuccaauuuuauuccuaaauaagauagcuacaaagauaagaaagcuacauaccucccucacaauuuugccacagggaaauuucuuguaggcuucaagaucuuuaaccuaaaacaguucugcugaauuucaccuucacaauguaaacugacagcauaucuucauaugugcgggacagaaagucacaccucugcugaccugaaacaaaggccuaucugcuuccucugucuuacuguuuauuguuuauguaaaaaugcagaugcacugagccagacuaaauuauguauugagugaaaggcugaucaaggacucgaaagaccccgcuucgaguuauccugcccuucugaaccaaaccaauguacuucuuacacauaaucaugucucaugucucccuaaaauguauaaaagcaaacuguacccugaccaccuugggcacauguuaccaggacccccugaagcuaugucuuggguguguccuuaaccuugacaaaauaaauuuucuaaauugauugugaccugucucacgauaauuuagguucacaccacuauugcagacauuuagcaaaacuugggagaacugaauccuccuugugggaagcuuggguggacagcaagaaccucuuggggcccuaucugaaauuagagaguagcagaagaaauaauaccuauuuauguuacauacuugcaaaaagccaaaggaaaaaacgugagaaaaagcccuagaacugcuaaauuuuguccaaggagaaggacaaaauaagucaucuccaucccucucuuacacauauagauucugcuucuaacuggggauccccugugauccagggcagcuuccugcucaccaggaagugcuaucuuauacccuuuccuacacugucuuauagaggaauaauucuauucauucaaacacaagcaaaaauuuuaacaugaaaucuacacuaaauuacccuaauuuaguguagaaaaaaagaauuaaaaguaaaaaaaacuaaaugcagaaaaacuuucuccaagagcaaauggaaauuauaaccaaauucuuuuccuaagaacuuggucuaauuuugcuuuauaaaaaagaacucaacacagagauuuagcucaggaaauaaguuaaaaagaaacguaucacugauugaaggcuacacuggaagaagacacggcugaaaacagagaagucuaaaucaagcuuuaacaaccaagacaagugaaauuaauagaauuaccauguaaaugauagcuaauauauggaagaaaaaagacagugugcacugaguccauuucaagaugaaaucugaaagaacuauggacauuucgguacagaagagauugcagaaguagaagagaagacagauuuaacacugucaaaguauucugauuucucuacacuacaguagucaaaagaauguacuaggacauucacagcagguuuagucacaauaguugaacacuggaaacaaucucaauaccuacuaguagcagaacagauuuaaaaaaaaacuguggcauauucguacaauagaauacaaugcagcaaagaauacaaaccacggauacaugcaacagcaugaaucauucucaggaacaucauguugcguaaaagaggcuagacacaaaagaacagaaacuacauuauuccauuuauuuacauucaaaaagagaccaaguaauguugguuuagaagucaagauacugguuagcauuaaugaacagggaggaugaaaacugauggggagaaaguccuaaguagggcuucuggguugaaacuauuuguuuuugugggguuuuguguguguguguguguguguguguguuuuuuuuuuuuuuugagaugaagucucacucugucacacaggcuggagugcaguggugcgaucuuggcucacugcaaccucugccuccuggguucaagcaauucuccuaccucagccucccgagcagcugggacuacaggcacaugccagcaugcccggcuaauuuuugcauuuuuuuuuuaaguagagacaggguuucaccauauuagucaggcuggucucaaacuccugaccucaugauccgccugccuuggccucccaaagugcugggauuacaggcauaagcuaccacaccugaaacuauuuuuaucaauguguucauugugaaaauucacuaagaauggauguacaauuaugguuugugcauuuuucaguauaucucaauaaacaaaaaucuauucuuaaauuuaccaauaagguaaaugaguaaaaggucacaccacagguaaaugaaguaaucagacauaaacucagaaaaucugacuuuagagaccacaucccggaccaugaagaaauaucaccucuaauuccucacauaaugaauugauuagaccuauguuacuguuuugguuauagcagcuuuagaauuuguuuuauaaaucugaaaagagggcaggcaugguggcucaauguauuuuauaaaucugaaaagaggccagguaugcugauucacgccuauaaucccagcacuuagggaggccaagacaggaggaucauuugagcccaggaguuugagaccaaccucggcaacgcagugagauccugucucuauauaauaagucaauaaaauaccuaauguaaaugacaaguugacguuggggaaccaccgccuagauuucagaagauguacggaaacgccuagaugcccagguaaguuugcugcaggggcagggcccucauggagaaccuguuagggcaguguagaaggaaaauguggggucggagcccccacacagagucccuacugggggcacucccuaguggagcucugagaagagggucacgguccuccagaccccagaauggaagacccaccaacagcuugcacugugcaccuggaaaagccacagacacaacgccagccugugaaagcagccgggagggaggcugcacccugcaaagccacagggacagagcugccccaaguccaugggaacccaccucuuguauuagugagaccuagaugugagaccuggagucaaaggagaugauuuuggagcuucaaaacuuggcugccaugcuggauuucgaacuugcaugggaccuguaaccccuuuguuuuggccaauuucaccuuucgccuccugccauaauuccgaggccucuucagccacgaggaacuguuaaguccaauuaaaccucuuuuucgucccaggcucggguuaugucuuuaucagcagcaugaaaacagacugauauagaaugcuugguaucugaaucucagauuacuauuuauguauuuaaaaaauauuuuaaauaugaugcauuaaaagagaaauaaugccagcuuauauuuaauuccugauauacguauuucugacauuuuaucuuuucuuuuuacuuucuuguuuucauucuuucguugaauauaguuuuaauugcucuuucuaaucacuugaaaauuauauauccuaguuauccuuuaacuuauuuucauauuuaauacuuucucuaucaaaauguaguauguacacuuuucaaccaaaucaaaaaaacaacucuaaaagauucuauuauguaaauucaguuuacauaaguauauuuuuuaaaauuuuguccucucaaagcacuuuuggacucucaaauguuuauuaaauauguuucacacagaugagguuauuuccuuuuaauguuguauccuaugugaaaaauggggguauuuguacaaauguauauacugcuuaaaacaaaucucuaagaguuuuacuaauuaaagcuaauguucaguaauguuauuuauuuuuacaaaagguaaauacuauuauuucauugguucuaacacauuuuuuccaugauuaaaagaaaaauguagcuuaccacugauagcuuaaugucaaugauauuacuagaagguaaauaguaaauuaaaaaggaaaaucaaaugacugggaaacaauccgugggaacugcaaguagcaguguuaagagcuauauauuagaaagaaaccuaauucuccuccaggaacuaaccacaaauauggaaaaaauaaauacauuuuuagagcuauuuaaguucucuuuguuaacaucuacucuaacguagguccuuuauuaauuaauguucaaaaguaacuauuuacauauuaucuaggaaagaaggugaccaaaucauguuaagacagcuuuuccacucuaaaauacugucauuaucaaaguagaauaacuagcaauguaugacccagaaauuuuaaaacuagauauauuaaccggaaaauauuuuuaaaguuuauuugucaaacuuuuugcauacuuccuaugcaauuuagacuacugugcuauuuagauccgaaugcuuuuagaaacaaucaguuaaaauaauuguuuauaucuuaccaaugcaagcuguguccuugaagcaacaguaugaaaaacugcaggcaucauaagagauucuucaacuuuuauuuccaugucauuuucugucgaaaagguaguuuuaggaauagcagguggacgaucacauaagaucauuucuuuguuaaaaagaaaaauuggauuuguauccuauauuuuuuaaaaaaggagaaauaaccaaaauaaaauguuauaaauacugagcgugcacauugccuucaauauaugaagcaaauaaaccuuacuuuugaacacugaguucccaaugugauguaaagauguugcauucuugugugaaaggacucuugaauaccuaccgucccagcacuguagguacacacucuucgaucugcagccaugcauucuccuccauugaccaccagcaccugguguugaauagcaaucuuguauuugcuuugaauggcaugcuuaaggucugccacacuucaaaaaaugaaauaaaauaaaucaguuguuuauauuugcccaaugacuuuauuuuccaaguaguacuauguaaaaacaccuuagagguuaaugaauuucacucuaaaaccuuccccaaaaacaguaauaaaaauauaagcuuccuauuuaaugaacaggauuccauaacaacuggcugaucuuagguaaauaacagcaaaagaauaugcucaaacugguuaucaggucuauuaaaauccucaggcuacauaauuuuuguuaaaaucuccacacguuuuagaaacuacauuaagucuaacacaugugaagauuccuuccuaucccuaucuuccaaaaaaucauucauguaaguguaaaaucaaguuuaaugaaaacuaauucuggaaaaaaaauccauaauucaauuuuuacaacaaagauuauuauuucacacacuauuuauaauaauuccaaugucaguuuuauucugcauugccauaaagucuuugcuauuauggucacuauaaaaauauaaacagcguuggaaaugauauuuacuacuucuauuucuuuccuguccugucaagccagagaauuauuagauaccugagucccacuaaauuuggaugaaaauauuaaauuuaucuuuucucuccuuaacaaacaaaauaaaccuauugacauuuauucauaaacugaauaaaaacaaaugaccaaaaaccauggaagugauauacauuguuuuaugaagcuuccgauaauucccuuaacaauggccugugaaaaauagaauagcaauugacuauagguacuuacaacaauggaaaucaguuuguuuugugugaguagaucuguuuacugaucuguuuacuguuuacaugaauauuauauucaugccaacaggacaaagcacaauuuaaagaauguaacuagucuuuuagagaaagauaacaauuacauauaaaauauguugggauaaaagauuuaagacuugccauuaugugaccuuuuuuuuuuuuuuuuuugagacaagaguccugcucagucgcugggcuggagugcaguggugcgaucuugacucacugcaaccucugccccccgggguucaagugauucuccugccucagccucccgauuaacugggacuacaggcaugcgccaccacacccagcuaauuuuuguauuuuuaguaggaacgggguuucaccauguuggccaggauggucucgaucuuucuugaccucgugauccgcccgccucagccucccaaagugcugggauuacaggcgugagguaccgcacccggccgccauuauccuacuuuuuaaacaguagaauaauauuucuuuaacuuucugcaugcagacagaaugcgaaaaaaaaauaaaugaaauacaacucacguuugcacuguaaguucagugucaaauguuagaguaguuccaguguuaaccagaaauacauauaacuucaugaugauuuaucugaauucugugagcuuauaccucacccucugauacaguuacuagaagaaacaagagaagugaucaauuuuacaaaugcaacuacaaucacaaauacuaucaucauuaugacacaguacaguauuacuauauaaauaacaaaaauaucaaaaugggcuuugaugucuaggauggcuaacuggauaguucaguaaacucaaugcuuaaaaaaaaauaaaaauaaauaguaaugaguuuagugaaaagaaaagcauaacuguucugccacaggaaaaaaaguuugauucuucaagaaguaaaaggccaguagcuagaguaaagguugcuaugugcauauuucacucaguguuuuacauuaagaauaaaacaguuggucaaucaucuuaucccugagaguuuuccccccacuucuuccucaacauaauaaaaaauagauuaguauuaagguuaaacuuacuaaucgcaaauuaagaguagccguuacuugcaaauuaggggaaaugaaucccaauuccuuccaucaucuguguuucaccucuacacugagcuagaaauccuccauaauaguuccaucacuuccaucagcugccuguugaacugcuuuucaccucuacacugagcaagaaauccuccuuaauaguuccaucacuuuguguaacaguagcaaguguacaggucuggagaucagaauauuuaaaacaacucugugauuaacaugcccaaggaaaaaccucaucuagaaaauaaagcuuuuucaucuauaaaaugaggauaacauacacaacaagccacaguggcucaugccugcaaucccagaacuuugggaggccaaggcaggaggaucacuugaggccaggaguucaagacuagccugggcaacacagcaacacccugucugcacaaaauguuuaaaaaaauuagacacacuugguggcgcaugccugugguccuagcaacuugggaggcugaggcaggaggauggcuugagccaaggaguucaagacugcagugagcuacgauugugccacugcacuccagccugggcaacagagaaaggcccuaucucaaaagaaaaagagaaagaaaaaaaacuuaaaauaaugacauaaaaaggggacagauuucauggucuagcauuuuacuuucaacaaauggaggaaaagauccauaagauuaaugaaacuggugaacgauaacuauaaauaaauucccagaaaguaguagguaccuuuacuuaugcucuuuccacauaagccuuagagaauuauuagagaaggaaaaagcaaauaagguuuuaaaauuaagauuuccagaaucauuauuuuaaaggcaauagauuaaacucugcuauacagguagaaacugugacuuaccgucaggcacugugaaaaggacuaccacuuuucuuaaaaaguagauuaaaacuggcuuauguuugcuuugcuugagauuggcaacugaauggcauuacugguuaaacucagaaaacuggaaaagaaaaauuucugguuauaaagagaaacaauucaguacgaaacaacauauggcuauuguuccuuucuuccuuuuaaaacuaccgucuaagaauaaucucuacucaggcccuucuacuugcacauucacuauaauaacaaccacaugacuucaacccacaucaauccauggcaucaaacaaaagucaccaauaaauuccucaaaacggccauuuccacaacaauuccucauuccuuaaaauauuaugguaaagaaguauccaggcaguggaguuagaaagcuuggguuugguuugggguccauuacuugcaauuauaugaucuuggacaacuguuuuggcuuccucuuuuguaaauaggaauaaaaauggcaccugcagcagacagccucuaagacagcagcaauuaucuguaccacauccaccuacuguauucauacuccagugaaauccccacccucaaguguaggcagggccugugaucuguuucuaaccaaaaaaauauugcaaaaaugaugggauaucauguagguaaucguuacuuaagauuauaacucccaucuugccagcugacucucucuugccagcuuugaugaagcaagcugccauauagagaggcccaccugauaaggaauugaagauggccagcuagcaagaagcuacagucucagucugacaauucucaaggaacugaaucuugacaaccaccacaagcccauaagcagauccuuuccuaguugagccucagagaagaccucagcccuggccaacacuuugacugaagucuugcagagacccaaaagggcccagugaagccaugcccagaaucuauaaaauaauagauuuauguugcuucaaacaaucaaguuuacuguaauuucucacucaacaauagaugauuaauauaacacaaccauaucacagggauauuaggaggauguuguugugggaagucagggaccccaaacagagcgaccagcuggagccacagcagaggaacauaaauugugaacauuucauggacauuuaucaguugccaaauaauacuuuuauaauuucuuaugccugucuuuaaucucuuaauccuguuaucuucguaaacugaggauguacgucaucuuaggaccacugugauaauuguguuaacuguacaaauugauuguaaaacauguguguuugaacaauaugcaaucagugcaccuugaaaaagagcagaauuaacagcgauuuuuagggaacaagggaagacaaccauaaggucugacugccugcagggucaggcaaaaagagccauauuuuucuucuuguagagagccuauaaacauaugugcaaguaggagagauguugcuaaacucuuuuccuagcaaggaauauuaauacccugggaaaggaaugcauuccuguggggaggucuacaaauggcugcucugggaacgccugucuuaugcgguugagauaaggacugagauacacccuggucuccugcaguacccucaggcuuacuacggugguggggaaaaacuccgcccuaguaaaucuguggucagacuggcucucugcucucaaacccuguuuucuguuguuuaagauguuuaucaagguaauacaugcauggcugaacauagacccuuaucaguaguucugcuuuugucuuuuguccuguucccucagaagcaugugaucuuuguuagacucuuauuaguucugcuuuuuguccuuugaagcaugugaucuuguaccuacucccuguucuuacacccccuccccuuuugaaacccuuaauaaaaacuugcugguuuugaggcuuaugcgggcaucacuguccuaccgauaugugaugucgcccccggcggcccagcuguaaaauuccucuauuuauacugucucucuuuauuucucagccggccgacacuaauggaaaauagaaccuacagugaaauauuggggguggguucccccaauaggaugucaaagaaaaaaugugguacuuggcagauaagucaacucuccaaaguuugggagggaucucagccgccuuaccuuuguaguagagcucacuuacucccauagcugcugcuaccaccacuguugauugcugacucccaaaucucuccuaaacuaucuauccaaucccucugaaacucaacaaauccaaaucaaucuccuauaugcauuucuucaacauuauuguuucuaaaacugagcucugccccuuaaaucuccuugcuuuaauuuuucauuucucuuuguugaugaagucuagauucacccaaucucucacauauuauccuagauuugucuuccuccuaaaagacauacgaacaucagcaaauuuguccuguaaauucuaacauuuaaauacuuaaugacacgauaucccuauuucuaucccuacugccuuaaaucagacccuguuuucaaccugcacugauuuccucaaucacuaguccgucaaccuccaugcugccuucaaagaaaucuuccuacaugcuagguagguugauccaaguuuuucugcugcuuuaaaacucaagacgauuaugacuuuuagggcagcagcuaccacuuuguauucauuauauuccaggaaacuauucuaaaugcuuuauuaaaugacaauaacaccuaagacagcaaauauaauaugcucuuccuuuccaccacaacuuuucacccucauccucuaccccucccccaacuuaucagucccaaauaucacacugcuugaacucccuaaacaaaucgagcugcuaaagucucugagucuucauggggcaguuuuccacgcuuaggauucuauuugcccugccugcuaugaucaccccuuccaccugcccuagccucauacacaucuucuuccagacucaagagaacugcuugaacugggaggcggagguugcagugagcugggaucguaccacugcacuccagccuaggcgacagagccagacucuuucucaaaagaaaaaaaaaaggcaguaucuacagccagggaaaguaggcauaauuaucauaaaugugauacuuucuaagaaauauguggagagugacagggaacuaugaaacgcacuuaacagauugacagaagacuggccagaaggugcagaccuagaaaagucaugcagaucugagagauguuaacaaaaggaagcuagagauaaacaggaaucagaugacuguauuaaauaaagauuugcugaaugaaugagugaaugaauaccaaauccaaaagcauaggcuuuaucuuacagcuuuaucuuacaggaggcauuuuguuuucucagagauuagguagcuaagggaugcugacuaaaguggaaggaauauuccuucauucauucauucauccaaauccaaaacacguguauugauauuaugugccaggacuggguauucugugggggaaaaaacagacauagucuuuguccucauggaguucagucuugaaggagaaagcagcauuaaacaagaacaaagcaaacaugauauaagcuguaaucaacgcacaaaagaaaagaguggguaggaagaacgacuuacuuuagauuuaugugaucaaaggaggccucuacguggguuacauuuaaacgguauuguugggauaagaagaggccugaacugagaagauguaaagcaguacaaggagacacaccauuuuugugagacuaaacacaaaaucuucaauaauaaucacuguauuguuuuuuguuuucucguuuuccuuugaauauuaucuuuuguuuugauauaauuccaguuagagaaaaauuacaagaauaguacaaagaacucccgucccccuuacucagaucaccaacugugaacacuuguguucuauuuaucacuugugucagugcacacuccauacaugcucucucuccacauacguauacacacagggauauauuuuuuccugaacuacuguaauuugcagacagaauuucccuuuauccauaaauacuucagaaugucuuaccuaacagcaagaauuuucuccuucauaaccaaaguacauuuaucaaaucauaaaauuuaacacugaugcacuauuauuaucuaaucuacaguccauauucaaacuacugccucaauaauauccuuuguaguuuccgccccucagauccaggauuuauuucaggaucaucauauugcuuuuagcuguaauaucuauuuaaucucuuccaaucugggacaguucagcuuuuccucugcaugaucuacagccaauauauugcuuucaaucagaagcuuuagaaaucguuagaguauagacgaccucaguuccauucuccucuuccaugauacuuaaagcaaauugagggaaacuccaauaagcuguagcagcugugugccuuuaaacaaacacuaaucucuucauuugacaugcacacaccucacccuaagaaaccauaaucauaaacaaugcugaccaaaaaaagcugaaagaaauaaaccuaauugagaaugaguuugucuacauacuugaugaacaauuuaaacuauuuuaaggauaguuuugauuacacuggcuccagaaccuagguuaaaauuaauuuaaaccacuucaaggauaguuuugauaacugugacucuagaaccuaaaauuugacuccaguauacaaauuucuaacagcuccuaagugauguuaaugacaauaucauuuucccacguuuucauccauuguguauaguccuaagacuggcaucuuuaaucagaagccucuucuaaauauuuucacucucuacauccucacuaacugccagcuaccaaaagucuacccaagaacaacagagaaaaauccaacuacuaacacaaggcaucauuucccaugggucuaccaguaccgguaaccugugaggaaaugugacgcucauugcuuucacggccacaaaugcucuucuuuccuccacauguccuaaguaaauggcacauaaaaucauaaucauaaucauugcuaauacuuauugaguuauucauuguauaccacucauaaugcuaaguagcuuuacaugcaugacuucauuuaucauuacauguaauacauucauaucauuaggguuuccauuugcagaugagaaauuacaauucagauuaaacuugucuaaaggaacaaacuuaguaaaccaaaacaaaaguaaacuuagccaggggugugaacacaggucaauaaauucauucauucaauaaaaauaucaccugagaaucuaguuagguaccaggcauuuucuuaacuuugggaauaaaauacaaaauaauaaaacugucugcucucaugaauuuuaauaucauagugggcaacaugaaaauuuuauauuuauauaaaacuccaugauaccuacuuucagggggaaaaaagcuacaaaaaaucuuuuuuuuaaaguaaaaacaaacaugaaguuccaaaauacauacuuccacuuugcuuuuauucuuuagagauaaugauacuguuggcauagcaauagcuuccauugacuggaaacaugaguaagaacuguaugaaguauaugauauucuuacaaauccuauagugagagagguuaagaauuauccgcaucauucauaugacaaaacuauggcucaaagaaguuauuuccuaaagucacauagaaagaaaguuguaaaaacuuaaaauccauagcuggaucacgggggaaaaaagaacaugaacauacuacauuaaaaucccuuaaauaagacuacauguaguaagcauauucuaugacuugggacuuuacuauuccuuuagaaauagcaacacuuuuuuccccuugcagauuuucucccuuaugugaccauuuaaaaaauuuccuuuacuaaauacaauacaaaaaaaaccucuuucaauaugaaguaagaagaguggaauaacagaacacuuuaaaugugacaagguaagguuuucaacagaaagcaaagucaucauccaagaaauggcauggacccagauccugagagaacaagauuuccuuguguccauaaaugaaaaggugaucuucaccuacaaccaccugaucuuccacaaaccugacagaaacaagcaauggggaaaggauucccuauuuaauaaacggugcuuggagucuuggcuagccauaugcagaaaacugaaacggaaucccuuccuuacaccacauacaaaaaucaacucaagauggauuaaagacuuaaauguaaaacccaaaacuaugaaacccuagaagaauaccuaggcaauaccauucaggacauaggcacagcaaagguuucaugacaaaaaagccaaaagcaauugcaacaaaagcaaaaauugacaaauggaaucuaauuaaacuaaagagcuucugcacagcaaaacaaacuaucaucagagugaacagacaaccuacgggauggaagaaaauuuuugcaaucuauccaucugacaaaggucuaauauccagcaucuucaaggaacuuaaacaaauuuacaagaaaaagaaaacauacauguagccaacaaacaugaaaaaaaagcucaacaucaaagaucauuagagaaauguaaagcaaaaccauaaugauauaucaucuuacaccagucagaauggauauuauuaaaaagucaaagaaaaagacagaugcuggcaagguuguggagaaaaaggaaugcuuuuacacuguuggugggaguguaaauuaguucaaccauuguggaagacaguguggcgauuccucaaagaccuugaggcagaaauaccauuuaacccagcaauccuguuacugaugagaacauauagacacacggggguaggauggggaaacaacacucacuggggccugucagagggugaagggugggaggagggacagcaucaggaagaauagcuaauggaugcugggcuuaauacuuaggugaugggauaaucugugcagcaaaccaccauggcacauguuuaccuauguaacaaacccauauaucccgcacauguacccuuuaacuuaaaauuuaagaaaagaaaaggugaucuuggcauguagcagagagaaauuuuuccauaccuggucauccuggcaguguggaauucucuagaaaugugcauacugaacacuucacagcuaaagaaacauauagaggagaaccuaccuaucguagccaagaacagagcugaguguuuaacacagacagcuaccccuuugcauccucacacacuucacucccaggacacacacuggggccaccuucaaauagggaacuccacccuacugcuggcaacugcaggacagugaggaguauaaucuuggcucuagaguggaagacucaacaggucacguggucucccaccaggcuuucaggaagaagaggagggugauucaggaucugcucucaaagcagaaaauaacaugguguuggccucuacucccaggcucaucccccccggguaguccccuguggauccggagacagucucgaacugaugccaacugggcacaaaacaugcccaccauccuggauggcucaucccggacaaacgggacgcagcaggaguuuucucucuuauuacauuaaacaucuauacaucauagccucaauuuugccucuuggagaguaaagccuaaaauacuuaacuaucugguccuuuagagagaaagugugugccucuuccuccaaagcuuaagcaacuacagccacuucagugagagcugcacauacuuuaguuaauaccaggcaucuacuagugaaggacugaaccuccugguaagcagcacuuccaucauauggaagugacagcaacaauacaaagaaguccugcccagagacaagcccaauuucccaguuuucuuucuaacagaugauagacccaggacugaucacacaaugacugguauucuaguuuagugggagaggaaaggguagaaaaccaaaaagaagaagauauuuuccauaccugccacccaucauuuaauucaaauauccaaagaugugauuacuggugaaaaugacaauaacaagugacuaaggauuacuauuagcuuuuuaguaggaguuccuauaaauuaauaagaaaaucacaaagacucacaauagauaaauaggcaaagggcaugaguagguuaucaagugguuaacaaauguggaaaauauuugaggccucuucaguaaucaaagaauuacaaaucuaaaaagaagacaguauuuuucuccuacuaagcaagcaagauuuucgaccuaagauuccaagguuuucaacccaagagaaaagaaauaaaauguauaaagaaguaaaaaguacuuuagaaauacuaguauaaacaagaauuuuucucuuuccauaaaacauuuauuccauagcuccauugaaaagaaggcauugacagaccuagagccagaaguacccacagcacaacaggcagugaaaaauuaacauuaaccaaagaaaggucuggccuuugcccuucgcuacugggaggugaucucuaggccccuguaauauccugacagauagaacuguguuuguuugccuuagggcuucagucacgucaguguagcaacgugacucauguaucaguuaaguucugaccuccagaggaacuacugacuaaagacauuggucugaccuccagaaagggcuagagacuaaaggugagucauguggacaguacaggaucaagccauaauaaaaacucuggacaccaaagacucaggugagcuucccuagugagcaauacucuguguauacugucacgcguuguggccaagagaagguaacacugucuaugacuccaccagcaaugauggccagaagcucugaguuuggaccccuuccagauucugcucucugccauugccugauuuuaauuuuuguauccuucucuuauaauaaaaguguaauugugaguauagugcuuuccuucguucccugaccuguuccagugaauucuccaaagagaggguggauauggggaaccugugaguuuguagucagcugguuugaagugaggguggguucugggcaccgccaaacuugccacuaguaccugaaaugagggcaguuuugugggacuguuccuucuaacuguagaguuggcuaaccucauuacacacucauacuaugguuuuuuuguuuuucagacggagucuugcucuugucgcccagacuggagugcaauggcacaaucucggcucacugcaaccucugucuccuggguucaagcgauucuccugccucagccucccaaguagcugggauuacaggcacccaccaccacgcccggcuaauuuuuguauuuucagagagacagaguuucuccauguuggccaggauggucucgaacuccugaccucaugauccacccgccucggccucccaaagugcugggauuacaggugugagccaccacgcccggccuacuuugguuucuagaaagaaccuuuggagaaguggcuaaugcuaaaugucuaaaguagaaaauguaccaaucacauaagccuggaacaucuuaauaugccauaaagcaagacagcuaacaaagacuaaagagauuaggucaaaaaggcaaggaaaacaacuuuaaaaggcuucuacuggcuaugaugggacagucugaccaucaaaagaaugaguacaaguaacugaauggcaaaaacccauaaaaauccaugcugcauaaugauacucaaaaaaacaaaaacaaaaaaccucagugagcuaagauagaacccaugauaaaaacuuaaaaagcaaagaaauuaagcacuguccuuccuauaugaaauguauuuuggauagcugggcacaguggcucaugccuguaauucuagcacuuugggaggccuaggcaggcugaucacuugagcucaggaguucaagaccagccuggguaacauggcaaaacccugucucuacaaaauauacaaaaauuagccaggcaugauggugcacaccuguacucccagcuacuugcggggcugaggugggaggauuguuucagccugggggauggaggaugcagugagccaagaucacaccacuguacuccagccugggcaagggagagagaccgucucaaaacaaaaaacaaaacaaaacaaaaaagauacguauuucaguccauuuauauggaaaaccuccagcuaauagcgauucaacuggacacagcccaaguauaaaguuuucuugccaccccagaccaccucugaaaaaguaaaccugaauuuaaucaagcaacuauauguaccuacgguuuccaguuucuaggaaauauggaguauaaagaaaaagacaaacauuaugaugaaucaguuaaauucagaauaagcauuccacagaacaaugacucuguuucuucaacaaaugguuacuaaaaaaaaaaaaaaaaaagaagacuuuuuauaaacuaaaaaagauggacgagacaaaauaaacaaaugccaugugugaauuuguucagauccuggauccugacuuaaaacaacuguauaauaacauuuuugggauaaaugugcaaaucuaaauacggacaggguaucggauuauacuaaagaauuagaauuacuuuuguuuggaugauaauggcauuguaguaacagaaaaugaacucugaaaaauuaguguguaaaaugaugccugagucuugcuuuaaacuagucuagcaaaaauaagcgaaggaaggaaggcuggaaggaaagaacagaauuagcugggcaguagaaaggugagauuggcaaaauguugguacuuauuaaagcaagugagauggcuauauuagguucacuguaacauucucucuacuuuuguauauguuugcaaauuuccauaauaaaacacuagaaaauguauuauuuuaaucacauucaacauucauauuacaggucagaauguauuuuaaauaauuaugauguuucuggaaagcaacugguguuuguagagguagguaagcaaagguuuuauaaaaucacauuuccuuaagccaauaacuguaccaugaaaucaauuuuagggaaaaaauuugaaauauaguuaaagcauacacaagacacuuuccuacauuuauuaguaacaaauauuugucuacccauacuuuuauuauucauauuuuaagacaggauuuaaaauguuacggauaaaaauuaaaaauuugauuuauuuauacauuuuuuaagacaagaucucguccugucacccaggcuagaguauaguggcgggaucacagcucacagcaaccucacaaccuccccggcucaagcaauccucccacuuaagccucucaaguaacugggacuaugggcaugcacuaccaugcccagcuaauuuuuuguauuuuuuuguagagacggcguuucuccauguugcccaggguugucuugaauagaaauuuuaaaauaugagagaauaacuuuuuuuuuuuuacacggagucucgcucugucgcccaggcuggaguacaguggcgccaucuuggcucaccggaagcuccgccucccagguucacgccauucucucgccucagccucccgaguagcugggacuaccaccacgcccagccaauuuuuuguauguuuuaguagagacgggguuucacuguguuagccaggguggucuugaucuccgaccucgugauccgccugccucagccucccaaagugcugggauuacaggugugagccacugcgccuggccagagaauaacuuuuaauaaggcuuacaguauuaacaaaaacuguauauguaaugguugguuuuuuuuuuuuuuuuuuuuuuuuuuuuuuuuuuuuuuuuuuuuuuuuuuuuuuuuugagacagagucucggucugucgcccaggcuggagugaacugcaaccuccccuucccgaauucaagugauucuccugccucagccucggaguagcugggacuacaggcgccugccaccacgcccggcuaauuguuuuguauuuuuaguaaggcaggguuucgccauguuggcuaggcuggucuggaacuccucaccucaggugaucugucugccucagccucccaaagugcugggauuacaggcaugaaccagcgcacccggccuucaauaugauuuuuuaaauggucaaaaauaaugcagaggaaaggaaaaaaaucuaacucuaagcuaacccuaacccaaaacaauuaacaagugucuguagguacugaauugguaauacuccaguaaaacauuuagcugcugucagaauacaccacccuccuugguuauaaucugaccuaaacagaaggaaaaacaacugacugcagaggaagaacuuaacagaccugguuaaaauucuuauucugccacuuacaagcugggugauuuuagaaaagaaauuuauccuaacauucaauuuucucaucucaaaaguagagauaacaucuuccucacagggcuacuguaggggauaucuguucuucaaaauuuacaggucaaaaguaacaagagaaugagaagcagauggaaguauagcuaaaacaagauuggccaugacgugaugauaacugaaucaaaaugauggguacaucauagcucauucuucuauugccuaucuuucuguguuuuugauuuccauuaagaauuauaaaaauacagccgggcaugguggcucacgccuguaaucccagcacuuuggaagggaaaggcagguggaucacuugaggucaggaguucaagaccagccuggccaacauggugaaacccugucucuagugaaaaaaaaaaaaaaauacaaaauuagcugggcaugguggcacaugccuguaaucccagcuaccugagaggcugaggcaagagaaucacuugaacccgggaggcagagguugcagugagccgagauucugccacugcacugcagugaaucuccgucucaaaaaaaaaaaaaaaaaaaaaaaaaaauauauauauauauauauauauauauauacacacaaaaacaaaagaaagcuuauagaacaaucccaguguuuccacacccacacaacaggauaaaaaugucugaaugaugccaggagcuguuucaccaaagcaagucaauuuuauaaaaggcuacuacaaagaaccaugucuacucuaauaccuaccuacuggcacaaugccuauacaagagcuaugugcaugcuagaauuaccuauauaauccccucccauaauucaugcuacacaaaaaacuuuaauuuuucccucuaccuauuccucacacucaucuuuucucauauugaugggaagagguaacugaaacacucugaaggcagucuuucacggugguaagacagagcugagaaaauuuucuuugccacuaugucucaaagaaaaucagcaacaugcugggugcauuggcagcacccuugggaggccaaggcagguggauugcuugagaucaagaguuccagaccaaccugggcaacauggugagacuccauaucuacaaauauacaaaaauuauccagguguggugacgcacaccuguagucccaguuauggggggguggggugggggcgcugaggcaggaggauggcuugaaccugggagguugaggcugcagcaagcagagacugugccacagcacuccagccuaggcaacagagcaagacuaucuuuagaaaaaacaaaaagaaaagaaaaaaaaucagcaacauguucuuaauuaaguguggacuaagcauaucuuauuggucauuggcauaucuuauuugcagccaauccauuaacaugagcagaacauacaaacaaugucugauaugaccacccuguauccauggcaaggcauaaacacuaaauaugcuuuacuaaauaaagggaacauagaaacaauugccaauaaugaaaauuacaguuuccuauaaguaaacauguauacacaaaaacaaauugcaccaacaucuaaccaauauaaaggauauucaagguuuucuuauucucagacuacacucucaaucucaauguuuaacaacaaccacugcaggcaugaaacgugaaaucuuuacuugaauugaauuucccuggaccugucacugcauuaagagggagguugaccuaggugacacccaaagugccuaauuacuaaagauucuacaaguaaguuguauaaauuggacucucaagccaguuguuuagggaaacagacauaacuggucucuuucucaaauggcuguacaaccuuauguauauaacaaugugugaaggaccagaucuuuuuuuuuuuuugagauggaauuuugcucuuguugcccaggcuagagugcaauggcgugaucucagcucacugcaaccuccgccuccuggguucaaggaauucuccugcuucagccucccgagcagcuuugauuacacgcacccaccaccacacccagcuaauuuuuuguauuuuuuaguagagacaggguuucagcacguuggccaggcuggucucaaacuccugaccucagguaauucaccugucucggccuccccaaguguugagauuacaggcuugagccacugugacuggccaagggaccagaucuauacaacagcaguaaauggaaaaaggaguuugauuacugcuuugccugaacacucugauccagucaaaacaagaggauacugaccuguuuuugcucacaaggaucauuacuuccuuuucuucuuuucuuuuucuuuaagagauggggucucucuauguugcucaggcuggucaugaauuccagcccucaaaugauccucccaccuuggcuucuccaagugcugggauuacaggugugacucaccaugcucggccagaucaucacuuuucugucacuuaaaucucuugauaaagcugcuugaucucaaauuuucucuucuuuaccuuagcuccuauaccacuaaagucuucuuugaaaaaaaaaaaaaucacuuuuuuuuuucuuuugagauggagucucacucugucacccaggcuggagugcaguggcacaaucucagcucacugcaaccuccgccucccggguucaagcaauucucccugccucagccucccaaguagcugggauuacaggcaccugccaccacguccagcucauuuuuguauuuuuaguagagaugaaguuucacaauguuggccaggcuggucucgaacucuugaccuuaggugauccacccaccucggccucccaaagugcuaggauuacaggcgugagccaccuugcacagccaaaacuaucuauuucuaucuuuagcuguuauuucaacccuggauuauuaaucuuuauguggucauguaauaaagcuggucagauuuuaauugaaauguaugguuuauaaaauuaguuaaauacucuguauggguaccaggaugaauaaaauauaccuauucaugcuaauguuuuaaguucucuuauuaaaagaaguaucauaugaccuacauagaccaauuuuguguaaucuaagucaaaguuauaaaauucuacugaaugaaucuucuccagaagauccaugagcugcauggcuuuauuaucagggaaagaaauguagauaaaacaggccaggcacagugguucaugccuguaauuccagcacuuugggaggccgaggcagguggaucacuugaggucaggaguucgagacugccuggccaacauggugaaaccccaucucuacugaaaauacaaaaguuagcugggcaugcuggcucucgccuguaaucccagcuacucaggaggcugaggcaggaggaucacucgcacccggcagguggagguugcagugagccgagagcaugccacugcauuccagcugguuggcagagugagacucaaaaaaaaagaaaagaagaagaaaaaaauguagauaaaacaagaaaacaacuuucuucaucaauacaugucugucuaaauuuccauucucuaaucuguaaauggggauauuuaucauaccuaccucauauggcuguugcagaaaaaaaaaagaaaucacaguaaauauucccaaaauguucucuagggacaggaaguaacucugugacauaacacaaagcacucaaaagcaucuguugaauaaacaggguuucauaagcaaauguacucuugggguucuaguagcaguacucuaagcaaaugacaaagcagaauccaaauaguaacuuaguaacagagagagaucacaugcagguagcuaauuuucagcaguuucuuuaucagccaauguguucccaguaucuuauauuaaaaaaaaaaaaguaaucaacuugguuuaauauauuuuaacaucauauaugaauaaguacuccuugguuccacauaaacaguuacuaaguauguguauccucucuuccaccuuauucccauuaagcuaucuaauucagaucuuccuacugcauaucgggcucuaacaauuaccuaucugagcaccuacuaucugcagauuccaucucagaugacaccaccaacuacauaaucuuagauucuuuuaauguuuacuucuccccaaacuaaaaaugcuucauaacuucuacucaaguauaaauuccuuagacugacacuccacuauuuccuuuauuugggucccuacaugaagcuccauaccauuuaggcugaucuccugaaaugaggugcaugaauaaauggauuuucaugccucuacucaugucauuccacagcuuccauuauguaaccaagaauucacaaauauucugucguaaagucuuccucaauguacuggcugucaguggucuuguuccugaaguacugacagcccauacuucaaauuccaacuauucaaguaaguguugguauucagaacauaaauaaaugcccugcuacacuuuuuugccacuugccaaauaacuuacaucgcccaagcuguauugcaaauggcuaaaaaaaauuuuggucaugacauaucauaccucaauaccuaacauacuaccuagagacaguaaacagucaauaaauguuugcggucaaaaccauggauaaggacuacggcaaccaaaacugaaaucagaaaguugcucagagagaauccacaggaacacugucgcuauuuauucacaagacuguauacuuuauguuacauacuccuauaugcuaucaaaauaacaugaucccaugaaacugaauucucuccuuuguaugccacaauuguuaaaaaacauucagcaaaaagggacaucaguaaccaaguacauauuuggucacccugaaauaaaaaauacuuggaaagaaauaagagaucugguuuuuaguccuagcuucacaucuuuacuccugugauuucaggaguuauccaauuucucugaaucucaguuucgucaucuuaaaacauaaagggguacacuagauuauucuucugaucuucuauaaauagucaaaucauacauuaaacaugagucuaacacacugaacaaauacuaauuuuaagaaacuuauuguguguuagugccaaaaaguaauaaaaagcacauuaccugccuuccaaaaaguucaauaauacuaauaugaagagagguaugcaaaaguuagacugagaaagaauggacaagaauucacacaaaggugacauuaaaaaaaaaaaaaaaaaaacacaaaaguauauguaaaaucaaguuccaacuagaaacugacaguuuacccucacugaucacauuacuaaaacuuaagaggauaaacuuaauaaaccaaugauuucuuuuaagaaaacaaucauuaaaaggagcuaauucuuuuauuaacuugcaacuuugggaaugcuuauuauguacauguaccccuaauuuacguaaaguccauuaaauccuguaaguggguugacucucuaugaucuagaacuaaaguuauugcauguaauuguuaaguaagguacaagcacagaaaucaacugcuauucaaggaauuauaaaguaacuuuauaagccuuauauaaauaagccuaguacauaaguauuacuuuucaccaaauagucacgauuuccuaaaaucugacuugaugcucauuuuauauaaaguccuucuuaacuuuuauaaaaugaaaccauauuuaauacuauacaaguuaacacaagccaauucuaaauuaaaaguaacagguuaguaacucaacaacugacacaagauuuucuuaaauuauuugacccucugcuuaaacagucuuuaguuucuacccacuaagaauuacuauaaacugccuaccauauauacugagacuucguaggacagaacaacugucaaaacaugucaaacauacucauaacucacacgguaguuaacaaguuaguaggaaucaugaugcauuaauaaacauaaugcaugaaacugaacagauccaaauugaucuuuauacaugcauaccugcacuuguguaucuauacaauaauggugggauuucaaauuggggagaaaggaucaacuuuucaugcaaugguauuaugacaaauggcuauccauagcaugaagaaaaauaaacuaucuggagguacauauucacuaaugagaacuaaaacaucaacaagguacuacuuuuuacccuucagauuacuacuaaugauuaaaaugagugcuaaguguugacaagauuaacaguggguccacuggcacauuucugacaaaaauauaaacugguauaacuuuuaagggaauuuaaucuggcacuauguaucaaaauuuaaaauguacaaaccagcaauucuacuucugggagcaaagaaugaaacaaguguacaaagguauauauaugcaaugauuuucauuauaccaucacuuuuuaaaaugaugaauuuaaaaacuaucaauggagguugguuaaauaaauuaugccuauaguccuagcuacucagaagguugaggcaggaggauauggcuugcuugagccugggagcuggaggcuacagugagcuaugauggcaucacuacacuccaggcugggugacccagcaagauccucucuccaaaaaaauaauaaauuauuacacaacccuauaagguaucaaauuuuagacauuuaaaaauguuuugaucuauacguauugaucaguacaaaaagcaauuuacaguauauauuaugugauucuguuuguggauuuuauuuuuacaacuaaugcaggaggacauauguauaugcaagcacuuaaaaagucuggaucaauuuaauagcaaucuuuuuaacacuggcuaucucuggaugccagacuuuuacuuucucccaguucuuuuaaaaaucacauuuauaauuagaggggaaaaacacauauccauuaaaaaaaaaagaugacacccuauacauuacaaagaaauaaagaaccugaauuuguugcaccaaaagaguuagucccaccaagagagcaagacaaagauucccaccagccuucccuauuucagucccaaucugagguccuaggggaguucugccccacucccauucuaaauauagccuucccuaaauggucauucauguuuagucuuccaacuguuaucuuuuuuuuuuuuuuugagauggacuuucacucagucaccuaggggcugggugcaguggugcgaucuccgcucacugcagccuucagcucguuguagccuccgccucccagguucaagagauucuccuuugggaggccgaggcaggcggaucaugaggucaggagauugagaccauccuggcuaacacagugaaaccccgucucuacuaaaaauacaaaaaauuagccgggcgugguggcaggcaccuguagucccagcuacucgggaggcugaggcaggagaauggcgugaacccaggaggcggagcuugcaguaagccgagaucucgccacugcacucuagccugggcuacagaacgagacucccucuguuucaaaaaaaaaaaaaaaagagagagagagauucucucuccucagccuccagaguagcugggauuauaggcacccaccaccacacccagcuaauuuuuuuuguauuuuuaguagagacaggguuucgccaugcuggccaggcuggucucaaacuccugaccccaagugaucugucugccucagccucccaaaguucugggaauacaggcaugagucaccacgccccaauuguuaucuuuauguaaacauaagagggagaacagaacugugaaaagaacaugagauuuggaaucaaaagaaguauauucaaguccuggcccaaugugaccugaacugacuucaccuaacaaguuuuuucauuugauuacaaaaaguaaaaguaccugucucacaggguuguggucaggaucuaacgaauaaucuauacauauauggaaguuauguaaaccauaaagugaaauacaaacaucaauuacuguuauuaacuaauccagaucucuguucugaguuuagagcuagcaguaacugaugcuucauauuuccagcuggaaauccuacuguuaccucaaacucaacauguccaaauuuaaauucggugcuuuuccuuuaaaucuauucccuaauuuauucacugucaaugaacuaucauucuacuauugccccaaacuucaguuauuuuucuuuucuuuuucuuucuuucuuuuuuuuuuuuuuuuuuuacaaacuuuccaaagugacaauggaccaggcuucaguuauuucuguccaaguccuacccauuuuuuuccuuucuaauccaaccccucauuuuccaaugacauaacccuuacuuaggaaacugcaaccucuucucucugucuuuaaaucucuauccggcuucaauccuuccuaaauacucccuaccaguuacaaccaagguagucaggcugcuucccucaaguaucuucccuagcaccuuacuguugccuacagcagggcacaaaucuguaguuucuuuacagcuacacucucuuugucaccuccgguucaguacucagacaguuucacuuaauuguacuaucugcccaccccucuuagcaugugaauuugccaacuugauauaggcuagauuaacauaaaaauggcagacuuaggaacaaaauuuacuuguauuugaauaccaucuaucucacugaggcucagguaaccuccacauaucaguugacaaucuauaaauugcaacgauaccuuucacagagaugagaaggauagcaauaauguacuucagaguccuuuacggugcuaggaauauacuaaaagcuuuaaaaaugguggcaauuaugacuuuaauuaaacuccagcacucaagaacuucauaauuaaccccaguuuauuuuuguagcaguaucaucaacuacucccuuacaugacaaaccuauacccucacuuuacauacuccugccagguaaaauacccccaucuuugcugaucugaauuuuacucaucuuuaaaagucaaaguauugccgggcacacuggcucacgccuguaaucccagcacuuugggaggcugaggcggguggaucacaagguaaggagaucgagaccauccuggcuaacacagugaaaccccgucucugcuaaaaauacaaaaaaauuagccgggcaugguggcggaugccuguagucccagcugcuugggaggcugaggugggagaauggcgugaacccaggaggcggagcuugcaguaaguugagaucacaccacugcacuccagccugggcaacagagcgagacucgucucaaaaacaaacaaacaaacaaacaaacaaaaguccaaguauuguccuauuaccacuucugggaagucuucccuuaucacagguggccuauaguauucuuucuccuuucucugaauuuacagaacucuuaaguaguuaauauaagguagcaggaauucucuuaucuggggggaaaaaccuaucucucauuaugaggacaucugguccuccuaaauccuccuaggauacagucagcuauaaaugaaggggagaagagagcuguauuuuaaaaaauauugauccgacagggugguggacauuaucuccauugaugcgguaguagcccgugaccccucaaugagggagaauugcuaauaacugcaguuuacagaacuagggaucaggcaaaauuauuucuaaucaucuuuucucucugaagcuuuuaguccacuuuauaugccacccagcacuuugggaggcagaggcggacagaucaccugaggucgcgaguuugagaccagccugaccaacauggauaaaccccauuucuacuaaaaacacaaaauuaucugagugugguagcacaugccuguaaucccagcuacucaggaggcugaggcaggagacucgcuugaacccgggagucagagguugcggucagcugagaucaugccauugcacuccagccugggcaacaagagugaaacuccaucucaaaaaaauaaauaaaaauaaaaauauauugaucccacugcauuuguuuccagauguacaggaauaacaacugaacccauauauauccauauuugaggaaaagaaccagaaaguaucucacauacucauuaaaaucuauccaacuuaucaaguggagauuuacaauuuucucgagagauuaucaugaugauaaagucaauuaucccagccuuacugucaacuauucuaauacagucaaaacuuagaauuaggccagacacaguggcuccugccuguaaucccagcacuuugggaggccgagguggguggcucacuucaggccaggaguucaagaccagccugggaaacauggugaaaccccgucucuacuaagaauacaagaauuaguuggcagugguagugcaugccuguaaucccaccuacugggaggcugaagugggaggaucaucugagcccacgaggcagugguuguagugagccuagaucacaccauugccugucgccugccugggcgacaaaguaagacucugccuuaaaaaacaaaaacaaacaaacaaaacagaauucgcuuccuuauaugauaaggugaaagggggacaccccaaugacaaucucugaccuucaaaacuggacacauucauuauucauccacuauuuugggggcaucuaaacauaagccagacacugcuaggugccuggaauacaaauaucuucaagaugcuuuccagcugaauagaacacaugagacucagauaacccuaaaguggacuaaaagcuucagagaaaagaugauuggaaauaauuuugccugaucucuaauucuguaaacugcaauuauuagcaauucucccucauugaggggucacgggcuacugcaucaauggagauaauguccaccacaaacggagugucuagguugcccagggacugaaaacugggcaucagucuccccaaaucagauguauucuaaucugauccuaccccuucucugccaagaaaaagaaugaaagaugaguaggucaggcauuuuccucacauuucccugaaagaaaaccuuuuucauaaaaguucagacuuccuaaauauacgccuugucuacaaacuagacaagcaacuucgccaaaagaaugaagcgagcauuuagaaagguagugcccaaagacagcaaaugagguaaaaauagcagaacaggaauacuuuuaaaacaaaaaugaaaaauacuuuggaguacacccuucagguuuuuuucccuagguguacaggaaauauguguauauucaggcaauaugguuuuauaaaaaugaggugacacccuacauacuacuauggacuuugcuugaacugcauaaaauaacagaaaucuuucuguaucaguacauauaaaugcauuacacauuuuggugucccuaucguuuauaaaaacuacauaaaaugcaugauuuuagugaaaauuuucuaguuguguuuuauuuuauaacggaaacuaacaguaaaaccaaaauuaucuauauagcaaauauagaauuauauaagacagggaaaauggggaaaaaaaagaaaauguagaauuagcugcauucuauuaaaccaagauuaucuauaaacauauaaccaaauuauuaaaccagccugcccaaaucugguauuugcaguaaaacaauuacuaaaagccguuauauuacuguaauauaauaugguauugaauuaauauuucaacagguaugcuggacaguuacugaacaaguauaauguguggaaugugaaggaaaaaugaguggacagucucaaaucagugacaaaaaaaggaaauggaacacaauuauuuuuaucuccuagcacaauuacaagccaauaaaauaugagaguucaaaagagcaaacuaacggguagaaaaaaaucauggaugaaaaaaaaugggcgaggauuguuauuccacaauccucaaagcacucacuaaacagccaugaaagcagaaacaaauuagccaaggaaagaggguacuuggaggcauucaaguacugcacuuacaaaaaguaauccaacagaaccggaacuuuacaaagggauagaaagaaaugccauccucucaggacccuaaacaauggggguacaguuuacagucaaauuaaguugauuugguccauaauaaauaaucagagacaaguaaucuucacauccuuuuaucuaugugaguuaagcaaaaacucaucaaccuagcacuauacaaucggcuuagcuagccuuuuaucuacucuacauccucaaaguaaucugcguuugucauuuaccuccaugaaaauuuccagugguuacccauuuccuauaaauaaauauauauacauagacagauaugucuuucuuguucacuguugcauugcugaagcuaaaagaguaugcugcagggguucaauuagcauuucaggaauaaaugaagugaauuuggcuucaacugcuuuccagccaugcuggguuuacuugaauucaucuguagaccuuugugaguuagagcacauuaguuuccuuacuaugacuuccaaaccugaauauguagagccccacaaucuaccauuacuaucgccucucucauaccaguccagcuucaguaacuucauuuuucuugguauaugccauguauaucagagccuuuccauuuacuguuucuucugccaaaaauuccuuucgagagucacacacuuacaccccuuacuucucuugggccuuuauucaaaaggcaaucaguggccgggcuuugggaguccgaggcaggcagaucaccugaggucaggaguucaagaccagccuggccaacaugguaaaaccccgucucuacucaagaacaauuacuuaaacauuuuuauguuccucauguaacuaguucaaaaaccucacagugguaaaaagauaauaaaagaaucgugaaaguguguugaaagggacugcuagauuuucaaagugucuuaggccaguauuacuacaaaagaaaaguguaacuggagucagaaaauaucauuaccugaaugagaaaauuuuaucagccauucuuuuaaaaagauauucauaagacauacacaucugcaaaguaaagcauguaggugcucaaauaucugcugaauguaugauauaaaauuuuaaguuaauauuagagucuaaaaacuuuucucaggcuaacauaaucaaaauuuagguucaaaauuucgaaaacaaaagucuugugucuucugccuuuaugaacuugauuugcuaaaguaaaucugccaugcauccugaucuuguguuuggcagcaagagccaaaaaaaaaaaaaaaaaaaacucagggacaaaaguaccgcuucauugucuucccugucguccaauaacaaacauauaaaggauuagguacauaaauaaucauaucuugauuaccauaaaaaguucaaaauagacuaaauaaaauuacuuuaaaaauaugaacuaugucaauauccacuuuccaucaacagagguuucucaacguaagcauuaugugccuaaagcaucccugacauaaaacuuuauccagguuuugaacacaaucacaaacauuaaaagacaugacaggaauguuauugagaaaauaucuucauuagggccauauucuguuacaacaaauauaaaaagcgaacauauuuucacauuccuagcaauggucugcuuauaaauccaauaauccaaaaacuaaaaucagccaccucccucaguaguuccuugguuucucacaguuuuaucugaucagaaguggaaggacccucuuuuuaucgucuaucacaauguaauaacauucuugauuaaacacacaauuaagucuacuuaagucucuuccuaaauugcuaacuguccaaacuuauguauaaaucauacaagcuucaccaaaacacaaaaacuuaagaaacuacacaauaaaauaguuagcaaauagguacacuuuaaauguuugcagcagacuugagaacauucccaucuggcugaaugucucguaguaacgugacucuuuaucaacagugagcacaugagucuuccuuggcagccaagucuacacuacuucaagguaugaccacacuuuaaagagucaugauggaaacgacuagauuacgaaaccauaaacaguaaacacagcacauccaccaggcgguggaagaaacuauagagauauuccauucagaagcugcuauuucuacuguugguuaauguauuuuuguuucuaccaaggaagcugugaaauccgcgugcacacccaucccaaaucuauccguggggcgggcgcaggcugagucauuccuaggaguaacuuuauaccgauccucgcacucuggggucgggacaaagacaucaucucuccguuccucccauucggugagcuucguucggccucggccaaacuccacucucccguuucucgaguccaacacagaauuaagggcugaucccuggcagcgaugagcacaagucaagaugcgucuugggagguucggacgucccucgcccucggccacuccggcaacuaggccggguacuaagcggcagcgcagagggagggaucccaaggcuccggccgaggaagccgcaggcagccccgcagcacgaguccgacccacaccuccggcagccuaguggagcaucgacucgaaccgcuuuugucuccacaggggcugucgcgccgggaaagcggccagugggcaacaccugccggggcgggaggcgccggggcccucccgugcacacaccugcgcgugggccgggcucaggccgaccggaacccuggaccaugcgaccccggcccaccgugccagggcccgccgcgcgaccgcugugccagaugggggaaggggacgcgggcggcggcgacacuuacccggcaacgccuccuccuucgccggcggcagcagcagagccagcgacccccggcaccaucuuccgccgccgccuaguccucggcagcgguuaccaaccgcccauucggcaccgcuaagccgacacaaccgccggcgucccgggcgcccgcccgccgcggccccgaacucuaggaggcagggagggguccgggcggacaaggacgcgagcaggccccucggcucugggucuggggccgggggacagaaggccgcggccugucagagccgaggggcccaggcgacugggggauucugaggcaacgccgagggcucggcagggccgcggacaccgccgcggcuugguuuguuauugucgacuccgucucuuccuccgcggcgcaugccgggaaac

SEQ ID NO: 193008 - RNA, 56438 nt, Homo sapiens
acagagcgacgcuggucucccagauuguugcagaaggagacggcgucgacgucugacuggacucgcggcgacuuaccuuucagucgugcgcuccugauccggcgcucggaauuuguccccggcuucagggcugcggggccuggaaggaggcguaucgaggcggcucgaaaacgauccaggggagccgaggcgcuccucuugucaucccacucagcgccauguccuggauguucaagaggugaagggggcggaggggguggggcgcucggucuaacggccuggaggcguccccaaaugaaccugaccuuccccgcguuccucugcguucccugggcgauuugugcagcuguauucguucuguuggucgcauauguggccgccggagaaauaaaugcauugucuucgcuggcgaguaggggcuccuagggcgagucccguguuagggacuugggaaaucucugucaccgacuguggggggccuggggcuuaaagcaucucggccagugcuuuauuuaacaaaacauccauuagauacccacugugcgccaggcauugugcucgguggagggccgaguaagacaguccuuguccccaaguggcucacagcuuaucuguaugcacagacgugcagauaaguauuugcagaggcgcuaguagagauaugcgccacuugcaaggaaaacgcaucgcaaauaagcgacuguucuuaggagaauggaaacuuuuugcaaugcuccaguagacuccccuucacuuuucauuguccaaauugguauuuauggucauucccgaaacaguuacaccuaauggguuugggguuaugcuuaaaccggcgacggaaggcggguacggguggcuuggggccaauuucccacgguggcgugguuuggauaccagaauagguguucugcucgcagggaguuacagugauggaugcuggauguauuuucuggaaaauuauaaacaacuucugguacauuaauaguuguauuuuuauaagucuuuuauauagcucaaucccuauugaaauuuuggcauaugauuucauuuuuuaaauuauuuuuuugacauggagucucgcucugucguccaggcuggagugcaguggcacaaucucggcucgcugcaaccuacgccucccggguucaagugauucuccugccucagccucccgaguagcugggauuacauaugggcgccaccacgccuggcuaauuuuuguauuuguaguagacaggguuucacaauguuggccagguuggucucaaauuccugaccucaggugauccaccugccucugccucccaaagugcugggauuccaggcgugagccaccgcauccggcccauaauuguaguuacagacaucauauacauaucaauuuagaugauuuucacugggaaagagguuagugaacucugacuaggcuuuucauuuugaauaccuagggggcagguagaagagccaauauugaaaacagguagaguuccuagaagccuucuccacucacugcaauuccugcuuuaacgagaguaacuauuaaucuuuaccgugauucccauguaagauuucauuugcugaaguaaagcaugagaaaacuacucauauggucuuuggaaauacuuaaauauuauauuguuuuucuuugccuuuaaaaaaaaauagggauccaguuuggaaguacuugcagacuguccaguauggaguucauggaaauuuuccacgccucucauauccaacuuucuuuccacguuuugaauuccaagauguuaucccuccagaugacuuucuaacuagugaugaagaaguagauuccguuuuauuuggaaguuugagaggucaugugguuggacuacgcuauuacacgggaguagugaguauaauaguagauaauuaaauuuugauuauauuucuggcguuaaccuagaaaauaagagaauucgcaggugaugugugcgguuaaucuuuauuuuacuuuaaguuaguuaaauauuuguacgcaaaaaauaacaaauaccuuaagugacccucccaccucagccucccagaguguugggauuacaggaaugagccaauaugcuuggccucagugcguuauguuugguuauuauggguagcaccccacccccacaccccagcgccuuguucaugucaucgauuuguugcaaaaaggagaucguuuuguggaaucuucuggauuuuauucuuucauuucuccguauguuucuuauguuuaagcuucucaauagggugucugaagcauguucgacaggagauuccuuaggaguuucauguucuggauuuguuuuucuccuguauuuccuuuacauuggaacguuucaaauuguuuuuugauugucugaaauguguugucuaggagauuccuuaggaagagacaauauuuccuaaguuuuuauauuuucauacuuguggcauuuuaugaaugacaguuucauaaaaugaaaguuaugaaggacuuaaugacaguugggcugaauuuaaaaucuuuguaauauaucuuuguaauaaaaucuuuguaauaaaaucuccauauccuaauguugcauagaauucucaggccagugugauuuucuuucacuuaagugaauuggauuuuuuuuuuuuucuuuuuuuuugagaccaaguuucguuuuguugcccaggcuggagugcaguggccugaucuggccucacugcaaucucugccucccagacucaagcaauucucccaauucagccuccugaguagcugggacugcuggcguucaccaccauacccagcuaauuuuuguauuuuuuuuuuuuguauuuuuuuuuagguuuuggcauguuguccaggcugaucuggaacuccugggcucaagugauccguccgccuuggccucuccaagugcugggaugcugcacccggccucuaauuuuuucuaauagauucuugaacucuaucaguucuuauuucacaucuauauauucucuggcucucauaugcauuucugagcuuuucuguuucagauuugugcuaauuuuucaaaacuuacauugcuuucgauaauuauuuuauaccaccaugaaauacuagauuaugguaguuauugaucuuagaacaaucaguauuuuugaucugagaauaaucucuaugacuucgguaaacucuaguguguguugauaaaaaguaaucaucaguuuucuuauuuugccaaauauauauacuuuaaauuuuauuuuuuuccaggaacacuauguugagauaucauuuauuuuauaauuaaugcauguucuuuuauuuguuuuuguuuuuuuuuugaaacggagucuugcuugcauugcccaggcuggagugcaauggugcaaucuuggcucacugcaaccuccgccucccagguucaagcgguucuccugcaacagccuccuaaguagcugggauuacaggcaugcgccaucaugcccagcuaauuuuuuguauuuaggagagaugagguuuugccauguuggucaggcuggucuugaaccccugaccucaggugauccacucaccucggccuuccaaagugcugggauuacaggcaugagccaccgcgcccagccacguucauuauuuuuaaauggcuaaaaaggcauuaaaucuucugaagucuaucauccagaaccauaacuuaucuucuacacuuguuucugugagcaugugcauguaaauuggaaucauauuauguauuaauaaaaaugagaucauauuaugccuaaugugauuaggaauaucaucuauauuggacuuauaauuuccuuguugauggacauuuuugaguuaaucacuauuauaaaaauaauaaaaauugagauacuaucuuugcauacuuguuauuuuaauuuuuuuucuacuuuauugagaugugguuuacguaugauaaaauguacauauuuuaaauguaugauccuaguguuuugacaaagauguauaccugauaacuacuaccccaaucaagauacagauuguauccgucucccucaaaguaucuuguauccuauugcauucauuuuucccuguuccugcccuaggcagccacgagucucauuucuuuucuuuuuuuuuguuuuuuuugagacggagucucgcucuguuucucaggcuggagcgcaguggcgggaucucggcucauugcaagcuccgccucccaaguucaugccauucuccugccucagccucccaaguagcugggacuacaggcgccugccaccaugcccggcuaauuuuuuuguauuuuugguagagacgggguuucaccguguuagccaggauggucuguaucuccugaccucgugauccgcccgccucggccucccaaagugcugggauuacaggugugagccacugcgcccggccacacaagucuucuaucacuauaaauaaguuuugccuauucuagaacuucauauacauugaauucuacaguauguacuauuuuaagucuggcguuuuucacucagcauaauuuagguacuucuuuggucuauuuugguuaguuacauuuuugaagaaaagcauccauuuuauuuagauauucaaacuuauucccauagaauugugcauaguaaucauuuauccuuauaaaauuguaacuguaauuuucuggaauugggguuuggugguaugauguguugcucacaaguggccagaacuccuauuccugaaggauuuugaauuggaggaacacauacuuaaacucccuuuuaugccuugguucuaguuacucuuuccaaguugaauaaccauuuuuuugguuguuuuaaguuggugcucugaaccuuaaauuucaguacccuuuacucugaauugucaaauuuugauaaaaugugccauuuuuuuaaugucugccagaacauaauuuuauaugccuuauuggcuccauuaaacuuuuuaaaaacuuuuuuaaaaaggugauuauauuccuguuuuuauucuuuguguuacacauucgugucuuuuuuauugauuagcuaugacauuauuucuuuucaaggcaggcucucuugaauuuuucuuaaugauuguguuucuuggcuuaauaauuacucuuacauucgguuuuucuacuuagauuuauuuucuuuucauuucuguuggacuugcgauuugagcacuuaauuugagucauuuaaucuuuuaaucuuuaaacguguuaaguauugcguugccuuuagccaccacguuuuguuauguaguagcauucuuuauuuuuaacucugguguuuucuuauucuuauuucauuuuuauuuuuuguuuuuuuuuuuuuaguguguuuucaauaagcauaugguuaaguuuauuuuuugacccaucaaaggcuuuauuuuauaaugugguuuauuucuuuuucuauuuuaaaauacaguuauguguugcuuaacaaugaagauacuuucugagaaaaguguuaggugauuucuuuguggaaacagagugaacaagauguuacuuuacugaauacugugggcaauuguaacacauuuguguauuuaagcauauauaacaugaaaaaaguacaguaaaaauauuguauaaaauaugaaaaaugguacacuucuauagggcagccccauuauaaucuuguggaacaacuguugcauaaugcauguggucugucauugcugaaauguuguuaugcgggguaugacuauacuguuaugauuaauucucauuccuuuuguuauucuugucuuugucuuuuuguuuuuuuauauguccuguuuuuucuugcugcugggaccauguuuuuguuuuuauagucuccaauauuuuggcucauauauauuuuauuuaaaauucuaguaauuacuuauuuguaacgacaguuaacuaauuguaauuaaugauagcuuauuaugauaaauuacaauuauguaauaccuugagaugaaaugcucaaaaauuguuaguuuugugcccugcuuuuuuauuuugguuauguauuuucuaggauuugcauaauccgguuuaaaaaagaucauccuguaggcaguggcagagggguggcgacugggagagaacauagcucugccucauagauaauaucucuaaaagucuagagaugaauaucugucuaauacucuguuuaguucuggcuguaaucucuugagucaguagacaugcugggagagguuugaagcagcuuucuuguauauuuucaaggaauuuuuuaaaauugagauacauuuauuauaaaauuuaccauuuuaaaguguacaguugaguaguuuuuagaauacucacaagguugugcaaccaucccuacaaucuaguuccaaaacauuuucauuacuccaaaaagaaaccucauucccauuuguagucacucccauuaucucuaccccucagucccuggcaaccaugaaucagucuucuuccuguguauauggauuuaccuccucuugacauuucacguaaaugaaaugauacaauauguggcauuugggucuggccuccaauacucauuuuuauguuaaauagauuuuuuuuuuuaguguacuauuuuaauucccuuguuucuuuuacuauauauuuugaguuacuuaugauugcuuuagggauuacaauuaacaacuuaauuuauaagaaccuaguuuggauuagugccaacuuaacaguauauaaaaaacuuuguggcugggcauggggcaugguggcucacgccuguaaucccagcgcuuugggaggccaaggugaguggaucacgagguuaggagauugagaccauccuggccaacauggugaaaccccaucucuacuaaaaauacaaaaauuagcugggcaugguggcaccugccuguagucccagcuacuugggaggcugaggcaggagaaucgcaugaacuagggagucagagguugcagugagccgagauugugcgacuguacuccagccuggugacagcaagacucugucucaaaaaaacaacaacaaagaaaaccccaaaaaaaccuuugcucacagcuccauccuauugccuuccuuugugcuguuauccaaguuauaucuuuauauauguaguauaccuaucaacaaagauuuauaauuauauacuuuuuaaugagauaggacaaaaauuacaaaaaauuauacuuaaaaauuuuuauuuuuuuaaauaauuuuuuuuuuuuuuuuuuuuuuuuuuuuuuuuuuuuuuuagaaacugucguuacccuuuugcccaggcuggucucaaacuucuuuugacaguuugauuaugaugugaccagguguggaucucuuugaguuuauuuuaguuggaguuguugagcuucuuauauguguagaguagugguuuccaucgaauugggaagguuuuggcuguuauuucuuuaaauauuuuuucugccccuuucucuuuucuccuuaugguacucuuauguauguguguugguaugcuugauauuacaaguuucugaggcucuguugugugucauuuuuuuguuccuuagauuguauaaucucaauugaccuaucuucagcuucgcugauuuuucuuaugccugcucaaauuugcuguugagucucucuggugaauuuuuucuucaguuauuguaccuuuugacucuagaauugcuguuuggugagacaucgucuccaugcuuuuagacaugcguuuucaugucgaaagaaaugauuugcuuuaggucuuugaacuuauuuuuuuuuuuuuuugagacggagucuugcuuugucgcccaggcuggagugcaguggcacgaucucggcucacugcaagcucugccucccagguucacaucauucuccugugucagcuucccgaguaacugggacuacaggcacccgccaccucgcccggcuaauuuuuuguauuuuuaguagagacgggguuucacuguguuagccaggauggucucgaucuccugaccucgugauccgcccaccucggccucccaaagugcugggauuacaggcgugagccacugugcccggccaggucuuugaacuuuuuaauuuuuuagagauagguucuugcucuauuacccaggcuggagugcaguggcgugaucauagcucacuguaaccuugaacuccugcauucaagcaguccucccaccucagacuccugaauagcugggacuacaggcauguaccaccauaccuggcuaauuuuucuauuuuuauuuuguagaaauggggucuugcuauguuucccaggcuggucucaaauuccuggccucaagagauccucacacuucagccuccuaaagugcugggauuacaagugugagccaccaugcccagccccuuugaacauauuuaaaauaacugacuuaaauucuuuuucuacuaugucaaacaucuauacuuucuuggggacaguugacauugauugcuuuuuuucccuguguauagaccauacuuucuuauuuuuuuugcaugucuuguacuuuuuuucuugaaaaauugacauuuuaaauaauguggcagcucuggaaaucagggugguuuguuguugcugaguuuuguaauuaguguguguuuguuaggcuucuagggugguuuguugcugaguuuuguaauuaguguguguuuguuagugacuuuccugaauuaauucugugaugucuauccuuuaucguguguggucacugaagucuguacuugguuagcuuagcggucagcugaugauugugcuggaacuaauaaaucguacauucuuugcugagaacuucuguauguuagggcauuccuucaacacucuaaggccccugacaacucugcuuuagcuuucacuucuggcuuguuuaaaugcucaaguucaggcaaaggugagcguuuagggccuucucaggucuuucuugagaaugugcacagcccuggucaugcauaccagcccugugcuugcuuacggccuucuagauauccagaaauacacuggagcuuuucaaagcccucacagacaucucauucccuagcucuucuuuauaagccuuuuuguuuuuuugcuucagcuguuauccacugccucagguagccaugaaguuaaaacacuuuccuguaaaauuguuuugacaaacauccgcccaagggagguuuuuuuguacuuggugagcucagagguuaaauacagucagccuugcaaguggggucuuccggggaacuucaggagaauaacaguucuuugggaaugaaucucugaaagaacuguaacuccauucucuuuuuuucuggugacugccaggcuuuaccuaggaucccaacaagcuauuauuuuuauuuauuuauuuauuuauuuauuuauuuauuuauuuauuuauuuugagaugaagucucgcucugucaccaggcuggagugcaggggcacuaucuuggcucacugcaaccucugccugccggguucaagugguucuccugccucagccucccgaguagcuaggacuacaggcgcgugccaccacacccagcuaauuuuuguauuuuuaguagagacgggggucucaccauguuggcuaggauggucuugaucucuugaccucgugaucuucccaccucggccucccaaagugcugggggcgugagcuacugugccuggccgugagcuauuuuuaaaggcuacaggauugcuggggaugggacugaaguacugauauucagcuguuuauucuuuuuauucuugaauaaauguuacccagauuucugcaagccuuugauuuaguucucaguguucugaaacauuugauucugacaaauaauuuaucuaguuuuuuuguugccuuuauugaggaauuuuugaaaguccucauucuaccauucuuuauuguguuacccuccuucaguuuuuaaaaauauacaucauaauauuuaaguuaaaucauacaguuuuuaauaaaguagaaucagaauggcaugaguugaaggcuggauauauuuuucuuaccuaguuccauccugacuuauaaaugccuuauucccugacuuuuauauucuggagaauugaggcucaggaaccacccuguguggguucagauccuagcucugcuaccuuuuagcuuugugaccuugggcaaguuacuuuucugugcuucaguuucuucauuuguaaaaugggaauaaugauaguaccucccaauagagcugugaggauuuaaaaagucagucugugcaauguacuuagaccaaugcuuggcacauaguaagcgcucaauaaggguuggcuauuuuucagaaguuaugauguugaaaauuuuagauaauuugaauuugcuaguuuacauuugacuauuuuuuaagacauuaaggauuuguuaacuuccuaaugaauauagauuagaaaaauaauauuaaggagucauaauaauauauauuaauauuucuguaguuugugucuagaaaauauauuuuucuuaugugcaguguuuagcaguagcauuaaaaaaugaauggaaaucccagauaaaguauaacaaaguuauugucuauuauuuauaauguaauauuaucuguuuaucauuuuuauuagguuaauaauaaugaaaugguugcauuacaacgagauccuaauaacccuuaugauaagaaugcaauuaaaguaaacaaugugaauggaaaucaaguuggccauuuaaagaaagagcuugcaggugcuuuggccuauaucauggacaacaaauuggcacaaauugaaggguaauguacuuucagaauuuaguuuuaauaauugugaauuauagucaucuuugaacuuguuagggcuucuuguuagagccuauaaagguaugcuaacaauuucuaucacuguacuuuugguacguguuaaauaaauguuuuauuucuccuuuuacauacuucuacuaccccagccaucaaacaauuguccucucauuuuccuauggaauuauuaccauggagaaaauagaccuugguucaaauauuaggaaguacauuccauuucuccaaaccuuuugguaccuagguuuaggaauuuggaaguguuuauuuguuuauuuauuuauuuauuuauuuugagacgaagucucacucuguugcccaggcugcagugcaguugugugaucucggcugacugcaaccuccgccuccaggguucaagcaacucucccugccuuagccuccugaguagcuacaggugccugccaccaugcccaauuaauuuuuguauuuuuuaguagagacagagauuugccauguuggccaggcugucucgaacuccugaccucaggugaucugcccgccucggccucccaaaaugcugggauuacaggcgugagccaccgugcccagccuggaaguguuuguuuauaucagagguuauaaacugguauucugugauaugauguaggugaauuucauuuugcccugcaguguuuuagacauuuuuucguucaguacuaauuauugaaauagcuaaguccgcauuuuauacauauuaauuuauuuucuuaaauacaaaaaacuuauuuuucucuugacaagugggaaaucuggcaaugcaggaugaguugucacuuccauaugacaauaguugacuggaacucucccuuuagcuagggcauaugcucucccaguuuuaucaccuguuucuuuuuucuuuuucuaaacucuuucaaucuuucaguuaccuuuucucuuuuaggcauuuguacuugugaucucaauuuaaguaucuggaauauuuaggaucuugauauucuaauucuaauuuuuaggauauucauauaauccuaggugaguuugaagagaaaauaaaugcucauaaugucucacuuuguuuucuccuuuuucaguuuaucagguuuuucaguuauugagaauaacuuagugaaucacaaguucuugcauuucccauuuuccaagcagaaugaguuacuacccucagugguuccguuagccaaacucuacccuuugauuuaacuuauuuuacuuauauuacaaucuuguuuacaggccauccuugcauuuuuaaaacugcuuuauuccauuuucucaauuuuuucuggcacucuguuucuaaaaaucacccuucugauuguuuaugguucuauuucuuuuccuuuuuuucuuucaagucugcccaacuaguuccuuauuacuuuacuucaauguaaaauguaaaugauacacuuaaaauauugaacuaauucuuaguggggauaaaaaguaaugcuucugauuucccuuucuuuuucucccaaauauaauaggguaguuccuuuuggugcaaacaaugcuuuuaccaugccucugcauaugacuuuuuggggaaaagaagaaaauagaaaagcgguuucagaucaguugaagaaacauggauuuaaauuggguccugcaccaaaaaguaaguuuaggguuucacuuaauauuauucugauauuguaagaugcagggauuaugaaacauuuauucucucuuggaguuuguuggcuaauuugugcucaaggcuccaagguacaacuuuuuuucaggagucuuuuugaggaaaucucugauuuuuccuuuugccucuauugaaauagauucacacauaaaaauauacacaguaagagugaggggauauuaaaaaaauuaaagaaaaaguauauaugcaaugaagucucauauauacccuccccuaauuuucccuaaugguaacaucuggaaaccccugacuuuaaacauucuuuuugauaaauuuuaggcaaaaauaaucuucugauagcgaaugaaaaggauugcuuggcaagaguuuguucaaauaauguggaauuacuuguuuuuuuagugauuuaguauuuagcuuuuaaaauaccucuaaaauacaaggcuuuuaaugcaguuuguuaugcacguuuuauuuauuuauuuguguauauauuuugagacagagucuugcucugucacccaggcuagaguacaguggccacgaucaguggcugagugcaaccuugaccuccugggcuccagcaguccuuccaccugagccuccugaguagcugggacuacaggcgcacaccaucacgcucugcuaauuuuuguauuuuuuguagagacagaaucucaccauguugcccaggcuagucucaaacuacuggacucaggcaaaccaccugccuuggccucccaaagugcuuggguuacaggcaugagccacagcacccagcccuguuaaugcauauuuuaaaagcuacuuaauaaaagauaaaaaccuacuuuauuugauggcuuuauucuuuuuauuuuguaaauuauagcuuuaggauucaauuuggaaagugguuggggcucuggaagagcuggaccaagcuauaguaugccagugcaugcugcaguacagaugacaacugaacaggugugcuucucuuuuauuuuguaaucuaaaagugaauuuuaaauguugcagguuuguauuuaaaagaacaggaugaauauguacguguggguauuuguggucuucaaauauauuaaguuauaaugaaacauguuauagaauaaauagaauauauauauguuaacauuuuauauaaaaaguacugauaaggaauaaauccauacgugaacauuuguacccaacauacaaaacacacacguuccuguuuaugcacggcauauuuuuguaucugaaauguuuuaaauguucaaguaguaauuuuaagaaaaaaauugaagcugagacuuaacuccuuucaguaauuuugcaaaugcagugcuaaagauuuaacuccaaauucuucacauugucuaauuuguaauuuaggaugaguuaugcugaauuucuuugaaaaaaaaguauauaaaguaauuaaugcagaucaauuuaaaaauaacauuaaaacuuuuuugauguuuguaucuaccaguguuaguccuuuuaucuacuaauuguaguuaccauauuuacccugcuuauuguuagaaggacuugagcuuguuucugguagauaagcccccgguuacuucugauuuuuuagaccuggccugauuucuucugagcugcugcuguguucauguguuaauuuucaaaaauaucuguaucacauauauguugauauaaaauuggacuaaccuaguuuaaauagucaauuaaguuagcauaauaauaaaaguauccuauagugcauggcaaguuccuuauugcaguaauaauaaauggaaugucauugaccugguaggacugagaaaauauuuugaauacaacugauagcaucacagaauuuuaauggcagaaggaaccuuagagacaaucuaaauuuaguucaucccuuucauuuuauaggaauaagacauggggccauaaaggucaagucuugcugaaacuuacauauaagcuuauuugugauaaaacugugacugaaacucgggacuuaaaauucuuuuauauucuuuuaccuccuaacaacuaaagcaccuguucauucgcucuucagugaguaguguaauucuagaguugauuuaugugccuuuuuggcguuugacuaguuugugguuuuuaaauuuaauuuaauuucaauuucuuaauuuuuugggacagggucucacuuucuugcccaggcuggagugcaguggcauaaucaugguucacucuauccucuaccuacuaggcugaagugauccucccaucucagcaucccuaggagccagaacuacaggcaugcacccccaugccuggcuaauuuuuuaaaaauuuuuuuguagagaugggaucucucacuauguuauccaggcuggucucaaacuccugagcucaagugauccucccaccuuggucucccaaagugcugagauuauuggcaugagccaccacuccuggcccguuugacauuaacgccaguuaauuaaaugauuucaaaucugacuuaaaugcaaguauuauuuuaauuaguuuguuuuacauuguuucuuguugcuguuuauuguagcuuaaaacagaauuugacaaauuguuugaagauuuaaaagaagaugauaaaacccaugaaauggaaccagcugagguauugaaccaauauuuuuuauuuaagacuacucagaauguuuaaauauacuuagaaucuacuuuuuguuuaaucacaggaucugcaugugaaaaaggaauggcuuaauguauuucgcuuuaugacuuuuuauuuauaggcuauugaaacaccacugcuuccacaucaaaaacaagcucuagcuuggauggugucacgggaaaauagcaaagaacuuccaccauucugggaacagcgaaaugacuuauacuauaacacaauaacaaauuuuucugagaaggaccgaccagaaaauguccauggaggaauuuuagcugaugauauggguuugguaauuauuuuuuucuuuaguuaauaaaaucuaauuuugugauuaugauuuucuagaaaguaauuuugaaguaaaaagagauaggaauauguugguaccaguuugggacuagaucuuacuaucuuuguagaacacaguuuuuccuguaguuuuuaguuaaaauagugguauaaagauguguuccucaguuuucuuuuuuuuuuuuuugagauggagucuugcucugucacccaggcuggagugcagugacgcgaucuuggcucacugcagccuccgccucccagguucaagcaguucuccugucucagacuuccaaauagcugggauuacaggcaugugccaccaugcccagcuaauuuuuguauuuuuaguagagacaggguuuuaccacguuggccaggcugguuuugaacuccugacuucaagugauccgcccgccuuggccucccaaagugcugggguuacagaugugagccacccugccuggccauguuucucaauuuucuuugcucuuugaaauucagggugaccugucuuucauagguuuucuuuuaaaaaguaaagacaaaacaauguuaugugaaauuguauuccaucacaaauauuguguuaugcagaguauuaaauagauacuuauguguccuuacacuagcaguuuuuauauuuuucagucucaguaacccuuucuacucauaaaaauuacugauuucaaagagcuuuugcuuuugugugcuguuaucaguaguuauaguauuaggcagugguagcuaaagauagcaguacaaacucauugcuuguuaacauaaauagcauauuuuuaaaagaaaaauaacuaugccaaaacauuaacauuuuuguugcaacaacuggcauugucacauuuuugcacaucucuguguuuggccgaauagauggcagcugaauucucaccugcuucuucauucagucuguucuguuagguuguuuugguugaaguauaugaagaaaauuuguccuuacgacgguauguugcuguaaagagaggaguauuguaauagcuuuuuagauaauugcagauuucuuugauauacugcaucaaaauucaauaaauauuaguuuauuaaagguuaauuguuguaauauggaacgcuaaaucauaucagugagcuuuuuauacccuguuuuguuaaaaucuauuuguguaucuugcucauugaaugaauauuuuacccauguaugauuuuauaacaccaggcauugcucauuuagaaaauguugguucauugaguugggcagaccuacuaaauguugauguauuucauaugcaauauccaaaacuuacauucauuaauauuaccacugauguuauuagaaaaucauuuacauuuugggaaggcacuauguucauagugucacacacaacuuuuccaacauucuaauuuucuauugaaaacucacauuuuaucauugacaagcucaguuguuuccuuuguagaugacagccucacuuuguucauuuucuagaaaguaucuuucagacacucagucgugauugauaguugucauucaaguaaaaauggugucgcaugaaaaaagugacuaguugagcuuauaacucccaucuugagugauuuuucucuagcuaacccucauaguuugauaugcaacagaaguaguuaauauguaguuuccauuucacuacacagaauauuaaaaagauuuguacugaaguaaugagacuuaauaaaauuaauguguacugcuucgucaagaacauucuucuucuuuuuuuuuuuuuuucuugagauggaguuucacucuuguugcccaggcuggaguaaugguucagucuuggcucacugcacccuccgccucccagguucaagugauucuccuuccuuagccucccaaguagcugggauuacaggcaugcaccaccacaccuagcuaauuuuuuguauuuaguagagacgggguuucaccguguugguccaggcuggucuugaacuccuaccucaggugauccaccugcuucggccucccaaagugcugggauuacaggccugagccacugugcccagccaagaacauucuuaaggaaaacuuuuuuuuuuaacuguauguggcaguuaagaauaugaugacuaguacuaauauaccuuagugccaacugcuuuguuuuaugcugaggcacuuuuuugaccauugcuauuugggcuuuuuguaggauuagugcagauguuaacagaguaaggucugucuuaguaguauuauaaaaacaguuuugacuuugcauuuucgugaagggcuccugggaaacccuccccauccccaguggccuguggaccacacuuugaaaacugcuguuauuuacacugcuuuaaaauugccagagauuuacuaauguauugccaacuaugaauuaagcugcaguaaauauugaaaaauuacauacuuccacuuaagaaaaaugcauaagaaauauaucuuuuaugcuuuauggagaaguuaugacuuuuaagcuugguauuaucuuuaagucaaauuuuaauaaaaugauuauaugcauacuggaauuacuaaucacuuuagcuccgaacuucauggcaaaugaguaguuauaaauaguugcaugauaaaaaucaagaguucaggauuaaauguagaauuguagaauagcagucauucaauaaaaugacacuucucagagauacuuguaguauuuuauaguguaaaucauuuaauaauucccuaauaaugcagugggggaaagcauuuucuaacuaaaugaaauacucauuuuucauuaauauacaguacacuuuugugaccuugaaugauauuugauauucgauuacuugauuuuaaaaugggaacguuuuucuggugaacuggguuucacaaucugaccauuuaucuuuuuaaaacauuuuuaaggguaaaacucuuacggccauugcaguaauccuuaccaacuuccaugauggcagaccucuuccuauugaaagaguuaaaaagaaucuacugaagaagguaaaguaguaguaagugcgcuuuaugugaaaccuccaguuuauugugaaaucuuuaaauuucaucauuaaaaaaaacuaccaagaaauuguguuuucagaaaugcgaugaauggucucucugucuuuuauguguugcugauaagaaugaaaguucgugucacauucuuuuuacguuuucagacaagguguggcucuguugcccaggcuggagugcaguggcgcaaucucagcucacuguaaccucugcuucccaggcucaagucgugggauuucgccauguuguccaggcuggucucgaacucaugagcucaagccaucuaccugccucagccucccaaagugcuggggcuauaggugugagccaccagcagguaucacauucuugagaacaauugauaauuuguaucaggagucuuaaaauuguuuauaaucuuugaacaauuuugccagucaauaaugccauuucuaagaaacuaucugaaaggaguuaccagaaauucauuuuuuccaaagaaaauacagguuuuuuuuuauuauuauuauuuuuuuuucccucaacauuguuuuaaaggcugggcauagugacuggcaccuguaguuccaccuacuugggaggcugaagcaggaggauugcuggagcccaggaguuugagccuauggucagcuaugauugcacuauugcacuccaccuucagugacacugugagacccugucucuaaaacaaauaaaaauaaaauaaagguggacaauuugaaacaucuuuugacaagggaacaguuaaacgauauagccauaaaacuuacuauuauguaaccauuaaguauuauuuuugaugaauaaucacuuucaugauucuuuuuaguuaaaaaaugacagguacaaaucuuuguguggaguuugguuccucacuuuguaaauaauauauucauguguguuuuaaguccauucacuacacuaucuguaccaaaauguuaauaauaacuuauguccuagugaugagaauaagggugacuuuucuugaaaauuuguguguguguguguauauauauacauauauauauguauauaauauaaacauacauuuauauuugguuucuaagaauuaaaaauuaguuuagugagaaaaauaaauguuacuagagaggaacaguuacuucuuuucuuaccugaaaauucaaguaacuuaaauagaaggaaauagcaaaaagauguaugcaauauacuucuuuucugaacucuucugaauuaccauucuuccuaguuuuuaguuuucagagaaggcaguacaucaguuuccugucagugcuauugagauuuuauuuuauuaaugucugcacuuaguuuuacuuccuacuuucuacuuuuauugagaguuaaaccuguugaagucucagguucaauuccucacccugagcaaccuaauguuuuaugucuuguucuuccuacauuugguuauugaaacugaaguuuuagguuaccagauuugauagaagcacauaagacuacuuacugcuuuagucucaauuauuaauugagaaauuaucaauuaacaauaaggauuucucuuauuuuuccccaagauaaguuauauauuuaaaguguguuuuauaguagaaagguuuuagaauauuuggguugcuacauuaauugaaauggcagcugaagaugugauuuccagccagggauuuauuaaaaaaaaaaaaaaaauugucacucuuucaaguauguuuagauauuccaaacauaaguagacugaaauauugauuuaaauuccccuagauucuaacauacuauuauuucauccagcuuggacuugauaaaaaguuuaucuuugaacuuuauagagaaaaaguuugcugagcaaaauauuuuaauauaaagaauaaugcaaagcugggcauagugacucauuccuguaaucccagcacuuugggaggcugaggcgggcagaucaccugagguuaggaguucaagaccagucugaccaacaugaugaagcccugucucuacugaaaauacaaaauuagcugggugugguggcgcauaccuguaaucucaguuacuugggaggcugaggcaggagaaucacuugaacucaggagguagagguuucaaugagccgagauugugccguugcacuccagccugggcaacaagagugaaacucugucucagaaaaaaaaaaaagaagaugaaugcaaaggacauccuuuauguuugaauaaacauuuaguuuuuuugcauacuguuuaauauaaaugguuauaguaauuauuguagacuugauaggauguuugaugaaaagcauuuuuaccaucucuuucuuggagcuaaugcuuagacauuaacugucuaaaguaacucuucuaguuacguaucucuaaaaauauuguauuugggauuuuaaauuaauuuaauuuuauuuuuugagacagagggagugcaguggcgcaaccuuggcucacuacaaccuccaccuccucaguucaagcaauucuccugccucagccucccaaguagcugggauuacaggugcccgccaccaugccuggcuaaucugugucuauuuaguagagacaggguuuugcuguguuggccaggcuagucucgagcuccugaucuuaggugauccgcccgccucggucucccaaagugcuggcaugagccacugcgcccggcagauuuuuaguuuuuuuugauugguaccuuuaaagaggaugaaccuuuucaaccacauuuuuaguaagacuuaacucuaaggggggauuuuuuaagugcuuacaauucaaauuuuauaaaauuguuuucaauucauguacauuggugccuuuggaaacaaagguacauuggaaaagaaaagaaaaugggcuagcaggaaaauaccccauggaguaagaagagaggacacucugggaccuguacuauuauauauuagaguuauuugcccugcaaauucuagagaaagagaggaugacaauggcagccucauuaaagaucugaacauggaacauugguuugaaaaguuugaagucugagaauucuuaauuauaaaguaaaucccaguucuugaauuuuucucacaauaaugugucauuuauaauugagauuugcuuucgguauuccuuucgaaaaggugaaggccaaguaguuuuauuuauuuuuuuuuuuuugagauaacccgugaaaaaauuuuaaaucaguuuguauauuuuccucuucacuuauucacccuccccuucaguugcuccagaauuggguagcaauuuaagucguuuuuauuaugcaaaguaaagcaauauaaaacaggaugcauuuaaaguuauuuaaaacugauagcaguacuguuuaagaaauaugccuauuuacccaggaauauaauguuaacgaugacucuaugaaacuuggaggaaacaauaccagugaaaaggcagauggacuaagcaaagguaaaugcuaauuuugaaaugauccaauauuugaucugguaaacuuuaauuugaauaugacccaauauuugauuugcguuuuuucagccuaauauuguaauucuaguuuuggcuuuguacuguacaaaaauuuaggaucucuuuuuuaaaaggucuucccugaguacugauaggaaagguuucaugaaggagaugauugaauuggguaguauaacauuuagagaacuggggaagagcauuuuggguugugaaaaaaaaucucaugaaaggguacuuuaaaaagagcauguuuuauucugggaccucagugaauuuuguuguauuuaaaauguaauaugcauggauaacagcagauaaugcuagaaagcuagcuuuagagccaaauucugaagucauaggagaaauggaaagagaucuguggauuuuacuuaaaugacccucauaaagcuuauuucuaaagauagauuagagcagacugaaaauauuuuaagaguaguaggugaaaaauuguaaauaacaauuggugcuauuacuuaaguuuggaacaggaaagaaauagaaagguggcgaguuaggguaagaugagguuuuuuuuguuuuugauuuuguucuguggucuaacucaucuaccuagaugaguuagguagaugaguuagcaguagaaggaaagaaguaagguugaaggaaaguauagauaaaugaguggauuaaaagauaggaaaauugagauuuuuauggaagauaccuucucauuuucuuuguaaagugaaauaggucaucuuggaauaaaaggaguuauaaucuaggcaaaggggucaauguaguauggaucauucugguauggaucauucugauaaauggguaggggagccgaacaguguuuaguaaaaagaguuaccaagugacacaaggugacaucugagauuugaacauguaaauuuauaacagcaccuauuugugguucuguugauuuuuuuuuccaauagcucuuagcugccuugguacagcaagacauucagcuaguguggggaugggcuggaugaguacaaagaaaagacugggucauaaaaauuugaagguacuuucuaauuagaaaugaggaaauacuagauuaggaaaaaaguagagaaaauagaguaaugaaaggaaugaagaucuuaagaaaacugaaaaucaguaauuagaaaaccaagguuuuaagagggauaauacuaguuucuaagacaccuuacuaauacuuuauauuugcauuuuucuuugaaauagacgcaucuagauguagugaacaacccaguauuucagauaucaaggagaagaguaaguuucgcaugucagaauugucuagcucccgccccaaaagguaaacuauuaugguuugauuaugucauauguuuauuuagacucuguuuucuuauguguaaaagagauagaggcugggcacgguggcucacaccuguaaucccagcacuuugggaggccgaggcgggcggaucaugaggucaggagauugagaccauccuggcuaacacagugaaaccccgucucuacuaaaaauagacaaaaauuagccaggcguggucgugggcgccuguagucccaguuacccaggaggcugaggcaggagaauggcgugaacccgggaggcagagcuugcagugaguuaagaucgcaccacugcacugcagccugggugacagagugagacuccgucucaaaaaaaaaagaaaaagagagagauagagaugaccaugacccuuauauuuguuaaguaguucuuucaaauacauucuuuuauuugaaacuaccaagaucacuaugacuuaggcagauagaguauucucauuuuacagaugaagaagaaugauacugaccuauaaaagaaaugaauugguaaauuuuaauaaucacucaucuuucuacuacuuuuuuucuauuuugucaaggaacuaagaucuagaucuugggauuuuugcuuuuuuuugagauuuuagaaguuuucuuuauggauuuaaggggaugaaaacugaagaauauuuuauuagauaacuugacaaaagcauucuugaucguuucaguucuucacauguaguggaaauaagacaugauaaaguuauuuguggacaguauuauauuaacauagacuagagggagaauuugaauaaaagauguaauuccccucugaucuugucuugaaucuguuaacuuuacaaacuucauuuaucuucugaaguaggucuaaaaauugggcuuuuguuguauugucuaccaucaguaucuacacaagucaucgcaaauuugucucugcuagcuauuucaucaacaaagguuuugaaacuggcuauguuaauuguucugucauuaauagcugucugaacuaagcacaaagccagcacucaucaguguuaucuaaaucuaauugcuucagauuuagauaaaugacaaauguuacaacuuugaacuuaucauaaaccuggguaacacaacacuguuaauuggacaagaucagauuaaaggacauagaaauaauaauggugaggacaugagaaaaacuuaacaacagcugacacacauguuauagcuaauaguuauguuauuguguaacaggcacucuuuuaggggcuuuugcauguaguaacauuuuauucuaugaggauuauauuuuuauuucuauuuuucuuaugaggaaacaggcauugaagaauauuagguaauuuacuuaaaaucacauaacaaauuacugguggaaugaggauuuaaagcuaggcagucugacuucagaauuuauugcucuuaggcacuuaaucacuguuaaacuuucuacacaaaauuuaugaaauuuccuauugugaaagaauuacauuuuugccuuuuggcugcuuauuucauuguguuagaaguauuuucuuugauaagagccaauucuuuuuucuuuucuuuucuuuuuuuuuuuuuuugagacagaguuuugcuccugucgcccaggcuggagugcaauggcaugaucucggcucacugcaaccucugccucccggguucaagcaauucuccugccucagccuccugagcagcuagaacuacaggcacgcaccaccacaccuggcuaguuuuuguauuuuuaguagaaacgggguuucaccauguuagccagucuggucucaaacuccugaccucaggugaucugcccaccuccgccucccaaagugcugggauugcagacaugagccaccgugccuggccacgagccaauucuuuuuuguuccaguuuuauaugcuuuaauugaacuaccaaauauuaaaccugguauugaaauuuuuaauuuuuuagaaugacuuaguuuuucaaauuuauuuuauuuuauuuuauuuuauuuuauuuuuuugagauggagugucgcucugucaggcgggcuggugugcaguggcgcaaucuccgcucacuggaaacuccgucuccuggcuucacgucauucuccugccucagccucccgaguagcugggacuacaggcacccaccaccacgcccggcuaucaaauuuauuuuaauaauagugaaauucgcuggguguaguggcacgcaccuguaguccuagguacucccgaggcuaaggcgggaugaucacuugagcccaggaguaugagguugcagugacuucugauugugucacuguacuccauccugggcaaaagagugagacccugucucaaaaaacaauaacggugguacuccauuuuguauaguuaaugcaucuaucugguuaugaaagcagaaugcuuuuagcagaucugacuuucauuugucaaaaucuuuaaaaaauuuuucaaaaaauaaaugaguaggacaaaaguuuuuuauugcauuuauuaaacauguuuguauaucuuauuuugcuuuggguugguccaaaaauuucuuuguguauacuuaauuuuagaagaaaaacugcuguccaguacauagaaagcagugauucagaggaaauugaaacaagugaauugccgcagaaaaugaaagguaacauguaauagauuugauuugauaauguguccuauauucuaauguccuguuuugcccauuuuuauguuuauuuuuguuuuauuuuuaggcaaacugaaaaauguacagucugaaacuaaaggcagggcgaaagguauguguauacuauauacccauaaucuagacuucaagauuauuaaaguacagcuccauugauuuguaucucgcuagguuggaauguuuuaguaauagcucuuaaacuuggcugauguuuacauuugaacucuucauggagcuaaccauggguuuuaaauuaauuuuguaaaggaggaaaagugaauaaauaguugcaaauuaaaaucuaagggauaauaauauuuaaacuauacuuaaaacaauuuucuacuaccuauaaaaugacuucaauaaaaccuauguguguaguaugaauaguaauuacaaaauuagguugagaaugucuuccuggcaauacuauuauuguuuacauuauuauacagaugugaaaauaaucaaauuuuuucuuuuucuuuaaaauauguuuuauuuuccuguaauucacaucauacuauauuucucauucguugagaaauuguauugcauuuggaaaauaacugaucaucuugacugaucugaaaauuuggcagccuuaucauuaggaaucaaacuguuuguuuccuugaaaaauucuccuuccaccugagagccgaauuacuuugcauaugacugcuccuacuuucauuucuucuccucaagucuuaccaugaaugacuacaucguuucucugaguugaaaagauauccuuagugucagagguaguaauuuugguuaccaaauauuuuaacuuaauaauauaagcucuuacaauagagggugaaaaugauauucuauuucuuacccuuagaaaguaccuguacucuagcacaggagauaauuugaaaaaaauuuaagauucuuuguuguuuuaucagcaggaucuucuaagguuauagaagauguggcauuugcaugugcauuaacuucaucuguuccuacaacaaaaaagaaaauguugaaaaagggucaguaaauauccuuguuuucuaguuuuugguuuuuuuucuguuuuugaaugaaaaaauuuaaaauuuuaaguuauaaaaccauauuacaagaaguuuagaaaauagagacuauuuuuuaaaguauauaacccauuaaaagaacaaagcuaccucauaauuuguuuuccuuuuggugcauuuuccuacuguauuuguuuuaguuagggccaaaaugugaugggggcccuuacuccucugaauagcagagauauuucuucuagugauggcacaaagcaauuuguggcugcuuuaaagcuuaauuuaauuuugguuaauuuaaguuaaagguuuaauuuuuugguauuagaauuugcuuuucauuuuaaaauguuagugaucuuuguuaugauuuuauauuuuguaauucauaggaaaacaacacugcuuaagagacuaaauauuugagaugggaagagauugaacuaagguugagaagaucugagacaaauuauaucucugccccuuggucuccauuauuuuacauguuggggauauagcaggcuaucuguuuucauauagcauaugauguaaugaugagagaaauauacaauaagcaagucaauauaauuuuaaauaaugagaaguaaugugaagaaaaaggaggauaaugaaguaaagauugaccugaaggggcuuguuuaugaagcuaacauagacucaugagaaagagccgacuuuugguccaagaaucagauaauuaggaauagaaaauauaggcauguuggguggauuauucuuuacccuaauuuuagaaauuuaaagaaauguggaaauuucgguugagauagaauuaaauuacacauuagaaaccacuuucaguugcagaugcauagcugugauacaagagagaacauuuucaaagucacagcugugugucauuuugguuuuaaccaaacuaaguauaucuuugaaagagaagcagaauagaaacaaaacucugugaauggagacagaagccauaauccugauuguccuugugguagauagugaucucuuuaguaagacacaaaaggucauaaggaaaagauugauuaaaugccacuacauuuuaaauuuccaugcaucaaaaggugccauaaacaaaguaaaaaaugauaaaacugaagaagauaauguguauuaaguguaacugacaaaagguucaauucuagacuauguaagaacuuuccaaacaauuggaaaaagaccacccaauaggagaauagucaaaggauguacauauggaguccauagaaagaaaacccaaauaaccaguuaacacuggaaaaaauaugcugauucagaauuauuggggagaugcaaauuaaaggaauaguggcagcaggcaugguggcacaugccugaaauugcagcacuuugggaggccgaggcccaugaguucaagaucaggggugggcaacauggcaaaauccuguuucuacaaaaaaauacacaaaauuagccaggcaugguagcacaugccuguagucccagcuacuugagccugggaggucaaggcugcagugagccauaauagcgccacugcauuccagccugggugacagagcgagaccaugucucaaaaacauaaaauaaaggaauagggggaugcucuuacccuucauauuuucagacauuaaaaaaucucacaaugccaaguauugacaaaguugugcagcaauaggaauucgugcauuguugaugggagcgccaauuaccaaggagagcaacuggacaaaaauauaaugaagcugaauauagaccaucuguaacucuguaaauauaaauaaggagacaugaaaaaaugguuuucauugcagcauuauuuuaauggaauauuagaaauaauguacauguuguccaguaggggaaugguaaauaaauuguaaucuacuuugcaguaugaugcuaugaauugguuaaaaugaauacacuagagcuacaaauacuaauaaguguaaaucccaaacacaguuguucuuuaucugcaguuucacguucuacaguuucaguucuaaaauauuauauacaauaagguauuuugagagacagagaaugaccacauucacauaaguuuuauuacaguacagucaucccucaguauuugucagggauuugguuccagggcccccuguguauaccaaaaugugcgcauacucaagucccacagucugcccugcaggacgaguauauaugaaaaguuggccuuccauauacaugaguuuugcaaucagcagauacuguuuuuuuguuuguuuguuuguuuguuuugagacggagucucacucugucgcccaggcuagagugcaguggugcgaucacggcgcacugcaaccuccaccucauggguucaagcaauucuccugucucagccucccaaguagcugagacuacaggcgccugccaccaugcccggcuaauuuuuuguauuuuuaauagagacggguuucaccauguuagccaagauggucuugaucuccugaccucaugauccacccgccucagucuuccaaagugcugggauuacaggcaugagccaccaugccuggcccauucuguauuuuuuuuuuuuuuuuuuuuuuuuuuuuugagacggagucucgcugucgcccaggcuggagugcaguggcgcaaucucggcucacugcaggcuccgcccccugggguucacgccauucuccugccucagccucccgaguagcugggacuacaggcgcccgccaccucccccggcuaauuuuuuguauuuuuaguagagacgggguuucaccguguuagccaggauggucucgagcuccugaccucgugauccgcccgccucggccucccaaagugcugggauuacaggcgugagccaccgcgcccggcccauucuguauuuuuaauccacguuugguuaacaaaaauuugcauguaagugcaucacauaguucaaacauauuguuuaagggucaacuguauauuguuauaauuguucuguuuuauucuuuguuguuacgaaucucuuacugcaccuacuuuauaaauuaaacuuuauuguagguauauauagggaaaaaacauuauauauaggguuugguacuauuuaugguuuuaaguaucuauugagggucuuggaacauacccccaguggauaaggagggacuacuguagauagcacugagagaaaaaagcaaguugugaaugauacguagauacaguaugauacuuugcucaccuuccaguuuaauuuugaaauuagugugaaaauacaauuuuuuaaaaacucagaaauuugcauuuuaaguuuacuggaagauacuccauugguaagggauaccaucucuagaauuuauuucaagaauuuguaaaaacacuuuauuaucacuauuuuuaaacaugcuccacagaaaaguauuaagaauuuuuguuguaauauauuaguuaccuauuacuguguaacaaauuauccuaaaacuuagccauuuaaaaucagacauuuauuaucucacacacuuugacagggcuggaagucggaguggcuuagcuggaugguuuaauggcuuauggucucuuacgagguugcagucaaacucuucuucaggggccgccgucaucugaacauuggacuuagggaggauccauuuccaaguucacucacauaguugucagcagaccucauuacuugcuggcuaacuguagucuucagauccucacuaugugcauccuuccauaaguugccugaguggccucacaucguggcagcuggcuccaccagagugaaagauuggagagagagaaugaguaugagagugagcuugcacacccaauacggaaacuucuuuuguaaucuaucucagaagugacauacuaucuucucugcuauauucuguuggucacacagaccaguccugguggaguaugggaggagauuacacaagauugugaauaucaggaaguagagaucauugagggccaucuuggcuggcuaccaaauuaaauauaacacaaauucagaaaacugcauaaaacaaauguucgucuuaaugaaugacuaugacuaucagaaaauauuagagacuuccuccuugugaccuacucucugucauaguccuuugguucuucucauaaucacuauguggauuuuuaguuuuuuuaagugaugagguaaaauuuauucccuguuaaaaguccaucugcuucauuuuaauuguuccuaauuuaucuuuucauggaggcacauuauugccaucuccuuauugacauauauauuucagaaaaacagcuaaagguucuaucagugguucauuuuuuuaggagcuugugcaguggaggggucaaagaaaacugauguugaggagagaccaagaacaacacugaucaucuguccgcuuucuguguuaagcaacuggauuguaagucuuuaagcccuuuaaaaauguaacauaauuuauauuuuaucuacaagguagaaaguauucuguuaaagagucauucauugggguaaauauacuuggucaucaguucguaucuaaguucaaauaaucaucaggugaauuggauuauguuugcugaauugaagaaauuuuucuuugaagauguguaguagagaagaagguaaaggaacauaaucaauugcuaacauaagauuugguuuguauuucugccuuugcuauuuuugucccccaaagugggaaagauguauaguuugacuccucuacauuuacagauugacuguuggaacugucuuuucuaagagcuauaccaacaauaacuuauuuuuauaacaauaacaacaguuagugaacuccuguuuauuugguuuguccuuaaccucuuuuaaggauuuuucucauuuaauucucauaacuguuacccugauuuuccaggugcccacauugaaacacagagagguuaaguugccuaaggucauccagcuaauaaaugauggaucuuguauauagucuccaacauuuugaaucuagagccuguccuuuuaacacuacccaucagaaauuuuuuuuuuccagauugcuuuucuguucugaaacauugacauuggaauggaaccucuugauuaauuguuuauuugcagccuggauauguuuucuuccuaguuugagcuucaaacuucuuguuaugaugaaauaaugacucucuuggaaucccugugaauauaaggaccacucaccguucuugccacuuccaaguuaucuguuuaucucucaucgccauucuucuuaugucagaggaggaagagauccuacucuuuuuaagaccaguauuuagucucuacauuggauucucucuuuucccacauugcucaucuguucuuuuuucccuuguuuauuuagucucuucccacuggcucuuccugauacauacucagguuuuuucauuuuaaaauacauucucuugauaugcaucuuuaaaaguugcuacucuucugcuuuccuucacugucauacucuuggagguuaauuucuacuuugugcuuuuacuuacuaauuccuuaauucauuguaaucuggcuuguaccauuaguucucuaaauugcauuggaaaagacuacuugugauaguuuaauugucaaauuuaguggccucuucuuggcuuuauagucuuuuuuuccgugacaugaauuaucuuuuuuuauauaaguuuuugguuuauuuauuuauuuuuuaaauuacaccuuguccugauaaguguaucauuuuuccucuuaggaccagaagaaugaauguuaauggucuguugcuauuuuuuuauuccaacgaaacuguucuuucuuuaauuuguuguuuguuaugggaaggauaguacauggguacuugaauggcaguuuugggaugagguuuagaguauuaauggagguauaaacuaucuaacugauuauuugagggcuugggguauagagauguauuuuuaaaauggguaaucaguauuuaauuauaauuuuauauuuaggaaaguucaaguaauguaaaguucagaaaggaaaguguggcaaaaucuugccaagugagaucaugcacacucugugaauuuaaaggaaugagaggugguuuggcauuuagggauucaugguuguguuaguccauucuugcauugcuauaaagaaauaacugaggcuggauaauuuaagaguuuuaauuggcucaugauacugcaggcuuuacaggaaguaucgugcuggcaucugcuucuggugaggccacaggaagcuuacacagccucaggaagcuuacacucuuggcagaaggugauggggacccagcaucacauugccagagugggaguaagagagagaguggagaggugcuacaaacuuagaaacaaccagaucucguguggacuuagagugagaacucacucaucaccaaggggauagcacuaagccacucaggagggauccaccgcuaugagccauacaccuuccaccuccaggccccucauccaacucuggagauuacauuucaacaugagauuuggaggagaugaacauccaaacgauuucaaugaucaagaauuaaaauuucacaaucugaacaagauaccgucuuccuggcucucaaguaaaggaucuagcauucuacagagcaggcuagaacugacuuauauucccuuuuuugucuucaaauaauccagguaaaggaauagaaccuggguaccaauccuacuucuaccacauauuuguucuggauauuuagacaaguaaucucaugaaauaacaccuauuucguuuucuauugagaggaugauacauacauacauauacaguagagccuaacacugucuagagauggaguaacuauaguucucucccuuuauucuccagaaaagcugauuuucuucuguuccaaguguaaucccuuuacaaauaaugcacugucccauuucaaggccacccauugauucaguuuucucauauuggauucuuugucaugcuggauucuaauuuccuuuucuucuuuaccaaauuucuauaagaaauucuuugcauuuucagcuuuacuuuuucauguuuuauccucucugcauuuuugccuuuauuucauguuuaauacuuucuucaguccuugguagucugguuuuugcuuccacucacuacagaaacucccuuugcagagaucuucagacuucaauauugccauguacaaugagcuccccuuuuccucugccuugaauauguuauucauuuauuauuuguuaugucuuauuuuguaagcuaucucuaaaccuucuuguaaagaacuggaaugaagauagaugacaaauuaaaaguccaccuugguuuuuuuucuugaaacuuuuauauucuuuggaucccaggccuuuacccuuuauauuuguuguccuaacuuuuucucugucuuuguucugguuccuauuaaaucugucuuuucuguauuuccauacaacauauaauuuuuuaaaaagaguauuuuaaaaaauuuuaaugagaucuccaucuacucaucaagauucaaaaauuaccaaaagucugacacaugugcuuuccuuuuuuucuuugcuggauugauuuuuuuuuuuuuuuuuuuuuuuacagucuugcucugucgcccaggcuggagugcaauggcgcgaucucagcucacugcaaccuccaccucccagguucaagugauccugcugccucagccucuugaguagguggaauuacaggcacaugccaccaugcccggcuaauuuuuguuuuuuuaguagagaugggguuucaccauguugaucaggcuggucucgaacuccugaccucguuccgcccaccucggccucccaguguuggaauuaacaggugugagccacugcacccggccuuuuuuaaagaaagaaucucauuccaucacccaggcuggagugcaguggcacagucucagcucacugcaaccucugucuccuggguucaagugauucucaugccuuagccucccgaguagcuggaauuauaggugcgcaucaccaucaccaccaugcccagcuaauuuuuguauuuuuaguagaggcaggguuucgccauguuggcuaggcuggucucgaacuccugaccucaagugauccacccgccuuggccucccaaagugccgggauuacaggcaugagcuacugcaccuggccuggaauauuuuuaauuauaccccaggcaucauguguuuucucccaauaaaaacaagucuucuccuuacauaccgguauucuguagacucugucccuaacguuugcucacuguacaugcucucuuuaggaaauuucauucauucuuacagcuguaaauacugucuguuguuaacuuuaaaauucauaucuacaccucucacuucuaucuauagguaauuauuuacauuuuccuaguauacgucuucaguuagguauucuauagugaccaaaaaugauaaaggucuaaaauauucaucucuuucuuacuuggaugcccacuuuucccuucuuuuuuuuuuuuuuuaaacuuccuuauauuuuuaucacacaauucuagguagucauucaaguaucagagcaucuuagucuuauuauuauuauucauauuucauauuucauuaguccccaaguccuaucagucuugucuuaguuucuguuuuucacaccuguccuuuccacccuguuccuacuucuaccuugcugguuuaggacuucaucaucucucuccucauagcuucccagcugugucucccugguaucuucucuuuucaguuuaaucagacuauuuuuuucugcugaaaaucuucuaggucugguuuuuuucaugauuaaaaaaauaauaauaaguuuuuaaaacugaucauguccucaagaaagucagggaugauuauuuguucuucauuuuuaguuacaucacuauugugguugauaccuggcaaauaguaggccaauaauaaaugagugaaagaaaguggcuacagugcuugaaucucugcccacauccuuggaaauauugguuguuguucuuuuacuguuuaauuuuuauauuauuaagucugcuaacuaaugcagcauuaaagggccuucuaauuaaaauauuuuuauaaaacucauuauuguuuucaauaacuuugguuuuuccuccuaaaaaugaagcaguugcugauugguagggccaaguaaauuuuaaauaauuuauuauuacuguguaugugucauuuuucuuauuguuauuauuuuggucuagacugaaggaaacuugauuucauacaauuuuaguaguuggauuugucacacuacugccagggcaguuacuuuuuuauacaucuauuaagucugacacaaaucugcucauuguuaaaaauauuccuaauuuuucuuuaggaccaguuuggacaacauauaaaaucagauguacacuugaauuuuuauguuuauuaugguccugaucguauuagagaaccggccuuacuuucaaaacaggauauuguuuugacuacguauaauauuuuaacucaugacuauggaguaaguauuguugauacuuaacagaucuuuuaaagauugaauguaagaaauaugccacagguuucuagaguguuccaaaauucaggcuuuauacuuuuuuuuucucuuuagauacuuaacgauauauagaaaaauaaaugguuuuuuuuuuugacuuuuugcgugaaaggguugcauuuuauuuagaugcuaauuuaggaguauuuuucuuuucuccacuccuccccucccccucccucucgauggaguuuugcucuuguugcccaggcuggaauauaauggugugaucucagcucacugcaaccucugccuccugguuucagaugauucuccugccucagccucccaaguagcugggauuacaggcaugcaucaccacacucagcuaauuuuuguuauucagcagagaugagguuucaccaucuuggucaggcuggucuugaacuccugaccucaggugauccacccaccuuggccucccaaagugcugggauuacaggcgugugccaccacacccagacaggaauauuuuucauuuagaacauuuuaaguuaagauuuuaaauuuggauuguaaguauaugaagcaauuuguaaaugaauuuuauuuucuuuuuuaauauucuggaaaauuguuuucuaucacaaugauuugauuaauaucucaguuugaagguaugcuuuuuuuguaguuacaguucauaaguuuuccaguuagucuaauuguuuuuuaccuuuauaauuccaauuguucaaaaguuaaaacuuuuugaaaaauaccuugcuaucaaaauuucagucuucuaguaaaaauauuaccuuuuauauaaaagaaaguaauguugaauucaaguaauucuuacaacugccauuuucuauaucauugcuauguuuuaauccgagguagaacaguucaguguauugaccagugacucaacagagagcuagacugcugcuuggguuugaaugcuaguucugccaccuguggugcuuuggguaacauacuuacuuagcaguuugugcuucaguuuucuuaucuguaaaauuaggugugcuaauaaguacuuauuuuauaaacuugugaguauucaauaauuaauguagugcuuaaagcaguaccuagcacauaguaaauuugauauuaaauaaugauaacaacuaguuagcaaaucauauuaaguacuauuuuacuuuccuguguuuuuuaauucauauaaaacauuuauuucagacuaaaggagauaguccauuacauagcauaagguggcuaagagugauccuggaugaaggacaugccauacgaaauccaaaugcucagcagacaaaagcuguacuugacuuagaaucagaaagaagauggguuuugacagguaaucauagcauuaaacuuacuaaaaccuuaaaucucuaaaauauaucauuauguaaguuaguaaaguaacuuuguaaacuuaaaguggguguaaauucugccccaaaauuaaucauauaaauaauuuaaucaaauguuuugaguuguucuucauaauugcccgugauauaacaacauuugacuuauugauaauuuauggaacagucacuagacuuauucuugaaccuuggaaauggaguagacacucuaguggaaauggaguagacacucuagucauccagucauaaucuugauuucuguuucccauccucaaaccuguuugccauucacaguaccuuuacuagaagguaaggaaaagaauguaaacuuaaacuaguugcuuuuuccuucugcuagugcugcugcuuuaaaaacuaaauaagcagauguacuugauaaggagaaaguugaauuuuccagucuuuuucuuggcuagugugucaugugagagcuaaaaauuagagcaaaacuguaucuugagauguguauauuuuuaauaaaugauuauagucaacacuugauaguuuaauuuaauugauaaugaugagccugguacagagugcccauuuucaauuguugucuucucugauugggccaaauagauacucuuacuggauacucugguuaaagaguuauaacaguuuccuguuauuucuagguacuccaauccagaauucuuuaaaggacuuguggucucuucuuuccuuuuuaaaacuuaaaccauuuauugauagagaaugguggcauagaacaauacagcguccugucacaaugggagaugaaggaggacuuagguaaguacuuucagacagugauuaauauuaguuacaaauaacuguuaguagcuugaaccaguuggcacuuucuuuacuauuuuaacuugacucuuaacuuuuccuucuaaaaaguguuuauggcucaguaccuuugucuuucagaaccuagugaugcuuguuuggaaagacaaagauuucuaauugucgauaacuacccuuccccuguuguggcuaaacugaaaggaaagacauaacuguuuuuuguguguugcuaagccccaaagccccaaaaccagcauuaacagauuuagcaggaaacaucguauauccuuugaggaucuaauaugcauuaaguuuucauaucuuauauagcuuuauuuauuuauuuauguauuuauuuauuugagauggagucuugcucugucguccaugcuggagggcaguggcgcgaucuuggcucacugcaaccuccgccuccuggguucaagcgauucuccugucucagccucccaaguagcugagauuacaggucugcgccagcaugccccgcuaauuuuuguauuuuuaguagagaugggguuucgccauguuggccaggcuagucucaaacuucugaccucagguuauccucuugccucgaccucccaaagugcugggauuacaggcaugagcuaccacaccuggccuuacauagcuuuauauagugaaugaugugagguaccaugaccuuagcaaaaguuguauaggaaaguuuuaugugguuguuucugguggagauagauaaaaguugagaacauaaauuaaaacucagugauagccauuuugcaagauguaaugugguucaacuuuuuggcuaaagcaccgguuuauagacugaagauuugagagcuauuagugggauauaaaaucauuauaaaggugguagccagcauuuaaaaagacaaugaaauagagaagagauuaguaaauaucggagugcaugauacauaguaaguauuauuuugugaaauauuuguuucuuuuguauguguuuguauauuuuugcuggauagaauguguuucuuacugugaguuauagugagaaagcuucaagagccacuaaccuaguuggcaguacuauccacuugauuccucaaaaccaacuauuuaaacuccaggaaauuguauuuauauuucaauguugggaaaaaacaagaauugauacaucucuuuuuuuccaguacugagaaagaaauguaaagauuguggaaccuguaaagcauuuuucuguguucugaauuaccauauuaucuuuuuauuuugggggcacucauuacuuuauacaauuacuuauuuauauacuuuugauuuuaauauuacagaauguaguaucuuacccauauuuguauucuuacaacauuuaauucagugccuggcacuuaauagauacuuagaauuugaguguugacuauucggugauggaguugacaggacaguugagaaguaaaagaguuagugauuggaacaaaaauggggaacagaacuuacgaaaauaaggacaggauauaaaaagauuaaacuauguuagguauugaggggaaauuuccauacauuuguuuuaauaauuuuauuuuuguagaauacuucugugauuaucagauugguuaaaaucccaaauaagggauuuuaaaaacacuuuuacagaagcuauaaaacaguaacaaauuaaaauguucuguuucguucuucuuggaucaauuuauguagaaauuaaaaguuacauaauuauuuguuuuauucugauuaggcguuuacagucccuaauuaaaaauauuacacuuagaagaacaaagacaagcaaaauuaaaggaaaaccuguuuuggaguuaccagaacguaaaguauuuauucagcacauuacacuuucagaugaagagagaaagauuuaucagucugugaaaaaugaaggcagagccacuauuggaagguauggagaaagaaaaccauguuaaaaauuaguuuuuguuuacuuuguuucccauucacugaaugacauuauuuagauguguuagcaauaguuugaaguauacugaaagauaauuugcuucuaugaauuacaguguuuuuuacaaaucaauaaagugaaugaaauaauaguauaauucaccagguaaguaauuuuuuaaguuaggaaauaauuuaaagcuuacuuuaaaugacaaguucucaauugcuagccagaagauuuugcuugcuucuauuuccaaaaucguauggaaaucuggaaauaggaacugaugaaauagguuuaacaagaagauuaaggauugguagaagguaugaaauucugguccaagcaagaucagguuuaaugugagcccacagggaacagaaugaauaagagacaagugaaagcagaauaggacugugaaaggggaaucuucaaaacauaaaaacuucagugagguagguacaaagcagguuugauaggaauuagagagagugggaaagauuguucuaagcagcagauuucugaguucaaaaucuucuuucuuuucauauucuuucaacaaaaauuuauuaagugcccacugugugccaggcacuuauacccauugggauacagcagaauaaaacagacaaaaaugccugcacucgaggaauuuauauuuuaaugggaagaaacagauaauuuaaaaacaugauuaaguuuuaaggaauaaagcaacgaaaggggauggggaaugccaaagcuguuuuaguaggguauuaaggaagaccucacugagaagaugauauauagguaaagaucuaaaggagauugggauuaagggguguuucagccagaaggaagagcaaguguagaugcucccaguugggaacaugccuggugagcuugaagaauaacagagaagcaaguguggcuggauaguaugaacgagagaaaauagucaugauaucagagauuuauuggaauggggguauguaacgcauaugucaaggacuuuggcuuuuacuuuuuaugacaggaaaccuuaaaggguuuugagccaggagagggacguaaucugauuuauauuuuuaaaagaucacucuggcugcugugcucagauuuagguuauuugaauaggaauaaggucagaaguagggagaccaguggcagucaaagcaagagaugauggugguuuuuaccauaguagugauaaagggagugagaaaugauuagauucuguuaaauugugaacguagaaccaacagaacuugcugguugauauguuauggcaugugaaagaggaaucaaagauaacuucaagccuuuuuaccugcauaaguggaaggcuggaauugcuguuuaccaagacaggucuaugggaagagcagagauuuuuuuaagcuaagaucagaagcucaguuuuggacacauugaucauaggaugcccgugaauuuuccaaguagagauaucaaauaauuaguuggauaggagagucgaguucaaagucagcuauguguggaugguaauuaaagccaugagaucaccaagggagugaguaaagugaaagagaucuaacugugaagauagcaauggcuggugaaauaggaggaaggaagcuucuaauauuuagcacaugguaggcacucaaaagagaucucuuaaauugaaaugcugaguaucaguaagauaugaccaugccagggaauaauuaguguuaguaaagguuauucuauuugaaaaaguugaaaaagauuaacuuuauugaaacuguucucagaaaauaaguuauuuuuaaaguauucuuuuuaauaggcuauauauuuacuaacauuuauuuagcacucacuagguguuauacauugaucuuagugcuuuaaauguauucacagcaauccuauuaggucaguauaauuauccacaucuuauaagugaggaaacugaggcacagagcaguuuaggugacuuacacuguugucacacagcuagugagugacaggacagauuaacucuggcacuuugguuuagagcuuguaaguuuaaucuuuguauuauuuugccuauuccuugcauucuugaauauucagaaauguuuguugccauaauacuaccaguacuaauacuagcaacagauucauguauagcacuuaauauaguccaggcacuauuuuaaauacuuuacauguauuaaauuaaauaacaguaguuguaugagguagguacuuuuacaaugccacuguuagaacugaggaagcucaagacauagguuaagcaaccuguccaagguuacauaauuaaauuggcacagccagguuuugaauucaugaccagcuagcucuaaaaauuuguacucuuagccguuaggcuauauuucuucuguugccuuaaaauacuuaaauaucagauggccugguuauauaauuuuuggaucacccauuuccuuaagaaucuauguugucauuguaccacuguauuuuguauagaauguuucuguggggaagccugguuuuuuuuuuuuuuuuuuuuuucccucugaaguucagcaacuucuuuguugacuuuccccugggacaugugauauuauuuaaaucuuuagauuccaggcuuuuccccccuucucuuuccuggaaagcuuucuuuaaauauuguuuucuguuccauuauuuuauuucucucuguguauguuagaugucuuuuaucuguguuccauagguaucauuuuauuucugaucuuuuacauuuuuuuguuuaauuuugauuuucucaguccuguuuccuacauccuuuucuauguuuuuaucagugacuagucuuuuuuuauauuggcuuauauugguuucagugugacuuucauuucucugaugauucacuguuuucuuucacuuucuugagccauaccagcucaucuuucaucucuuccuguucucuugccauauuuuuucaaagcucuuugucuuugcuuuaagauuuuuuuuuuuuggaggaauuguuuuauugagugguguuaaauugugacaguauccuuggucauaauuuuuauuugcucuguggcaacauuuuucugcugaguuuucuuucacugccauguguccccuaccuuugcucucugcugauuauuacuuauauuugaauaucuugaguucuucuuggacuagcuauuugcuaguccagauauacaaaagggaaaggucacaaucauguccccgaccagcaggaaauaacccaauuuacuuaagacucaggguuacauguugaguuacuuuagguuuuauuaguacacauaaacagagaucagaaacuuuaggggugcuuggaguguagagugcugugcccauagucuuuuuuugaaaauacagugcaccuguauguuucuguauucaguuuaccuucccucuuuuuuugauauaaauuucuccauggaagcucaagucaccaagcaugcacccuguuccuguuucugcacaugagagguauugauuuuccccucagggcaugccauccauuuuaaagaauuguguuuuggcagcucuguuugagaucugcagucaucccucucagcaucuuccuaucugacuuagacugcaauuggcagccauuucucauauauugugccuuauuguuauagaucucucuugguuuuauuagaguugcuuuucugcuuuucauucuuguuuuggaguaauuucuagagaagaaaagaaaaaugccauuuuacucugcuguuuuagaauaggaaguuauuauuguuuagcggacuuaauaauauuugacauuuuaaucucuagguauuuuaaugaagggacuguccuggcacauuaugcagauguccugggucuuuugcuuagacugcggcaaauuuguugccauacuuaccuucuuacaaaugcagugucuuccaauggccccucagguagguaaauuugauugcuucauaucauuguauuugucagagauacuuaaauaagagugauaaauuuuuuuuauguggcauacauuuaguuuauuuuguucugucaaauggagauugcuuuuagugugagacucagcuaggaauacauccaauaauuuuuuuaccaaugaaauggaauuauaaugaggucuuuccaggaauuccggugauagauacccuuugaugaaagauucauauuggaucugccuuuuauuguguggugguauguuauugucauguuauaaugaugcuucucuaugagguauauuaugugaguuggcuacuauuuuggcuucugaauguuucuuaaauuucaaauuuaaauuaugcuuuuugccuauggcagaaaaugaugagagacuuucccuacuggcaagcgaaacuuuuccuuauaagauagauuaacuugucauauuacaaaccuugcucugaaauuaauuuuucagccuuuucucuaggaaaugauacaccugaagaacugagaaagaaguuaauaaggaagaugaaguuaauucugagcucagguucagaugaggaaugugcaauuugccuggauucuuuaacaguuccugugauaacacauugugcacauguauuuuguaaacccuguauuugccaagucauucagaaugagcagguuaguuuuuugcucaguacagguucaguguuugauagaguaguguaccugucuuuaauauaauaaaagauaguauauggaguuuugcacuuggauuuaauaauauaccuuugauaguuaauuauuccaguauuuuaauaggugauauauuucuucuaaugcaacauuugcaacauaaaaagauguucacagucaauaucuuaauuccgcuguuuauaucauugcuguucaauaaauggauugauaaugugagacacaaagauaauuuucaguuuucuaguagucauacucuuaaguaaaaagaaacauuaagcuaauuuuaauacauuuguauuuaacccaauauaucuaaaauauaaaaaguauuaaugugcuuuuuacaaaaaacuaaaucuucagaauuugguggugguguauacuuacagcacaccucaauuuggcuuagccacauuucaaggacguaauugccccaugugauuauuggcuauuguguuggauaagguaggucuagauucuuuugugugguagaauuuuuuugaaguugacuagucuguuaagcagucauucagcugggguagaauuuuuuuaaacauuuuaaauugauauauaacauauguagaaaaaauguauaaauucauaauuaaauagcucagucaauuaugagguaaacauauuccuguaucugcugccuagguccccuuguggccccucccaaccauuuacccucucccucuuccccaaaaguaaccccacuguauugacuuuuaaauaauuuuagcuucagaauuauuuaauuguaaugguguuuuauauauaguuauuuaagauauaaucuuauuuuauuaacagguucaaacggguacaacagauguugcuuuggaaugaacuugauaggauuuaacagauccuaguagcuuuauaagcuauuauaagcuuuauaagcuuaauagcuuuauaagccauuaagauggauuuuuuuuuaaagaauaguacuaaauaguguagcuguauuguauuuagguucaauaaauuguuauucauagauuuuuuuuuuaaacuugcuuacaauguuauaauuuuugguuucuugcucuugcuucuagcuaguccagaucacauacuuuugcucccuccuuuauccguucuacuuaccacauuaugucuggaguucagcauguucagaugucucuuaaauggaugaaauccauuaaaagguuuaauaaaauguuagcuaugagagauacagauuuuagcauacauuuaaaaauuuuuaggcauauuuauauuuguucuucuguuaaguguugcucauacuucguucuuucuuauauagccacaugcuaaaugcccuuuaugcagaaaugauauacaugaagauaauuuauuagaauguccuccagaagaauuagcacgugacagugagaaaaagucugauauggaauggacauccaguucaaagguaaaguacucaugugcaaauauuugaguauuuguuuuaccuuuauauaaggaaauauacacaguauaucaaaaucguaauucugcuuucauuccugucauuuuaguguucuguuguugaccacuggcuuuuuauuuuuaguggugaauuugaggggaaauggaauggguucagauuauuagaguguucuuucagucuuaauuuuuuguuuuaaaugaguagucuuuugcauuuuagggaaauaacauuucaggaccuuuucuuuaugauaaaaacuuuuagacuaauuuuacugauuuaaaauggaaucuaauggacaucuuaauauuuuuugcagauuaaugcgcuaaugcacgcauugacugacuuaagaaagaagaaucccaacauaaaaaguuugguuguuucucaguuuacaacauuccugucuuuaauagaaauaccacuuaaguaaguuccacaguguuuuucacuuucaguaaaaggauuuuauauaaucauauugauuuggauagcaaaaaaaaaaacuuaauuuguuuugccaguuuuagucauuuuaucugaaagauauucagagucacaauagagaauacuuccuggcagcacaagaauuuaaagauuaaguccugaauuuaucagaaaaugacugacucagugccuagcauauuaauaaguguucaauaaacauuuguuaaaauaaaugagugaaagaauuuauugaagagauuuguaguuacuuaacuuuguuuuauuuuuauaauaauaguguuuguuacuugucucuuuucuuccccccuuuagagccucuggauuuguguuuacucguuuggaugguuccauggcccaaaagaaaagaguugaaucaauucaguguuuucaaaacacugaagcaggaucuccaacuauaaugcuucuguccuuaaaagcagguggaguugguuugaaucugucugcagcuucucgaguguuuuuaauggauccaguaaguaguucuguaaauuuuuucagaaucuuaguacuucuuucaaaaaaauaagacaaaaaacuauuugguaaauaccuucauaguuauaauuaacugugaaaauucuuaggcaaacuuuagaaauaaauaacaaaaacuuaguaaauguggauuaagagcuuucucuuaagcacuuuacugaaauccucacaacauccuuaugagguagauaccauuauuaaaugcucuguuuuggccaggugcuguggcacaugccuguaaucccagcacuuugggaggccaaggugaauggauugccugagcucaggaguuugagagcagccuaggcaacauggcaaaaccccaucucuacaaaaaaaaguaccagaaaaguuacucugguguagugguuugugcuuguagucccagcuacuugcagggcuaagucggaaagauugauugcuugggcccaggagguugaaguuucagugagccaugcuccugucacugcacuccagccugggugacagagcaagaacccgucucugaaagaaaaaaaagaaaaaaaaugcucuguuuuacugaagaggcaacugaagcacagaaaaguaaauaaugugcccaguaucauacaguuaguaauaggcaaaaccagaaucauaguccauguaaauauuuaaguacuauuaugcuaugcuauucuacuuuucuucuauaauaaauauuaacuguaaugcuuuuuaggguagugguucauucagccagcaaauaaugagauccugcuuugcgucaguuuuuauaggcacugggaaucuaacuauaaacaagauagacaaaaugauuaccaucacgguucuaguagucuuaagcuuuaaugugcauaagaauuagguaaaaugcaauuuccuuugcauucaacguagagacuuaggaguucuaggauuagacccaggaagcugcauuuuuagcauauaucauaggugauugagguacagguggucuaggaucacaauuugagaaacaaauuaucauuaauggaauguucugaguacguuuuaaugccuaauauagugcagucaguugugguuguguaguacaggcaugaagguagaacagaggcuaaaauucacuuugaacuuuacucaccaagcugugugaccuggacgugcauucacauaggagcguguuuuucuacguguacaaaggggcuguuuggccugagaggaccuuggacuaauucaguuucuaauuugcacuggguacuaugugggcuaaaggcaacccucugcuguuucugugcauucagacuuaagauuugugguuguaacuuguuaccugaaacucagaagauuuuuaacauguaggaauucuacugagauacauguaggaauacuacugagauauaaauuuuaguuacuugggugaggcuaccuuguugaugcauauauguuuacucaggcuuccuuuuuccucccucaacugacgguauccuucucaguaagauuauaacuagggucaucauacuuaggccuucaugggugaauaucauggauaugguauggucuguuguauuuucuuuuuucuuuuuuuuuuuuuuuugagacagagucuugcucugucgcccaugcuggagugugguggcacaaucuuggcucacugcaaccuccaccuccuggguucaagcgguucacugccucagccuccugaguagcugggauuacaggcaccugccaccacgcguggcuaauuuuugcauuuuuaguagagacgggguuuuaccauguuggccaggcuggucuugaacuccugaccucaugauccaccugccucagccucccaaagugcugggauuacaggcaugagccaccgcgcccagccggucuguuguauuuucuugccuuuguacuguggaugaaguuugaaaucuuuguuugcaguauuuuauggcuacuauaaaaaauauuuguaacuauagauuguugaauauuaauuaauccagugauaauucuagaagcugauuuuuagaacaaaucccaaauuuuauuuuucuugcuuauaaucuuaguaccaaagagguuaauaccaaaauaauuaguaugaaaaaguugaucagagacuaaacguguuaacaguuuuuaaaaauuuacagaacguuuuagcaguuuuauaguaaguugaguguucuucauugaacauaucaagcuuuccaauguuguuucuaacuuaaaagucagguccgagaaacauaaugauucaauaaaaaaauaaaaauuugcucaugaaagucuuuuaccauuaaauuuuuuuuucuuuuuuuaagagacagggucuuccucuuuugcccaggcuggucucaaacuccugagcucaagcaauccucccucagccucuugaguagcugggauuacaggcauauggcacugugcccagcuuucuuuuaccuuuucauugaacauuguauaaguauugggguaauauggccuggcgcggaggcucaugccuguaaucccagcacuuugugggaggccgaggugggcggaucaugaggucaagagauugagaccaucuuggccaacauggugaaaccccgucucuacuaaaaauacaaaaauuagcggggcaugguggcaagcgccuguaaucccagcuacuugggaggcugaggcaggagaaucgcuugaacccaggagguggagguugcacugagcugagaucgugccacugcacuccagccuggugacagagcgagacuccaucucaaaaaaaaaaccucauaguuuuaauuuaaaauuuaaugauccuuauccaaacaauucaugauacuauuuaaaaaccacuuaccaggggucuauaucuuuuugguuauucuucccuuuucauuguugcaccauuuuauugcuguuguuguguuuuuuguuuuuuguuuuuuuuugagauguagucucgcucugucgcccaggcuggagugcaguggcgcgaucucggcucacugccagcuccgccuccuggguucacgccauucuccugccucagccucccgaguagcugggacuacaggcgccugccaccacgcccggcuaauuuuuuguauuuuuaguagagaugggguuucaccguguuagccaggauggucucgaucuccugaacucgugaucugccugccucggccucccaaagugcugggauuacaggcgugagccacugugccggacccaucauuuuauuuuuuagcuuaaaacaguucucaugaucaugucuguguuaauuagcuaaugguacuuuuuuuagcucagcuuuaaagucaaacuaacgucaaauacugauacagaaaauagcaucaacaaaaaaauaauuuuuaggacuuacugacucuuaaaacccccuuuuuuuuuuuuuuuuuuuuuuuuuuugagacggagucucgcugucgcccagucuggagugcaguggcgcgaucucggcucacugcaggcuccgccucccgggguucaggccauucuccugccucagccuccugaguagcugggacuacaggcgcccgccaccucucccggcuaauuuuuucuauuuuuaguagagacgggguuucacuguguuagccaggagaaacccuuuuuuuauacuuuuauuucaugaacagaggaaagugaaagaaaaccagaaaagggggagaaaacuaaauaggcccaagaauugugucuuuucucauauaaauuaagucauuuaagaggauguauaaccuuuuucugcuguuaagcacacauagauucuuuuaaaaaugaaaaaaaaaaccaaauugauuaaucaacaaauacuuauuuugggugcugauacauaugucggggccuguauuagguauuagaaguaguaguagggggaggaugccuaucaucauagugauugggaggguggauuuuuccccagaguauuugugauguuaguaucugacuucaggcagaaaacuuucagucagaaaaagaugaaugaauacuagugaaaugaaaggacaaaugcaaaacacugaaagaucagggcaguaguaaaguaacucauccauguucuuguuaggccuggaauccugcugcugaagaucagugcuuugacagaugccauagacuuggucagaagcaagaaguuaucaucacaaaagugaguuuuuaaacaaacuauuuuaagacuagguugauacgauuuuuacaauuaagcaaguaaugcaugaauauauuauuaugauugaguguaauuaugcagagcaaaauauaagucaccuuuuuccuccuucaucaauaauuuaauauaugcuguuuaaggggccuuucucugcaccuacauuuauaguuauguguacaucuccuuaaaaacauucuuuuaaagauaaauggaauuauacuuuauucuacaacauauuuguuucccuuaaaacuauacauuggagacuaccucauaaguacauuuagaugaacacuuuuuuuaaauagugguaaaauacaaaauuuaccauuuugaaguauacaguuuagaugcauuaaguacauucauguuguugugcaacagccaucacaaucauccaucuccagaacuuuuucaucaucuuaaacugaaacuguguauccauuaaauaauaacuucccauuccucuccccccagccccuggcaacuaccauucuacuuucuuucucugaauuugacuacucuacaaaaccauauagauauaucguaauauauuuaacccauuaaguuuuuugcuaauaaaaacagugccauaaugagcauuauuauauauaaaucuuuucacauagaugcaaguaauucuuugggauaaguuaagaaaacuagaauucuggauuuagaauuuuuaucaacuaucgaguugguuucaaaauaggauuuauaugaaaauuguuaauuuaugcuucuguggccaaaaaagugcuguucuaauuugcauuuaccuaaaaccuugaguauauuucacauaucuuguuuauuaacauuuuuucugugaauuauuuauaucuucuguccaguucucauaguuaugguacaaauaguuuuauaguauaaaggacucccugauacagucugacuugaaaucuuuuguuuauguauguugaaaaugguuuaucccauacucuuccuugucuuuaaacugcauuuuuuuggucaugaaaaagcuuuaaaauuuuuaugauuuaaaacgucagccuuuuuuauacguucuagguuuuaaggucuuaccuaggacagaaggcuuuauuuucacauuuuuucaacuauucuguauuuacuucugguucuuuuggaagauuuuauuuuuuguuuuaugauuugugacaugagucuaagcuuauuauuuuaucagaugaagaacgauuuguucugucacaucauuuuuuuucuuugaaaauuccaacuuuuucccuacuaguaugaaaugucacuuucaucauaaacuaauuuauauauauuacuugggucuuuuucuagacuauucuguuccauugaucucuuuuccuuuucuuagggcaguauuacucuuauaacaacuaugguuuccuaaaguaaguuuugauaccugauaggguaaaauguucugaugacccuuuuugaaaauuguauuggugguuauuauuauugcucuugaauugaacuuuagauuuuaguuauaaaaucccauuuaagauaucuugagauuuauugaauuuauuauuacuuucgagaacuaucuuucuuuauaaguaacgaauguuuccauacaggaacauaguauccuuucuccauuuauguagaucuuauauguauuucaguaaaauuuuauuauauagcuuuaguuauugcaguaauugggucuucuuaaacaauguuaaauaguagcagauagugaccauucuugacuuguuucuguuuuguuguagaauacuuuuauuguuucacauuaaauauguaagguugagacauucauuccuaguugggguauuuuaaaaucaaguuuuuaucaggaaugagaugaucacguuuuauuuuucucuuuguuaguguugugaauuauacuaaagauucauucuugaauuucugggaauaguuuuuuguuuuuuuuuuuuuuuuuuuugagacgucgcucugucacccaggcuggagugcaguggcgcaaugucggcuuacugcaagcuccgccucccggguucacaccauucuccugccucagccucccgaguagcugggacuacaggcgcccaccaccaugcccggcuaacuuuuucuauuuuuuaguagagauggcauuucaccguguuagccaggauggucucgaucuccugaccucaugaucugcccgccucggccucccaaagugcugggauuacaggugugagccaccgugcccggccagaauggccuuuuuaauacaaugcugaagucauuuugccagaguugccuauauaguuugcuuuuuuuuucuuuauugcuuugcuuaucuugugaucuguaacuucuauucguacagccauauucuuuauauaagaaaaccauauuggguaaggaaagcaaaguucaguucuauuaaauaguuauuauaguuuggugcaaaaguaauugcgguuuuugccauuaggcaaaucuuucauuuaguuuuuuuaauaaagauuuuaaauacuaugccuuaaaaacuacuuaacuuuuuuuuuucuuuuuaaaguucauuguaaaggacucuguugaagaaaauaugcugaaaauacaaaacaaaaagagagaacuugcagcaggagccuuuggaacuaaaaaaccaaaugcugacgaaaugaaacaagccaaaauuaaugaaaucagaacauuaauugacuuauaauuugugggauuuuaguaaggucaguuugauuggauacuuaaguuuuagaaaugagaaaaauacagaguuuuagaaaugagaucuagagaacacgucuucuaaaaggggcauauuuuauauuagugaagagguauuacugacacaauuucuucuauauaugaaccuauuuuuaaugaaacuucaaauagcaauaaguuccguuauauacuguggccugaaauaauuugagaaaaaagguuacuuuguuauucagcuuuucauaauaucuaugcugaguauuuucacguaucuuccaaguacucagcuuuuucguauuucaaauaaggucagaccuuuuauacuuuugaccaaauaguuauuuucuauguuggacacuuaguuauuuaccaaagccuccgauuugugaugcaguguuuguaguccuuguaaacaauauauacagacuauacaagaauuaauuuuauugggcuuucaaaaaccauauuugcauuccagaaccaaaucuuaaaugagaccaaaguccagguuagcacagguuuuuauuuuuccuacagcuacauugagauauaguucacauaaaugacuuggaguuuuauguucaugaaaaaauuagggauuauguuaagaguacuauuuuuuccauuuuaguuaaguaguacuacacucauuguuuaaauguaacuugcugugucugagguauaaauauagucugugggagugagaggcaaaccaguccuacccaauuugauuugaauauuuuaaauuauggaacugcuaaauagauauuucuauaaauagauaauuuuuauuuauguagcuuuuuuuggaaguaacuuuauaaauuuuuauaauucagaagacuacuauaugugagaggcgugauaucuggauggaaguugggcuggaugaucuccaaagucguuucaacucuuaaagacaucuuaauccugaauguaaacaauuguuauguguuuagaaucagaauuugauuuugaacuugaguaauucauccuuacagcuaucuguagaauuagucaucuuuuuucuuuucuuuuuuuuuuacuuuuuuguuaauaagcaaacuuauuugcugcagaauuuggguugacuccugagcauauuuaaaacaaagaagcuagaaauuuagcagucagauuagguaggugguuuuauuucaaagggaaacuuuaauccaaagaaagauuaauuacucuaacaaacaagagaagcuucauguuugaugauacagauuuaagaauaccugagacuuaagaguguuggaagucauuugauagaaagaugagaucggagacaauguuguguuauagggcacacauugaagguauaugccaaaucucucaccagauaaguccuuuucucccugugccguuuucuugcucaaagggaacagugaauuagccagcuagaaucuuccuggucccuuuuugaggcaguagcagguaaggaaagggcugauuuucaucaaaaccaagaccuuucugcagggaugauaguggaauaauaaugugggauuagcccgcuagcauuaggagcaguugggaaguuaccugguagaucaagcauuacacacaaaaaaucaaguugaucagaguauggguucuccauauagcaauacuucagugagauuaaguauaaacaguuuuuggcaaaaaacaacacagucuacucuuucugcuuacaaagacaaagccuuacaaacucacuaugaagguaaagggaggacagcuugcuucuuugcccagacauuuacaaaguuguuuuuaaaacacacucauaaguaaguuuggcaaguuguuuaaaaaaugucucuuuguuuuguacaguucuguuagauguuguuauauuuuaaaaguuuaauuuaaaaaauuuaauuuguccuuccuaagaaggauaaauauauaaaaaagccacuggaaugaaaacuuccuauaugcuaugcuguugucuuauuauuauauagaaaaauaacuuuagaaaaauauugaagacauuguauuaccacuugugauucaaacaauuuugugguuaaaacuggauuuuaaauuuaaaaaucaauaaaaauuucaaauguuuauuaccuuc

SEQ ID NO: 193009 - RNA, 72900 nt, Homo sapiens
uccaauagcauugacuuuuauucauucauguuaagucaccugaaaugauaucuguugcauuuaaaugcucauuaauguaaauggcugaacaaauccauuucaauggauacucaauaucccacauagauaagucacuucaacacagccucaugacaacucccacaccaaaacaguacuuuauuuugcaaauuuugacccauuauuacucccauguuguuuuuuuucagcugucaaguguacaaggugaagagaaauuucaguuagacaggggcugcaccuggaaaauaaauuucuuaaacuccauaaacacauuucaaaacugcugggucccaaaaguccaucuaugaacucuagggcugccaguaucaugugcagcacauuaaagcuacacuauccaaauagcuuauuaauucugcauaaaucaggucaagcaaugugucaaccuguaacagacugugcacuuuaacugaacauggcaaaauauucacucuuucgaacuuuacaucaucauuugaugucaaacaaugaagcaaaucccaacaguauauacaaaaaacagcuuugcauuuacaaaagauuguuucccauacugauuaauccaggcagcuaacucauugguuuaugcaacuuuauugaagaaaaauaaaucaauuacuagcagagcuauuaguugaucacucauccauugacaacuugcaucauuuauucagugcuauauuaaacaguguauuggaagauagauuaacuaauagcuccaagccuccuaacaauuuaaaugaaaauuacaaaauguuugagacccuauuuuggaauacaaaggguguuugacuuccaauuuccauucucuguagaacaagaacaggucauuccuuuauugacaugcauaaaauacaucacauuuucuguucugcugaugcuauaaauucaauaccaauucuccagccacaucaguuaugagcauaaagcauaucauguaaccucaaaucucuaacaguggaaggcuuaaacaagaauggaugcugcuagaauaaugcuguauccuuugaugugacaacugagcauccaucucccucccccucagaugauuucuucagcauguuagagcagugaggaaugguuuuagucucauaaccaaguuagagugaagacauuggccacauaauacacaugcuccauuuuuuuuuuuaaaaauucugagucuugggcaacuguucucuuguaacuacuuuacaguuucuaaaagcaguuauuguccaaagcuggaagaacuuaagucuucucagaugagcaugugaaugaauggagggagguaaacaaaaaauaaaauuaaaaaagaugaggucugauaggggagcagccggauaagaaaaucaaaaaaggaacaguaauuuaaaguuuauuccagcuauaaugcagguuauucugacuuuaagguagcaucacauggcauacuucugaguccauucccgagauauucuguuguaccuguaaauaaagauguuauuuuuaaaaguuaaaauaaagaauuccuaauacuuuaaauggaagggaaagauuuccauuuuaucaucuccagacucaucaugaagucaucucuaaugacuaugauuagaauaaaagccaacaagggagaaauagcacugguacucaaagcaaugugggaaaugagagccugaugcucugaaaguaguauuuuaaaaacaacuaagaaagcagcacugaaaauugggaggcuaacaaaaaucaaaagacccuuucuuucucuaccaccgagcucaugcucuaauuuuaacgugaagaaauuuuuacaguucauuauggacaaauguuaaaauaguauacacauucuaucuauccacagaaauuuccaccaaggccagaacuaggcuuuuacuagaacaauuuuaucugaauccuagaguuugggaaauuacuugguccuggauauuacaagaaaaaauggcuuugggacuuagguagaggcagaaggggaagaugacacugggcagaaugacaaagggcaguaauuuucaaaaggggugugugugugagugguuguguucaucagaaucacguguuacuuuuaauaagugugguaacugaggcuaauaagcaccacugagaccuguugaguacaacaagggcaucuucguuuaaaaagaucaacagguaauucacacacaagcaagguuauuacucaggaagacuacuaacauugauaaauacuaucagcuucccccuggauuauacucaugccauagacuacuuacaacaacaaaaaacagugauaaccuuaagaaaugaauauauauauauauauaugcacaggagaauuuuuauauuguuuaaauauuaacuagcuuuauuucaaaccaagaaccaaauaugguccaacaacuuuccuaaacuuuuuaaaaaguucuuucuaccaauucauugucaucuccuaaggauacucucucaaaaagccagcacuuuaaaacaaaggcuuuauuuagcauacagggagccacaaaguacagcugacgcuaaugcaugcuugucaguaaugaacauuuaguuuagaugcuuaggcuuaaaaguguuuuucccuuacauuacuaucucccggcaaaauuugaacuaaaccaccacauucuguauaggauugguacaaagucucaagcuaaaauuuaaacaccaugauaguuugaaaaaaaaaaaagauacuacauaaauucccauuucuuacuagugcuauuguaacugcuuugccaugcaguacuuucaagcaauaacggcuaccagauauuuacuuucacguuaaacagagaccaagcaguuaaauguacaguuuucagaagacugccauauuuguuaccuuuuguuaguuaauacagugccuuaacgcaugcagcacucaagugcuggcaguaccauaauaagcgcaccauagagugcagauccucuuacccuacaacauagcguauuucucuguccacucucuugcuaaccuauuguaccuaauugaacaaguacacuuagcauuaauuauaacauaugaaaguuauaaugguuaaguugaacauaaauauaauucaaauauuugagaaauuuagaccaaauuuuuacaauaguacuaacauuuuuggaaaaacaugcuugggguaaagaaaaauuugcuuucuuccccaaaaguugagaauaaagugauacuguuuaacacgcuaggaaaaaaaaaacaacaauaaaacauuuuagaggggagcauucacugucacauaagcuaaagccuaguuaaguuuuuuuaaauaaccacauuucaauagcuuucuccauauuuuaacuauuaucuuacuaaauaucaagucuucuuggcacugucacaagcaaaguauaagccuaacucauuaaguaaaaccacuuuuauaauaacuuuuuaacauacuuacuuaucucugucuguuuuauagauccgugcaaucucuggcacuagggggucaucuggguuuggaucacauagcagugaacaaauggauaaaagaacugcaagaaaacaaaaacaucuguuacccaguuucaggaguuuggauaaauaaauuuuucuaaaccguguauuacaaaacucaauccucaaaagacuuuuauuaguuuguaucuuuaucucaaugagacacaguuuuacagagauuuuguuucacagaagacaagcuccugguaaguaagaagugcuaaaaacaggguuuuguggcaugaaauucacugcagacuagccauaaaaauaguuucuaagauaggcaacugaugccauauuaauauauauauuuuaaauaggcauaaaugauauuagaacuugaguuucuugguacucaguggcuggggggggggggacuuuagcaagaauaugcagguaacacucaugccauauucauagccauuaggcaugaugaaaaauccauucuuagccguugucuuggcaauuucugagaaaaacccucaagugcuccacuaaaugucuccuugaacuuguaagcaagaaaccauauucccaagaguacuaguuaaauacaaugccaaaaucucuuuaguacuaagugagucaucagcucuaguuuuuaccuuaaccaguucaacauacugauguauaagaugucaagcauuaaggaacauagaucgcauucacuuugagugccugcuaugugccagucaccauauaugguggugcuguuauaaaauguuaagauauaaaugcuugaaaugguucugaccgauuuuuuuuuaaaaaaagcaauaguauaaaaaagacaacacugucacauauuuauugacuacagcaaauuuaauuucaaaccccaaauacagcagaauauaaaauuaccuaauauaggagacuuggcuauacaauaacucacagaaaaaagguagcuucaguugugacugcuaguuuaauaaguuagcaaaguauggcugccaaaaaaguaaguugcuuuaacgacaaaacaauaccaauucaaucugcccuuacaaaaacaguuuucaguguuacuguacacucccagcaguaguagaaaaacuuggaaacugauauuuagguauguagcaugauuugaaaagaaauuagaaagcauccaagaaggugaaaaacagguguaaaauuuuaaaaacacucgaauuauggcagcaucugccuaaguuguuucuuuuucucccuuaagugauucuacucaauaaaguuugggaaaugcuacugcuacagucucucuccaugagauucaagugcaguauauacacauaugaaacuuuuauacaaugccuugccuuuugaaaaagcuuuuuuguacuuacugaacucauaaaaucaaaaaacaauuaauggugaaauaguguuaauuauuacaacuucaccugggauauucaugcggagaccggaaaacuuguuacauauaacguaacagauaccuauuaagagaccagaauugaucuacagaucuuucgaagauuauauaauuuuagacugucauuagguagaaacaaccuaucaugguuacauaaaacaugacugaagauuugucuaaaaauuaacccaggaaagcaaaaucagaauuuuccuagaguggaaaccucaggauucaaaagcucuauuaaguuuagguauaucauaccauucuugguaaaaaggccgcaaguuagugugagauguccaagugguuugggauugaaaaauacagaagucuauuaaaauaaauuuugcuauuauaagaugagaugaagguaacucauuaggcaaauaaugccuacucaccacaauuugaauuuuaacaacuucucacaaaguaucuuuaaucaacaccacuaaaagaacaaaaauuauaaaaguaacuuuauugcuuccccaucucuuaccaaaaagcugccauaauaaaaauacucagauaaguagaucuaagaaugaagcuuuauuagacaaugagaacagcuuauuucacuagaaauauuuaccuuuagaaauuguuaaagcaggcgaccacugugaucuuagaauaucgagacaaaugcugccauuacuguuaauauuuggaugauaaauucuuguuguaaaugcaaccuaaaacaaaaacuuuuaaguauuuuauucaaauaaaaacaaacaucuuuuaaagcaaaacuuaaaauaaucaagccacaauguuaaaaaugucaucuauuagcauagaaguucuaaauauuauagaaacugauuuuuacaaucugaccacaacccccugccuccucuuuuuacaacagaaaccuaaacuuuuggauaaaaauuucauuacucauaugauguaaaguucuaaagguuacuguggcccuaccauaucaugaaucaaagggcaauuuaaagguauuuaacacauucauuuauaaaagcccuaacuuuuggauguaaccaaaauuuguagaccaucucauuuaaaguuucauuaaguuacacagguacaccugagucugcauuuccaccguacauaaaacauaaacuugaaucacaaaaauggaaaccaucacauugcaccuauaacauuacuagagauuguuauagugacauguuuaugaccuuuguauauuaccuuuucuaguuauucauacagguugaauuuauguuaaugacugaaaagugaaggauaauaugcuuuuaauaccuauaaaccagugcacuaagcaacucuaaguuuucacaaauuuacacuuacguauacaaaacuauaagcauaauaagcauaugcuguaacaauacgugcaaauauaaauugaaguuggacauuugaugcuuacaagacaacaaaagcccaaaaaucagaaucuguguaacaauaauacagaugagggcggaagcuuccacauggucugaaucuugcaacauuaaagaaaaggcaaaccuuauuccuauuuacaaagcucaaacugaggucuagcucuuuaaaccaaagguuaagagucagcaucuauacaugagugcaauucaacauauauauacagccuacacagaacccuaucuuccaagaaugcucuauuccuuugaaauaaagcauaaaucuauacuaacagauuuugagggaaaauacuugccuuaggugguuugaagggguagucuguaggaaaaugaauugucaaaaagaauacaccgccuugauaugggcugucauucuguaaaaagaaaaguaugcuuaacucaaauuuaaaauauuauugcuaaauauuccguaacauuuguuuccaagcauuucucuaauaaugaacccaaaucaccuauuuacacugcaauaaauaaucuauuccaugaaaauucagucuauaguaauagaaaaaaacuuaaaacuuauacaguaauaaacccuaauuuaucuagucauuuuacacgucaccaaaauguuuuuuuaaaaaguuauccagaaacgcaaguauucuagaucucaauucucaaaaguacaacacagcaauaaagccuacauaaucauguuucagaauaaucuguaaacaaaauuuuacacauguagauuauuucuuccaauagccagauguguacaaauggcuucacaacaguccauucugcccacuggcaaaccaaauguuagcuauuccagguaacacacacacaccaccuucaagaggagaacagagaaaagccuaagcuucucauuuuaaucaauaccagaaaauacaugcauugccccuauuuuaugcaugagaaaaaugaggcuuaaagaacuuagucuaguguacaaaugguaaaugauagaaccaagauucaaacacaagucuuuugaagaccacuuaaugaucaaagauacugaccuacucaggaauuuaaaguuaaaauguggaaugccuaacugcuucuggguaugcaaagaaccaauccgaagacauguuuuacaacuuacaugaacuggguuuuuaccaacacugacuccccucuauuagaaaggcuuuguauauacagcuauauaugagccuuucacuaugcccauucuggaugucaggcacauaaaaaacaggccugacacuaacacagcucaucuaauuccuacccuucuguaaaauaaauaaacauuaauucaauuaaucuaaccccuugcuauauacuguauguguguuaagggauccaaagaacaauuuuuuuuaucuugaugagcuuacacugauagacauguaaaguaacugcaaugaaauguuauagguaucaugaaauaugaacaagggacacgaguucaaagaagaaaggucaauuuauuaaugaagaaucagguucaaagaaauauacaacuaguaaauggaagagcuuuuauuuauuugagacggagucucacucugucgcucaggcuuaagcgcaguggcacgaucucagcucacugcgaccucugccuccuggguucaagcaacucuccugccucagccucccaaguagcugggauuacacauaugcaccaccacacccagcuaauuuuuguauuuuuaguagagacugaguuucaccauguuggccaggcuagucuugcggccuccugaccuugugauccacccaucucggccucccaaaaugugcugauuauaggugugagcuacuguacccagccagagcuuauuuaaagugaguccuucuccaucucccaagucuucccccuuuuuuuuuguagggguggagggcggggggaaugggaacgggaagggggacaaacaagacgcagaauaucaucuugcuguuuguugcccaagcucgaguaaaauggugcaaccucagcucacugcaagcgccgccuccccagguucaagagauucuccugcuucagcugccucaguagcuuggauuacaggugugcaccaacgugcccagcuaauuuuuuauuuuuaguagagauggggcuucaccauguuggcugaacucuuaacuccugaccccaggugauccgccugccucagccucccaaagugcugggauuacagguaucagccaccgugcccaguccuuuuucauauuuucuacaaaauauggaacuagaaaaacacucaggucacuuagaaugugaccugaguuuauuagauuaacaugucuuuauuaaauaguuauauuaauuuugaauagaugcuucaaauagcauauacuuucaccugauccaauacuauacaagauauguuuuuucuguguaaaauuaacaauuuaaagguaaucccaaacacuaaaguuguuuuuguuuuuuuugagacagggucuugcucugucgcccagacuggagugcaguggcacgaucuuggcucacugcaacccucugccuccugggaucaagugauucucccaccucacccucccgaguagcuggaacuacaggagugaaccaccacaguuggcuaauuuuuuuugucuuuuuaguagagacggaguuuuuguugucuuuuuaguugagaggcuggucucaaacugcugaguuccagugauccacccaccuuggccucccaaaguguugggauuacagucgugagccaccaugcccggccccaaacauugaaguuuuaauaaccuaauuccagaaguucuuuguaagcuuucauuucaauuuucauaaaaucaaaugcugucuaugacugcuucugaauaaaggcaaucugcugaugggauuuaggcaaagccaaauuucguuucguuuguucgaaaaaagaacuuuauaaagaaggcaaaauauuucaauguuacaauuuaacacuaaaguucugccaugccaaaagaggaagaacuacgagguucagagauaaugaaacuaggcaauauaaaaaauugagacccuaugauauuuaaauucuauuaugaaucagcagcaaacuacaccaaaaagaaacaaaauccccaaagaauaaggaacacugugaucagcaaaucgacucaaaucguacaaguccagaauuuauguuagauuuuuucagaaaccuucuacuucuuuugcucucaucagugcaaaguugcucccucacagugccucagcucuucuguggcaauaaaacguugguauucuuuuuuuuuuuuuuuuaaaguggugcugucgcccaggcuggagugcaguggugugaucucggcucacugcaaccuccaccucccagguucaaguaaauucucgggccucagccuccaaagaagcuggaauuacaggcaugugccacuacacccagcuaaaaaugcugguauucuuauagguugauuuucuacucuuaacugcugacccauaaaaauuugaguugcaaaauauaucucuggucaguuauucauuccagggcauauauucaaaugccuacugauauuucuacuuggauaucucuacuuggauaucucaugucaugcguccaaaacugaaacuugucucaaucccuuuuuuccuguuuauuaauagcaagccauaacugaaagccauaaaccaggaucucaucaucaacuucuuccucucuuaucucagaaucaagauaguuaucaaguaagaucuuuaaaauuucuugaauuagcuucuccuuuaugcccacugucacuaccaucuuaguucaugauguuaucuucagccuagauuauggcaauagcuuacuaaugauuaucccuccauccuaaugauaaaguggucuuuuaaaaauguuacuccccugcuugaaaucuaugauaguuuuuaagauaauuccaacuccuaaguacauacggugcuuuaugaucugggugcccaucuaguuucaucuucugucucuucuauagaacauguucucuacugcacauaaaauauuauauggauaacauaucuuuuucucuucccuacuuggaauauucuuccuuauaauauagcccuuccuuugucuuaucugcucccuacccuucuuuuauaccucuuuaagcacauaguuaccauuauccacccauauaucuaacauuuacuuauauuucucuuuuauuagacuacaaagcuccucaacgaguaagguuaaagguggaaaaagucuucagguaucaguaaccuacgugggaaaugacauaauaauacacuugaaaaaaaaguugaaaaaauaauccuuauggaccaaauaaaauaguaccuauggaccaauuauuuuaauucagauaguuuuucugguugacuaugcucaggcugccaaagguuacauuuuucagauacuuucacauuuuucacagguacucucuucuacaucucugucauagauuaggugggaguuaguguuguucucuaaauccacuuuuucuggauuuccaauaaaaaaaaauuuaagcaaguaaauaucagaggcaauagguaaggaagucaauuucuucuaauuacaucaauucuuguuggaaacuaaccuuaauacaguaccccacgccccccuccccaaaaaaacccacgcacacaaaaaacuagcaaugcugucauuucuuucgaagguuuaguuuuuagucaauaguugugcuuccgaaguagcuuaccuucagaaagaauaagccaguacauaugauuauuaaagccaagcaauuuugcugcauaacuaaugaucuaaaggauuucccaacaacucacuaaaaucaaaguuacucuauugaaacucaaaauuagaugguauauucccuacagucaggaaucuucaguucuguggcacuggcaccacuuuaagggaccuaaguaguaguccaaagcaaaagugacguuguuaacuguccaguucucccacuaaaucuguaauuuauggguugcuuuaggucacaacugcuugcuacauagagcaaccauacucacaaaauaagcuacuauuuaucuuauacagugaugcuuugucacaaagaaguauugagaagccaaaagaacaaaaugaguuguuucauuggugcacuccacaguaagcauauaguuaacuauuuaaagcuggcaucuaaauuaugugcuuacuuauguacaagacaauacccguacuuuggguggauuuuuauaaucuuugacuccuucuugaaauuuacccaaccaacagugagaacuaaccuuuuuaacugaaaacauauuucagugaguacugcuaccaaagcaaaacccagcaguugugguuaaucagguuaauauuuaaaugguucugaaaaucacaugcuucuguuuguaaaagcagaaaacugcuagucauuauauuaaaagguugcugaaaaaguucagcaaggaauagccaucaccugaaauauauauuuaaaaaaugaaaaaagguaaauguuuucucaaaauaacagcaaauuaaguaaacugcuaaaaaaucugucagaauaagcaacaccauucucuaaaaaaauuacuaccauacacucaucauucauguuuccuuuugauugucuauagguauguuccuugccuuuugggaaaaacuaguguguuguucaaaauaacaaagucuaaacugucaagcagaaaaaccaacuaguuuuaaagaguuaguuuauucugcacaccauccaauuagaaguuuuaauuaccaacgcuucugugcuuucuuaguauugacaauuuuuauaaugaaacuaucaacuacccucugaaucaaagaugagcuuuauuuuaaggcauuuuauagcauucuuugaaaacugguaauccaaaaugggaaaauucuagagguugcaaaagcaacugcuuuacaaaacacuaggcagauaauauggaauugaccuaguaggcacugugguaaacacauaucccaucuaaaaaagggaggcagcugucauuccaucccaagccauuacugcuuauggaaugugggccuacucagaaggcuuuuauuugaagacugccaacuuucaaaaauaucgugugggccaaacuggguaacucaacauuuaacugcguguauuaaaauuaaacaauauugcuaccaaauuagauaaaaguaaguacuuuuaauaacuacaaagccaggauugugcauuucguuauuacaggacuauuuuuacuguuuuaaauguuacuuuguuuuaaaaugauccaggacguuucaaaguauuaaacuuaauauuugcaccccugccaugucuuacuuugauuuaguuuuucuaccuuuagggcacuaacauuuuaauuacucuaaauuaauccucccugcuucaauuucccauuaauuuauccuacucagcacuucauucaccaaucacuuauuuuccaucuugucacacuucagcacuuguuuuagguaucugucuccucuaauacaguguaaguucccuauaagaucgacagggauguuuauuauguucaauuuguauccuuauuaccuggcacacaguauguacucacauuugagacagaaaaaugacuaaaguuagaaucagaauuacuaaauaaauacuuguugauucgacucaucuacuaacucuaagagcauuuuuuccuuuagaauucuaaauauuacuuacugaccauuaucucaccuaguacauuauugcucuuuauguugcuuauaaaaccaccaaaaagggaagacaguuuucaggaagauacacauguaacuuagaaaacaaauccuuaagcgccuuagcaaguuaaaaaaaaaaaaaaaguuaaauauuuguguaagauacagucuuaccccaggauguuuuagugcgcucuaauucucugaaauucuuagaugguauccauaauucugaauauucaauuauccagcauauaguugcuuaucuacccaggauagaaaggaauuuugcuauauucaaaauaucacuuucugccuaaauauauucaaauuuugcauaaacugaaguucuauaaagaaucaaauaucaaaauacaauuaagcuagauuauuggcagcugcaguaacagaauaagaucucugaguaacacaacgcauggcauaucagagccaguaacuuugucucuauaaauaacaggaaguuccaugacaaugcuuuacacagugcuauguagaaaaacugaacugagauacagagauguuugguaggucauagagauggcuauacucuagaacgugaacacagggauagacacaaaguacacguaacaaaugacuaacucauuauguuuuuucuuucaaaugcaguacaacuauggaauauccaaaauagaauuaacuauaugauaaaauaaaccuacagaccaaguuaaaaauuacaaccaaaucaaugcuggauuuucacuuaaaacuaaauuuaaaaauucuuaauacuuacaggucccauaauuguggcuugccaaugaaacacuagaaaaagaaaaaaaacucugguuaucuaaaaaugcacaagcuuaaaaaaaaauuaggcauaaaaaucaacuugcaaguuacuuacuaucauccccaacuggaccugcagaacauugugcuggagggucacgggccaaaucacuaaguuccuacaccaagacagaaaaugggugagucacauaagcuuaauuuaagaaaacaagcaaaugaguccacugcuuucaguuacuuucacccuauuuuuaaaggcacacuccaucacaauucacauaaauaauauauuccauuaggagagagaacaugccugaacauaugcugagacaaucaucuuagcuagaguucguaaaaauauauaugcaaacacauugauacaaaauuuuuuauuuacauaaaagccaaucucuuacaaaccgaaauagcuauaauuagauauucucauaguuuaagagcuuagaccagagagagcucaacauucacguuauuuguugaacuuccaagaccacuuucagaggcccucaacugucuuaaauucuuuguucuuccugaaccauccuuccuccccaauccacuaacucuauuuucuaccugaaaacaaaccaaaaaaacucucauggggcuaaguaccuuuuuuguuuucuaaucuccuuauucucucaacucaaccuuuuuuuuuuuuuuuaaacucagcauccauuuuuaacuauugaaauuuuuuuuuuuuuugagacggagucuccaggcugcagugcaguggcgcaaucuggggucacugcaagcuccaccucccagguucacgccauucuccugccucaggugcccgccaccaugccaggcuaauuuuuuguauuuuuuaguagagacgggauuucacuguguuaaccaggaugggucucgaucuccugaccucgugauugaaauucugacccugaagagcguacuucuguaaguagaaagacguuugcucuuaacauauagucugcacaauucaauaugaacguuuuauuuccaacaaguauguaguucacuguuccaugacuugugcauaacaauaugaauuaucuacuaugaaaauauaguuuauuagaauauuuuuaagaugguacagcuccaucuuaccaaugauauaaccaaugucuaauaaucacaaguuaaaaaaaaaagacaauaaauagaaccaauguuaauacauuacugccuucaacauuuucaaacuaacaguuucucuuaaguuuagucuauggcauaagucaguacacccauuaagucuagggacuacuauaucuucuauauccccuuucucauauaaacacggaaauaacacagaaggguaagguuugggauuccauuugaacagcagaagaccacuagguacguggcucaugccuguaauccuaacacccugggaggcaaagacagggaucgcuugagcccaggaguuugacugagaccagccugaacaacaaagggagacccccgucucuucgaaaauguuagcuaggcaugguggugcaugccugggguccuagcuacucagaagacugaggugggaggaucacuugagcccaacaagucaaggcugcagugagcugugaucaugccacugcacuccagucugggcaacagagcugucuugagacagaaaaaaaacacaaaauccugucucagaaacaaaaaaacaagaccaaaaaagcuagacugggcacaguggcucacgcccguaaucccagcacuuugggaggcugagaaggguggaucaccuaaggucaggaguucaagaccagugcugcuaacaugguaaaaccccaucucuacuaacaucacaaaaauuagccacgcauagugcacacgccuguaaucccagcuacucgggaggaugauacaggagaaucacuugaaccugggagggagaggcugcagaucgcgccacugcacuccagccuggggaaaagagugagacugucucaaaaacaacaaaaaaaaaaccccagaaaagcugaacguacucauauacaaaagaccaaguacuagaaagcaaaagaaaggaugccuaaauaaaaaagauacaacagagaagcagaggcgagaggacagcuugagcgcaggaguucgagaccagcuuggauaacauagugagaccccauucuccauaaaaagaaaaaaaaauuacgauaaagccaguaucaacugucuaccacaauaucaaugcauccguguauaacuaaaaacauuaaucuucuuuuggucuacuagaacaacuuauucccuauaacuacaggaauuuaaaaauggaaacagauuuucaaaguggguaacuuuuuuuccucaacugugaucuuuugccuuccugugcaaaaucaaggacacaaaaugcagaacuuucaguauaagcucucucagaagggugcagggaaugggaagaagagcuacaaaucuuaauuuaacaaggcauaguggcaugugccuguagucccagcuacucggaaggcugaggcaggauuaagcccagguguuucagguuuuuguguguuaaaugaucaugcugguggagagccacugcacucuagcuuggacaacaauguuuaaugccuauuuuauacuggcuucagaugauuauuuucauucacuacaucaaauuuaaacacagugacaaauuuauguaagggucccacuauggcacugacuugguugggggaaauaaaugaguccucuaaauuuuguucauuuuguuaaauccacuggaaaucuuuaaaauaggcucucaacaaacugaggggccagaacaaaaaacaacccagcuuccaagucuuuuagaaaauuagaaucauugaauagauagcuugaaaaaucagauaauguugacaucuuucccugcaaaacugaggaacugaacaaaucaaacaauguaugcaccaacaguacacaagccuguaacugugcuuuaaauauuucaauuugugggaaagcucuuucaauggagcugcuauuuuuauuggguaaguuuguauucuguagcagcauggaauaaaauugaaauuucgagaaacacugaaaaagaaaagagacuacauaaaguguuuuugucuuauuaaaaaagaauugagacuuugucccauuuaacaggauuugcucuaagcuuuuaagacaccuuagcucccagagggcauuuugccauuuaaaaaauuauaguauuauagacuacagucaauggggguuauuaauuuaaaccuuauuaaccucaaaagugcuacuuucaacaagauuaaguaagacuauuagagauauuagcaaaacagcacugagaaacagggcuaggaaacuagaguacacaaauacggacuaagaauaauuguacuaccuuuaaaaauguuaagaugaucaacacaaaguuuuaacugcucuaauaguaucuuuuuuaaaaaaugaaguuuugauuaaaguuguuuaguuaaaaguccaccaauccucuccccuuuuaaaaaagugaugggaaucucacuauguugcccaagccggacuacaguggcuauucacaggcggaaucacaaucauaaggcacuauagcccagaacuccugggcucaagggauccucuugccucagccucuuaagcagcuggaguugcagguacgcaucacuauguacagcaauuuguugaacaauaaauguacauuuuuaauuguaaaauuaaacaaugaauuuuguugauugacuccaugugggaagaaaaggugacgcuaagauuuuuggccugagcaaagcaugagauuggcauuaaguaaaauggucaacuuacaggugaagcuugugggcagauguagagauaaaguaaguaaaauaggauaauguaaguaaagacucaauuugaaaaguauauauacaaguugagaacaggcugggaacaaauacaaaguaucauuaauaaacaaaugauguuuauagccauucaacuuggugagagcacuccuggaacagaagguccuaggaguuaacacuggacuaauuuaacgcuaagaaagggaaccuuggccaguaaccugaaaaguuaaaaagaaauaaagaaugugaagaaaggcuuugucacaauaaacaacacugcaggaaaauuaagaggcaaauauuugccucuuauauucaaaauacacuucagaaaauggccaguuguucgggaauggucagucuagauuaaugccauaaaacaaacaacaaaaauagaguagacaaggagaauuguccugauaugcugugccaauucacuuuggaaacucaucacaacuacuuacaagguugccagagaucccaagauucacaauuuuaagacuguauaucacacacccuuuauaugcuugucuguauagauauacccucaugucuuccacauauucagaaauggaagaaaauucauuccaaauacuauugauucugaucagugggaauuacagaaauucauaucgcaguucaacaaucuguaaaagaaacuacauggcuuuuggccuucaaaaaauuguaacagaaaauauuaacugaaccaaaucaguauuucagaagcuuuuuuuuuuuugcaacuuaaauuauccacuauuaagaaaaugacuuuuuuuuuugagauggagucucccucugucauccaggcuggagugcaguggugugaucuugguucacugcaaccuccuccucccagguucaagugacucuccugccucagccuccugaguagcuggaauuacaggcacaugccaccacaccuggcuauucuuuuuuuuuuuuuuuuuuuuguaguuuuacuagagaugggguuucaccauggccaggcugaucucgaaauccugaccucaagugauccgccugccucggccucccaaagugcuaggaauacaggugugaaccacugcaccaggccugcagucuuacuuuuaaucuuacacaggccuacuuuuucucaugguucucuucucaucucugaaauaggaaucacuaccuggcacauaauggacugguacuuaacaagcagaccauguguagaccacccauccugaaccaagauuccugggcaaggcucuuaauucaucuguuacugaacaaaagcaaaacugcuccacacaugggccacauaauauagccacuuguuuauuuaaauuuuugaccuaugugauaaauccugaugcucaguugucuaaaaaugucuuuguaagcaucugaauauaccuaauacugaaauaagaguuuaaaaagcugacaacacaauccaaguuuuacauuuauuuacucauaauuaacucaauaaacauacuagauuuuacauuuaauauauguuaaaaugucugaacaaaaauauuuagcguaauuuucuuuuuuuuggagauggaguuucacucuugucgcccaugguggaguacaauggcacaaucuuggcucacugcaaccucugccuccuggguucaagugauucuccugccucagccuuccgaguaacuggaacuagagaugugcgccaccacacccggcuaauuuuuuguauuuuuaguagagacgggguuucaccauguuggccacacuggucucaaacuccugaccucaggugaucaccuuggccucccaaagugcugggauuacaggcgugagccaccgugccuggccagaauaaauauuaagauaaaauauuuuaauuuuaaaauaaaaaucaauguaaucaugguuguucuaaacacaauacccaauaauguuggaauacuucauuauaaauaaaacuaaaggucagaaaacuaugaaguugaccuagaauauaaacaccauacuacuucaacauuacacauuucaauuacaaagaaaguaagaaaguauuucuuauagaauaaaugaguuuucggcacacugauauuuauccaucacuaagccuuuaaaugcuagcauuaucauccuuuuagagugaagguauaauuucagcuaguuaacacuggguuucagcucuucacuccuguaauuucagguucuuguuacucuccuaacauuucuaaaugccuuacuuucgaaguucuccaucaccaagacaucucuuuaguaauaaucaaagagauaaaaucagcccaauacacuuaccuacuuuaaauucaauauagaaaaaugaccuaaguauuuuaacaaucaaaacaaaggucuuuuuuaaagauaaaaaugcuguucuuauuucaccacuuucuuucuugccauuuaaauaguaucuaauauuacuauuuaaaguaccacuuaguacccaauaguaacaaaaccaugcacaagcacuuaccuuugagcuaccaaauaauuuuuguaacauuauaugcccacagaaugagcaagacaguaucguaggaaaaaaaagugagaaaagaguaagucauagcagaugcucuuuguagcuagcagacauuuugucuacucaauaaaccaucuuacucaugaauuccuuuucccuuacuccaaaucaugugacuguaguccugggucagccaucauuaaccaauuauuuggacaugacuaaccacagaauuuuguucccucagcugggacccaacuauuaguccauuguccaucccaaccuaagaguuuccaaaucaaagggacauucuuccuucuauaaucaagagcuauaagaaugugacccauagcuguugacaggcacgugucauggacuuacaugguaaagucaaaagcuaaagagaccauauucaacagcagcaauaacaaagagcugacuuuccauacagaugugcaauuuugguuccugagguuguagcuugcucugguuccuacaccuauuccauucauuguuaacuaucccaguuuccuucuaauaaaucccuuauuuaaucuggauuauauuaaggaguuaaaaaauauauacagcaguagugagagaccaaaucugaauaccaauuauguagauuuuaugccacuucaaacacaauuuaguuuuugaguuuugcugaaaaacauguaagaaaucuaaaugaagcuaagucuuaaaauugaauuaggaguaacaagguuaacuuucacacuggagguuaauuuaaauccauuucuaaaaugaaaauguaauguuaauuucaccaucaaaacauucauucauucauaggaacauugccuuuuuggugccaugcauguuagguauaaaaacaccaagauaauuaagauagaaaugccuccucagacucagcuaacagaaagcaggugcaagacaaaacaaaaauuauacuuuaacaaccuacaugcuuaaaauaaagggacucaaaugcucugagaauccugaaaaaccaaccacuaacuuuuccuggguuuagaggagugccauuugagcuggcucuugauggaaaaauaagcaggcauuuaccaagaacaaggagugagagaagcauucuagguagagaaacucaaagucaggagugucaaagaacacagggcauaaaaauuugccagaacaaauacugcagaguuugguauaccagacagaguacaccaggagaguggcagauuuagcuaaaaaggcagguuaugacuugaucuuuuaaaagagcccuugaauuuagucagacuauuccaaaggcaaugggaaaucacugaugguuucgaaauagaagacaaaugaguuuugauuuuuaaauauacuagcagucguacaccacaaguguuuaacuguacucuuauaaccacuuuacggaaauagagcucaucuucucuguuuuacaguugagucccuuaagagaggggaaagaaaugauuacauucaagcauagaacauguucagcuuuaggauaggugaacuaaguguaccuacuaacaacuuaaaaauuuggacuagggguaaguuucaaaaagguuccuuucucaacaggguguccuugcaaagauaauuuaauguuuggcaaacugagggaaaaaaauucucaacugcaccaaacuauuacucaaugcuccagaaugaacacgauauggaaaacuaauguuuuccuuaguauuuauuuccgcauaaccauccaccguuagucuguaucucauuauucguacguagugugaauccaguacuauuuuucaaguuacauggccugagaaaaugauucuaucccacagcaagacuauuuacuggacuggaaaucaauuuccaacgacacccauacucagcauuuuuaaaaguaauuuugucuacgauagucaccuaacaaaauguuuuuagagccuaaaguuucacaggcuucagggacaaaaacacuaaaaaauuacacaauugaaauuuucagcuuauuccuuccuagcagucuagaggaagaggaacagugccaagaaccagaaggaacagcucucacacggcaccuguaaaauuuuuuuauacugugcugacuaccccucaccuaaggggaacagcauuacucaacuauuaaggccacugaaacaggaaaauguuugguuggggacacugacuuacuuuaggaauugcucaagguuccacucacguugaagggacacuaagaucaagcacauacaaucaggguacaacacuaagaaacuguacuagcuauaaaaagaacaaaagguuggacauuucuuuuccacagagugcucuuuuaggaaacuuucuccuuuuagugucaucuuccucugagcugcuucuccucaaacuuucugcacacuuggcuagugugagaauccagaccuucucacuggaaaaaauacuuguauuuaaaagccuuaaaaaaccuauaggaaaagaagucaaggagaccccucugccuucuuucuaagcuagguaaaugagacccucucaaagcucucacauggucuaguucgccucauuaguuaaaacacuacaaagaaauuugagacagcaacagacuuuacacaacugaguuguuugccuauuuccugaagaccuggugggcaccaugguagaaaauagggcaggauuuuuuucaccaaaaaaaucucucuaaaaggcaaccaacagguacagcuuaagccacuggugaguguucucaucuggaaguacaugauuuaagcaguaauggguuuggucacuauuuuuuuuuuuauucugaaacauuccuuacaugagauuuuuaauacaaagccugcaaaugguuuaucuugaggaagaccuuuacuguagucacuaugggauaugggauuuaacaguugauuguuggagauguuaaacuaugcuuucugcuucucuauucucuaucuuccucauucaaugauaagugguacuagcaguggugaccaaccacaggcuacaaagaacaguaggccaagguauugaaaacauuaaagaccugaaaggaugcuaggagaaacauaagaauguccccucccuugcugggcgugguggcucacgcuuguaauccuagcacuuugggaagccaaggcaggcggaucaccugaggucaggaauucaagaccagccuggccaacaucgugaaaucccaucucuacuaaaauauaaaaauuagccgggcaugauggcgggugccuguaaucccagcuacucgagaggcugagacaggagaauugcuugaacccaggagacggugguugcaguaagccgcaguugcgccacugcacucuagccugggcagcugaccaagacuccgccucaaaaaaaaaaaaaaaaauucccuccuuucaaagagcuuauaaauuggaaauacuaaaaauauuuauucacaaauauuuaugaauauuaugaauauucaugaagcuacagagcagccauguuccaggagcccaauaaguaucugaacauucgguuaacuuucuuucaaugacagccaguaucuguucaucagaucaacauaaccaaaagguagcauuuaugaaaacaagguuuuaagugucaacccuauuaaagcguaacgccauaaauaacuuauucuagguuucauccccccaaggcuugucaaaauucaaaagccuauauaguggcaaggccaaguucauggauucuaccuuuaagacaguaaaauuaucaccacgauguuccacaaaucauuuguuaucccaaucucuaccaucuauuuugcacgucaucacacaaaggucauacagaggacagaacgcaguaguauagauacauuuccucucagcacuuuccggaaaacuaaaagcuuaugccauuacuaaagguuaauuucuuguauucuauuugagagucuauuucuuucagaacuaaagacaagauuuacaugacucaaaagacaagauuuguaugacugugaaucagcauuauaaaaacagcccuugccucaaaaaccuauacugagcaacacaaaacacugcuuuggggacuggaagagaugauaaaaugaggugggaaacaaagggaguaagugccuuaagaaauuuuaagaaucauccucaagaagacuuuacaaccaaccuagaaaaauacaaaggugcgaaccaacaauagaggucgaagugcagugcaauuagcuguccaucaggcagacaguaacuacuguaacuguucauauaaagaucugguuuacuauaaaguuuuauuaacuuuaauguuaugaaaugucuguauaaaauauguagaugcgaauaucaaggcagggaacaacaaacuucagaaacaugguuauuucaagagaaggaugcuuggcaaaaagauaugaacaauuucacaaaacuccaaauagucccuuuaaaacacauuuuaauuugaaauuucuucugagaaauccuuuuuuaucuuaagguuuaacaguaggcacugcacaguaucucacugcaucacugacaagguauuaacuuccuguuuagucguaauuauaggugaaacaagcaugcguguucauuacacaagguacuaagaauggauugaauauuacuaauuuucuuucgaucaccacugaagguaaagucacuuaacauuauucaaagccauucuuuuguaagcauuauuuaaaaaugggcaaagaaacccaaauuuagauuugaagcucugcuccaugaaagcaagaaggguguuuuauggacauuaaaacaaacaaaacaaacaaacaaacaaaaaaaacaaagauuaacagccaaacagcugcccaguaguagaaaacauucaauuacacauuagccaugaaauuacagcaagguuaggauuaauguaaguauuucauacugaaaaagguacaagaaaucaugauucacaauugacaaacauuuaaauacgacaaauucagcuaugaaaaguugaaggucucuuuuacaauagauuauguugaaaguaucauuaggagauaaaaaucagauguuucaacaaaguauaaaaauacuucccuaaacuuuucccuucccuacauaacaagguugaggauacaauucugaauaaaucuuaucuaauaagagaaacugggcaguaagauauuuggugaaugcauucauuuuuaauuaugaaauaacacugcuaugguagcaagcucaagaccacaacauuuccaagaauggagaguuuuauuucauuaauuucaaaauacugguuuuggcaaggggaauuaagucauuauaauaaaagacaaaucacauuguaauaauacuaguacaaaaaauacaguauagaaaauuuauuuuaaauaccuccccuacuagaucuaauauucuugaaagguaaauuacaaagugacaaacaacuauucauguguuuacaugcuuauuuucaccacugaacgcagagauuaccauagauaaggaccaucuuccucauuuauucccugggacuagaauacuacgucuaaugcagauuaggaccuuuacucccuuguaucugugguucuuaaucagagaggagcuucagaaucaccuagaaaauuuucaaaauuauguguuuccagggaaaaugauuuaguaagucuaagacccccaugcagcuguauuuuuuuuuuuaaauucuaaacaaucugacauuuaaaaauaaguaaacaaguauaacuggauuguaacacaaaggauaaaugcucgagguauauaccccauuuacccugaugugauuaugcauugcauaccuguaucaaaauauuucaugcaacccauaaauauauacaccaacuauguacccacaaaauuuuuuuaaaaacuccaaauguucuggaauauaaauguaauucaugucacacccaacaauauauaauauucaguaagcucuucuauacgcuaacagauacaagaaaacugcuauuuaaaaaaagaaugcaaaaaccaaccuagguuugagauuuuaaucugaaacauuuuuuuaucucaguguuacgaaccuaguuucuuuuuuaauagauagauuauagcaacaugcuguggagaauccucaaagauugccugucuuggauaaaaagggucaccuaaacucaggggcaaaguuugacagagcaaucuagugacacaguaguucaucccagugauggagcauucaacuuuuuauuuguauaaauaacaaaaacuagaaucaacacugcagaugagcaugaugaaagaaaaguaugcagugucaguaaugcauccuuuuucaaauuaaacaaauacugagguccuauuauuaucagcauccuucagucacaacuauccuacacagaaagugagcuggcuaucaacaagcuuugaggaccauauaugaaacacaugcaagacaguuuacccagccuauauacuaguuggggacaauaaauauauuuuguucacucuaagacauccuaagcaguuaacuggcacauguuaguuuucagugcuugaagagacuaccccaaaagaauuaaauccacuucuacuuucaaaauauuauuagccaaaaucuuaacucacaaauuagcuauaaccuaagaguaaagcuaacucccaauuacuuagauguauaagugggagagcaaagcagcuuauuucagguaacaaacuaaaaucacauacauuauaaaacaggaauugaagggccaggccacgugguggcucacgccuguaaucccagcacuuugggaggcugaggcggguggaucacgaggucaggagaucaagaccauccugguuaacacggugaaacccugccucuacuaaaaaaacaaaaaaauuagccgggggugguggugggcgccuguagucccagcuacucaggaggcugaggcaggagaauggcgugaacccagaaggcagagcuugcagugagcugagaucgcgccacugcacuccagccuggguaacacagugagacuccgucuccaacaacaacaaaaaaaggaauugaaaugguucaaaaaagagcuugagcuuuuggugccuaucugauuugaaucccagucacuuacuaguugugugacuagacgacuauuucucugagccuguuacuucaucuauaaaauucucacaucuaucccacaugguugucuugaggauuaaaugaguuaggguuuagaugagacugcauugucuuaacuacuguaauagauaauacuauaugcaaaaguaaaccguucugaaugacaaaaaaaaacuaaaggaugauaucaaacuguaguuguuaagagcacauacucuggaccaggcugccuagguucuaaucccaacugucacaacaugaaccugggucaucuucuuaaccucuaugccuaaguuuuucaauuucgagauggagauaaucuugaaauuaucucaguggaaguggugguaggagggaaacgaagaucaaaugagaguuuuuuaacccuuuacccaugguuucccugcuagccgcuugcuuauaaucauauauaaacacuaaagucauacuuccagaaauaaaaacccuuacgaaaacuuaacaggguguauacaaugaaaacaugagcuauucuuuuaggcuugguucacauauuuaucuucaaacgucccuaaaacacauauauuguagucccuguuuaaugggagugguaaaauugucuacagcucucaauaccaaucaacuuggagugccacuuuuaacuccuguuguuuaauagcccuauuuaagaccauauuacagcucguucaaauaaagaauacaggaaaaaaguugauuggucuaacagucaaaaaacuuacuccaagaacacagcugaagcaaaguauaaauucaaaagcucgaucaaauggacuaaagguuaaaacuauuccaauaaucauuucaguaaaauauuaacgaggaauacagauauaucauaauacuugaaaugugggaccuucagacaagaauaaauucgaaauagguacguaacacaagcauaccauacugacaucaauggcuacuugaccccauauuucuagaagaggugccuaaaccgaagagcauuccaguucagagcuguccacucacuaaaauuguuggauguggaauguuugaaaguugccucaugugauuuuaacauuaacagcugaaaaaccaaaccacaugcacacgucaaaguuucuguaaguugaaucaauaauguucacauaaacacugguuuuuccaauaugccaaguuuuuauguugugucuauauuacauaaaucuucaaaauauuuacaaaaggagacaaccugguuaacuaagaguacuaaacuagaaaucaaaguucuuaaacaaaaacgauuuuuaaaaauuauaaauugugauauuaaaauagcaguaauaacuaggagugucaugugccaagagccuguucaaauuugcacauuaauccauuuaaucgucaaaacaaaucuaggaacuuaaaauuuguuuuguucacugcugccaccccaaugucuaaaacagugccugguacauauuaggcacacagucauuuauuguucauauuacaacagauacccuucuuauagaggcacauaaacuugcccagagcuagaauucuaacuggagcauuucugcuccaauguuuacacucuuaaccacuguuauauugucucucuaaagcuuuuaaaucauuuaaguggugucacagcagcuggguaugaccuguaagagaaaaaaaaucagaggccuuccuuuaacguguucuguuccacaugcacaaaaagcuauggaucugguacuauuccacauuuuaguggccugaacuaauuccaacagaaaagauuuuuauuuguacugaauguuaugcucuuuguguaaaccacacuguaacauacaacuaggcuucuccaauauguuccuggccuuuaaaguggucacaaaaagagguaauuauuucaaaauaauuuuuacuuuaauccuuaacuccuaaaaagcguuucuuccucuuuucuuucauuucacaaagauuuaaauuuguauuucgcauaacccaaaaugacgauguuaugaaggcccaaaacaaaauucacgauuucauaucaauacauacuaagagugaagauuuaaaccuuccucuuucaugaaacaccaaucuugccaaauaaacuccagucauaauuaaauacaggcaaauguaguaucaggucuauuuuaguaaaggcaaauucuugccauuccucucagaacucuuuuuaaaaaaguaaucuauuaaaaccaaaguuucuaacacucaccgacacuccacaauuuuucuaguaaggcugaauuuauuccaugacauuuuuuucaaguuagcuguaaacacuccacccucuucgauugugcaacaaccaaacacaucacacaaauacaagucacaaaaaagggaaauacaguuuaagaguuugaauuuagguaaguuuugagcagaggaucuuagagcagugcacaacgcgauauaaaaguuaacauuuaacaaaucauauuaauucacauuauuacgaaaggagaugccggaaagagccugaaccaguuaaagcagccgccaucuuaaaaugcgggauagaaguuagagcaagaaaaugagacuaaaccaccggagguggagguuccgcucacucccagagcuccgaaaaauccuaguuuuuuuucaacuuaaaucgauaauauacuaucaaaccacauuucaaguaacgaaacaaggguguuauuaaauagaaugaggcaaaaauagguacauuagcuuucccuuacugccaucgcaccccuuauccacccccacucuccagccaaaaggaaaagggagcuuccagaaugccuuuuacaucaguucccggugucccucggauaaauagcuucgggugaaaagcugcaacuacaaaauacaggaaguggcaacacugugucauuccaucuccucccaaacccacuuauucgguguaaccugcccagagucgacuaagaguuucuacuagacucacugacugaccuucaauacgcaagacuucuucuacccgacccucagucaaguucgggacucgccagauuuuuuuucucuccuccgaguuuucuuucuuaccccuagaaggccuagauaaccuugaucucacaacuaaacuaaguuuucaagcaccaagaauaggaagcgccaugacaucugcuggagcgucucuccgcaauucggacccccaaaaaaacuccuucuuaagcagcaaaaaaauaaaauaauaaaggcgccuuaagucacucuccuccaccccuaauuugcaccgauuccacugaagcacucaggauaacaccucacuugccacaaguguucuccguuuccuagcuuuaaacuucauuucuucaagaaguauaucugcguucuccauccccccauggaagaagugauccaagagguauuuucagaauuaugcuuccuucccacccccacgcuuuccucuuggcccgagccuuccuuuucuccuaccaccccaugcccuuguccccgcggguuaccuuauuaauccguuucagcgccauagugugugcuugucgucuggcuccucacucucucgguguaugcucaaagguccggccaaaacucuugauuaucccggcggcggggcaggauugucucgucucacaccagcucugccagacacaggcgccuuuugcaaaaacggagcagaucagcacucgcacaggccccgaagagccccugaugaauccaggucccuuaagacagccgcgauccggggugggugggguggcguggcaaagccaccaacagccucuguaccgugcuuucggcccgaagugggggcgagggugacgggaagagcggaggugguggcuacaaguuuaacuucccggccucuagaaaggaagagacccgggugggagaggaagaggcguaggagaaaggggugggugcggggcaggguccggagcccagcagaggaggagccggggccuagucggcgcuauaccggcgucacuagggcaaagaaaggcaaggggggagggggaagcauaagacuccggacggacgccgggcugcuuucgguuucuguccaaaggugcggccgggaaaaggaaggaaauaaaggaagggagacuugauguguauugcuauccucgcagcgagcuauucugugucaccccugacgccaccguacacucacuccgccuuccagcgcgcucccgcgcgcgcccgcccagccaccuccaccacgcgcccgcgcugucccugaggcuccggcuuaggcgcgaggacgcgcccauucccccuccuccuccagcaggagaggccgcggcuuccccaaccuucccacccuaacccaccgcacccaauaggcuggccgcucaagccgcccaggucccgcacugccccucuuacccggccggccacugggccggccucccuucccugcccuagccguccacacccacgcguacagaggggccggggccucccucaagcugcggccucggccuccuccccgcgcggcagcuggugccuccccggcccuacggggcucacgcgcacgacacagccacaagauguccgcucugacggaacuacugccagcugccacgcuccgccccucccccuccuccugccucuucaccgccgcggaucaguccgccaacgccgccgucccgagcacaagaccgaugugaggccgaagccagacggcuugcuucccacguccggggccgagugaauacgugucaagcccuuuuccuucuucucggaacagcaccuucuuacuaaacagaucggagauuggaccaggagggcgggggagggaggaggaucaugagcuggggggagggugaacgaguggcggaaacccuuaggcucagagaagcaucgagaaccggaaggagaccaugggaggaagguaaaggaagcagccgcugcgcgauccagccccacgccccuccccacagcgucccccaguuuccucacuugguaucgaggagacgacucucgcgagaacuucguggcuggcuaaccgaagcgguagcucugcaaugacuuaagagcaguuuugugcgcuuuuccugacgggguuccgccuccaaaaugcauaaguucucgcgagacgcaguaaggcaccggcucgaacuggggcgggccacugccaggaaagcaacgccccugaaugcuuaugccggugguugguagaggaaauggaauuccccagacugguaagagcgcgcgcagacacagccuugucucacgcgcccaaucaggagcguguggugggaggugccaaggauuaauuaccagauaccuuuagucuagcucgggccgggauuuugagguuuccgguggagcaggugagcaguauuuacucgccugcccuccugggcugguuaugcugugggaggaggcgccccucgagaugggaauaguaguuuuaaauagacccagguuggccgcucaucagcgcucccacgugcugaagucuagugcacgucugacccuaagggagcaauacugagaacagcagggagcaggcugagucaagcucaauugaguggauggggcuaggacagagagaguuaggggcaggguuuucacuggucuccguaaucagucgcugccguccgccaagguguagaugugggaacaagcuuaaauucucaaacuuuagcuucuguugcuguguuucaguucuugagccagaaaguguugagacuaauuaguuaauuagguagaguuuagagucagaaaaacaauacaauacuuccugaaauauccaaguugggaggugggauuuaccucaguaggauuggccuguuuuagucaaggguuuaaaguauggagacggcaguuaugcucucuaguguauccuucaggcaaaagaaagaccuuaauuuuuaugaggaauuuaaaaguggguaagcacugaccagcuuaagguuuuuuaacauuccuuaaugaccccaguuaccgaaguggagaucuucaauuacuuggaaaaauaaacuuguuuuaaaaauacacuuaauuugaaaacuguugcagaaaguuuuaccuaauaaaaacuuaacacgucaacaaugaugaauauaaguagucuaauguauacuguucaagugaccauguagugucacuagugaagcagugcuucucaaacuaguguccauaggaaccaccugggguuuuguugaaaaugcgacuuugauuugguagggcagugguggagccugagagccuacauuucuaacuagcucccaggugauacagauuuuucucgucugaaccaccccgugaguagcaaagcacugaagugcuuaccucauggccuaacugcucaugaggcucaccucaguaacaccucuggccccucccuccucccugaauaaucuguguucucucucauagcuagccagauauacuaaaagcacaggacuaggcaugaagauggagggaggaacccagauuaguuauugcuucccauuugcuugauauuggccugguuaguuaucuucuaaccccguuucuucaccgcuaaaguaaguaauaaugacuguccuuucucacagggugauugugugguuaaagugucauaauauaugugaaaggacacuggagacucuacagugcuguauaaaugucaguuauuaaaguaaccagucagacauuaacuggccauagugugaaacaaauguauaguaguaauaguggccacgccuguaaucccagcacuuugggaggcugagacggguggaucauaugagaucaggaguucgagaccagccuggccaaaacagugaaaccccaucucuacuaaaaauacaaaaaauuagcugggcguaguggcgggcgccuguaaucccagcugcuugggaggcugaggccggagaaucgcuugagccuggaaggcggagguugcggugggccaagaucacugcgacagagugagacccugucucaaaaaaaaacaagaacaaaaaacaaaacuaauauauauggaguucuagauuauccaugcuuauaaaggcaagugauuguguaaucacaaacucauuauuguuaggcagugaaguaaauucauugguugauugggcuuucuguuuacaaguuuguauuugcauaaguggacuuacauuucugcuuauauuuugccaugguuaaaaucaaaagaaacauagccuagaagcauuuugaugccuuaggauaaagcaggcuaagauuaaguuaaauuuuaaaacauuauucauguaccuguuguuacagagagcccacuuuacaguugcaaauaaaguuaaaacauuuucauucauuuaacuuacuugaauuacaaugguagagauguccucauuugaaacaagaaaggaaaauaaucauguuuuuuauauugcagucggaaauaaugcuaacaagaaaaaaauuauggcuguaaauacugaaagaaaaauuuacauuuagaaauuaauaaagguacaaaaauguugaaaauuuaauuaacuaaaaauaaucccuuccuuaauaaauacuauuuugaaguccuaaaaacuuuguaaauauaguagaucagauuaucuugcaugaauugacauaaaacaugagaaaauagaaaggaucaagaaaauuaaagcugggcugguggcuuacgccuguaaucccagcacuuugugaggccaagguggaacgaucacuugagcccaggaguuugagaccagccuggauaacauagggugacccagucucuacaaaaauaauaaaacaauuagcugagcauggugguacacgccuauggucccagcuacuugggaggcugaggugggaggauugccucagccugggagguugaggcugcagugagcugugauugugccacuauacucaagccugugauggagcaagacccugucucagagaaaauuacuaguaaaugggcaauuaaucuaccaaucugaauaaugguggugugccagggucuuauuacaugaauuuuucagugaggccacguuauuauaauaacuugagaguaagggguuaauuagaauguauugaugaauaaacauaauuaacagauuuuauauauauguacuuaauauuguaucuauguuuucauguaucuuuaauuuuguuacagaauauuauaacuugccaaagacacuggcucuaguacaguguauaccauuuuauuaguuuaauuaaauuguaaaugcuacgguccagauuuuauauucagaaugcucauuuacauauucugccuggaccaaguaauuuggagcccaggucaaccaaauguuauuuuacauuguuugcacaaaaaucaaauugauuucuauacuuaacaauucagaaucucauuaagucaaauuaauaugguuuaagaaaguguacuuuauuucaugcuaagaugucauuuuggccuuaauaaggcuuuuggcauguaaugaagcaugcacaaaucuuugagauaaaaauagagcauuuuuccacacaaaaacauauauauacacaaauguucagaguagggcuauucuacuuuuuaguagaaacaacucaaauguccaucagcugaugaauggauaaagaagaugugauauauguguauaauggaauauuauuauuauuauaaggaacaaaguacuaauacauguuacaaaauguaucuugaagccuuaaaacauucugucaagugaaagagccagacacaaaaggccacauacuguuugauucuguuuaugugaaaugaccacaauagugcauucugucuuccaaaaagcugguuuacuuacaaacacagguuaaaaaaauauauauuuguaauacugcuuuugguguagggugaggcacgauaaagagacuuucauucgguuugucaaucagugauacuuaggucugaauaggcaagugggagucuuucagguuuaggacaaagaauguuaauguaguagagaucuguugauagagucacuccuaguuuucuauuuauuuaaaaaacaucgaauuacuauuaggugcuagacacugaagauacauaaaagacacagaugucaucuauaagaaagucucuugaggagaccaguaagcaucagacaacaucauagaguggguucagugacauaaaugugugcacagagcacuauuaauguacugaacucagcuggcgguggucagggaaaguuucucugaggaagagaguuguauuaaaacaaaugaaaaaaagggagcaaggcaaaguuggaaaaaaauugugagggaggcuccuaggaagaggaaacagcaugcaaagucucagagaugacuugauaaguuuuuaaaacuagaaaaacuuuggcugcaguauugcgagguugagguggcggggggagcggcaaggagagaaugagaagacagaaaagaugaggagacaagauagauuugaaagacaugacuggagaucuugagggccuuuuauuuugaaggggaugggauagaauggagaaauugaauuuuuaacaaaaauggccugaucagauuugauggcaaaaagguaacugugauagcaauguugaagcaugugcccaaaguauguauugggauggagacuagaggcaagaaaaacaggauguuaaugaaauaauccugaagaaaugugagaaagaucugaaauaguugcacuaauaagagagaguacaggaaguaaacuuaguuuauuuacugggucaagcuugccuaaaaaauauuugggggcggggggaauucucccuccaguuaccuuuauuagaauguuacaauaaaaucaagccaggcacaguggcuuaugccuguaauuccagcacuuugggaggccaaagcaggaggauugcuugaguccaagaguuugagaucagccugugcaacaugaugaaacugugucucuacaaaaaaauuaggcauaguggcaugugccuguggucccagcugcucuggaagcugaggugggaggaucccuugagcccagaaggucaagguugcagugagccauguugcagcagugcacucuagccuaggugacagagugagacccugucucucaaaaaaaaaaaaaaauguuuauagaaaaacaaaauaugauauucuaauaaaauaacuugaaacaauaguaugaacuuccuauguuuuuagcucuuaaagaacuacgaaacuaaaguuuacauaacauuggaaacaugugcuacauguuuuuuuuuuuugcaaaucaaaucuccucuugaaacucaaauguaggacuaacugccacaauuucauuucuuuuaaauuuggccaugucuguacuaacugcugugauccaugucucaguucucuuaccacuuuacuagaaccuuugggagacuuuuguucauucuuugacugauaucauuuggcuuucaaguggccaggaaaaagaauucauuaucuauuucuguuccaucugccucagacaaaauacuauuauguguugccaacaagaucauaaaccuaaauaaaacagagguucuaaaaucacauggcaguacuuaguauaaguggguaucaaggugacugagacugugcuuacaguaauuauagauuacuaaaaucacaaaauggaaaaaaguucauguagagaauucaaagaauuuaguuugauguagauagagauuauaacaauccuuuugucacauaccuaaaguggaauuuguugaguuugaccuugugacuuuugagucaagaaaugcuaggcagguagaacagauaaauuaauaaaccugauucugaaauggaaguaaaagggcuuuaaagauguuagaagcauuuuaagauucauucucauucuggaucucaggacauaauuucuuauagaaaaguaguugugccugcagaucaauccacaaaaggcuuuaaaacccacccucccuguauauauuacaccuaugagaaaaugcuccauagaauuccaaauugauaacaggaggaccgaccuaccccucugcccgccagaauucccguggcucagggcaaguacugaagccgaauaggaagaauugacugaggguaaaucauguugagugguugguugaaagcuuugaaaaguuggagaauggugguuaagaaaucuguacauucagacuucuugaaugucacuguauguuuuggguuagugcugggauacuuuucuuuuuuagugccagauccauuaauuuacauuccucuccacugccauuaucaauugcuuccuaacagaaaccaguaagcuuucuuuuucccccuuuucuacagagaagagcaguuucacaagauucaacuuuucuuauacuuuuguuccuaaaacagauacacacucuguuaaguuuucauaaggguuuuuauuucugcaaguaugacuuuaguguuuauauaugauuauaagcaggcagcuagcagggaaaccauggguaaaggauuaaaaaacucucauuugauccugguuucccuccuaccaccacuucagcccccaaucccugccuaacaaauuagacccaauagaaaaagucacaagauugagggccggguguggugguacauagcuguaaucccagcacuuugggaggucaaggcaggguggauugcuuaaacccaggaguuagagaccaucuugggcaacauggcaaaacccugucuguacagaaaauaaaaaaucagcauggcguggugguaugcaccaguagucccacauacuagggaggcugaggugggaggauuacuugggcccaggaggucaaggcugcagugagcugugaucaggccacugcccuccagccuggaugacagagugagacccugucuggaaaaaaaaaaaagauucaacuuuuuuuuuuuuugucuuuuguuuguuuugagacagggucucucuguuacccaaguuggagugcaguggcaccaucuuggcucacugaagccucugccuccagggcucaaggaguccucccaccucagccuccugaguagcugggacuacaggcauaugccacuaggcccagcuaauuuuugaacuugcccacacagauucuuuccccuuuuccauccaucuccaauccccacucucucaggauacccugauggcucuguggguauccuuaguguucacuuaucacagucuacagaaccaccagucuaaugaauauaaaauauuuuaaauuauaaugaagaagccucauuaugaguaauaguaacaugugaagcaaauacaaucagcccuccagaucugugaguuccacauccauggauucaaccaaccacggauccaaaauacacauuuuuaauugcauauuuucugaacauacauacuuuuuucuuguuacuguucccuagacaauacaguauauuuacaguguuuacauuguacuaaguauuauaagcaaucuaaggaggauguguauaaguuauaugcaaauauuauggcauuuuauaucauggauuuaagcauccuuggauuuugguaucugagagugguucuggaaacaaucccucauggauacuggaggaugacuauaauaugaaguauauuagagauaaacauauaaagacaggcacucagaggaguggcuuaccagcagacauguaauaaaaacaugagaauuucaguugccugacaucucuguaagccagagauaugugcuuuuuggcugcccaaagaaacuauuucaguuuaacccugaaagaaaggaacuauguugucuagcauaaagcaguuaccucuuccucaucucuaccaguuagaccacagcuacauuguuauguuuuuaacagcuuuauugaaauauaauugacauacaauaaauuauacauaccuaaauaaacaguuugauaagcuaacauauauauauacccaugaagcucaccaaaaucaagauaaugaacuucaccacaaguuuccuuaugcucuuuuauaaauccuuucucuuguucuucccccaccccucugucuucuuaacccacaggacaccucugaucuauuuucugucacgguaaauuaguuugcauuuucuagagcuguauugaaguugaaucacaauacaacuucuugucugccuuuuuucacuuagcauaauuauuuugagacuuaccuauauuguugucucucaguaguucauuaucuuuuauugcuaaauaauauuccauuguauguauuugccacaauuuauccauucaccagucaguggacauuugguuuguuuccauuuuuuuuuuuuuuuuuuuuuuugugacugagucucacucugucacccaggcuggagugcaguggcgcaaucuuggcuuacuguaaccucugccuccuggguucaaaugauucuccugucucagccuccugaguagcugggacuauaggcacucgccaccacgccggcuaauuuuuuuauuuuuuaguagagacgggguuucaccauguuggccaggcuggucucgaacuccugaccucaggugauccacucagcucagccucccaaagugcugggauuauaagagugaggcacuccgccuagccucuuccaauuuuugucuuauuacaaauagggcuacuaugaacauucuuuacaguguuuauauggacauauguuuucauuucucuugaguaaguagcuuaggaguggaauagcuagauuauaugguagauauguguuuaacuuuuuaagaaacugccaaacuuucccaaguguuuuuuaccacuuuauggucccacaagcuauguaugaguguuccaauuucuccugacugguuaggauuagucuuuucaauuuuagccauuguaauagguguguagugguauuucauugucauuuuaauuugcauuuuccuagugaccaaugauauuggcauuuuuucaugugcuucuuugucauccacauaucuucuuugcugaaaugccugucuguauuuuuccccauuguucauuguauuccuuuugucaguauuuauuuauaggugacacauaugggaguggccuuaaauguuuuuuaacuaauaaagucauaacaagguaacauauaccuggaggaauaugaaaaagcaugacaaacuuuacuuugcgagauagcaaaauuuaagauuucacuauauaaaucugaguacuaggucaauuuuuuuuguggguuuuugggugaaaccugcuagacagauucuaaaagagcagucacacuaugucuauuuuuuaaauuauuagcuagcagaaccaccucaacucauauugacuagucccuaagucacuuccacaauuaagaguauaggcaguagugugauagaacuggcuuguaacagcuuacaagggucaauuuaaaaauuguaggaauuuugcaggcugauuguuaaacacagccauuauuaaaaauuauagaaacugacaauuauauuaaaaucuguuaaauaaagcucaauaauaaauacucaaaacucacuuccuaguuauuuuacuauagacauaccuaauuuuauugaacuucauggauaugguauauuuuacaaguuguaaguuuguggcagcccauauugugcaaguuuguggugccauuuuuccaacagcaugugccuacuuuguuaguauguuuuagcaauaaaguauuuuuuaauuaaaguauguacacaggccaggugcaauggcucaugccuguaaucccagcauuuugggaggcugaggugggaggaucgcuugggcccaggaguuugagacaagcuuaggcaacacagugauccugucucuacaaaaaauuuuucggcugggcgcaguggcucacgccuguaaucccagcacuuugggaggccaaggcgggcggaucacgaggucaggagaucgagaccauccuggcuaacauggugaaaacccaucucuacuaaaaauacaaaaaaauuagccaggcgugguggcaggcaccuguagucccagcuacucgggagaggcugaggcagaagaauggugugaacccgggaggcggagcuugcagugagccgagauugcgccacugcacucaagccuggguggcagagugagacucugucucaaaaaauauauacauauuuuucuaaaauuuucuaaaauagcuguagucucagcuauuugggaggcugaggugggaggauugcugaaaccugggagguugaggcugcugugagccauggucuugcugcugcacuccuaccuggugacagagcaagacucugucucaaaaaaaacuguguacacuuguuuuagacauaaugcuauugcacauuuaaauaguguaaacauaacuuucauaugcacuaggaaauggaaaaauucacgcgaacuaaacccacaguaucucugagguaugcuauaccuuuuacuguguuccguguuuuugugguuaugucuauuguaucugcaugguggaaguauuacaguuugauagugugcaccucuucccagcucuguguucagugauguucuuuggaacaugacacaguaccacauaggaguacuuuccccagggaaauuugaaaacaccacagaucagaucucugccugcugcucccuacuucaggcuaguuguuaaacuuuaccagcacacuugugaugacaugacccuucaaguugacugacuucugucaguaaugaauaaucgaggcaucaguuagauggagaguuuaccuuugugaaacacuuaacucucaaaaagaaauauuuuuguuacagaauaaagcuuguaacaccuaguuuucuugguguucaauguuuuccuuacuuccaaauucucuaagguagagaaagguaaagucugacuacuggauaaggggggauacuaauacaguaguucuguggucucaaguaaaagcguaaaauauuacauuugaaguagaacuagaaaggaugcuaaacaaaacugugcugggcaaaaaaaaaaaaaaaaaaaaaaaagaggaaaaggaaaggcaaauagcucuaucuaaccaaaauucuauucaugugagggagcaaaagaugauacaagaggagaguuucuucugacccccaaaucagcuuuuuaauggaugaagcucuuuuuguccagaguuacugaagcuucuggauguuguuaggaauuuaaguucccagacagauucaguaaaauacuauagcaguccagagaaaaccaaauaaacuugcagggagagggagggaagggaaauucuaaguauaaaagauaaaucuacagcuaagguugaauggcuguuacaauuaaauuuuuuuaaaacuaggagaaacugacuaaggauuucaaauggaauagaaacugucuuacacuuuagggucuaaaugaaaggcauauacauuuaaaauguaaaagaaagaaauauaucauaugacuuucuucuucuuucuuacuuuuuugagacagggucucacucugucaccuaggcuggaaugcaauggcgccaucauggcucacuacagccucaaccucacaggcucaagugauccucccaccucagccaccaccaccaaagagcuaggacuacagccgcuugccgccacacccagcuaauuuuuuuuaucuuuuguagaaacaggguuucaccauauugcccaggcuugucuugaacuccugggaucaagcaaccugcccgccucggcuucccaaagugccaugauuacagugugagcuacugcacccggccucauaugauuuugaauaaggcauuugcuuuaugcuuuacaagguacuaguaguaaaaacuguuuagagugauguacauaaagaacaguucagacacaaauguaagaccugaagcuauaaaacuacuagaagaaaacagguaaaccacuucaggacauugggucuaggcaaagauuuuauggcuaagaccucaaaagcacaaacagcaaagacaaaaauagccaaauuggacuauauuaaacuaaaaagcucagcaaaggaaacagcagagugaagagauaaccuguuguauggaagaaaauauuuacaaacuauuaauccaacaagggacuaauguugagaguauacaaggaacuuaaaaguaaaacaaaaauaaccccauuaaaaguggucaagcgaugugaauagacauuucucagaagaagacacaaaugcccaauaaguauaugaaaaauguguaauaucacuaaucaucagaaagaugcaaaugaaaaccacaguaagguaucaccuaugacagagugguuauuacgaaaauaacagaugcugguaaggaugcagaagaaauucuuuuauacugucagugggauuguaaauuaauacagccucuauggaaacacaguauuucucaaaaaacuaaaagaacugccauaugaucugucaaucccacuaauggguauuuauucaaaggaaaagaaaucaguucaaugcagcacuauucacaguggcaaagaacagaaucaacuuacguguccgucaacagaugaauggauaaagaaaauguguuaccuaugcacaaugaauacuauuggccacaaaaaagaaugaaaucauuuccucugcagaaacauggaagguacuggagauuauuguguuaagugaaauaagccaggcacagaaugacaaauaucacauguucucucauucauguggaagcuaaacauguugaucucauggaggcagagaguagaaugaugguuaccagaagcugggaaaggugucugggugggaggggggaugaagagacguuggugaauggguacaaacauacagugagauauggaacaaaggaauguuuaauagcagaguaggguaacuauagcuaguaacagugaaugcuuuuuguauuuuaaaguagcuaggagagaagacuugaaauguucccagcacuuagaaaugagaaauauucgaggugauggauaccccagucaagguaacaaaauagcccauauaccucauaaauauguaaacuauuauauaucgauuuuuuuaaaaguauagcaguuuguuacaaaaauuagcugggcacgguggcaggcgccuguagucccagcuacucaggaggcugaggcaggagaaucgcuugaacccaggaggcagagguugcugcagugagcugagaucaugccacugcacuccagucugggugacagaacaagacucuuuuaaaaaaaaaaaaaaguauagcaauuugguauuaaacuggaaggaccaaaggaccuaacaaauaaucuuuaaaccagucaaugcccuauguaacuuguuuaccaauaaauuggacagaacagauggaacuuuaguggauacaggugguuuauuuuuaaaugaggagggaauacaaauuccccaggagauaaccucuuucucuaagaacauaaaguuuuauguaggagacagaacauucucauaugaaaaauaccuaagaauauaugaaacuaauauauguaauaggaagcuauuacauauauuaaugguaacuuaguuguucaguuuuuaguuacugcugaacaucuugacuauuuaaauaaaucacuauuuuuucccuaaccuuguccagauuucuaaaacucaguuacucuccuaaccagucuacuuaagugaauauauuuuuccagucaucaagacuaagauucaguauaauggagucaucuuugucuuucacccuucccuuuccuuaugaguguccauuucuacuuauuuaggccuucaaugcauauuacaccuuaaauuguauaacaguuuauacauuuuaaaagauuuucaucauuauguaaucccucugaguuaagcagaagugauuaacauuucaucacucaaguauuuauugagggccuacaaggucacuacaaggugagugacauauaaauaaggaugcagaaucaggcaggucaaaugacuugcccaaggugacaggaucagugauuauuaccagucuuaugauucuaauaucagcauucuuuucauuacacuaugaugccucucaacucauauuugguccauuacuauaaauucauagugggcuucucugccucuacuuuuccuucuccagacuaucuugcacaucaccauuaaauuaaacacagcuuucauuauaauguagcacaauaaagaacuuuucaaugguuuccuauuguauagaggagaaaaacuuuaucucuacuuuuuacaggauaucucuauuaaacugugauccucauauucuuuugaacauacuuuuacuuuucuaagaguaugccuuugcuuuuagcaguuuaaccuucuuugaguuucaagucccuaaguaauaguuauuaccguagaucuagauauuuauguaccaagcauuaucuauagacuacauauaugcacaacuaccuuguguauuuugacugagggaguaaaguuuugauacuaaaaaaaaaaaaaaaagaguccucuuugcugggugaggugccucaugccuguaaucccauugcuuugggaugccaaagcaggagaaucacuugagaccaggaguuugagaccagccugggcaacauagugggaaccuguuucuaccaaaacaaaaaacaaacaaacgcugggcaugguggugcaugccuguaaucucagcuacucaaggaggcugagguaggagaaucaauugaggccaggaguucaaaguugcagugagcuaugaugaggccagugcacucuagccugagugacagaaagccugucuuaaaaaaaaaaaaaccucgaguuucacuucugauaauuaagaacucagugguuuugaucauacuucugcugugaacaauuaaaaaagcuagaccaaaaccaaacaaacaccccuguuuaaaggcacuuguuagugacaaguuguauuuuccacuaucacaacaaagaaaaaggcaaaauauguggcaggcgucuuuagauuuggagacaacaaaacauaguacaauuggguaagcuguucuuagaggcuuaacuguaacuguaagacuaccaguuuuggccaggcgugguggcucacgccuguaaucccagcacuucgggaggcugagguggguggaucaccugaggucaggaguucaagaccagccuggccaacguggugaaaccccgucucuacuaaaaauacaaaaauuagcuggaagugguggugcaugcuuguaaucccagcuacucaggaggcugaggcaggagaaucgcuugaaccugggaggcagagguugcaaugagccgagaucuugccacugcacuccagcgugggcaacagaauaagacuccgucucaaaauuaccaguuuugagugggguagggcccagacuuaggcuuuaugauccuguagacccaaugauauuagaaguuaauguaggagagauguuauaugaagccucuggcaaguuucagugcaagaauuacaacauagacccuuaagguuuaggaguaaggccauaucuuccuuagccaugauuuuguuucauuuuuuuuuuuuuauuugaaaaguaccucuugacuugcuacugguaccuggaagagauguaacaccugaccaugggacaucaagugacugugugaaucaaacugcccaucaugaauuguuguuauuugacucaucaaacuguacaacuggaugaacacaggagcagugcacuacauaugggacuggaaccaugaaugagcaggugacucagacuccuauaguaccugccucuacuccuucagcacuucucccucaacccacauaaacugucaucauaaugaguucccucugaccaguuaauggaagagaaaaaaguauggauguuauggauauccuaacauauuucuggccauuggaccccuagaaaccuguggcaaguccuggaaguuuuucaagguucaucuugcaccuucuagcaugcauaugucguaccaaagcauguagaaugcugccuacuucugcucuucaguuucauuuaauauaauuucauuacucugauaaaucagugugauguucuauggaauaacaaaagaccaucaaggucccuucauaccauauagagaacaggagaguugauguagccugagacaagacaguaaggacuuacuguuaucccuccuauuuaaacguagucuguuucugauucuccuuagaauggggguggggggacauuuccagaucaauaucagaucaguaucaugucaacauggguauuaauuucuuccgaagaagauaccacaccuagaacagcaaccauaauuggcaucccuaccuaauuaaaguuugcaguccacugucauucuucacuagccaucugguuuuuauauugucauucucuaugaugcaucugguggccacaggaaauuuaaaugggaaugugguaugaaucaccauggcagcaugguggcacuaaucucugcaauucuuuugguuuuucuauuuugcuuuuuuauguuuuguagaaaugcagucuugccauguuauauaggcuggucucaaacuccuggugucaagcaauccuccugccuuggucccccuaagugcugggguuacaggcaugagccacugugccuggccaaucucugcaauuuccucagggauauagcccugcuuuuccuuuacuaucuuaaugaggagugguagaaagcagaccuaagcugcuguguagcacuuucuaccauaauagcaaucccuccauugaucaggaaaccaaaauaaagauuguuguuaaaagauacauauuaccacuacacaucugggacuggagaaauagccacaguauggguccuucuggaucuacuguuagccacagccaggccaagauuccaucacuugacuuccuuagguucccuauucugaccaguuguccaggguagaguuuuggguuucuaguauuaguacaaguuaagagacagugccuuaagaauucuagccagccugggccgggcggugggucacgccuguaaucucagcacuuugggaggccgagguggguggaucacgaggucagcagaucgagaccauccuggauaacauggugaaacccugucucuacuaaaaauacaaaaaaauuuaccuaggcaugguggugggcgccuguagucccagcuacuugggaggcugaggcaggagaauggcgugaaccugggaggcggggcuugcagugagccgagaucgcgccacugcacuccagccugggcgacagagcaagacuccaucucaaaaaaaaaaaaaaaaaaagaauucuacccagccuggccaauaugacgaaaccccaucucuaccaaaaacacagaaacuagcugggagugauggugcaugccugcagucccagcuauuugggagguagagguugcagugagcugagauuaugccacugcacuccagccugggugacaacagagcaagaccuugucucaaaaacaaaacaaaacaaaacaaagaauuuuggauauuuuccuuucucuagugaauggucacuggucccuauggaaaaggcuuagggcaaugauucccccaacauaucugcucacuggaaguaucuggggaacuugaaaaaauacugaugccugggucuucccugagauuacuauuuaauuaguuuggguuguggccugggcuuuagaauccuaagguguucuaauguacagacaaguuugagaaccccacuggauuagggaacaauucguuguauacagcugugauugcauugccccuuucgucaaaggauccagucucuuuccaucagugaaggaguaccaagucugggagcuagaugagaugcuucaaauuuuacuacaaaaccacaagaauuuuuccaccuauauaugucaagcagcaccuugguagguuacuuuauuauauuuccagggaccucaugaucauuuagccauuaucacuuuucccugugggucaaacuacucugguuaacguucucuccuuugacuuauuuugguaauugugccuacuuugucucugauauuuauuuauuuauauuuuuauguuuuuugagacagagucuugcucuguugcccaggcugagugcaguggugugaucucggcucacugcaaccuccacuucccaggcucaagccauucucuugccucagucuccugaguagcugagaccacaggcaugcaccaucacacccagcuaauuuuuguauuuuuacuagagaugggguuucacccuguuggccaggcuggucucggacuccuggccucaagugaucugccugcguuggccucccaaagugcugugauuacagacgugagccacugugucugucuugucucugauauuuauaugccauuauguggccucuacugccuuaggauucuaauguucccacuaagaucagcuaacucaguuccacuacaguguuuaccaccaucaucucucgcaaacaaagacagccacuucagagcuccuaggaaauaguggugcucccaucaucauugcauuccuuaaugacauggugaaaauuaacaauggcuaaggagccuuuguguuuucuccucuacaauaugcccaggaauuucuggcauuuuggccaucuuauuuauaggcuauuacugaauuuaagccucauccuaccaaauuauuaaugccaaaauauuaacucuugauucuuaggugagugcacccaugccaauaaauuugccaugaucuaaccuuaaauguauucucauauaugcuguccaaguuucugcugauuaaaauggcaaggccuuuaguucuccuacauagguuuucucucuccagagaaggccucaauucucugacuaggcuauguugggauauaacuggaggcacuaauagguaguaggguaaauucuuuauuuuauuauuuuuggagacagggagggucuugcuuuguucagacuggagugcaguggugugaucauggcucauugcaacuuugaacuccugggcucaagugauccucccaccucaaccuucugaguagcugggacuacaggcgcaaaccaccaugcauggcuaauuaaauuuuuuuuuuuuuuuagagacagagccuugcuguguugccuaggcuagucuugaacuccugggcucaagcaguccucccaccucagccucccaaagggcugggauuacaggcaugagcuaccaugccuagccccagccgguaaauucugaggagagcauguaucagcuugugaaggagcuugcccaagugcaaucacugaaagccucuaugcauaggagccugguuuccucagaaagagauuuaggggaagauugauguucagaguuuucagcuucauuuuucucugcucaaaugucccuaucguaugucuuaggacuccucuccccaccaauguuccagcauuagaauaggaaaggggaagaauuaagcauguaauugauacuacaaaucuaccauaucugcccagugauuacagaagauaaucaacuccuucagaccuguaauagaguucucaugcuccacauacagucauuuucuuuuuguuguuguuuaugauagugucucacuccgucgcccaggcuggagugcaguugugcaaucaaggcucacugcaaccuccaccucccagguucaagcgauucucaugccucagccucccaaguagcuaggacuacaggugugcgccaccacacccagcuaauuuuuguauuuuuucauagagaugggguuuuaccauguuagucaggcuggucuugaacuccuggccucaagugaucuacccaccucagccucccaaagugcugggauuacaggugugagccaccgcaccuggucaccacauacagucuuaauuguaguuuuuauguuuuucuuuuucuuauguauuuuucuuuucuuuucuuuucguuagagauagggucccacucuaucacccaggcuggagugcaguggcaugaucauagcuuacggcagccucaaacuccugggcuuagacaacccuccugccucagccuccugaguugcugggauaacaggugugugccaccaugcgcagcuaauuaaaaaaaaauuuuuuuagagauggggucuugcaguguugcccaggcuggccucaaacuccuggcuucaagagauccucccaccguagccucccaaauaggggacuacagguauuagccaccaugccccuuaacccacguaugccuagcguuccauuauuggaacgcuaagcaugugggaauuauuuauagccuacugcucaaggucaucgccaaggucugauuuuucacucaugcaaaaauucaaaaaauugcaaccucuggcauaaacggguuaaguacuuucuguuucggaccauaagaaaagccagauggaucuauaaucuuuauaauuacuaugguuaucauggugauacacuccucaccugcuucacuugauuucauguuguuacugguaauccuaauacaacugcaaacuggcugggcacagugacuccuuccuguaaucccagcacuuugggaggcaaaggcaggaggaucauuggagcucaggaguucaagaccagccuggacaauauagugagacucugucucuacaaaaaaagaaaaauaggccgggcaugguggcucacaccuguaauccuagcacuuugggaggccgaggugggugggucaccugaggucaggaguucaagaccagccucgccaacguggugaaacucuaucucuacuaaaaauacaaaaauuagcugggcgugguggugggugccuguuaucccaguuacuggggaggcugagacaggagaaucgcaugaaccugggaggcggaggaugcagugagccgagaucacaccauugcacucaagccugggugacaagagcgaaacuccaucucauaaaugaauaaaaaauaaauaaauaggcuggguaugguagugcacgccuauagucccagcuauuuaggaggcugaggcaggaggauuguuugagccuaggagguugaggcugcagugagcuauggucgcaccacugcacuccauucugggcaauagagugagaccuugucucaaaaaaaaguaaacuaaauauuguaagccauggauuaccuguagucuguagucucuuuccuuauaggaacgagguuauuccucugauugauuuuaugugugccuguguguguguguguguguguguguguguguguguguguguguguccaacccaaucucaaaaucuuacuuaaggguccauuuccuguaauaacuucuguugcaaaucaccauaucuuuagagucuuaagaagaaauagaggacagauuaaaaauaauuuaagaaggcuuggcaugguggcucaugcauguaaucccagcacuuugagaagcugaggcaagaggauggcuugagcccaggaguuugagacuagccgggacaacauggcaaaaccccacuucuacaaaaaaaaaacuagcugggugugguggcacacaccuguagucccagguacuugggaggcuaagguaggaggaucgccugagcccaggagguugaggcugcagugagcccugguugugccacuacacugcaacuugggugacagagugagaccccugucucaaaaaaaaaaaaaaaaaaaaaggaaauauacugguaaaauguauuacauuaauaauucuguuuaucaaggcaccauuacaaaaagacuaaccacaauguaagaaaagauacuggccacacauauauuugaccaagaacucauauccagaauauauaaaugauuccuaaaaaucaguaagaaaaagaaugacaacccaacagaaauaugggcaagugacuuuaacaggcacuacagaaaagaucuccaaaaugucucugaaggccauuuuugugaaaaacaaaaacaucuccaaauguuaaguaccauaaaauggugcucaacuucaauggucaucaaguaaaagguuaaugucaaaaugagauaccacuacauucgcaucagaaugaccaaauuaaaaagauugacaauaccacguguugaccacaguguggagaaagugaaacuuugucacacuguuguggagcagugacaggggacgggggacagggauuggguaaaguuuccauaaacuuggaaaacugucauucuuuacaaaauuugaaaauacaucaaugacuaagcaacuuuaauccuaaguauauacucaacagaaaugucuucacuugcaugugaagagacauacagaagaaugcaccauaauugguuaauagcuuuaaaguggaaacagcccacugaaauaucaacaauaaaauggauaaauauauuuuauccauuuaauagaauauagaagugaauaugaacaaacgauaaacaccacagaucauuuucagaaauauaauggugaaaauauacauuacauaauuucauucauguaagacucaaaacuaggcaaaaaugauguaugguuagaaaucagaagagugguuacauuuggggaacagugacaggauaguuacugggagcucucauaagaagguuucuauuuccugggugcuggauacagggacacucugugauaaaucacucauuuuugcauauaugcuauauuucaauuuuuuaaaagggugguccuuaaaagauuaugauuuaggguuuaccaccuugccccucuccaucaauucaaauauuucuuccaguucagaucccacaccuuacaugaagccuuucccaaccauuucagccagaaggaauuucucuuucuuccugguuuuuaugccauguucucugggagguaguguaauauaguggaaauaguauaggcuaaggaacuuggacuuuaaucuguguggcaauaaagagcagaagagugacucggucagacuuguaucuaccuaccacaaauuuaaccaauuuuacuuauauuucucugugaacaaauaugaaaauuuauacacauauauuaaauauaaauauauagcuuuuauaccacggaauacuacucagccauaaaaagaaaugaaauaauggcauucacagcaacuuggauggaguuggagaccauuauucuaagugaaguaacucaggaauggaaaaccaaacaucauuauguucucacuuauaagugggagcuaagcuaugaagaugcaaaggcuuaagaaugauacaguggacuugggaacuuuguugggggcgggugagaggggggugagggauaaaagacuacgcauuggcuacaguguacauugcucaggugacaggugcaccagaaucucagaaaucaucacuaaagaacuuauccauguaaccaaaacccaccuguuccccacaaacuauugaaauaaaaauuuaaaaauacauaaaauguguaauuugugagauuguuacaauauuugcccucaauaaaucaugccuacuuuguucaugcaucuuugcaaugugcuuuugccacuuuucccaucaaaggcuuuauuuccuuaccccuugaaucuagcuaucuuugugacuugcuuugaccacagaaugcaaauagaugugacuuuguacaacuucuuagacuaggucuagagaagcuucacagcuuuuuucaccguuuggaacacugcacugagaccacuauguuauaaaucugggagugaaagacaguguaaaggcagccacaggagugaacacaggggagacuaacagaacuuucuggccaaaucacaguguggugagagagaauaaaucauguuguuuuaagccacuguuuuggaaugcauguguaaugcagaaguagauaauuuguaggaaacagagucccuuuuccauuaccuagcucaccuauuuacucuguuguggcagagaauacaauuauuucccaauguccuuucuccucuucuuccuuuaauauuagaacccccauuuuuuuuuguuuuguuuuguuuuuuguuuuuuuuuuuugagacggagucuugcucugucucccaggcuggagugcaauggugugaucucagcucacugcaaccucugcugccuggguucaagcaauucuccugucucagccucccaaguagcugggacuacaggugcacgccaccacaccuggcuaauuuuuuuguauuuuuaguagagacgggguuucacaguauuggucaggcuggucucgaacuccugacccucaggugauccacccaccucagccucccaaagugcugggauuacaggcgugagccaccgugcccggcagaacccccauauguuagcuggguacauugcuacauggauagugacuauaauuuccuaacucucuugaaaguuuggccauguaacuauuggcccaugggucguaaguggaaaugguggcuccaacuucuaugauacgcccuuagaaagaagagguauacucuuuuacuauuuccuguucucaaauguaucauggcaggagcuggaacuaccaccuuaggccaugaaauagaagccacauauucacauauugaguagaucagauuaaaaagcuaaaaguagcuugaguaccuaauauccagagcugcucuaucaguccugaaccgauuauccuuggacuaugagagaaaaagaaauuuacaucuuaugucauuacuguuuugaccugagagcaagcaaaccuauaaucccaaguaauauguguuuuucacauucccucguauauauauguucauguauauauauacauuuacaaauauaaauauccauaugugcacacacaaauauguaaacaucucuauagguauugguguauuuuguuuuacagauugagauccugcacuuuucuccaucuuuuucucauuuagcaauaucuggaaaugacaacucauacaacuugaauucauuccuuuugauagcuguauaauauuuuauaggaugcaggaguuguaauucauucugcuguuuuccuacugauuagcuuucauuuuguuacccuuuuuuccacuaugaauauuuuugugaauagaaccuuauguauuucuauagaacagauucccaagaaugguacagcaaggacaaaagauaucuguagcuuaaaaaauuuuaauacagguugucagacuguuuuacgaauaaguugaaaaauuucacauuuaugccagcuaucuauaacaauacccuuuuacuuggaccccucaccagccauaguugcuauuggucauuuaacauuuuucccagucugaaaagauguuucaccucacuugugacaagagaaaugcauaguaaaauuuuacugagauuaaacauuucugcuuauuagucccaaauccaacaguuugaauaacauacucuaauaacaaugcugugggggcacucucaucuguuuauacagcaccuauggagagaaauuuggcaauaucugucaaaauuacacacaaacacacacauuuuuuuuuuuuuuuuuuuuuuuuugagacggaguuucgcucugucgcccaggcuggagugcaguggcgggaucucggcucacugcaagcuccgccucccggguucacgccauucuccugccucagccucccgaguagcugggacuacaggcgcccgccacuacacacacaucuuuaacuuagcaaucucuuuucugugaauuuauccagcagauaucuugaacaugugagacaaaauuauguacauuauuauucaaugauacuguuuuuaaaagcugaagacugaaaacaauguccauguccaucauaaggucuaguaaaauaaguucuggcauucauguaguggaauacuaagcagccauuaaaagauaaggaaucucauuauggaguuacauaaauaauucuaagauauauuguaaacuaauauauguaggacaguguauauauuguuaucuuuauuuuuaaaauggagaauaauauaaauuuguauuuuucuguaaaauaucugggaagguaugcaaaaaacuaauaaaaguauuaaugggauagguggugguguuaugagaaauuggugaacaggagaucaugggagacugaaacgcaaaacaucugucucucucuacacauacaguaucugaaugaacuaucuauucaaaaaggaaagaaaaauagcuccuauagagugaauucaauuucgccuacugugaguuuuaugauccucacuuucaucaacugaauaaaagggauaagauccacuucaaaguacuuucugaacacuaaauuagaggugugcuuagcucagugucuguccauauuaggcacucaguaaauguuaguugaauuaaaaaaaaauugucagucuguuagacuaacuggcaucuuauuauuuuaauuuucauuuuccugauuucuccugauucugagccucuuuucauauuuggauuuauuauucucugaauucauauuauuugcccauccauucuucuguugaauugcuuguucccuugaugugaauuucugaguucccugauuaaaccuccuugcaaauauuuuucuaaauuuguuguguaucuauuaauuucguuuagauuuuuuuugcaaacaaauguuauuuuuauauugacaaauguguauauuuuuuaaggauaauguauauucugcuguucuuacaugaaguauucuauaaaugucaacuagauccaguagauuaaugauacuacaguucaauuuuuacugauuuucugccugcuggaugaauuauugaaagagagauauugaagucucugugauacuggauuugucuauuucucuucgugguucuaucaguuuuugccuuacacauuuuaaugcuguuaggugcauauauguuaaagauuguuuuaucuuuuuggagaauuuaccucuauacuuacguaaugcuucucucuaucccugacaguuuuccuuuuucugaaaucugcuuugucugacaauauagcaacuccagcuuucuuuuuauuaguuuuagcauggcagaucuuucuuuauuuacuuuucaccuaucuaugucuuuauauuuaaagugaguuucuuacauaugguuccugaaaaaaugaaaaacuaguaaaggcuguugucuuccucccuccaaaucaacccugaguaacaacagaaacaagaaggaagcaaaagcuugaggaauaagaucaaaaacuuaagaggaaaccauaguuaguguuaggaguaaguucugaaauacuguuuugccaugccccacuuugcuuugggacaaucagugccaaacuacugauugcuacagaaaucaccagcaacagaucaggcuuccuguaggauuagauaaagggucuguugaagugaguugccaaugaaaaaguggggcugaccagauacuauagaauauuggggcauucaccccuccacuccuucccugcugccagaauuuugauaaauuauaacagccuucugcugcuggauuguggauuucaacacagauccuuacuagagaaacaguagcaaagagagagcaucaguucugugguugccuacagcucuugcuuucugcuccuuaaacuugugggaagggauaaaaacgagggucugccauuuugcucuaccuuucuauccauuauuagaagggguaguagauaacacuaggagaacauggcuugugaaccaaaauaucuagacaccugaggaguaugaucacuaucaaacacaacaaauucuacaacauguaccaacagaaguagaauaauaggauauaccaauacuuuuaauaacucaauuauucauucaacacaauuuguaaagauacagggucucacucuguugcccaagcuggagcaaucauaguucacuucaugcagccuugaacucuugggcucaagcaauccuccugccucagccuucuugcuagcugggauuacaggugugugccaccacacccaccuaauuuuuagaauauuguuuauagagacgaggucuugcaacguuucccaggcugcuucaaacaccuggccucaagcaaucauccugccuuggccuccugaagugcugugauuacaagcaugagccguugugcccaguucauucagcaguuuuuuacugaacaccuaccaagugucagguacuaaggauucaucagucaacaagauagguaaauaauuuuguucaugugggacauggcaagggggacagagacaaaaagauacaaauuaacuaaauaauaaacaauuuuggaagguaauauuuacuaccaaaacaaugcagaguagguagauugggacugaugaaaggguugccauuuuaaaaugaaacccauccuaaaauaggagccacaaagaugcaggguugcggugaggcugguaauaugugaagagugaacaagaaaccauaaagccauaugagauuauuagguguggaaaaauaugagcuaaaauaaggaucauagcugggcaugguggcucaugccuguacucccagcauugugaaaggccuaggcaggcaaaucacuuaaggccaggaguucaagaccagccucgcuaacauggcaaaacucugucucuacuaaaaauacaaaaauuagccaggcaugguggcgcaagccugugaucccagcuacucggaaggcugaggcaccaaaaauuucuugcaacugggaggcagaggcugcagugagcugagauugcgccacugcacucccgucugggcaacagagcaagacggucucaaaaauaauaaugaauaaaaaauuaaaaaauaaagaacaucauagauaaauagcagguggauuggaucuuaugaugcuuuugagauacagaauuuuaauauuuuugugcaguuaaaaucucuagaacuuuuccuuugugcuuucuagugcuuucaugcuuugaaaaaaccuuuuuauccagagauauuuuuagguugauaauuaaaauauuuaaaaucauaauauucguauauggaaagaaauucaaacaaaauaagauacuagaaaguaaaaggccucaucuacugucucuccuccuuuccucagaaguuaucauuuuucuagguauccuucuagaaauguucuauguauaaucaaauacauguaauuuuuaaaauuuauaaauaggauacuauacauacuuucuacaauuugcuuuuuucauucacacauauggcccuacuccagagauugagguuuuaaauaucaggaagaauuuuauuuagaaggcaaaacuacagagacaaaagauaauugguuacccagggguauaagguagguagggguaaauagguggagcauagggcacuuauaggguaauaaaaugauuauguaugcuacuauuaugguggacacaugacacuaugcaguugucaaaauugauagaacuauacagcacagagugaccccuaauguuaacuauggauuuuaguuaauaauguagcaguacugguucaucaguugugacaaauguaccacacuaaugcaggauauuaauaggagaaaugguguguguuggguuagagggugacauaugggaaucuguauuuucugcccuguucuucuguaaauuuaaagcuauucuuuaaaaagucuuugaaaaaacuucauuuagaaaaacuauucuuaaagcuuuguauagaauauuuuaaaauuggaggcuagaggucacauaucugguagacuguugcuauggcccaaacauaaaauaauaaaggacuauacuaugguagcaaauaaaauuacuuugaauagguuugcuaauaccuaagaaaauuucacauuagaaauugaguggaauuuaaaguuucuaauauaaagaaaucaugugucaaacauaguguuaaucaaaaauaggaaaaaacaauaugcauaaaaauuaugagaacaaaaggaaauguggcugaaaagaugcuaauagccauaacauguugaauauguuguuucuuuuuaaaguuaacaugacacagaggaaccaggaaaugcgucuacugcauuuaguuuuauuuauguucuuaaauuguuuauuuccagauuucuguaacauguauauauauuuuuaaauucaauuuuauuuugugugugugugugauggaguaucacucccucgccuaggcuggagugcagugcugcgaucucagcuuauuacaaccucugccucccggguucaagcaauucuucugccucagccuccugaguagcuaggauuacaggcaugcaccaccaugccuggcuaauuuuuuuguauuuaguagagacaggguuucaccauguuggccaggcugaucucgaacuccugaccucgugauccaccugccuuggccucccaaagugcugggguuacaggcaugagccaccgugcccggccuguauuuucuuaaaagaucagccauuaccaaguuauuauuggaugccuuuaaucucuuuuguuaguguauccauauuccaauaaaaauuuauuuauaaaaacaggcaguggucugcucuauaggaucuugcacuaauaaguuacuuuaauucuuuaagguugucuugagaauuaaaacacauaauguacaaauaaaacaccaugauuuggcauauaguaagcacuugaaaauaguaguggcuauuuuauuaaaauaguguguuaucauacagcucaaaaugcugauaagaugaaucugaaauucagacuuaaaaguauuuuuauuauaguaacaagguuauauuugggauuuuaaguuuuguucuaccaccagugguaguuuaaggcuucuuguauaacgguucuuugugauguuuuucuugucagagacacgugugaugaacucuugggacauguuccacuacuuggggauccugguauuuccuugcucaguuuucacaagaaauagguuuggcaucucuaggaguaucaaaugaagauguucagaaacgacacaaggugucguuuaaaguuuaaagucauuuucgacuuuaaaaaauauucuauugauauccauuaauaauguaguaaaagcuuccaaguuacuauaaaguaaugguucuggaaagagcauguuaauuuaaaaaaauaacuacuuuagguaugauugacauguaaagcuguauauauuguauauaauacaauuaguuuggggauacauucuaaucauuuaugauaauaacaacuuagaucucauacaaaaacucgacacuuuaacucaucuauccucucccacauuguuaucgaugucaaaauuuacauuuuuauauugugcaucaauuaacaaauuacuguagcuauaguuauuuuuaauacuuuuaacucagaguuaaaaaugauuuuauguaucaccauuacauuacaguauucugaauguaacucuauacuucccuuuaccagggaguuucauacuuucacguuuucauguugcuaauuagcauccuuuaguuuccacuugaaguacuucaacuuuaguuucaguuuuagcauuucuugugaggcaggucuaguggugaugaacucccucagcuuuuguuuuuguggaaaagucuucaucuuuccuuuucugaaugacagcuuuguggguaaauuauucuuaguugggaggcuuuucuuuucuuucaguauuuugaguauaucaucccauucucuucuggcuugcaagguuugcugaaaaaccugcugaaagucuuauaggagcucccuuguacaugacaaguugcuuuccucugcugcuuucaaauucuuugucauuaacuuuugaaaauuugaucauaaugugucucagugaaaaaauuuucauaucagacagguaaugugccaguguuuuggcaaggucugagaaaggcacaucuuacacaaugguaugaaaacccaaucaucaugcuuaugaaccacaaaaagaucaaugaagacaucuuuauguucaaccuacauggaauucuuugggaauuguggaucuggauguucauuuuccuccccagauuugggcaguuuucugcuauuauuucuuuaaauaagcaaucugccuccuuucucuuucucugcuugcucuaccacuucuauaaugcgcauauugguuuagaguccuguaggcuuacuuuauuauuuuuccucuuuguuccuuugacuggauaauaucaaaugaucugucuucaaguucauugauucuuccuucugcuugauucaaucugccacugaagcucacuuuugaauuuuucaguucaguuauuguguucuuuaguuucagaauuugauuuguuuuuuuuuuuugauauggagucucgcucugucacccaggcuggagugcaguggcgugaucucagcucacugcaagcucugccucccggguucacaccauucuccugccucagccuccugaguagcugggacuacaggcacccaccaccacuccuggcuaauuuuuuuuguaauuuuaguagagacggcguuucaccauguuagccaggauggucucgaucuccuaaccucaugauccacacgccucggccucccaaagcacugggauuacaggcgugagccaccgcgcccagccagaauuugauuguuuagugguuucuuuguugaaauucucauuuguucauguauuguuuuccugauuucguuuagcucacugagauucaaggugaguguucugaauucuuuaucagguaauuuauaggucucuguuucuuuggggucaacugcuagaacuuuaauuuguuccuuugguugucauguuuucuugguguguguguguguguguucaacugcuagaacuuuaauuuauuccuuugguugucauguuuuccugguguguguguguguguguauguguguguguguguguucuuuuaagccuugucuucuaacuuugcaucugaagaaagagucacuuccuccagucuuuacugacuagcuucagaagggaaagacguucaccagucagccugacuagagauucugaaggucucucagaccuuuucuaugauaugcccauuccauuccucuuguucugucuugggaggggaagucuuaggauugugugcuuucuuucaaucucacaaagcuagacuaugugcugagaaccuccuuuuauuuucucuagugcagugccucagaguguucaagguugugugcuuucuuccaauccagcaggagccaguugcugauaucugugugcuaucugcuggggccugcauacacuaucugcaggggagguugggcugcuggcuagugggugggugcauggagugcugggugugcuugucaguugagggguucugcaggugaaguguccuguagggcucaugggugagccuaugguggagucugcaagccaguuaggagacuccacaucuagcucugaagaaucauguguugguugcuauaagccucugcuucuuuucccuucuccuagauauuccuagacuauucaucugugaagagucccucaguauucuggauagggaaaaacagaagugagccuuuugggcggcaacacgcaaggcuagggaagcugggcacucacuugacucuuacuuuccuuccugggagaacucaugggccaaaagggccucucuuggcacugaacucugcugccuuggaggagaaggauguagguaaagugaaacuguuuuucuuacccucuucaaugugucuauucuugaguuuuucauucuacuggggugcuggaaccucuuagcaggucucccaggcucccaaaaugguauuugguauuucugcagggguuugagggcuggaaccuacuaauccaccaacuugcugaugucagucagggugccuuuaaucugaauaguauuauuucacacagaaugcuaucucugaguuuaguagcucagaggcaaaauauaaacaguuaaauauauaaaguaacauuauuaaaucucacauuuauucugugcacaacuacaauaucgcaaagcauuaugcagguuccuucuucaugccuaguucaucggugcuuggaguagcuaguuccauaaacuucugagguaauaagaaucugccuuguuauuuuauuauuuaaugacuauauuuauagauuacaguaaccauggaauuucuaaggcaaaaaagauggcuuccaaaauagcaaaagaaacuucaaagaucuauggaauuaagcuuuuaauuaugcacauaugcauauacaauuauguauaucauauaugugcuuuguaaccauaaucuuuugucuagucaaugacugcaaaagugguaugucaguauacacuuacagaauuauagaaaagagaagcuuucuucagagcucacucuauucuaucauguguuugcuuguuuauuuauuuauuauggauugacugacagggucucacucuguugcucaggcuggggugcagaggcauaaucauaccucacuguaaccuuaaacuccuggccugaggugauccucccaccuuggcuauauagauaauucuauauacuguuaguuuuuaguaccacaaaguguuauggaaggugauuucaaaauaguuucgccauguuauugauuuauagaucccaguuuuguuucuuuaguuuuccauuuauuucuaguuugcuggacuuccucuuaaaacugugggguuaaggcaaggcaguuccaaauguaguuccucauacacaaaggggaaguaagaacaccaaacaccaaaaucaaaauguucuaauaaaaaaaguuuaucucuuuaaaauguugaauagacagauuuaauaauaauucuuuuuuuaaaaaaauugauuaguuucucauaugauaaucauuauuuuaaccccaaccuauaguccacuguaaguauccuuuuaauuuguuaaagcauauuaguuguuccauuaauuucaucuacuuuuccaauccaucaaucugugauuccuuuuaccuuucucuuauuuuggguuucuuauaccuugaucaaauguccuacuuuuucuuaguuuauuccucauuuagguggaacacauccucuauuagcuuucugagaagagaaugcguagauuguguauuuuuuaaaccuuuuagguuugaaaaugaguuuauuguaguuucacaauggguucuugguuuggauugguauagaauucuaaauuauagguaguuuuucuucagauauuuuaagaauugcccuuuaacuaccagagcuacuguuaagaaguccaguacauuuaacuuuuguaguaugugucucagucuguuuggguugcuguaaaggaauaccugagguugggucauuuauuuaaauaagagguuuauuuggcucaugguucugcaggcuguacaagaagcaugaugccaguaucugcuucuugugaaaucuucagacugcuuacacugagggcagaaggcaagaggaacccaugaauacacaguucacauggugagagagaaaggccagaagugagggguauggguaugcccaggcuucuuuguuuuucuuuguuuuuuuuuucuuuuuuugagacagagucucacucuguggcccaugcuggagugcaguggcacaaucuuggcucauagcaaccuccgucucccaggaucaagcgauucuccugccucagccucccaaguagcugggauuacaggugugugccaccacacccagcuaauuuuuguauuuuuaguagagaugggguuucacuauguuggccagucuggucucgaacuccugacgucaggugagccacccaccuuggccucccaaagugccgggauuacaggcgugagccaccgagcccggccccaggcucuuuuuaacaacuaccucucacaggagcgaacagaguaagaacuaauuaucacaaggacuauaccaaaccauucaggagggaaccaccccuaugacccaaacaccucccacuaggcccuaccaacaacauuggggaucaaauuucuuuuucuuuuuugagacagucucacucugugacccaggcugguugcagugguacaaucucagcucacugcaaccuccaucucccggguucaagugauucucaugccucagccaccugaguagcugggguuacagguaugugcuaccacaccuggcuaauuuuuguauuuuuaguagagaugggguuucaccauguuggccaggcuggucuugaacuccuggucucaagugaucugcccagcucagccucccaaagugcugggauuacagacgugggucaccgugcccagcugggaucaaauuucaauaugagacuuggaggggucaaacaaaccacaucuagagaaagagcuccagaaaucugcaugggguuccuuaagcauuuuauauuaguaacaaucuuacauacucaauagccauguuauuaguauugacacauuacauaauuacauugaucauguagaucuagaccaaccacugugaaaaaaacaaggugcagcuaauaauaaaaaagaugaguugauaaugagguaaaaaaaaugaugaagaugaaauaucauacuaacuaugcauguauaugugccagguacuguuuuaauugcuaucuaugucuuaauucagugaauauacacaacacaaccuuaagauguagguauuaccuacauuuuuacagguuauauaauuuauccuaguagaaucagaauuguagucuaaacaguguggcuccaagagucuacagucuuaacuauaaugcuguauguaauuccuugcaguaaguagacaguaguaguguuuuguuauauuguuauuaaaugcccuuucuugaccaaauaaaaaauuggcaaaccuaucuugacuucccaauuuauccaggaaugggcugacagagcagaaaaagacaggguuucaaaacuaaaucaaaggauguuuaguggcaguaaaaauguaccagaaugugagauuguggucaccaguaaaauugcugaauuuaaggucugaaagccagaguaaagggucauucauugaugguaaagacgauaaugauaauaaccauucauugaguauauuacaaaauuaauuguaucuagucauaaccacugguaucaccauaucaaagagaagaaaacugaggcccuaauuaauuuucaguaaaaaguuaaguuuuucauacaacuugacaagaggacucugaaauucauagaguaguaacaaggccaggcauucacaaugcaauuugaagaaaacagguggggaagcuuaucuugcuagauauuaacacuuacuuauauaguuguagcaauuaugacaguaugguauuguuauagagguuauacaaauacagcaauggaagagaauaagcaacccaggauguguggaaaccugauuugagauaagugacauuacaaaccacaaaaacaaguuuaacucuucaauaaauggugcuagaacauaguugucuguauguaaaauaauaacaaaugagaguagaucccuuucucaugcacaaaaaguaaguacuggguugaguaaagcccuaauaugaagaauauaaguuuaaaacuuuuagcaaaaacacaggugaauaccuuugugauuuagggguagaaaaagauuucuuaaacaagacucccagaacacaaauuguaaagaaaaagaugaauaaauuugacuacacccaaaccaaauuucaguauaaaaacagacauacacggccaggcacgguggcucacgccuguaaucccagcacuuugggaggcagaggcagguggaucaugaggucaggaguucaagaccagccuggcaaauauggugaaaccucgucucuacuaaaaauacaaaaauuagccgggagugguggcgggcgccuguagucccagcuacauggaaggcugaggcaggaggaucacuugaaccugggaggcagagguuguagugagcugagaucgcgccauugcacuccagccugggcaacagagacucugucucaaccaaaaaaaaaaaaaaaaaagacauacacuaggagaagauaagcaacaggaaaagauaagcaaccaauguaaccaacaagguaauauuuuccagaaaacauguaccagugaaacugaugaacaaaccaauagcacagugggcaaagaugucaagagcagacuaguaggcauuuggaauuagacuccuagaauuaagauuagccuaaagaaaucugggcuggaaauagagauuugggcuauaucuuaacgaucauauuugaauuuggggcacuggaugaccuaaugggaaaaaaacaugaaagaaauaaaagucuugggccuagcuaggacaggcagaagaugagugauccaagcucaagugcuugaaaguaaauaaugacuccuuuaacuguauuuacauauuuaucuugaguuuucugaccacaguuucuuuaugucuuuuaaagauggagucuaaaaacacuaucgcauaagguggucagauaagccuauuacaucuauuuagagcaauauuaucuuuagaccauguuucaugugcagccaagaaggcaggguuguggaaaugaaauacaaauauaaaugaaaacaggauuuaaauuuuaaguaaagggaauuuaagaaaauauuccuuuuaaguggauaauaaggauuuuuaaauugguggaguuaggaauuaucuccuauuacacauucgcauagcucauguaaugcaucagaauaccuaauauaugauccacaccuuuucucugaauuucaaggccucccaaaaaaguuuuauccauauagacuugcauucacuacauuuuuucuacuugaaaauagcaaaccagcuauucacauaaacugcuaagaggaaguaagccaaccauaaaaaauuacauacuguaaaauuacuuauaugugagggucaaaaacaugcacagcaauacagaauaguaguaauggugguggaugugguuggaagggucgcuuuuuaaaaacgccucuauugaacauucuguauauugauguggguggugguuaccuggaacuguacauuuggcauuugagcauuuuacuauaucuuuaaauugagguauguauuuuuuaauucuuuaaagaaaaacugcuuggaggucuuauucuuaaugcacaacaaucacaaacauuaaauuuauacaguccagagaauguaaaguugcuuuaaaaaaauucuuuccuuuucucacuuuaaaauaccaaggggaaaaauuaaacucaacacagcacgucuugcccuugucaagaugacagauccucuaagagaagaaacgaauagguaauggccuuuuccagauuuucuuuuccuaauguaccccacuuccaaccuaccccuaccucaacuaggguaucuaguuguacccaagggugcuucuacauuagauccacagagauuaaagauaacaguuaacagaauaguccagaggacaaggauauucaaguuccaucaucuucaggauaaaaaagcuccaggguuuaccuccaaacucucucuaaaggaaaucccaucaaccuuuuaaacaucacuuuguauacaccaucuucuauacugcccuagcucaaaaacaugaaccuguaucuaaacguguuuguagaauuuccauuguaaguuuuacuuuaacaauuuugaacaauuauaaugauagaaaauuauuuaaucuagauuuuggucaacucuauuacugauauucuuuuuuagugaaggacaaucacaaacacuaaauuuauacaguccagagaaugaaagauugcuuuaaaaaauuccuuccuuuucucacuguaaaauaaaaauaccaaggggaaaaauggaaaguauuuauuauaacuggcuguuacacugucauacacaaugaaauacuggaccauuagcaguucguuauuauauguuguuaaguguagaacuguaaauaaugaggcauauuauuaagauaucacacacauuauccaaucagcaagugcacaacuucggacauuuugacuucagccaaaauaugaaacaaagucauagcaagaaaguuauuucaagggagugaaauuuucuccucuuacccuucaaaucuuuuagagauauuaauaaaaacaacuauccagccugggcgauauaaugggacuccaucuacauacacacaaaaauuuuuaaaauucguuggguguggcagcacacgccuguaaacccagcuacuuggaaggcugaggcagaaggaucccuuaagccggaguuagagucugcggugagcuaugaucugaccacugcacuacagccugggcgauagagcgaaaccuuguaacaacaacaacaacaacaaaauuaaaaccuucaagaucaagcuugcccaacaggauggcuuugaaugccacucaaugcaaaucuguaaacuuucuuaaaacuuuaugaaaaaaaauuuuuuuuuagcucauuagcuaccauuaguguuaguguauuuauguguggcccaagacaauucuucuuccaguguggccuagggaagccauaaggacccccugcgcuagacuucagcagaagccuuguaacauaaagaaaaccauacauaaggcuuuagauucuuuuuuuuuuuuuuuuuugugacggagucuugcucugucucccaggcuagagugcaguggcacauucucggcucacugcaaccuccgccucccugguucaagcgauucuccugccucagucucccgaguagcugggacaggcaccugccaccgcgcccggcuaauuuuucuauuuuuaguagagacgggguuucaccaucuugaccuggcuggccucgaacuccugaccucgugauccacccgccucggccucccuaagugcugggauuacagacgugagccaccgcgcccggccagcuuuggauucuuuuaccacuuucccgaaggaaaaggaacugaaaauaucuaaggaaggacuacuacgaaucuucucugaguggcaaaaaccagagguuuuuggagcuagggcugcaguuaaguugccaaggggcagagauguaaacaguuccugguuuaguuaaaauauuuuaauuuuuauuuuuuuaagccuggccuuugggugaaggaguaaaauuaggcacuggggucuggguagggggaggauacucaugggcgaguaugcaacccuagggccacagcacccaaacuguaggggaagaggcggggcgagaggggacgaaguagagacagcaagagacucacuuuugaaaggcacuuucgguuagaaagcauucucacaugcuuaucucaucgcacacaguauccuuucugcuggucuccagcaucuacagacguuaaaggcccaagaggagggccaccuucacacgagauuccgaggagggccucgcuacccgccaguuccc

SEQ ID NO: 193010 - RNA, 12771 nt, Homo sapiens
cauuggugacuuggauaaagacuuuuuaauuuuaacuuuguucuaagacugcuugucaugauuucaaauuagaaaauuauauaauugcaaacagcuucacuucuccuguucaacagaggcuuaaggccagauguccaaacuugucucaauaaggaggugauauuuuacuaaaguuucccacgugcacauacugacuaaauacagagcuaggcccaguuuguauuguacucugaacuuaaugcaaagucuccuuggugauuuucgcaaaguccguggauuugggucagaggcacauuucauacauaacagcccuuauaaacguuugcccugccuccacauuuuacaguaucuuaaaacaguacauuucuuucaaagaauuuuaucucuaugagucaguacuccaacuuagugguucucacauuguggaccaggagcaucagcaucaucuggggaauuguucaacuuaccucuuauaaccuaugaacucagaaacccugggggugggcugagcagucuguuuuagaaagcccuccaugugauucugaugcauaguagccuaugacauaauuccagaccaggugaaucucaagauacuaauccucacaucauuugccuucucauauuucccucgucuugaccaucuggugccuguuaugcaguuuaacauucugcagcaauaaaaguguuuuauuauaaaguauuaauuuuaauguucuauacuuagugggaaccacuggucucaaaauuugaagcuauucuuuaagaggagaacauucgcaaaacucaagcauacuugguuuuucucuguaguacuuuugaaugcuuuaucuuccuuacagaauaacuugucuuccuuaugcuucaagcuccaaaaggguaaggaagaagucuuaaucauuuuuguauuccuugcacaggaccuagcaaauaauugguacucaauguuugcuggaugaaugaacuaaauucccauacggccacuuuauggaaacuaacugccuaaucgccacuuucauuauaaacaaaggaaaaugaagauaagacugcaacagaggccaggugcaguggcucacgccuguaaucccagcacuuugggagcccgaggcgggcagaucacuugaggucaggaguuuugagaccagccuggccaacacggugaaaccucaucucuacuaaaaaugcaaaaauuagcugggugugguggcaugugcguguaaucccagcuacucagguggcugaggcaggagaaucgcuugaaccugggaggcagagguugcagugagucgaaauugcaccauugcacuccagccugggugacagagcaagacuccaucucaaaaauaaauaaauaaauaaauaaauuaaaaaaaagacugugacagaaaggguuuagagaaaugugcuaaagaguuacaauuggcaaauuuaaaauuauauguuaaacuauaaccucauuuguaucauauucauuuauucucaauaccugggacauuuaaggcauucaauaaugaauuaaagcugugccuuauuuuggucugcauuaaaggaguggucuaaauuuuacaagauauauuuugcaucagaaaaucaaacuucagcaguuuaacaugcuggcauccaucaccaaggcaugaagcaacacauuugcuaaugauuccuaaucacuacagugcuacaucauuuacuuaauaaauacugauucaguacuuauauauacagauagucugauggaugaguaaccacagugauguuguucaggacaugauguaaaguugaaaggugcauauugcuauguuuuaaaggcugccuuuacaguagaagcagcaaagugugcuuaauggacugcuguccucugaugaccaagcaaaugcaacaaaugaaauaugcacaaggcuguccuuggacaguacuuguuugcuuugcucacaaaggagaaaaggaaagaaacaauugaaaauauguauauggugaaaguaugugaguccgagcagaaauaacaaaggcaaaaggaugaggagagauggaguaagucuagagaagaaaauaaauggaugagauagagagcugucuaagcaaaaaaggugucagaccucugaucuuauaaauaagacacuucaaaaguagcaaaaacaguuuuaagaaggugacuaauagauaagguguguuguguuuagcuauuuccuguuagguauuaguaauggguucccaaugaccugagccaaaaaugaaucaaguuaaaugaaaacugacaucugauaugagcauauauuauuagucuauucaagcacaguuuugaaguuagcaaacaucuaaauccucacaucucuacaagguaggucaaaguaugauucuucucaguuguacaagauaaauggcuguauaacaugucuagucauaguuaagacaacaauuggggacagugcuuuggucugauugccaugccagcaucauauuuuaucugugaaggguggcuugguuguggaaaacuauaaaaacuggaugcaaaaguaaaaugcaaccuuguuuggugacguccaguuccucuggaauuaggaaaaaccacuuguguuuaagaacaggagucaaaucaauuuuuaaggaaacagauucuaauacaaaaaccuuuucuguugggucuaguaggucuggacaaaacaucucccucuuuuccuuuuauauuuuccucauccucuucuugcagcgcugguugaaaacaggggaggaccccaugaggcugucaguggagugggaaccauagcugcuaucugagucaucagggcucugaggaaucccagcuucacucaugccugacauaggcuccucgaagacaucacugcccagcacaccaugcccagagacauugccuucuucacuuucuugaggcuccauuuucacaugggccagauuccaaagaggagaagcauuuaccucugcaccuagaaacagaggaaagauggacauacaccaaguguauauguguagccaaguguagaacaaagaguaaauauaucacucagaaccaacuaauaugcuuugagcucaguuuucacucugauucuguacuuggcuggagaauaugguuguuacucucugcuucaaaaaguuaaccaucccaaaaaauuaccagcucugauuaucuucuuuuccauuucuucuaccuuucuuuccucuaccucacccacccccauuuccccuaaaccagggaagugaaacuaggcagguggaaagauccccugucucacagcccaaagacaugcacaaccacaggacuuguucaguuguuuaguuugccuguccuuccuuccuucuuuuauggggccaucuuguuuuccugccuuuuguuugggucucuggucaucucuugcauuaugaaaaguuaauggucacuacauaaugcuaacagcaguucucuaccuggucuucuuugaagagacauggucccgaaguccgcaacaauuucucuuuggcccucgcaucucucuauguauucuagcaaugcuguucucuuaugguuauucuuccauagugaaaggcucucugcccaacacuuuuaaaaguaugaccuaauuccauuuagaccacauuugaggauuugcuauuugagucauuugugcauugaugacaauuuauacuuguaaacaacugaguguccagacuaauuugcaaccuaacugacacguaaccagucaguuguccuggcuccuaagguaaucacagagucuggaaaaagaagccagcuaccucuaacugggaagcccuauuucuuuuuuuuugagacggagucuugcucuguugcccaggcuggagugcaguggugcaaucucggcucacugcaagcuccgccuccuggguucaugccauucuccugccucagccuccugaguagcugggacuacgggugcccaccaccacgcccagcauauuuuuuguauuuuuaguagagacaggauuucacuguguuagccaggauguucucgaucuccugaccucgugauucgcccgccucagccucccaaagugcugagauuacaggcgugagccacugcgcccagccggaagcccuauuucaaugucuuucaucuucaguuuguuagaauacucuagcagggaagccaaacucugagaacauccuugagcaauuaacacucccccaucuaucuggcagcugucuuauucaaugaaguacaagcaucaggaaggaccaauacagaauacuaaaaauaaaauacuaaaggaggaaggggauaucuucccaaccagcuggaucagcugaaucagccuugguaaucaacgugacaacacauugcaucuacaucuuaacuagggauuauuuuaaagaaugccuguaaagcugugcuaauccucucuucacuaauuagaaagagaagaaugcugggaucucuagauaggugaaacuguauucguuuuaggacuuuccauucugcccacugcugcuuuuguucuucuaccucuugagcuugauuccaaaaagcaaaaaguacugaaauuggcagaucucccagaaucaaagugaguaaguuuauuugucuuacuugaagccuguggugaagcuucaaccuccagguuagaugggaagcguucgcucugagccccaagcacucccauaggcagugacuggucuccagaagcaaggucagccuccagcuccucacugacaggaaaagugaugucgcucacagguuccuccuugaucuucacagguuuagcguccucuguggccuucucaggauugacaauccuuucauauucuucagagaguugcuuacuaaucuguuggcaagcaagagucaauuuuccaaggaaauguuaaaagcaaguuggauagucagcuugugacgucccauggaaaagccaacagaacaugaauaacagaauuuuaaaacauucacugccaaugggagggauuuguuuaaggugcugaguuugcauuuaugagugauagagauauguaaagaaaauugguuuggcagagaauguguaugucauuaauuaaaaguuacauaaagguaaaaaaauguguuagaacugggacaaaagauuacauuuuuuuggcuauaaaaauuaacaguaggcugggcacggucauucacaccugucaucccaguacuuugggaggccaaggugggaggacaacuugagccucggagucugagaccagcuugggcaguaucuagugagaccccaucucuaccaaaaaaaaaaaaaagcugggcauggugguucacaucuguggucucagcuacuuggaaggcugagguggaaggaucgcuuguagugagcugugauugugccacugcacuccagcccaggcaacccugucuaaaaaaagggaaaaaaaaguugacauauguauccuaggugaauaaucaauggugugggaaaucuggaucacuuagcaaagacuuuuuucuuggguguuaaaaauuccuaaucauauuuuagaccugcagaaacugaaacagugaacaaaugacuuaagagcacaagggcugaagagauuagauauuucugguuccaagcaaaaucaucaccccccaccaacccauccuccaggcaauaucauuuuacucuguuuuuuucauagcacuuaacauuauccaaaauuguauuuuuuuguguaugugcuuagagacagggucuugcuauguugcccaggcuggucuuaaacuucuggccucaaacaauccucccaccucagccucccaagcagcuauauuagauauauauauuacaauuccagucaaaccauuauauuagcugcuugagaggcugaggcaggaggauugucaguaggucuguguucucuuuuuuuuuuuuucagacagggucuugcucugucacccagguuggagugcaauggcacaaucauggcucacagcagccuuaacuuccuggucucaagugaccuucccaccucacacucccaaguagcugagaccacaggcaugagcuaccauguccagcuaauuuuuauuuuuuaauuuucuguagagauggggucucacuauauuguccaggcuggucuugaacuccuggccucaagcaauccucccaccucagcuucccaaguagcugggauuacaggcaugugccaucaugcccagcuccugaaauuguuuugauuguuauuuauugacuuguguuugucucccuucaaaaacaauguaaacucagguaacuuaguaacugcugaaucccacaaugcucgacucucaacaggcacucaauaaauacuuguugaauaaaaucagacuaacugcauucucucagauuccauauacuuguggauaguuucuuccagaggaaguaucagugaauguggccauucacugacuaaaggagacccaugguauuuggccaggaacaucgcuagggccaucauaaaaguauguuaaguucacucuguuccaagacucugugcucugcacucuagaccaaguguugugggauccugcugaacacuccgagauugcacagacaucugugcccacuuuucaacagggucgccucaccuguagcauguaacugugauaguccuugaugcggugcugccagaacuucuggagggagagcacacugccaauacccacuucauggaauaccugcuccaucacaucaggaaaaggagucugucccagccgggccucccgguccacagcaaaacgcagcaacuugguaaacuuaaggcaauacucaugugccacaucaguuagggucuccaggacacucucauuagcacagucaaagcccgcgugggccaggauuguggccacugccugguagaggagcugccgacaggagugccagcugaguucagucacagguuccccuuucccacugaaaguggagauacggugguguuauuaauguucuugcaaaggggugaccccuccugucuuccccaggaguuuuacaauuccagucaagccacuggccuagcuuuccagggaaauuccauccaaguuacauagcucaguuucauccugcugcuaucugggcaugucuuagcaacccauggucauaucuuugagcuccuccaaagacauaguuugaauaggcaauacaugucuauaauacacaauccaaaaggauaucuagugaaaagaaaguuuccuucuagcaacuguucaauuuugaucacuuuuaggauuaaguuuaacaguauagcccagacacugcucaaugaugcucuaauuauuuuaccauaaccuaguuuucauacaugcugggcaauauauuaauacaaacuuuuagaaauucacaguuccaauaaagagauucuucacaguucccaggaguuuaagauucuuagauucuuauaaaguuacaagggaccauuucaaaacagggaagucaacucaauuuuauaaaagcaauuuaaaacauauauagcuuacaaagcauuuucauccuauccuguguugugcaauggguagggucuguauuauuauuauuucuauuugccaggagaggaaacagguuuagaagggcugacuugccaaaauuuguuuacauauaauuaguaagugguaaagcuucugacuccagaaaccguauccugcauaauacaccauuuugccccuaaucacuacugcagaaaucuuaauuuuccaagaaaaaaauuaagaaagcuauuugaucuaaaaauaacuuaagaagcuuuuaauaauuuaccugucucuugaaauuuccuacuggcuucugccuaccccugacaaaggaauuuauuuuaccaauaaaaauaaaauagagcacagaaaaucauuuuuccuugguucguacuuggcaugugucaucacgcacuguacaaaagugccugagugguuauccacccacuaaacucugaccuguucaauagcaacuauugcaguuuacauaauaguuugacaauaagauaacuaauugccaaguaacuuuucauuuacuaucuucaucauuuccauggccagugucucugggccaaaagcuaaaggccucauaaguaccuaauaaacagagacaacuaaaccaauaucacuuuccuagaauaauaucuggaccucuuucaaaggaaaguaauuuuuuggugcccccauaacugaugcaaauuauuuuuguuauacaguuuccuaaauauguauaaaauaaaaccagguacaaacuuuugauggucauggcucuuacuauauaaauuugauacaaaacuaaaaaugaauaaacagcaucaauuuaauaugauagauaacauuauauuguugaaauuaaauugcccucaauaugugaauacaguauugaucaccacagagcaaguuuuuugaguugggcgugucuaugcuagcauaugcugugcauguaauaacacaguuaugccuccccuuuucauuauuccagugacuucagaaccuuugauuacaauggaccuugauauaaucuggccuucaccuggcccaacugcaaugcaaccccuguguauuuagucuauuucuguacuuuucucauuaguuugggaaccacuaaaauaguauuaccagcaacagguagauguaauaaauaacauauaauaucacuucuguaguauucuugccgaacauauuuaaucugaaucuaaucuugaggaaauaaucagcaaauccaguaauugggacauucuacaagcgaccugaacucauaaaagacucuaaagaggcauaacaaccagguacaaugcaugaaucuuuguuagauccuggauucgagggaaaagacauuuacaaaagauauuuuguaaauauacuuacaaaagauaauuggaagaaugugaauaugaacuuauuaaaugguacuuaauguucauuuacuuugguaaugguauuaugauuaugcaggaaaauuuccuuauucuuaggauaugcaugcugaggaauuuaggggugaaauauggugaugucugcaacuuacuuuaaaaugggggaaaaaaugugugcauauacaaguaugcauauauguauguuuguauauguguguauauauguguauacacacacauaugugagaaaguaaauguggcaaaauguuaaacauuagugagucauggugaagguauuuggauguuuguugacuauuacacauuucuguagguuuggcaaauuucaaaaugaaaauaaaaaaguaauuggcauuaaauacaacuugcacacugacaucuaguagcagcucuagguuauaaggcagucacguucagaggauguggagcagagcuucucaaacuuaaaugcacauacaaaucuccuggagaucuuguuauaaugcagauucugauucagcaggacugggugaggccugagauucugcauaucuaaaaaacugccaggugauguugaugcugcagaucuuggaccagauauugaguagcagggaucaauaacauuuuuauauuauuauuucuuuuuuuuuuuuuccagacagggucucacucagucacccaggcuggagugcaguggagugaucugcaaucucugccuccccuggguucaagugauucucgugccucagccucccgaguagcugggacuacagaugugcgccacuacaccugacuaauuuuuguauuuuuaguacagaugggguuucgccauguuggccagguugauuuugaacuccuggccucaagugauccacccaccguggcuucccaaagucuugggguuacaggcaugaaccacugugcucagcuuauauuauuauuucuugaacuauguuaucaaaaugaaaacacacaauuuaaagauucuuguguagacuugcggauuccuaaaaauaccagaauaaguccaugaaucccaauuugaagacaacgagcuaaacccauaauuuuuuuuuauauuaaauagaaagacuagauccuaagaacuaugaggccauggccuuuuuuacauaccaguguauuacccugcuccuaguaaagugcuuggcacauaguaagcacucaaaaaauuaaaaaauacagacccugaauucugaagacuggcauucaaaacuuagauaucccacuaauuaccuggagaaaccuuggccaagucaauuacucuuauccucaguuuccucgcaugaaaauggaaaugcuauuauaggcuuaacaggguuguugggaagaugacuugagaaaaguaagauacagcaaagccuugccuuaccgauaaaagucacucucugggucacugugccggaucuggaauggugcauugggauucuuacaaucuaaaggcaggaggucaucagggagaggaggugacccagggcacgagggaagagguucacucucuucaguuuuuacaccuucugucugcugcugauucugggccugagcuguggcaauaagguugcgaagacgucgguugugcugaaucaacugaaucguauggauggugagacuacauggcucugaggggauguccagcauaguggggggcuucggcuuguuggcugaggguuggugcaggggugggucauggacuuccaccagacggaacucccgugggagcaaaucgaaggaacuucuguuggucuggcuugaugauauugguaucucuccccaguaucucaacauuuuggaauaagaagagaagaggucucaggauaaauguagacaauaaccuaaaaguaauguguuuaaauccuggcaacuuuagauuauaggcuucuguagugaaaaauacgaggucuagccaguuauuuauguaaaaaguaggcuauuugugaccacuuagaaaaaugucagugucagcaaaacuguaggaccaaagguguucucccuaaauaaauuaagagaaauguaacuguuagaugcugguuauugucauacuaugacaauuccuacuacacugaaccacaggguagaauuugggucauuaguggaccaauagcuacaacagcaucuggagcucuaguaucccuauuucccaucucacucacuaacucauuaccagaacuaccaucacgcucaauccugaacaauaagcaaggcaugauaagguaucuugauacaucugugcuggaucaauaggagaaaaacuaguaggguuaaagauaauaagaagugguucuuacucugugugucuuaggcaugauccugguggaaaaauuuaugaaccauuaaucuaaauggcauuaugcuuucaacuuuugacauauagaacgugagagauuucugcugccuucuaacugguaucccuuccuccaaucucucuuuguaugucaucuauucucuacacugcugcuagacuuacucuuuuuaaaacuuaaaucaaauggcuucccauugccuauuggaaaaagucagaauuccuuggcuuaccauucaacaaaauucacaaucugguuucaacucaccuuugcagauucauuguccauaugucucuucaaguucaacaaacauuuaucaaaugccaggcauucugugucggucaaagacugauaaugugagauccuugcccugaagugaggaagagaaacagaagcagaauauuucaauaugaaacaugguaaguacuguucuagagguauauggaccugggguacuggaagcacaaaggaggagcuuccugggugaaaugacuaccuuuguucuaacaacauuauacuacucaguuucuugagaaugcuguacauuuccacaauugacacuuucagcugugaacucugccagaaaugcucugccaaccuugcacaucccuggcagacucauauucauuuuuaaguacagcauaaguccccaccguccgucacuucaccagugcaucucccuuucucuauucucacagugcuuugcaagucuaugucacagcaguuauccuuggauuuuaauuaguacuuaucgcaauagauuuuuucugcccgucuauuucuuauggcuguggucuuguuacagggccaggcacacagaaauaucuggcauuuguugaauguuuacuauaugccagacuucaccuuuuuuguuuguuucuuuuuugagacaggguuucacucuguagcccaggcuggagugcaguggugcagucaugguucacugcagccucaaccuccugggaccaagcaauccucccaccucagccucuggaguagcugggacuacaggcgcgcaccaucaaaccuggauuuuuucuuuuuuuuuuuuuuuuuuggcgagacagggucucgccauguugcccagccuccucuggaacuccugggcucaagcaauccucccgccucagccucccaaaauguugggauuacaggcaugagccaccggucuggcuggccuuuauuguuugauucaauucuuccaacaacccuaugaggcuaauaaucuuauccccauuuuucagagugagggcugaggccuagugucuugcccaaugucacaaauggcgaggucaaaaaucgacagucuccagagucugcucucuuaaccacuuaacuauucugccuuaauaauuucagaaaaaaaauaaaugaaugaacgaaauaacaaaaaagucgcccucuucccuuacuuuaccgaaaggagcacgaagaacaggcacggagcccaaggaaugcccaagucccuccagggguuuccucggucacgguccgccggcgcaggcgccaaucacaggguccugaggucgccugacguucagggcagccggaagacggggaggucuggaccugaaccgagacaaggagguaccacacuauucacugcugcgucgcagagcgggcugggcggcugucuggaccucgagaggccugaggcaaggaucgcgucag

SEQ ID NO: 193011 - RNA, 12771 nt, Homo sapiens
cugacgcgauccuugccucaggccucucgagguccagacagccgcccagcccgcucugcgacgcagcagugaauagugugguaccuccuugucucgguucagguccagaccuccccgucuuccggcugcccugaacgucaggcgaccucaggacccugugauuggcgccugcgccggcggaccgugaccgaggaaaccccuggagggacuugggcauuccuugggcuccgugccuguucuucgugcuccuuucgguaaaguaagggaagagggcgacuuuuuuguuauuucguucauucauuuauuuuuuuucugaaauuauuaaggcagaauaguuaagugguuaagagagcagacucuggagacugucgauuuuugaccucgccauuugugacauugggcaagacacuaggccucagcccucacucugaaaaauggggauaagauuauuagccucauaggguuguuggaagaauugaaucaaacaauaaaggccagccagaccgguggcucaugccuguaaucccaacauuuugggaggcugaggcgggaggauugcuugagcccaggaguuccagaggaggcugggcaacauggcgagacccugucucgccaaaaaaaaaaaaaaaaaagaaaaaauccagguuugauggugcgcgccuguagucccagcuacuccagaggcugaggugggaggauugcuuggucccaggagguugaggcugcagugaaccaugacugcaccacugcacuccagccugggcuacagagugaaacccugucucaaaaaagaaacaaacaaaaaaggugaagucuggcauauaguaaacauucaacaaaugccagauauuucugugugccuggcccuguaacaagaccacagccauaagaaauagacgggcagaaaaaaucuauugcgauaaguacuaauuaaaauccaaggauaacugcugugacauagacuugcaaagcacugugagaauagagaaagggagaugcacuggugaagugacggacgguggggacuuaugcuguacuuaaaaaugaauaugagucugccagggaugugcaagguuggcagagcauuucuggcagaguucacagcugaaagugucaauuguggaaauguacagcauucucaagaaacugaguaguauaauguuguuagaacaaagguagucauuucacccaggaagcuccuccuuugugcuuccaguaccccagguccauauaccucuagaacaguacuuaccauguuucauauugaaauauucugcuucuguuucucuuccucacuucagggcaaggaucucacauuaucagucuuugaccgacacagaaugccuggcauuugauaaauguuuguugaacuugaagagacauauggacaaugaaucugcaaaggugaguugaaaccagauugugaauuuuguugaaugguaagccaaggaauucugacuuuuuccaauaggcaaugggaagccauuugauuuaaguuuuaaaaagaguaagucuagcagcaguguagagaauagaugacauacaaagagagauuggaggaagggauaccaguuagaaggcagcagaaaucucucacguucuauaugucaaaaguugaaagcauaaugccauuuagauuaaugguucauaaauuuuuccaccaggaucaugccuaagacacacagaguaagaaccacuucuuauuaucuuuaacccuacuaguuuuucuccuauugauccagcacagauguaucaagauaccuuaucaugccuugcuuauuguucaggauugagcgugaugguaguucugguaaugaguuagugagugagaugggaaauagggauacuagagcuccagaugcuguuguagcuauugguccacuaaugacccaaauucuacccugugguucaguguaguaggaauugucauaguaugacaauaaccagcaucuaacaguuacauuucucuuaauuuauuuagggagaacaccuuugguccuacaguuuugcugacacugacauuuuucuaaguggucacaaauagccuacuuuuuacauaaauaacuggcuagaccucguauuuuucacuacagaagccuauaaucuaaaguugccaggauuuaaacacauuacuuuuagguuauugucuacauuuauccugagaccucuucucuucuuauuccaaaauguugagauacuggggagagauaccaauaucaucaagccagaccaacagaaguuccuucgauuugcucccacgggaguuccgucugguggaaguccaugacccaccccugcaccaacccucagccaacaagccgaagccccccacuaugcuggacauccccucagagccauguagucucaccauccauacgauucaguugauucagcacaaccgacgucuucgcaaccuuauugccacagcucaggcccagaaucagcagcagacagaagguguaaaaacugaagagagugaaccucuucccucgugcccugggucaccuccucucccugaugaccuccugccuuuagauuguaagaaucccaaugcaccauuccagauccggcacagugacccagagagugacuuuuaucgguaaggcaaggcuuugcuguaucuuacuuuucucaagucaucuucccaacaacccuguuaagccuauaauagcauuuccauuuucaugcgaggaaacugaggauaagaguaauugacuuggccaagguuucuccagguaauuagugggauaucuaaguuuugaaugccagucuucagaauucagggucuguauuuuuuaauuuuuugagugcuuacuaugugccaagcacuuuacuaggagcaggguaauacacugguauguaaaaaaggccauggccucauaguucuuaggaucuagucuuucuauuuaauauaaaaaaaaauuauggguuuagcucguugucuucaaauugggauucauggacuuauucugguauuuuuaggaauccgcaagucuacacaagaaucuuuaaauuguguguuuucauuuugauaacauaguucaagaaauaauaauauaagcugagcacagugguucaugccuguaaccccaagacuuugggaagccacgguggguggaucacuugaggccaggaguucaaaaucaaccuggccaacauggcgaaaccccaucuguacuaaaaauacaaaaauuagucagguguaguggcgcacaucuguagucccagcuacucgggaggcugaggcacgagaaucacuugaacccaggggaggcagagauugcagaucacuccacugcacuccagccugggugacugagugagacccugucuggaaaaaaaaaaaaagaaauaauaauauaaaaauguuauugaucccugcuacucaauaucugguccaagaucugcagcaucaacaucaccuggcaguuuuuuagauaugcagaaucucaggccucacccaguccugcugaaucagaaucugcauuauaacaagaucuccaggagauuuguaugugcauuuaaguuugagaagcucugcuccacauccucugaacgugacugccuuauaaccuagagcugcuacuagaugucagugugcaaguuguauuuaaugccaauuacuuuuuuauuuucauuuugaaauuugccaaaccuacagaaauguguaauagucaacaaacauccaaauaccuucaccaugacucacuaauguuuaacauuuugccacauuuacuuucucacauauguguguguauacacauauauacacacauauacaaacauacauauaugcauacuuguauaugcacacauuuuuucccccauuuuaaaguaaguugcagacaucaccauauuucaccccuaaauuccucagcaugcauauccuaagaauaaggaaauuuuccugcauaaucauaauaccauuaccaaaguaaaugaacauuaaguaccauuuaauaaguucauauucacauucuuccaauuaucuuuuguaaguauauuuacaaaauaucuuuuguaaaugucuuuucccucgaauccaggaucuaacaaagauucaugcauuguaccugguuguuaugccucuuuagagucuuuuaugaguucaggucgcuuguagaaugucccaauuacuggauuugcugauuauuuccucaagauuagauucagauuaaauauguucggcaagaauacuacagaagugauauuauauguuauuuauuacaucuaccuguugcugguaauacuauuuuagugguucccaaacuaaugagaaaaguacagaaauagacuaaauacacagggguugcauugcaguugggccaggugaaggccagauuauaucaagguccauuguaaucaaagguucugaagucacuggaauaaugaaaaggggaggcauaacuguguuauuacaugcacagcauaugcuagcauagacacgcccaacucaaaaaacuugcucuguggugaucaauacuguauucacauauugagggcaauuuaauuucaacaauauaauguuaucuaucauauuaaauugaugcuguuuauucauuuuuaguuuuguaucaaauuuauauaguaagagccaugaccaucaaaaguuuguaccugguuuuauuuuauacauauuuaggaaacuguauaacaaaaauaauuugcaucaguuaugggggcaccaaaaaauuacuuuccuuugaaagagguccagauauuauucuaggaaagugauauugguuuaguugucucuguuuauuagguacuuaugaggccuuuagcuuuuggcccagagacacuggccauggaaaugaugaagauaguaaaugaaaaguuacuuggcaauuaguuaucuuauugucaaacuauuauguaaacugcaauaguugcuauugaacaggucagaguuuaguggguggauaaccacucaggcacuuuuguacagugcgugaugacacaugccaaguacgaaccaaggaaaaaugauuuucugugcucuauuuuauuuuuauugguaaaauaaauuccuuugucagggguaggcagaagccaguaggaaauuucaagagacagguaaauuauuaaaagcuucuuaaguuauuuuuagaucaaauagcuuucuuaauuuuuuucuuggaaaauuaagauuucugcaguagugauuaggggcaaaaugguguauuaugcaggauacgguuucuggagucagaagcuuuaccacuuacuaauuauauguaaacaaauuuuggcaagucagcccuucuaaaccuguuuccucuccuggcaaauagaaauaauaauaauacagacccuacccauugcacaacacaggauaggaugaaaaugcuuuguaagcuauauauguuuuaaauugcuuuuauaaaauugaguugacuucccuguuuugaaauggucccuuguaacuuuauaagaaucuaagaaucuuaaacuccugggaacugugaagaaucucuuuauuggaacugugaauuucuaaaaguuuguauuaauauauugcccagcauguaugaaaacuagguuaugguaaaauaauuagagcaucauugagcagugucugggcuauacuguuaaacuuaauccuaaaagugaucaaaauugaacaguugcuagaaggaaacuuucuuuucacuagauauccuuuuggauuguguauuauagacauguauugccuauucaaacuaugucuuuggaggagcucaaagauaugaccauggguugcuaagacaugcccagauagcagcaggaugaaacugagcuauguaacuuggauggaauuucccuggaaagcuaggccaguggcuugacuggaauuguaaaacuccuggggaagacaggaggggucaccccuuugcaagaacauuaauaacaccaccguaucuccacuuucagugggaaaggggaaccugugacugaacucagcuggcacuccugucggcagcuccucuaccaggcaguggccacaauccuggcccacgcgggcuuugacugugcuaaugagaguguccuggagacccuaacugauguggcacaugaguauugccuuaaguuuaccaaguugcugcguuuugcuguggaccgggaggcccggcugggacagacuccuuuuccugaugugauggagcagguauuccaugaaguggguauuggcagugugcucucccuccagaaguucuggcagcaccgcaucaaggacuaucacaguuacaugcuacaggugaggcgacccuguugaaaagugggcacagaugucugugcaaucucggaguguucagcaggaucccacaacacuuggucuagagugcagagcacagagucuuggaacagagugaacuuaacauacuuuuaugauggcccuagcgauguuccuggccaaauaccaugggucuccuuuagucagugaauggccacauucacugauacuuccucuggaagaaacuauccacaaguauauggaaucugagagaaugcaguuagucugauuuuauucaacaaguauuuauugagugccuguugagagucgagcauugugggauucagcaguuacuaaguuaccugaguuuacauuguuuuugaagggagacaaacacaagucaauaaauaacaaucaaaacaauuucaggagcugggcaugauggcacaugccuguaaucccagcuacuugggaagcugaggugggaggauugcuugaggccaggaguucaagaccagccuggacaauauagugagaccccaucucuacagaaaauuaaaaaauaaaaauuagcuggacaugguagcucaugccuguggucucagcuacuugggagugugaggugggaaggucacuugagaccaggaaguuaaggcugcugugagccaugauugugccauugcacuccaaccugggugacagagcaagacccugucugaaaaaaaaaaaaagagaacacagaccuacugacaauccuccugccucagccucucaagcagcuaauauaaugguuugacuggaauuguaauauauauaucuaauauagcugcuugggaggcugaggugggaggauuguuugaggccagaaguuuaagaccagccugggcaacauagcaagacccugucucuaagcacauacacaaaaaaauacaauuuuggauaauguuaagugcuaugaaaaaaacagaguaaaaugauauugccuggaggauggguugguggggggugaugauuuugcuuggaaccagaaauaucuaaucucuucagcccuugugcucuuaagucauuuguucacuguuucaguuucugcaggucuaaaauaugauuaggaauuuuuaacacccaagaaaaaagucuuugcuaagugauccagauuucccacaccauugauuauucaccuaggauacauaugucaacuuuuuuuucccuuuuuuuagacaggguugccugggcuggagugcaguggcacaaucacagcucacuacaagcgauccuuccaccucagccuuccaaguagcugagaccacagaugugaaccaccaugcccagcuuuuuuuuuuuuuugguagagauggggucucacuagauacugcccaagcuggucucagacuccgaggcucaaguuguccucccaccuuggccucccaaaguacugggaugacaggugugaaugaccgugcccagccuacuguuaauuuuuauagccaaaaaaauguaaucuuuugucccaguucuaacacauuuuuuuaccuuuauguaacuuuuaauuaaugacauacacauucucugccaaaccaauuuucuuuacauaucucuaucacucauaaaugcaaacucagcaccuuaaacaaaucccucccauuggcagugaauguuuuaaaauucuguuauucauguucuguuggcuuuuccaugggacgucacaagcugacuauccaacuugcuuuuaacauuuccuuggaaaauugacucuugcuugccaacagauuaguaagcaacucucugaagaauaugaaaggauugucaauccugagaaggccacagaggacgcuaaaccugugaagaucaaggaggaaccugugagcgacaucacuuuuccugucagugaggagcuggaggcugaccuugcuucuggagaccagucacugccuaugggagugcuuggggcucagagcgaacgcuucccaucuaaccuggagguugaagcuucaccacaggcuucaaguaagacaaauaaacuuacucacuuugauucugggagaucugccaauuucaguacuuuuugcuuuuuggaaucaagcucaagagguagaagaacaaaagcagcagugggcagaauggaaaguccuaaaacgaauacaguuucaccuaucuagagaucccagcauucuucucuuucuaauuagugaagagaggauuagcacagcuuuacaggcauucuuuaaaauaaucccuaguuaagauguagaugcaauguguugucacguugauuaccaaggcugauucagcugauccagcugguugggaagauauccccuuccuccuuuaguauuuuauuuuuaguauucuguauugguccuuccugaugcuuguacuucauugaauaagacagcugccagauagaugggggaguguuaauugcucaaggauguucucagaguuuggcuucccugcuagaguauucuaacaaacugaagaugaaagacauugaaauagggcuuccggcugggcgcaguggcucacgccuguaaucucagcacuuugggaggcugaggcgggcgaaucacgaggucaggagaucgagaacauccuggcuaacacagugaaauccugucucuacuaaaaauacaaaaaauaugcugggcgugguggugggcacccguagucccagcuacucaggaggcugaggcaggagaauggcaugaacccaggaggcggagcuugcagugagccgagauugcaccacugcacuccagccugggcaacagagcaagacuccgucucaaaaaaaaagaaauagggcuucccaguuagagguagcuggcuucuuuuuccagacucugugauuaccuuaggagccaggacaacugacugguuacgugucaguuagguugcaaauuagucuggacacucaguuguuuacaaguauaaauugucaucaaugcacaaaugacucaaauagcaaauccucaaauguggucuaaauggaauuaggucauacuuuuaaaaguguugggcagagagccuuucacuauggaagaauaaccauaagagaacagcauugcuagaauacauagagagaugcgagggccaaagagaaauuguugcggacuucgggaccaugucucuucaaagaagaccagguagagaacugcuguuagcauuauguagugaccauuaacuuuucauaaugcaagagaugaccagagacccaaacaaaaggcaggaaaacaagauggccccauaaaagaaggaaggaaggacaggcaaacuaaacaacugaacaaguccugugguugugcaugucuuugggcugugagacaggggaucuuuccaccugccuaguuucacuucccugguuuaggggaaaugggggugggugagguagaggaaagaaagguagaagaaauggaaaagaagauaaucagagcugguaauuuuuugggaugguuaacuuuuugaagcagagaguaacaaccauauucuccagccaaguacagaaucagagugaaaacugagcucaaagcauauuaguugguucugagugauauauuuacucuuuguucuacacuuggcuacacauauacacuugguguauguccaucuuuccucuguuucuaggugcagagguaaaugcuucuccucuuuggaaucuggcccaugugaaaauggagccucaagaaagugaagaaggcaaugucucugggcauggugugcugggcagugaugucuucgaggagccuaugucaggcaugagugaagcugggauuccucagagcccugaugacucagauagcagcuaugguucccacuccacugacagccucaugggguccuccccuguuuucaaccagcgcugcaagaagaggaugaggaaaauauaaaaggaaaagagggagauguuuuguccagaccuacuagacccaacagaaaagguuuuuguauuagaaucuguuuccuuaaaaauugauuugacuccuguucuuaaacacaagugguuuuuccuaauuccagaggaacuggacgucaccaaacaagguugcauuuuacuuuugcauccaguuuuuauaguuuuccacaaccaagccacccuucacagauaaaauaugaugcuggcauggcaaucagaccaaagcacuguccccaauuguugucuuaacuaugacuagacauguuauacagccauuuaucuuguacaacugagaagaaucauacuuugaccuaccuuguagagaugugaggauuuagauguuugcuaacuucaaaacugugcuugaauagacuaauaauauaugcucauaucagaugucaguuuucauuuaacuugauucauuuuuggcucaggucauugggaacccauuacuaauaccuaacaggaaauagcuaaacacaacacaccuuaucuauuagucaccuucuuaaaacuguuuuugcuacuuuugaagugucuuauuuauaagaucagaggucugacaccuuuuuugcuuagacagcucucuaucucauccauuuauuuucuucucuagacuuacuccaucucuccucauccuuuugccuuuguuauuucugcucggacucacauacuuucaccauauacauauuuucaauuguuucuuuccuuuucuccuuugugagcaaagcaaacaaguacuguccaaggacagccuugugcauauuucauuuguugcauuugcuuggucaucagaggacagcaguccauuaagcacacuuugcugcuucuacuguaaaggcagccuuuaaaacauagcaauaugcaccuuucaacuuuacaucauguccugaacaacaucacugugguuacucauccaucagacuaucuguauauauaaguacugaaucaguauuuauuaaguaaaugauguagcacuguagugauuaggaaucauuagcaaauguguugcuucaugccuuggugauggaugccagcauguuaaacugcugaaguuugauuuucugaugcaaaauauaucuuguaaaauuuagaccacuccuuuaaugcagaccaaaauaaggcacagcuuuaauucauuauugaaugccuuaaaugucccagguauugagaauaaaugaauaugauacaaaugagguuauaguuuaacauauaauuuuaaauuugccaauuguaacucuuuagcacauuucucuaaacccuuucugucacagucuuuuuuuuaauuuauuuauuuauuuauuuauuuuugagauggagucuugcucugucacccaggcuggagugcaauggugcaauuucgacucacugcaaccucugccucccagguucaagcgauucuccugccucagccaccugaguagcugggauuacacgcacaugccaccacacccagcuaauuuuugcauuuuuaguagagaugagguuucaccguguuggccaggcuggucucaaaacuccugaccucaagugaucugcccgccucgggcucccaaagugcugggauuacaggcgugagccacugcaccuggccucuguugcagucuuaucuucauuuuccuuuguuuauaaugaaaguggcgauuaggcaguuaguuuccauaaaguggccguaugggaauuuaguucauucauccagcaaacauugaguaccaauuauuugcuagguccugugcaaggaauacaaaaaugauuaagacuucuuccuuacccuuuuggagcuugaagcauaaggaagacaaguuauucuguaaggaagauaaagcauucaaaaguacuacagagaaaaaccaaguaugcuugaguuuugcgaauguucuccucuuaaagaauagcuucaaauuuugagaccagugguucccacuaaguauagaacauuaaaauuaauacuuuauaauaaaacacuuuuauugcugcagaauguuaaacugcauaacaggcaccagauggucaagacgagggaaauaugagaaggcaaaugaugugaggauuaguaucuugagauucaccuggucuggaauuaugucauaggcuacuaugcaucagaaucacauggagggcuuucuaaaacagacugcucagcccacccccaggguuucugaguucauagguuauaagagguaaguugaacaauuccccagaugaugcugaugcuccugguccacaaugugagaaccacuaaguuggaguacugacucauagagauaaaauucuuugaaagaaauguacuguuuuaagauacuguaaaauguggaggcagggcaaacguuuauaagggcuguuauguaugaaaugugccucugacccaaauccacggacuuugcgaaaaucaccaaggagacuuugcauuaaguucagaguacaauacaaacugggccuagcucuguauuuagucaguaugugcacgugggaaacuuuaguaaaauaucaccuccuuauugagacaaguuuggacaucuggccuuaagccucuguugaacaggagaagugaagcuguuugcaauuauauaauuuucuaauuugaaaucaugacaagcagucuuagaacaaaguuaaaauuaaaaagucuuuauccaagucaccaaug

SEQ ID NO: 193012 - RNA, 97319 nt, Homo sapiens
uguggggacaagaguaacuuuauugaaaauacuaauccuccauguuacuucugacuggcccugagucugggaaggccgccaaagugucuaggugauguauuacucuuuaugguagaacaccuauucauuauaaacuucccccaauacaaccccuguuguugcagaaaucuuaggcugugacaaccauagcugccuacacauuccuuguaucuugggguaaaagcacacgugcucuggaaggaauguguagguggcuaugggugcacaauuucaggggguucgugaacuccaguuaagacuugcccuaauuauaccauguaaauaauucaauaaugggcaauucuguaguagaaauuuuauucccacccauaaaauauaucacuaaauagcugaaaaauuuacauauuauuuuaaaacauagacuuaaaaaaucauauuagcuucuccuuagcaaaaugcuuuuguuuuauguauuuacaagaauauacuguacuucagguacacaauucacucaagccagccugagaaggccuuggaugcagaucaaugcuccaauaaaguucauuaucagcuccuccugccuugugacaggaugauuugauuuuacaaaagucccuuugaaaacaagaguaaacgcagacagcuucuagagaaaagucuggugaagcagcaguugauaauagauuuucuuuuagugaugaaauuaaucuuguuuugguaaucuacagccuguuagggauagguggagggaugaaguccuuaaaacuaaauuguuccucuacgaaucuucgaccugagccugcggagagaguagccccaaauccaucucucugcugaaaggucgccuguuuugguaggugugaggacauuccgaaacacggccauccacauucugauacaucugaaugugggaaagagacagaacacugauuaccaucugauguagaugcacauguuaugcgcccauauuacaaauuauuuaaauaaaaacaguuguucuauauagacaauuacuuuuuuguuuguuuguuguuuguuuguuuauuuuuugagacagagucucgcucuguugcccagacuggagugcagugguacaaccauaguucaccguggccuugauguucuggguuugagcaauccucccaccuuaaccuccugaguagcugggaccacaagcaggcuccaccacacccugcuaauuuuuuuauuuuuuguaaagacaaagucucacuauguuguccaggguggucucaaacuccugggcucaagugaucccacaccaccccggccucccaaagugcugcgauuacaggugugagccacuacgcccggccuagacaucacuuuuaaaauguuuaaacugauauauaauagauguacauauuuucaggaaacguguagacaaguacuuuuauuaugcauaggucucagaggauauucuauauaacuaaaaaagcaauuuugguccuuuuauuaauggagaaaucaaaucauagucaaauauuuuauuucauuauugagucuacucucagauauaaaaugucacccuagaaauccuaaaaccaugcagaaaaaucauaaaagagaaaggccacaaaaggaaaucuguucauuauggaguuaauacaagggacugauucuugaguuuucccuuggaguuucacgacuuuuaaauauuuuuuucugaaaugaagagauuuacuuuccuuucccaaauaugaaguuaacaugcauucauauagauaauuugagaaauacagaaagagacguagaaggccgggcgcaguggcucaugccuguaaucccagcacuuugggaugccgaggcgggcggaucaccugggguugggaguucaggaccagccuagccaacguggagaaacccugucucuacuaaaaauacaaaacuagccgggcauggcggcgcgcgccugcagucccagcuacuugggaggcuaaggcaggagaauugcuugaaccugggagguggaggcugcagugagccuagauugugccacugcacuccagccugggugacagagcaagacuccaucucaaaaaaaagaaaaaaggcuacaagucaugacaaguacccgccauuauagacagcuugcuaugcacacacaauuuugugucugugggcucaggcuauauauucuauuuuggaaccuuauuuugaauuaucaauauauuguuauuauacugcucauauguugccugugucacauauuuacauuauucacuaaggauggccacauauuuuuuuuucacggcagccuagaguuccauaguacugaugcaucauaauuaaccuuuugaccaacugguuauacgaaacaaacugaaaagugcacacucaaucuagucugacguugggauaagcagaaguggaauugcuggaucaaaaaggaugcacacuugaacugugauacacaaggccaggcugcccugcagaaagguuguauuuauuucuacuccuaucaacggugccuggaaacuauauuuuccagagccuucugaacaauggguaugucagccucccacaucucuucucuuuugcugagcaagaaguucuaucuccuuaacuauauauguuucacuaucugcaaaguugggccuuuuuccuauacuuuauguccauuuguuuucauuuugaauagccugccuauuuccuuugccuuuuauguauauaaaaggcuauacaggcuggguguacuggcucaacucuguaauccuagcacuuugggaggccggggcgggaggauugcuugaggccaagaguucaagaccaaacuaaccaacauagcaagauccugucucuaaaagaaauaaguuuuuaaaaggugauacauuuuuauuauuauuuguuuauaagaacuuuaugauuuaggaaucaugcauucuauuuaaauuuuauagauuuguuccguucccacagcccuuguuacugucuacuucuuuuucuuuguuuuugacaguuuuaaugugaacuguccagacugccuccuacacuucacuuuucuuucuagaaaauuguguguguguguguguguguguguguguguguguauccuuugacccaaaauauauccauugugaaccagguguugcacaaugacagcuuugcuuguacccugaaggaugaacaguaacuacucaugcgugccuuuugugaaguagacauagcaguuaguuagcauuuguugaaccuguugaauccaaauguacaucucuaccacugaauuucuaaccaccucaugaaguuuguguagcacaaauaccaauaacacuuccaaucuuccaccugaauuaacuaacaugugcucuucauccagucucacugucuagaaguuucuagaaccaucucugacaaucucucuccacucccauagcuaguuacuggguauaguuguaauacaucacucuuuuccauuucuuuaagugaccuuucuuuccuuuuuuuuuuuuuuuuuuguuguugcuguugcuguugugacagagucucacucuguugcccaggcuggaguguuguggcaugaucucagcucacagcaaccucugccucucagguucaagcaauucuugugccucaaguagcugggacuacagguguguaccaccacaccuggcuaauuuuuauauuuuuuuaguagagacaggguuucaccauguugaccaggcuggucuugcacuccuggccucaagugauccacccaccuaggccucccaaagugcugggauuacaggcgugagccaccacccucagccacuguuguuuuuaacaggcucacagauaacaucauaaaagugaccuuuaaaugacuuuuuaaauacauucuccuuaugaaauugugaaacaaacccuagguuuucaaauguaucauuauaaagaaguauauaaauuuucuuauacuuuaaaaaaugguucuuuuuuccuuaguuaucguuuccuuuucaucugaauguuauuuauuugugcuuuuuucuuuuucaagacagggucucgcucugucacucaggcuggaguacaguggugcaaucacagcucacugcagccucaaccuccuaggcagaagugauucucuugucucagccuccugaguaacugggacuacuggugugcgccacuacaccugguuaauuuuuuaauuuuugguagagauggggucccauuauguugcccagucuggucucaaaccucugagcccaagugauccucucaccuuggccucucaaugugcugggauuacaggcgugagccaccacacccgacuucuuuuuuucuuaauuguucacuucaaagauaguagcuuuaguaguauauuuguauacuuuguugauauacaauauuaauauacaguauagacuacacucagacugcuguauucaaauccuaagucugacauuuaccauguuaccuuaggcaaauuacuuaaccucucugugccucaauuuacuagucugcuaaagggauaauaauagaaccuacuucaggagauugaggugaggauuaagaguuauuaauuuuguggcuaauacauuaguaaacucuaugauuaaauacucaaaaaauguuagcaauuacauuauuaguucaaaaaacaacuuuugguuuuccugaucaucgcuauuauuuugcuguugcuacuuccucugugucauuaaaucuggcuauaucucuauuaauuccuucuuucugcuuuguucauuuuccuccuccucucucucuccaccuucuucuuuauuguuguuuguuuuuucccuagcuucuuaaauugaaagguuaaucaggcuaggugcgguggcucacaccaguaaucccagcacuuugggaggcugaggcaggaggauugcuugaggccagcaguuugagacuagccugcacaacauagcaagauccccaucucugcaaaagagaauuuuuaaaaaguacucaggaagcugaggugggaggaucgcuugauuccaggaauuugaggcugcaaugagcaagaaccugucucaaaaaaaaaaaaaaaaaaaaaaggaaaaaaagguuagcuauugauuuucauuuuucuuuguuuucuaauaaaugaauuuagaauuaugaauuuggguaacucucacagguuuuaauaggcaauauccauuuuugcuccuucucccucuuuccccuucuucuucuuaagcaaagacuugcuuaagaggcaugauuuuuauuuuauuuauuuauuuuuugagacagaguuucguucuguuugcacucccaggcuggagugcaauggugcagucuaggcucacugcaaccuccgccucccgguuucaagcacuucucgugccucagccucccaaguagcugggauuuuagcuaccugccaccacacccagcuaauuuugucuuuuuaguagagacgggguuucaccagguuggccaggcuggucucgaacuccugaccucaggugauccacucgccucagacucccaaagugcuaggauuacaggcgugagcuaccacgccuggcugauuuuuaauuuugguauauaaauuugggggcuuuuuugguugggugauuuuuuuauuacauuguauugagauuagugaauguggcauucacuaacaaugcauguuaacaacuuuauuuauucugagauucucuuuccuaaguaggcuuacugauuguugccauuuuguguuuuauuuuuguauuuucaauuuuuauuuauuuauuuuauucuuuagagaugggaucucucuccuuugcccauauuggagugcagcagcccaguuauagcucacugcagccucgacuuccugggcucagggaauccucccagcucagccuccugaguagcuagaacuacaagcuugcaccaccacacccagcuaauuuuguguuuucuauuuccaugaacucucuuuauuuuucucuucccccauuuuguuggacugauuauguuuucuauggucauuuucuuccccuguacugaaacagaaguuauguguuacguuucuaucucacccauaucguucuuacauuuuuaacacccacauuuaaucuuauguugauuucaccauguggcugcuccugcuucagaacuucugcagugucccaggacuucuugcugccuuuguguuacccuuguccuuguuuuucccaggcauccucugugguggguuuucccucugcagugcaauuuuaacugcuuucauugucucagggauuuuccacaguuucugguccacaaaaagaucucuuucuuacugucaaagccaauuauggccucacuuuuauuuuaguuuaguuuaguucuguucuguugagacagagucuugcucugucacccagguuagaguacaguggcaugaucguggcuuacugcagccaugaccgcuccccagacucaagcgauccucccaccucagccucccuagcagcugggaccacaggaaugcaccaccacgccuggcuaauuuucaaauuuuuuuguagagauaggguuuuaccauguugcccagacuggccuugaacuccugagcucaaucuauguuugugccucagccucccagagugcugggauuaucagugucagccaccacgcuuggccucccuucucuuaaaacaaaacaaacuuauuuccuauaauuuauggggcugaguaggagaggggaggugauguuaguucagaccccuuuucugaaacaggggacaaguaugugcccccuuuuaucagcccacagccccugccuagugugcucccucagcgugcccauccuugcugcugccgccccucucaacugauguccugacaucucaucuucugccucgcuuuuccaaacuuccuuuuaugcucucuuuuucuuucucauuccagaaauguuugcugagcgccuuccacgugcuaagcaucaugcuagcagcggggucuauaaugaugaaccaaacagauguggucuccaacuugcuuucaugcugacuucauucauuuacuuaauaucacauggcaagcacuaccccaugggguguaaagaugaacaggaaacaguauuuacccuugcuaaugaagucuagugacgacagagagagacccauaauauaaagucauccuacacuaggauuugagucucacauggaguuacagcugaaaguguuaaugagaauucagaagcagcagccugaaaucugacuagggaaauugggggaggcuuugcagagcacagaauauuugaucugguucuuaaagauugaagcauguuuguccauccuaaaaaucuucaucgguucaccacugucuaaaugccuagacagguaaucauguaaucagugaucucccugaucuaaucccauugguguugagguuagacauaaaagccuuaaccuauguuuucuccaugcauuucccacucuuucucucugguucucugagggcccuuuuccuucccuaguccuugaugcagaaacaaagauucuggccgggcaugguggcucaugccuguaauccccccaccuugggaggccgaggcaggcgaaucgcuugaccucaggaguuugagacuagccuggccaacaugguaaaaccccgucucuacuaaagaugcauuagccaggcgugguggcagaugccuguaaucccagcuacucaagaggcugaggcacgauaauugcuugaacccaggaggugaagguugcagugagcggagaucacgccacugcacuccagccugggugacggagugagacucugucuaaaaaaaauaaauuaaaaagaaaaauagggccaggugggguggcucacgccuguaaucucagcacuuuggaaggcugaggugggcggaucaugaggucaggaguuugagaccagcccggacaauauggugaaacuccgucucugcuaaaaacacaaaaauuagcugggcgugguggcgcgugccuguagucccagcuacucaggaggcugaggcauaagaauugcuugaacccaggaggcagagguugcagugagcugagaucaugccacugcacuccagccugggugacagagugagacucugucucaaaaaaaaagaaaagaggagaggagaggggaggggaggggaggggaggggaggagagaagauucuacaaaaccuuucacagauauaacagggaagaucacccuggggaaggugacaaggccaguuuuccaaccaagggacuagauaggauucugcagagugggcagggcugccugcguggcuguguggguugugccuugcaccaaacaaaagugcccagcagagcgggcaagauggcugagacccacgccaagcucuccuccuucagacuggcuuagacugaggcaggcugcaugagcccuaaguaagggguuccucuggacuccucccacccggggaggggggcauuuccuuccuuccuuccuuccuucccuccuccuuccuuccuuucuuucucuuuuucucuuucuuucuuucucucuuucuucuuucuuuuuuuucucucuuucucuuucuuuccuuccuucuuucucucuuucuuucucuuuuucuuucuuuuucuuuuuugagauagagucucacugugucacccaggcuggagugcaguggugccaucucggcucacugcaacauccaccucccagguucaagcgauucuucugccucagccucccgaguagcugggauuacaggcaugcgccaccacgccuggcuaauuuuuuuuuaguagagaugggauuuugccauguuggccuggcuggucuggaacucaugaccucaagugauccgcccaccucagccucccaaagugcugggauuacaugugugacccacugcaaugggccaugggggccuguuuucuaaccugcuuaaaggagcuaccauuuucucugggugcuucugacacuggucacagagggucagggaacagaguggaaggaacugggagaaaaaguuugugaaccgucugucccuaagcauggauucucucagcugauuaaucaugcauggauauguugccauucaacgguuccugauaccugacaggcccccugaacacaggaaaggggaucuggacauccugugaguauggggacaggaaaggagaagcucaaaccaagacccaagugguccugaagccuccauccuggcgacacgagcuuugcacuuuuuuuucccucucuacucccccauucucccuguauauuaggcacagccaucuacuugccacucuacuuuuucaacuuuggacuuuuauuuauaugauucauucauccuggaauauccuacucacccucuacucuccagcagacaagaugcuacucaguccucacauccagcucacaaguuccccacaaauccacacccaacuaugcaaugaguaacaucaaucaguccucucuuagccaggcgugguggcucaugccuguaauccuagcacuuugggaggcugaggcagguggaccacuugagcucagaaguuugagaacagccugggcaacauagugagagcccgugucuaccaaaaauacaaaaaaaauagcuggguccgguggugugugccuguggucccagcuacuugggaggcugaggugggaggauugcuugagcucacaguguggaggcugcagugagcugagaucauuccacugcacuccagccuggaugacagagcaagacccugucucaaaaaaaaaaaaaguguauagcuagacagcuauacaugcacauauacauucuuucuuuaccagcucacuuccuguuucauucuaaacucuucuuucaguuuaccuuauggugucaugaacaguuuauagguaucugugcaauaggcuauaagucugcugggggcuuuccauuuccucuggccuuuugaccuaauucucugacaauaaccuaguuuccaugucauuuucaaaaaaaucacagcaguaggaaaguacacacuaucuacccaggucuauauagagaauacagaacugaaaacugacucauaacaauuuagaaaggaggacagacaauccacuuaaaaaucagauuuauauuuaacuaacauuuuauggaguaaauaccaagugcccaguacgugcuaacucuucucacauacaucaccugauuuacuccuucuuacaacuccaugaggugagauuuguuaaucacauauuucagguaaagaaacugagaaggagacuucccaaaagauuaagugacuuaucaaguaaacgauggagccaagaucugaaccucaguauuaggagcccaagguucucuccuuuauuuauuucaucuggagaugguucuuuucacuauaccagguggugguguugaugggggaagcguuagcaaagaaauuccaaguccucaaagcucaaaagauaaucuaacuuaacaacccauuuuacaggugagaaaacugaugcuuagagaaguaaagugauuugcuauaauggacacaauugggagacagagugguacagcugguauucaacccucagaacuccaggucaaugcucuuuccaggcuaccauauagcaugauugagucaugugauuuuuccacacucaugcuucauaagaaagggcuaguggcuucuggaggccagggauuauuuuuauuuaguuuuauuuaguugucuacuucacugcacugaacucuuaagagcuuuuaauuuauuaaucauuuggcugaaaucaggaaagguguuuuuuuucccuaaaaacauuuuuaucaauaugucuuagggcaggcagaggagcucaugcccugugaucccagcacuuugggaggcugaggugggggaaucgcuugagcccaggaguucaagaccagccugggcaauacagugauacccuauuucuacaaaaaauaaaaaacuuagccuggcguggugcugcccucccaugguccuagcuacuuggaaggccguggcuggaggauugcuugagcuugggaggucgaggcugcagugagccaugaucacgccacacacuccagccugggccacagagcgagacccugucucaauaaauaaauaaauaaacaaauaaauaaagucuuaccccacacaacuuugaaagggcaacccagaaaaacugcaaugagaaugacaacuugguaccuuugguucacaggaagacagcaacaaguguuuuaauuuaccaauuuccuuuguaaagcuuuauaaaguccuggcugcuacauaccgcuucuucugcaucugccagcugacauccuaaaaacgaagucaaauuagggaaggauggccguuuccuugagucaaaagcccagcaggauugcauuauaauguaucuguaaaagcaauagaacaaggaacaagaugaagaagucugaaugaagcaaaauggaucauuuuccauauaaugaagcaccauuuauuccucuggagcugcuuauuuacagcauguuuguuuuguggcaaguccucuaccagauuuugaauucauauccgaaaggagaaaucagaugggcagaaaugcauuuaaagaaacaugacguaguggauagaaucgaaugaccuucauggagcccucaagcaaaggaauuaaaaccgggaagcaggugccucugaggacaggaaagguucagcuuuguucagaaacucccaaaacaaagaguuuucuuuucuuuuuaaaauggaaucagacagccaggugugguggcucacaccuguaaucccagcacuuugagaggcugagccaggaagauugcuugaagccaggaguuugagaccagccuggccaacacagcaagaccucacuucuauuuuuuaaaaaaagaauccuauacgcuuugcacuaaggaguuugacuuuuuuuggucaugcauuuggaaguagacagacuguaccuuucugauuucaaccaaauuacagucugacuugaacuuacauuucuucuguagcauaaaauggcugauccauuuuaaauccauuuugaaucaguuuguagaaguuagcaucaaccggaaugccaggguaaggauucacaccugaggaaaacauuagacaauugcagccauucauccauuucuucauuuguuuauugauucauucaauuaaacacguauugagaucugccaugugccagacacuguugcaggcacacgggcugcggcugggaaaaagaagucacgguucacgcucucaagcagguuauagaccagugaggaagacaggcuaaaggacaccagcaaauaaacauaaagucaugggcugcaauacaaguaagacccaucaguguuggggggagggguggggcggcaccgagagagcagaggaugcaaagccaggagccaagggaggccagcagcugcccaacuuaccaagugagaagauuucccacaguaauauuccauaugaccagacaucacucuuaaugguguagaugccuucaaacaggcuuucgggggccauccauuuuacaggcagacgggccuguggaaaacccagaggagauaagauggugaauuuuccacauacagacaugacuucuuuucuuuuguauuaagaugaaaugcaucaucuuccuaagaccacucuuaaugccuuauugagaaaaucacauuccucacgugaaagguuuucacuuucaaauuaacauucuaauaauacuagccuaaaacauaaggcauauuucuuuacaacuccucucgaacaaaggcuugugcuuggaauggguaaguuuaacuugccaucuuuccacuggaaagagguacuuuccauuaaggaauagccagucaguugccuagggguaaguggguacuagugaauuagugagaucuucuguuacagcauuucugggaagaccuuuaguggaaaugucauccacaauaaugucgggaggggagcccacgucaucacuuccagaaaugauaccagucuggcuucuguggcuuuaauaauuuccacuagcaugaaagggaguuuugacuuaguauagucucagacuagaaucaagacacaagauggguagguuacuggggcagagcuuuguacugauuuucuuucucuuuuuuuuuuugagacggaguuucgcucuuguugcccaggcuggagugcaauggcgcuaucucagcuuacugcaaccucagacucccugguuuaagugguucuccugccucagccucccgaguagcugggauuacagguacgcaccaccaugcccagcuaauuuuuguauuuuucguagagacgggauuucaccauguuggccaggcuggucuugaacuccugaccucgugauccacccgccucagccucccaaagugcugggauuacagcugugagccaccacaccuggcuguacugauuuucuuuuacauggguugacgaguccuucacagcacauguuuaaucagcacaugcuuaaucagccaaguaaacccucuuuuaaauguaugcaaacugaugagcuauugauucaugcaggcaagucugguuaauuugauuaauuaaagaaauuaauugugguuccaaauggaauucacuuucccacauaagagacaaccagcuggugggguagaaacugaaugacuacauaugagcagucuaugaugaguaggaguagaucguaaaucagcuaagaugauuauuuguuucuagugggaauacaguuuaauuugacuuuucacauuuacuggauguucacccuggacaaggugcuuucacguugguuuuauuggcuuuuucccacaucaacgcuaugagguaagugcauaacccucaugggaaacacuacaacauagugguuagcacagacucggggcucagacuauuccuguucaaguccacaugcuguguaaccaugggcgaguuacuuuucugugccucaguuuccaaguggguacucugaggaauaaaugaauuaauaugcauaaagcacuuagauguuuagcacauaguaagcacuaagucagcauuuaauauuauuauuauuucacaaguagggaauucuuuuuugagacagggucucaaaaaaaagggucucauucuguugcccaggcuggagugcaguggcgugaucacagcucacugcagccucgaccuccugggcucaagugauccucccacuucagccucccaaguagcugagaccacaggcgugugccaccacacucagcuaguuuuuuauuuuuuauagagacaguugagugucucaccauguuccauaggcuggucuugaacccgggcucaagcaauucucccaccuuggccucucaaagugccuuggauuaaaggcgugagccaccagcacccagccagguauuguaauucuuuaaaaacacacauuuucaacuacacaauuuugucaucuauuacuucuaauaguucuuuuuguaaacacaucuguccuuaguuuuucauuaccaagucaauucacacuguuuuuuuuguuguuguuuuuuuuuuuuuuuugagacagagcuuugcucuuguugcccaggcuggagugcaguggcgcgaucucagcucacugcaaccuccaccuccuggguucaagcaauucuccugccucagccucccgaauaguugggauuacaggcacacgccaccacgcccagcuaauuuuuuguauuuucaguagagacagaguuucaccauauuagucaggcugguaucgaacuccugaccucaugaucugcccuccucggccucccaaagugcugggauuacaggcaugagccacugcacccagccaauucacucauguuuuagaucuuccuguguuaacaguaaaaggaugauaaauauucauuaauucauauuuaaguauuuagcuuuaacauuuuauagguaugugcuauauauguuuuaaagugcuuuauugugacuauuagcuuuucacauaauugaaaacauaacucaaucaucacuuuauagcuaggauaacugaacuaagugcaaguauugagauuuuggguuuuuuaaagugaggauugcacucaaaggccccuaacugaucuacucugacuagcuagcccaaggacagaugugaugcuauuuugcucagcuuuuauuauagauggaagauucccugaagcugcagaaaaaccuuuuaagcauaaguaagcagacugcugugaggguuuuuugauguuaccauaaaucaaaaaugcaccacagugagugcaguuguuuaccaugauaacgacacaacacaaaauagccguauaaaaauaaguaggaaauagcagccucacauugccccugacaacauaguuggaaucacucaugauaucucgagccaauccaaagucacauaucuucaccacuuucccgugggugacaagcacguuccuggcggccaggucucugugaacacacugucaagaaugacaccagaguguuauuuacugugauguguauuauccuggagugcaaucuuucuucuagacucaacuucaguaggagguaccggugauggaaggccucuuaucuuuacugggcugugccgugagcggccaugaugaugugcaacaaacaaagugaauauaggagaccuaauucugcagcuaugguggcugcaguucuuugugcggcuucugaagcauccccagaggccaaagaggagcagaucuuuugcagauuccgagcaaaagugagaggcuccccaacaggggcccuccccugagccuucagagggaaucucagagcuguccuccaguacucuuauugugggugugagaaauagcaucucuuuucuuuuuuuuuuuuuuuugagacggaguuucacucuuguuccccaggcuggagugcaauggcgugaucucggcucacugcaaccucugcgucccagguucaagcaauucuccugccucagccucccgaguugcugggauuacaggcacgcgccaccaggcccagcuaauuuuguguuuuuaguagagacggcguuucgccauguuggucaggcuggucucgaacuccugaccucaggugauccacccaccucggccucccaaaaugcugggauugcaggcgugagccaccgcgccuggccagcaucucuuuucugacuggaaaauagcuuuaggaauaaauggaguaauaucgagggaaauaaucggaaaaacaaaaagcuaaaaaugaguuuggagagguuuacugaacuggaauuagaaggagucccugagcugaaagaugucgugauguuaaucaaaggggucugacaagaaaaugaacuuuacaaaggaagaucugaaggggaacagggcacuaguagcaaagguccaauguacacucuuucaucuuuaaaaaauaaaaagcagcaccaugaacacuggcagcccugugccacagccccucuagagcucccuccuccauacccaguuuuuucagugccaucuaccugcacuuugcccacuuuaccccaggucugcaaccugccuccuccuccugccugucugcccaagcugcucuggccgaggccugcacugacuggcuuggcacccacacagucucgaucugacgggaccucccuguggugucugcugcuguuggccagccccucccgcuucugguccucccucugggaacccugcgcaugguucacuccugcuuucuccccacugcucugccggcuccugucucccucaggggcuuugugcacgagccuacucucacuccugagggcugcauccucacaacccacacccucacccaagccauuucauccaaaccuagggaugcaaccaccauugcccacaucccuauuuccaacccaaacauuucucuugagcuucagacaggagaaguguccaagugucugcuagaccacgcucuacuugguugcucaaggcaccucacauucaguauguccaacucauuaccuuucuccaaaaaaaacuccuccugauuccaugcuuccuauccuaucccacauucccugcugguuuuccuuuuccuucaaaaaucuccauuaguccaagcaugaagcacgcacucccucagaaagccucuuccacugcaucuccccuucccccaaccaggucugcugugcagaucccuccccuggguucccagaacuuacuucagucacaacacuuaucaugcuacaguguugucuuuuuuaaacuuuuuaaaauuuuuuauuuuuauuuuuugagaaagucucacucugucacccaggcuggagugcagcgguacaaucucugcucacugcaaccucugccucccaauucaagcgauucucaugccucagccuccuaaguagcugggauuauaggcguacaccaccgugccuggcuguuuuucuauucuuaguagagaugggguuuugccauguuggccaggcuggucuugaacucuuggccucaagcaauccaccgucucaaccucccaaagugcugggacuacaggccugagccacccacccccggccucagugucaucuucgacuugcaugucugcuugucucugucuccccuaucauucauaagaucuucgagcccaggagucauaucauaacugacucuguaucuccagcaucuaguacagugcuuggcauguagcuggggcucaacaaauguuugaugaagucaagggccuacagaggaaacugaggggcacccagaggaauaucagggagggggugagagacaagaaggggacagugacacgcaugauucaaaggggaggccugaugugaagauaaaaggauagaaggccuaagaaacuggauguucuucaaaaauucauauuauuacaagccugggguugaaggggaagcagugccccuugacugccaguugggaguaguuugaguauuuacuuagcuaugggcagcaaaccaggccagacaaucuaaguagguguucucccaccucuauaaagauguucgugggccagguacaguggcucacgccuguaaucccagcacuuugggaagccgaggcgggcaaaucacuugagucaggaguuugagaccagucugaccaacauagcaaaaccuuaucccuacaaaaauacaaaaaaauuagccaggugugguggugcacaccuguaaccccagcuacuugggaagccaaggcaggaggaucgcuugaaccugggaggcagaggaugcagugagcugagaucacaccccugcacuccagccugggcaacagagcaagacauugucucaaaaacaaaaacaaaaugcuugugaaagcaggauuguaguuguauaagugaaauagagaaagacucaggugggcaagaugcgcgagcaagaagaauccaaacagcagguggggaaaaugaagagaaaaaugugccucgcaguucagagguguggaaauauuacugugacaguaauuuuuuaaaacuuguauuauuauugcuuuuaagcuuauuucauuauuauuuugaauagacagacuggagggcagugcuauagucauagcucauugcagccuggaacucuugggcuucccuccaaaagcacugggauuacagacguacaccacugugcccagccuauuuauuuauuuuuaauuaauuuuuuuuuuuuugagacagagucucacucugucgcccaggcuggagugcaguggcgccaucuuggcucacugcaagcuccgccucccagguucaugccauucuccugccucagccucccaaguagcugggacuacaggcgcccgccaccacacucggcuaauuuuuuuuguauagagacgggguuucaccguguuggccaggauggucucgaucuccugaccucgugauucacccaccucggccucccaaaguguugggauuacaggcgugagcuaccacgcccggcugccuauuuuuuauuuuuuagagaaagagacuugcucugucacccaggauggagugcaguggugcgauccuagcucacugcaguuuccaacuccugggcucaagcaauccucccaccuuggccucccaaguagcuggaacugcagacacacaccaugaacaucuggcugaggcaguaauuuuuuaaagaaaaaaggccgagugugguggcucacgccuguaaucccagcacuuugggaggcugaggcagguggauugcuugagcucaggauuucaagaccagccugggcaacauggugaauucccaucucuauuaaaauacaaaaaauuagccaggcaugcugguaugcacccguggucccagcuacacggaaggccgaggcaugagaauugcuugaacccaggaagcagagguuguagugagccaagaucacgccacugcacuccagccugggcaacagagcgagacugucuccaaaaacaaaacaaaacaaaacaaaaaaauacaauugaaaguagucuuuccaaauucagagagaaaacaggagagaagaggcaaggggaaggaaguggaggagaagaggaggaggagauuagaagacugcaagaaaaaugagggggaagaauuuugggaaauaaagagaagguaaugaaaggcaagcaaacgaggaaggaagguagccagagagugggcuaugaucugcuuauaggcaggagacauuugaaaucacagagaacagcggguggaaaggcaguucaaaaagagugcaaaauugggguagagacaugguucacggcaggcuccagggccuuaccaacgaauggaucugggguuagcaacagaggaggcagugagccugcaggacugcugccagcccacagcacgcagggugagaauuagacaaagacacucaggguggcuggcucgguuucagccuccucucauccccuggguugaaugcccacaugcagggcacaaccugaacagccguucugaaagggacugacaaugcuacgcuuuguuuugaggaaggauuucugaggacuuccuaucucgaccuucagccuuggaaguuucaggggacuuugugcagccugggagggcugugcuagccgugaccucacaagggaucccaggccuuuaugcuacuacaauuagccaagagccaagguaacacgcuaggugacuccaacagugaacaggggagaaaaggcagacuuuaagggauacaaguuaaaauaaacaagaaaacauauauaagcacaucuuuucaaaucuuuuuuuugguuuguuuuuucuuuaaaaggagcauaccgacuuaaauuccagaaauuccauuccuuuggcaacuugauaugcaaagcaaagaagaucuucaaauguaagcacauucaaguccuccucuucuuccagccuuuuuugguuuucauauucaauuucaucuguaaaauagagccagucuucacuuuugccaaaacucuaagaaguugccuuauuaaaucucuaugggaagguuauucaagccagaguuaggugaggugcuaagacaugaagcuaucgcauuaucuucccggcagcauuagagaugaccuguuuaugcugccuaugaagggucacuggagacuuguuuugguuagagauaaacuuuggaacugcuuugaugaccgaugaccuccugauugauuagucaggaguuuuagauacuucucuuuugcacuagguagggcugucacagugggaaaggaauuaauauuaauugucuaucccuuuuuuuuuugagaaggagucucgcucugucgcccaggcuggagugcagugacacgaucuuggccugcugcaacuggauucuccugccucagcuucccgaguagcugggacuacaggcucaugcuaauuuuuuguauuuuuaguagagaaggguuucaccguguuagccaggauggucuugaucuccugaccucgugauccacccaccugagccucccaaaguggugggauuacaggcaugagccacugugcccggcccaucuauccuauuuuauaaacuauauugugcauuuuauauucuuccauuuacuccuuccuuuuuuuuucuuucuuucuuuuuuuuuuuugaguugaagucucacucuguugcccagguuggaaugcaguggugcaaucucagcucacugcaaccucugccucuuggguucaagcaauccuccugccucagccucccaaguagcugggauugcaggcgugcaccaccauacccagcuaauuuuuguauuuuuaguagagacaagguuucuccauguugggccaggcuggucuugaacuccugaccucaggugaccugccugccucggccucccaaggcgugauuacaggcgugagccaccacggccagccccucauuuacuccuucuaacaguccugugaggaagguaguguuaggccuauuuuauaaacaagaaaauugugauucugguggucacauaacuuguccaaagucauccagucagaaagcaaaguaagcagaaguuaauccaaauucuauguaacuucggaacucauuaucucuuccacuugucagguaauaagauggcuguaauuaauauaugacuuuaaaugaauaaucugaccaaauaaaauaguccucaguguuuauuaguugaauguugacauaaaaucuacaguauacaaacuggcuuuuagcuaucaucugacaauuagcaaauuuuaaaaugcuuuuguguuuacacacuuuuaaaaaauagcuaacauaaaacuuuugcauucauuuccauuuuaaagugcuacuacuuagaauaaaauauuaccuucagagugaaaugaauucccaugaagcccugagauuugauccgaguccggguguaucugaacuucucuugaaccaggcaugcuauuaaaaaauuuuguuuuuucauuauuuacauuauucuucucagcagacauuuuauuuuaaaaauguaauucaucaaauaaauggauuccaguuauaaauugacuuuuaaauuaaaagcacaccauccauuuguccauuuuuuguguacauuaaaaacaucuguguaacugggcuugccagucuaagauaaaaguaaucccuguuuuccauauagaaucuuacaguucaaaaaggaccucacucaauccuugccacaaccuaugagauggguggcauuuuauaaaagagaaauuaggcacagugagauaaauaugauucgaguggaaccaggacucacaucgaucucauucuuugguuucugaacucagcccacuuucccucacauaauacagaucuucccgagagucccguaagcguuucaccauccuucuuuuuuccaguuugccuuuguaaagcucauuucuuuuuacugugaaauuaauaaauagcaauaauacaaaucucuuuuaagguauauaaaaauucuucccugaggagcucuguaggaauuauaaguagaucacgauucaauuuauucuaauauacgaguuuaacccaauuuacaauuuacauaucuuuaggaaauggcuucaugcuuucagaccacaaauauuccaaaaggaauaauuucaguguauuuaauauuccagugaacagaacgaaucaaaggggcuaaguacugaccaguggauacuggucacacacaucggacucaguaggauagccccucuguuccagaauaugaguggcuuuauagaguucucauuucuagacgaugagcugggaaaugaguguaaaggagaggacggugugacgggcaugcauagguuaagggcagcugcacacggacgugcauggggaucuccguggggccugguggcuuuaagacacugggucugugucucagaccuggaaggccagaggccugcacuuaaaacuuacauucuaagaaaacaaagccgggacucucaaauguaucccuaaaaagccccugguaaagaaaaaagucuccaauaaacaaauacccuucagaauaagggagaacuuccauacagggagggaaauaagaacgcgccaaggcucagccaggugcgguggcucaugccuauaauuccagcacuuugcggggccuagguggguggaucaacugaggucaggaguucaacaccagccugaccaacauggugaaacccugucuccacuaaaaauacaaaauuagcugggcgugguggcacaugccuguaaucucagcuacucgggaggcugaggcaagagaaucgcuugaaccugggauguggagguugcagugagccgagaucacaccauugcaccacuccagccuaggcaacagagcgaaacucugucugaaaaaaaaaaaaaaaaaaaaaagaaugcuccaaggcucaacgaaugccuccaucagaaugccugggaauccauucagagaaaggugcuacaaagccaugaugcucaaguaauuagcaagaaaguucaaggaugaggaggagauccagcaaacuccuacagcccucauuuaugcccgcuaaagcaauaaaucccugcaggaccaagcaucucucaggauccccauggaugcggaggauaaacacagagcagagacaagguuacugcuacuuuacuguguccccaucacgugucgaucaauccauccuaauaucuuagaauccaauuugaguucagcguucuuuugcgcaauagucccaggacccgagcugcucucuuugcauauguuaaggacuuuggaaaaagucuucauucuuucuaccaauaccugugaggcaaccagguguccugaaagaccgaauaaugcaccuuuccccaaaccaaauaggcgucuauggugugaugcaggcauggguggagagagacuagcucagcuauaguaccuguacugaaggaaagggacaggacucguuccaugucaacagggaaacuauagcaaagauucaggaaaucucuagguugcaggacccacagacuucacggugccuuuagaaacuggucaacgaaguguguuugaacagcacacuuugccuacguucuaugauguguaauuacgaaacccugacccagccucuuaccuggaauuuggaugugauuggaaagugggguaaaaacugaaauuguguuccuugaaaaucucuguccaaguccugugaaauuuuucucuuuuacuucuuagauaguugagaagaucaccauagcaacaguauucaaaaaucaaguaaauugguccugaaauaguuacaguuucaauuauaggcauacacaaagcaaacuguuauuucagaagucuauguagcagacaacauacucuuaggagggcuugguucucugcugacuuggggacaguacaacuuuuucugagccuagcucuucuuauacuuuaaauucaguuucagcuuuugcucaaauuucuuuggaaagcagcaucuucuugacauucucuguggcccuuuuuuguauguguggccucaccaauaccacuggccuccuggauucuccaguuggcaacugaaaguaauguucuagcuguguauuauaggugaacacuugguaacuauaugcugauuugcuguuugcuugaggagggagaaauauauucccaguccucucucagauucacuuuccucuuuuuccuuucuuuuaguaccagccccaggccugcugcugcagaaagaaugaaccuugggcacaucauuuggguauuucuaggcagaagagagaagaucagagggcaugccccagagaauucugggaaaguaaagucugauauccuagcuaggcugugccguauuugacggcagcccaacuggggcaguggccaggcucuguaaccacucucaccacgccugugcaccagcuuccaagcugggagagaagcacagacaccaccaaauguacuugcaauguuguuguuguuguuguuuuuaagcaggugagaauuaugcaauauaucacgauaaagcagaugaaugaggcauucuuuauuuugaccccucugauuuauagagugcucagugucuaauuccacuuggguuugagaguucacacugugacugagaaaagacaaagaauuaaaaagagagagagagagagagagagcaaacauccucuuugucaucaagcuacagucuuuuugaugaggugauuuucguggaaguggguuaccugacagugugcacgcccccagcagguucacaauauucucguggcuucccagcugggucaucaucuugaguucugacaugagugccucucuuucagagcugucugcuuuuucugucaaagaaaggagcauuaaaaauguaaaacucaaguaaaauacgaauuuuaugucauuaaauaaaauuuuucucagcucagagucaaucugcauuauuuauuuaaauucaaaauuaugagagaagccaggcauggugggucaugccuguaaucccagcacuuugggaggccgagguggguggaucacuugaggucagaaguucaagacuggccuggccaauauggugaaaccucgucucuacuaaaaauacaaaaauuagccaggcgugguggcaggcaccuguaaucccagcuacuugggaggaugaggcaggagaaucgcuugaaugugggaggcagagguugcaauuagcugagacugcaccauugcacuccagccugggcaacaagagugaaacuccaucuuaaaauaaauaaauaaauaaacaaacaaacaauauccuguguuuuaagacagaauuucuccuuuuucuuuuuuuuuuuuccuuuucuuucuuucuuuuuuuuugacacaguaucucacucugucacccaggcuggaguguagugacaugaucucagcuuacuguagccucugccuccugggcucaagugauccuccuaccucagcccuccaaguuacugguacuacaagcacaggccaucaugcccagcuaauuuuuauauuuuuuguagagauggggucucaccauguugcccaggcuggucuugaacuccuagauucaagcaauccucccaacuccgccucccaaagugcugggaauacaggcaugagccaccaugcccagccuaaggcagaauucagacuguaguauagggcugggcgcaguggcucacaccuguaaucccaacacuuugggaggccaaggcggguggaucacuuaaggucaggaguugaagaccaaccuggccaacauggugaaacccugucucuacuaaacauacaaaaaauuagccgggcgugccggugcguaccuguaauuccagcuacucaggaggaugaggcaaaagaaucccuugaacuggggaggcagagguugcagugagccgagauugagccccugcaccacuccagccugggugacagagcgagacucugucucaaaaacaaaacaaaacaaaacaaaacaaagacuauaguauaaauguugaaucugguaaugcaccuuucaacaggacuuuccucuaccuaccaaaauaaaaauccuuacaguuggcccucaaaacaaacaaacaaaauaauaacacaugcuuuuccuccucaguacaaguuaacagaagggagaaacguccuuuuuguuuguuuguuugaacucuuggaucuguuguagucagagagagauaacagugucgugagcaugguugacucuagccuguggcccucaggucuagaacauuagauuugccagcaaguccaaugggagaaggucaaagaggacuaauucccacuaucaggugcucaagagacccauuaauugacauugagaaauaaaacugccaagcaggcuagaacauauugguuggccaaugcauucucucucuagggaaaauuccagauagcucagcaaacuguacuuauaagcugacuuagaagcacagugugaggaaagucacuauggaauccaagggcucccgucauugcggcucaugugcaguuggucagggcagcccgggcagccacaggggcaagggcagggucucuggacuucccucuccaggcuccaggcaccaccccucugugaacagacuuuuucuuccagauauaguaacucuucuuuacauucagugaagauuugguucgauugccagguuccauuauuuuguccaggaaggcauccuaaccuuuauaguggcuucuccggugcugacauccucuauuuugguuugggcaagcucucagggguauccuuguuuccaagauuuuagcuugggggugggauuuccugugggcacugggacccccuaauacaucaugucuucagcuucacgcuggacagggauucggggcuuuacuuguucauguccuauuccucauggcuaaaauaauaucuuacauuuuuuagcaugcuuagcuucuucuaagcauuuucauguaccauuaccucuuucauucagucauucaacaaguauuuauugagugccuacucuguaagagccaauguccuagacacuggggaaugaaggaaaaacaagacacaacccuugucuuccuggaucuuagagucuccuggagaaggcagagaaguaaauaagccaugacaauacagugccauaaaugcaauacggcaggcaagacguggguccccgcgccucuaaucccaacaucuugggaggcugagacaagcgggagaauugcugguacccagaaguucaagaaaggcccgggcaaaauagcaagagcuugucucuacuuaaaaauaaaauaaaguaaaaauacauaaauaaauaaaauaaaauaaaauaaaaauuagcugggcuugguggugccugcauguaguuccaguuacuggaaaggcugcagaccaucacuugagcccaggacuugaagcuugccgugagcuaugaugacuucacugcacuccagccugggugacagagugagacccuaucucaaaaaaagaaaaaagaaagaaaaagaaaaaaugcaacguugggcugggcacgguggcucaugccuguaaucccagcacuuugggaggcugagacaggcggaucacgaggucaggagaucaagaccauccuggcuaacacggugaaacucugucucuacuaaaaauacaaaaaaauuuagccgggcgugguggugggugccuguagucccagcugcuagggaggcugaggcaggagaauggcgugaacccaggaggcggagcuuacagugagcugagauggugccacugcacuccagccugggcgacagagugagacuccgucucaaaaaaagaagaaaaaaugcaacguggcaaaggagugcagggguacuguagggucaaaagggauagcuaccuuagccuuggagggguggagaaaggagcauucaaugucuaaacugaguccugaagaaaaaugggagcuggccaggugacucaugguggaaggggaggagaacagugcugaggguugugaaagagugggcaaaggucgagaaaggagagagcacagcaccacagacacagacccugcccucaugaggcacaggggcuacuggacagaugggacaacaauuggauguuaaaaaaugucaugacaaaggugauggauucuacgggggaaagccugcagagagcuaaugucgcacauugcaagggccucaauauugucuguggugugagacagaggaagugguguuuaagcugagaucugagggggcagugggagauacuuacaugaaaggggaaggggaagcagaaggauccacuugugcaaaggccccacagugggugggaggacagugcugggggaacugaaagaaggccagcgcucuggggugccgagagcaagagguggggaggcagcgguggcccagccaugcgggugguggaggaaaugugaaguaggaaagccauuugaucugcuuagccuuucgccacugucacuuggaccucaguauggagaagccaaagggaggcaagaguggauacaggaaccugcuuuggaagcuuuuguccaggagagagccuugaacuagagugguggucauagagauggagggacgaggauggaaucaagagacacuaaucggaaaccugauaggauuagcucacaggguguuagaaagaggaaggugucaaggaaaagucacggguuucuagugugcccaacuauauagaaugugguuauuuauucacuggcauucauuaccagucacagagaggacugcuggugcagggccaggguuaggggaauucaccuugcauacacuguguuaaagggaccuuugagacauccaaacauuuaacauaugaaccugaagcuccgaaaggagacgcaagcaugagggcccuugguguaugggaggacaucacggguguaguggggauggacuguguugaguguguggagcgaaaacgcaaggcgguccaggagcaagcccacagggaugccccauaaaaagcuggauggagccugggcaacauggcgaagccccaucucuaccaaaaauacaaaaauuagccaggcaugguggcgcaugccuguaguccccccuacucaggggccugaagugggaggauggcuugagccugggaaguggagguugcagugagcugagaucacaccacugcacuccagccugggcaacagagcaaggcuguguuucaaaaucagccacaacaacaaaagcuggauggaagaagaugagcccacaaaggacugaguuucaaaaucagccacaacaacaaaagcuggauggaagaagaugagcccacaaaggacugagaagggcagaggggugggaggaaaaccagaauauggugacacaaaacccaaagaaagaaagcuucuggauggagagaagaaucaacagcaucaauucaugcugaacaaucaaguaaugaggacugaaaaauauccauuaggcuugguuugguuugaagucacuguugaccuuagcaagagagccagcuggagaugcuuuugcugggucagcggugguaacggugaggccagcaauggggcuggacgccagaucggaauggauggagcaacgaagugaggauacaaagggccccaguuuucucuccuacccagagucuguuucaacccacaccuguaaucccagcacuuuaggaggccaaggcagccucacuugagccaggaguuugcaaccauccugggcaauauggugagacaccguaucuacaaaaaaaaaaaaaaauuagccaauugucuuggcacacuccugugaggcugaggugagagcauugcuagagccaaggaggucgaggcugcagugagcuaugaucacagcacucuagccuggguaacagagcaagauccugucucuaaaaauaaaacaacacaaauguaagaaagaacuucugccuguggcaacuguauccccaaauaucaaagccuauaaaaacuaaauaggccuggcacaguggcucacgccuguaaucccaacacuuugggaggccgaggcgggcagauaguuugagcucaggagucccagaucagccuaggcaacauggugaaaccccgucucuaccaaaaauaaaaaacuuagcugagcgugguggugcacgccuguagccccagcugcugaggagccugagcccaggggguggaggcugcagugagccaugaucacacuacuguacuccagccuaggugacagagugagacccugucucaaaaaaauaaaagaaaauaaaaauaaacaaagagagaaguggaagaagagguggaguuuuguauuuaugacuugaauuuuguauucaugacuggguugacaccccaauccacuccauuuuuagccuugaaacauggcaaacaguaaccauuaaaaggauggaaaagagaagaaggcaugggugggaaacugugccucccauuuuugugcaucuuuguugcuguccuuccacuauacuguaccuuucagcauuuugacggcaaccuggauugagacuccuguuuugcuaauuccauaagcuguugcguucaucacuuuuccaaaagcaccugauccuaguaccuucccugcaaagacaaauggugaguacgugcauuuuaaagauuuuccaauggaaaagaaaugcugcagaaacauuuggcacauuccauucuuaccaaacucuaaauuuucucuuggaaacucccauuugagaucauauucauauucucugaaaucaacguagaaguacucauuaucugaggagccggucaccuguaccaucuguagcuggcuuucauaccuaaauugcuucagagaugaaaugaugagucaguuaggaauaggcaguucugcagauagaggaaagaauaaugaauuuuuaccuuugcuuuuaccuuuuuguacuugugacaaauuagcaggguuaaaacgacaaugaagaggagacaaacaccaauuguugcauagaaugagauguugucuuggaugaaagggaaggggccugcaacaaaagagugucacucagcgaugaaacagaauuccugugugacauuauaaauaguggacaacucauuauaaucucucacauccuguuucaguaauaaucauuuucaguccuaacaaccacucuacauauacucuacuccccacagacaaucaggcaaugucccuguaaaggauacauuuccucccuagaaaauugcggauuauucucaauccauucuuuaaaaccauuuacuaggguaaauuuacaagaauuacaucugguccaggcacgauggcucacgccuguagucccagcacuuugggaggccaagaugggaggaucacuugaguccaagaauuagacaccagcccaggcaacacagugaaaucccgucucuaaaaaaauucaaaaauuagcugggcgugguggcaggugccuguaaucccagcugcucgggaggcugaggcaggagaaucgcuugaacccuggcagaggugagccaagaucacgccacugcacugcagccugggugacagagcgagucuccaucucaaaaaaaaaaaugcauggauuuaaaccuacaggauguacaagucagagaaaaaagaaguucauaucccuuuuaugaaggucgcacaugaaaguggagaagucaguuuugugagguuggugauccuaacuacuagggugggcagccagguuucacaacuguuuaacuuaggagggcucuaaaaagcaaaccaaaaauuauaaaacagcaagcugagggcaaauaaggaggcuaaucaaaagggaaaaugacagagacuccaagugacaaaaucuguuucucuagaguuagaucuuuccauggagauucaccacacugggaguuucugcuucucccggucacugugacacaugagucacaagggcacagggaggacuccgccccaaccugugaaacagucucucuggggauucuugccugacucaagaaaccuuuucucacacacugacccuauacucuccuguaaaauuccccaaguaaaagucagcgauggggacuaacuucuaguggggaauuccugaugguggaauaucacaagaacaacuguuguaccuggagaguuuaaaaggaucgucucacaagaugugccaagggaauuguaugcacagcacuugaccaggaacccuuuuauggcuucacucauguuuagaguacugcucgacacccacuguccaaacacuuuucuguuagccuuucuauuccagacuccuucugugaucucuucugugcagcugaaaaaaaaaauagcaaagaauuuagacaggugagcugucaucagauuggaaguuaggauuucugcagcgaguucuaaaagagauucauccaguauaaguuaucagaaacagucuaugacuauugagaguuaugguugauugagaagguuagcauuuuaaauauuucaucauuuccucuuaaacuguauucaugaaagagucaauaggucagagaguuuuauguucuuccauuauaagaggcaucaauguccuuauuacuugggagacuugucugaacacuucuuccagguccaagaugguaauggguauccauccgagaaacaggacgccugacuugccgaugcuucugcgagcacuugagguuucccuauagaaaagaacgugugaaauaagcucacuggcugggcauagugguucacuccuauaauaccaauacuuugugaagccaaggugggaggaucacuugggccaaggaguucaagaccagccugggcaacacagcaagacccugucucugaaaauaauaaaauaaaauaagcucuuggaguaugguacuuucuggaaauaguuucaaaguugccuacaguacaggcuacccauuuacuccagggcaguuugugcuucugggaggauuucucauuuaggaugccuccagaccucugguaauuucuucuuuccuccuugccaugcaaccuccuugccaugcaaccucucugcuacacaccauuuuuccauugccagccucucccuggagagagcugagguacagaccuccaccuguuugcaugccuuaaaaugauucuuagcuucaggagaaguuggacuucucauuguuuuauaagccaaagaaaugaaaauuauuaaaaacaaauaaaugagagauaaaaugacuuucagccuuuccuuaacaugaccuuucaaaauacuaaaaucaauaaagucauaacacuaauucauauucagagacaaugugaaauaagucuuucagcuucugaugauacacacagaaagagauauauggccaggugcaguggcucucgccuguaauccuagcacuuugggaggccaagguaugaggaucccuuaaggccaggaguuugagaccaaccugggcaacaaagggaggcccccucucuacaaaaaugguuuuaaaauuagcugagcaugguggcgcgugccuguagucccagcuacucgggaggcuuaggaggaucacuugagcccaggaguuugaagcuacagggaucuaugauugugccauggcaccccagccugcgugguagagugagaccuggucuuaaaaaugaaacagaacaaaauaacauaaaaaauaaaaagauauaugaucaaugccaguagauaugagaguaaaguuucaaaacacuucagcguacaaaaacaguuuuguaguagcccuucuaagccauuacuuaacuuuuccuaguuaagacuaauaaaaaauuaaggaauuaaaaaauaaaaaucaaauucucggcaauuuaacuuacuucuuauauucagcgugaacauuuugguaaauugggcaucaucauuuucugcauggaauauauauucuccuggcuggugcuuaugauugcaaaacuuggauaugcuguuugaaaaagaauuaaagacagauuuagcccaauugcuacaggagaugcugcaacuaaugacagugugcaugggaggugucuuccuugaaaugcuccucacuugcuaaaguucacuggaaaaggaaauguccauauuguagacccuugcuacucaaagugugguccacagacaggcagcaucaacaucgccauugguaucaucugggagcuuguuacaauugcaagauuucaggucccuuccaaaucacugacucagaaucugcauuuuaagaugaucaccaugugagucauaugcccauugggaguugggauuggccgaagauucucagugagaccaggaaguuccugccccucuugcucuggauagucuaacuucucagaacuugugcagguggagaagccuguaguucagagguccccagccccccagccucuagacugguaacuguccauggccuauuaggaaaggggccacacagcaggaagugagcagcaggcaagagagcuuuaccgcuuccugucagaucagcagagggauuagauucccacaggagcggaaaccccacugugaauugcacacgccagggaucuagguugugcguuccuuaagagaaucuaauccccgaugaucugagauagaacaguuucaucccgaaaccaucccccuacccccaaucuauggaaaaauugucuuccacaaaauggauccuuggugccaaaaacguuggggacugcugcuguagcugcccugcuuccugaaaugacaguccaaggcaggaccuaugaccaacccuugacuuacauagcaaugaacaacgaugagggcucaaauccacugagcuugugcagaaaccucugagugcucucagcaggcucuagugccuacuuggagcacucaucaaccacucaauauuuugacacagauaaccugaucuuggggacuguccaccacgcccagcaggccuguggguugcuggauacugcagugagauguuggauggugcaggagaggcagggcagcaaugaguuguugaauaugccuucgugcacucacaguaacaaaauuggagaaaaagaaaaaaauucccuuaaaacagaaaaagaaaucuaaggcuuguaccgaagauaucuaacucgaccuccacauagccuacugaaaguuuuuuuuuuuuuuucuugagacagagucucgcucugucucccaggcuggagugcaguggcgcuaucucggcucacugcaagcucugccucccggguucccaccacucuccugccucagccuccggaguagcugggacuacaggcuccugccaccacgcccggcuaauuuuuuauauuuuuuaguagagacagggguucaccguguuagccaggauggucucgaucuccugaccuugugaucugccugccucagacucccaaagcgcugggauuacaugcaugagccacugcgcccagccuagccuacuuaaaguuuaaaaaacaaaaagacccugccuggcagguuaggaaggugagucagaguggacgcagcuuuagaugaggaguguggaggaugcaaaagaccuaaaaaguagguagcuccuaucuucaaagauaccuaaaccggguggauagacaggacccauacaaguggaaucauuaaagcauuaaacugaaguccagcagaugaucaaagaaggcagaggucugugucggugggaaagguucggggccuucauagaggagguagagcucgagcuggagccucacggaugaguugguuuugaugagaggacaaaagaaaaggcauccaaggaggagacaaagcagcgacugaaggcgccagacgggaagucauagggcugcagugaggaggaacggcaagccucucaugggagcagaauaucaugaacaguauuguauuuacuuacuuuauuuauuuauugauauggagucucacucugucacccagguuggagugcaguggcacuaucucggcuuauugcaaccucugccucccagguucaagcgauucuccugccucagccuccugaguagcugagauuacaggugcccgccaccacgcccggcuaauuuuuuguauuuuuaguagagaugggguuucaccauguuggccaggaugaucuugaucucuugaccuagugauccacccaccucagccucccaaagugccgggaugaauuacgcauuuuaaaaauacaaauuacuuauuuucuacaacaaugcuuacugcccugagcauugcaauaaaacuuuuuuuuuuuuuuuuuugagauggagucucacucugucgcccaggcuggaguucaguggcgugaucuuggcucacugcaaccucugccuccuggguucaagcaauucuccugccucagccucccaaguagcugggauuacaggcacacgccaccacagccagcuaauuuuuauauuuuucauagagacaggguucaccauguuggccagacucgucuugaauuccugaccucaugugauccucucuccuuggccuccaaaagugcugggauuacaggcaugagccacugcaccuagccuuaauuuuauuuuauguaauuuuucuguacagauggggucucacuauguugcccaggcuggucucaaacuccugcccucaagccauccuccccaccucggccucccaaagugcugggauaacagguaugagucaggguggcuuggccuaugaagaguguuuuauaugcaccugcugauggcagcaaaaguuuacuggaaguuuaaaggcaguuguagcaauccaagaacucguucauucauuccuucauucaacugucaauguuagaaccuguuugugacggaaauugaggacacaacagcaaauucaaaaaauuggguuucuguucucacagaauuuacaauuugguggugaagguagagggguaauaagcaguuggagugugggaaguuucugugauaggagaaguaaaaguucagauuugagguuucggagcaugacaaggggagcguuguuuaauggaggagaaugggaaaggagagaaaagagcaaacccuagaggcaccagaaaaaaagaaauggcaggggcuagauuggauacagaagauaaaggggagaagagaaucccaguugguccccaagacucaaaacacaccuguaaucccaacacuuugggaggcugagauggguggacugcuugaggccagaaguuugagaccagccuuggcaaucuacugagaucccaucucuacaaaaaaaauccacaaaacgccacugcguaauugcagcuuuugagcccacguuugugugacaccaauguucugugcccugaacucguaagccaagguaauucugacuguguauugugaacaagagaauucaucucucugaccuaucaaaaguuucaggcaguuaaaaguugaccuuugggugcgugcagggguucacaucuguaaucccagcacucugagaggccgaggagggugcaauacuugagcccaggaguuugagaucggccugggcaacauggcaagaccuugucucuacagaauuuuuuuuuuuaauuagcugggugcgauggcacacaccuguggucccagcuacuugggaggccgagguaggggaauugcuggagccacuauacuccagccuaggcagcagagcaagacccggacucaaaaaaaaaaaaaaaaaugcugagcauugaauaagguguuuaaccuucuuuugcuuuguuaacaagaaggcugaagaagucaaaaaggggaauuucuuauccugaccuauuucuggacaacaaggaggaaaucacuggugaaguggaaacaauagaaagauugggggaaagccagauuacaacccuagggaggagaagaggaaacagagcuccaugccagugcccgaccucaggaaggcaguguggaagaggcuggcguggaaguggcccaagagaagaaagacgugagcuucuaagagagaaaguguaauucucucuggacaauggccaaagacccugaaaaaggagaagagaggagguaaugaagccaguguggcucaccagagagcaugucagagacaccagucaauucaguggaaaaagaaaugaccaguacaauuacuuaucaugaggcagaccaaagcaaaauguuucguaaacauuuuucuuccucagucuuuugugcugucuuaauagagugugguuugccaugguuuagaagagauagcacuugaaacauuuuucacucuucugaacaaacuccaaguaugaaauuggucacauaaauagcaggaacacaaaacugaauauccaauggcuuuaaacugccuuuccucaugcuuaugacaguuaacccuggaaacaaugacaacugcaaugacaaccguguccugaccccaugggaauuccaaggggacuaacuaauuaggcugauugggagaugcaaagcuuccucuuucgccuagggguuuucuacaaauggccagccggcaggagacggaggucaggacauuugaguuuacaguaaaacaauaccucggugucuaagaagaugcguucucauuaaaacuaagaaaagggguuucuuggcugggaacgauggcucacgccugcaaucccaacacuuugggaggccaaaggaggaggaucacuugagguaaggaguucgagaucagccuggccaacauggugaaacuccaucucuacuaaagauacaaaaaauuagcugggcacgguggcacacgccuguaaucccagcuauucgggaggcugaggcaggagaaucgcuugagguggaggaugcagugagccgagaucgcaccauugcacuccagcaugggugagagggcaagccuccauccgaaauaauaauaauaauaauaauaauaauaauaauaauaauaauaaauaaaaaugucaaagaaagagaaagaaaaaaaaguaaaguugaugcccaucaacaggaguuaguuaaaauaaaaauuucugaaaaguggaauacuaugcagccauuacagcaauaagguagauauaacaacauacuuauuaauauagaaagauacucaugauauauuuuaagugaaaaaucagauuacaaaugguaccuuauuucauguuuauacaaagauccauauuguauguuucuaucauggugcuuacauagaaaaagucugcaauguuaucucuggagguggaauuauguguuuuuuuaaggcaauuucagaaaaagaaggaauaaaggguguuggcuuugccuucugugauugggcaaguaauuuagccucaauuuccacauuucauaaaaugggauuaugagaguuaaaugagguaauacaccuauaggauuuugcacaugguaagagcucaaagaaggaucuuuuauucucacagaauggcuucuuaagaugugguuaauaacuuacaacugaguggggucuugggaagaccugcagccaggaauguugucucaaacugcagaagugaaugggaacggcauuuagguaggagcugcugguauuucucuagacucaaacuuuucccucauuuucccuccuuucugucugugcucaaggcucaacuccuucagaaaauaggaaaaaaaaaaaaaacaacuccucucccaggcuccauaaucuucugcaauugugugucacucauuguaugugacagccugcuuuucaguuugugguucuucugagcaggacccuggcucaccacccagaacccaaacgaccaccacacagcuguuuaccccguaagcacucgguuagugccuacugugggcaaaacuuagauucacagaguuggaaaauuaaauauuucaggaaaaaggaaaacaucaggcuuaggcaaggcuaaggagaagguuucagaagagguuacuaaguaauuacaacaguccuauuccuuuuuuuuuuucccauaaaaguggaaaaagcuaagguagauuuggaauuuguaauuaagucuguagagauaggaaauuauacaaacuaaugggugaaauauccuggaaaccuuuaucaggaccaggacaccaggacggcuagaaaguuauaauuuaauaaaacauaaaggcaagcccuaguaaacuuuggcguaauauuugaggaaguaaauuggagaaaugaagccaugaaaguggggaagccgagagauuucuggugcacauaccaugaccacaccaaaguuuuuucagggguaguguuauuacaggggccuuucaguaacagauuuuuaaaaaauuguaucacuuugccuauaaaaucuugauacaugacuaaaauacuguacuucacaaaccaaauucgguucaauuaaauuguugaaucuaggugguagguaaagaaugcucaugcacuauuauuucaacuuauuaguaaauuugaaacuuucuauaauaaaaagucaaaaggaaagacgggugcaguggcacacgccaaguugcagcuacucaggaggcugaggcgggaggaucacuugagcccaggaguuagaauccaaccugggcaauauagcaagacccugacucuaaaaagcaaaaagaagccaggaaaggugguucacggcuguaaucccagcacuuugggagggcaaggcgggcagaucacgaggucaggaguuugagaccagccuggccaacauggugaaaccccgucucuacuaaaaauacaaaaauuagccgagugugguggugcaugccuguaaucccagcuacucgagaggcugaggcaggagaaucacuuacucaccuccaccgagaggagaaucacuuaaucaccuccgccaggaggaggagguugcaguaagccaagauugcgccacugcacucuagccugggugacagagcgagacuccgucucaaaaaaaaaagcaaaaagaagggccaggcgcggugguucauaccuguaaucccagcacuuuggcaggccgaggugggcguaucauuugaggucaggaguucgagaccagccuggccaacauggcaaaaccccgucucuacuaaaaauacaaaaaaauagcugggcaggguggcacaugccuguaaucucagcuacuagggaggcugaggcaggagaaucacuugaacccaggagacggagguugcagugagccaagaucaugccacugcacuccagccugggcgacagagugagacucugucucaaaaaaaaaaaaaaaggcaaaaacaaagaaaaguggaaauuaccccugacuauaaucuaguccuccauccccaucucaacauagagccucauguggagagaaaaagacauuuagagcacucagaggcguguucaaauuuuguguuguucguuucuuguucaguacuuugagcauguuuucucaugaagaaggagggcccaucuuuccuuugcugugugucgucaguggcccauaacaccugguacauuaucaguaccaacaaugcacaucauuagcacaaacacuguagcucuucaagaacuuucaaauaacaauaaacacugaguacuggguguugugcuaagaaccaugugcaugguccuugcagugaagaggaugcugucgacucaucuuuggcccagacugcacugugaguugcauuccagauaugaugaugaauucauucauuuauuaaacacacuuacugaacaaggcauuguacaaagauagagaaauauggcagcauaccuauucuuagaguuuauaaacucccuggugagaugugacauacauacuuaucuguugccagauaaguaggaaugagugagguacaaaacgcuauaggagucaggagcucaccuaauucauucauuuggcuaccucuauaggauaacaaucuggggucauggguauggauuguagccauggaaugaaacuacaugaagcagcccacuacauuggcccaugacccauaugucagugacaugguccccaacuggcgauucuguaaaaucucaaaagguuauaccagauaucaccagcacaguagcaaucuguguacauucuugcgggagagggaaagcaacauuaccuuauucacucuugcagcccaucacagcaucacacccaucaagaggauauuaaaguaauauuuguugaacuaaauugaaucgaccccuucucucuuugaaucagguucagaagagauucccauaaugcuaagagcuuaucuaacauggggauaggauacaaaggagagaggggacagugauaugcugauuuccuucugaacacaggccaagugguaaucaagucaacuaggguaaagaggggcugacucuccaaccuucuacauuuaaaagcuugaugggccaggcgcgguggcucacgccuguaaucccagcacuuugggaggcugaggcgguuggaucacuugaggucaggaguucgagaacagccuggccaacaugaagaaaccccgucucuauuaaaaauacaaaaaauuagcugggcaugguggcaugcaccuauaaucccagcuacuuaggaggcugaggcaggagaauugcuugaacccaggagcuugcagugagccaagaucgugccacugcacuucagucugggcaacagaauaagacucugucucaaaaaaaaaaaaaaagcuugauauuucugaauaacagcuuacgaugacuguggguugaugccucuaaggcaaugguucucaaaaaaaaaaaaaaaaaaaaugccagggguuauuuuucucaauuuggcagugucuggagauauuuuuggucacacugggaaaagggaaugugcuccuggcauccagugggaggagacccgggaugcugaaaaguauccuacagugcacaggacaguccuucacaacaaagaauuauccagcucaacaugccagcagcgccacuguugacaaacccugaguuugggggaguguguuucagucagcucccagaccagucugcauucuuaauuacuuuaaaaaugaaugcucugaacauugggggguuucaguaagagacaguagacaacuccaugcaaacccugcacugagauucuaaaagucccaacaagggacuuuuaguacaaaucccuuuuagguauaaagaguaacaauaaucaugaaacaaacacuuagcggaaucaaggugaaaagaacuccuacucuucaucuagaacagggcuagccaaugaaacagaaugugagucacaacuucaagccuuguacaucauuuacaaauucuguuggcuguauaaaguaaaaggaagcaggugaaauuaaguuuaauaacauauuucgcugaaugcgauauauccaaaauacuaucauuuuaauauauaaucaauguaaaaauuguuuuaauuuuauuauuauuuuuucuuuuugaggcagguucuugcucugcauccaggcuggagugcggugacgugaucauggcuacugcagccucgaccaccugggcucaaucaauccuccaaccucagccucccaaguagcugggacuaaagguguacaccaccacacucaacucauuuuuguauuuucuguagagaugggauuuugccauguuauccaggcuggucucaaacuccuaggaucaagcgauccacccgccuuggcuucauaaagugcugggaugacaggugugacccaccgagcccggccaauauaaaaauuauuaauaauauauuuuacauucuuuuuuucauacuaagucuucaaaaucuaguguguauuuuacaauuagaguacaucucaauuuggaccagacacacuucaagcucucaauagccacauguggcugguggcuaccguaccggacagcacagaucuagaccugugauaggaaucaccaaagguucucauuaaaaaagcagagucugagcguuuugccccaguuuugagucagcaugucuggaaugggagccaggaauccacauuuuaaacauuugcucagaugauucuuacacaguuguucaacagaccacaugcugagaaaggaugauuuauucuaguccauugacuuguuugaaagauaacaugugcgucucagugucucauagccuaguccaaaaccauguuccauagcauuaguuuaaagagacaagagaugucauaacuauagaagauauaggggaaaguuguuuuuuguuuuccaaagaaggaauggagaauuccucccacaagagaaucuuucggcugggugcaguggcucacgccuguaaucccagcacuuugggaggcccagguagggugaaucuccugagcucaagaguccgagaccagccugcgcaacauggcaaaacccugucucuaccaaaaauacaaaaaauuagucaggugugguggugugcaccugugguaccagcuacuugggaggcugaggugggaggaucacuugagccugggagguggagguugcagugagccaauauugcaccacugcacuauagccuaggugacagagugagaccucaucucaaaaaaaaaaaaaaaaagaaaaagaaaaagaaaagaaaauuuguuguucuuaaaaaaaagaaucuugcauaguuucucauacaaaucccgaggaaaacaacauuuuccuucagcacuuacuauugggcuauuucugcauguauuuuuugaaaauuuaaaucaauacaccuaugaguaauguuuuucuguuuuuaaggaguuuuacuuccucaaucaucugcaaauguuuuaggggagacucaguguccuacacaccgcacucucaaacaggaaguaaaaacuaccuugugacucagaaaaugccagagaaccagacucaaacuagaccagacuaauacgguucuuucuguuuucaugcagcagguuauauuaucuaaaguaaugguaagacugcuacuguauccucacaucugcuuauuguuuucuuaucuccaauuucaacucaauaauaguuaaacucauaagugaauuugcuuccauaaguauaaaacuguccuucucaagggcgacaagcaaggagaauuaugcuaaaaaugguaucuuagaguccuuuguggucucaccuguauccguuaucaagacccuuuugcucacaaggaaaugauuuucgagagaagguccacguacaucugauuuguggguaggcuuuaaaccugacagaaaaacaaaacucuucauauuggucaauuucauaaucuucacuugaauugguagcauuuauaaaucccuuuucuguaagaaaaaauaggcauuuaugaguuaguuaauaauauucauagggaaacguauugagaagauaaaauaaacuuguauucaucaguuuaacacaggaaaacucaaguguuggcaugcugcaggucagguuggauaauccaagugaaaacccaggaguccuaucccuaguucuaagccugagcucaucaucuuucgaaguuaagaaauguuuaaaaaaagaaagaaggaaagaaaaagaaugggauguagauaauugacugucuggccccugcucucagccagcaccacucuuccauugaugagagagaguaaaauaaacucaaggcacaaauaaaagagcgaucuggcuagcaauauucacgagguugccuuauggaacacuuccuuauuaaucugcuaagagcaucgcuguauuucucggcauuuucauuauggcugaacgcugugcccuaaucugagauuauugaacugugguuauuuucagauccuacauaccccaccaaaauuucagugcaucuaagggcuuguacugucucucagugcucacugcccuaacagugcgguuaguugguucuuagaacuaguauuuauuguccauuuugugucaggcucugugucagguucuggaacuacaaggauagaaugaguuguucuuguccuuaagaaacuuacagucuacuggaggauaaaaguacacaaacagauggucauauuacaauguguuauaugcaaagacaguggcauucaagcgagccugguuuaacgggaaaaggaagagggugggcagauuaucuuugcaaagcuauucuaacucaguuucuuucuuaguguuugauaguagcauuauauugaaaucagaauuuguaccacauacuucacauuccacacuacagcgacuaaaaauaggaauaaagauugugugagcagccugcauuaccuacgaugguaaccaaagcugauugacugggaugcuuugaagaggaacaaguguaguauccggugucguuucuugccacugaugauacaaaagcaaacagaauccguaucauaguucuguuuguugaauagguacucaucucaaaguaguugcccuagguuuuaauaaaacagaguuugcauuuaauguuuucaauccagacuauuaguuaauuguuccugcauuuucagaauacaaacuuguccuauuaccuccucgagugcuuuguuuucuaauucccaggugagcccgaauccaugguucacaugaacagcuuugcaccuuauccauaaggguuccccuacuuuaagaaauaauuguggcaauguggucugaggaguuugauuuagaucuaggagaugaaaacaucccaagugagaaaaaaaaagugauuuuugccucaucacaaaagauauccugaacauucugaacaaagacuuuagcaucaucucaaauauuacuaaccacauuaauaaaagaagcuuuuagagacugacuccucuuuuaugaagaaaucagcauuuacagaauccauaauauugcauuuacugugaccugaaggaaugauaggauuucugaaguugaaugaucaccuacgcaguuacuguuagucccugauaguugcuaagaaccggucacugaaaaugaaagugcaugauauuauaguguuaccuauugugaacagccuggugcauucccugcccaguucauuucuggcacagcaccuuauguccgucccaaauaauucaugaagcacuuuuuccuccuuuuuaacaacagcuggacuuucuucuuuacagcugcaauuagaaaagaaguaccauuuggcuaaacaaguuuuaaaauuacaaaugaaugcucaagaggagaacaaaguucuagagccaguuuuaagggucaaaugguaaacaaaaggucaaaagguaaacaagcccauaucuaugguuucagcuaagagcucagaggggagcuagcuaguuacucauuaucgcaaugaauuagcauaacacuaaggagaauuacauaacaaaacaguuuaaaauuguucauguuuggugaucucuuuguugcuguuguuuaaagacagggaaagaaagggaaaaaaaugagaaagaagauaaaggaaaaaaagagaagaaagagagaagagaaaaagcaugauugggcuuucaugaaguuuagcaagguaagcauccuuuugggacgcaguaagggagggggaagcuaaaguuucaaaagucacccgaguucccauaggaacagaggagggccaaggugucacccacaagggaagucagccaagacucccaaguauucaacagagcaaaaccccucucccugccucagcagaaagcgaacuuuuguaccacuuuggaacaaaguauuugguacuuuuucuccuucuauuugguccuauuuuaaaaaaaaaaaaguuguuuaguaaauuuuaauuaguucaaacugcaugaauuuuuacuuuguaagaacuuaacuuuggcauauaugaaaaacuauguaaacauuuauaccuuacuuaguauuggcuaggcacuguucuaugugcuuuacauauaucaauucauuuaaucagaauagcaauccuauaaguaucuguugucauccgcauucuucugaugaggcacagagaguaaguaacuuguccaaggccacacagcugcuaagcaaaccaggguucaaacccaggcuaucuggcucuggauucuauaucuuuaaacaaucauauuagacugcuuucccagaacaaacaggauaaucagaaauuaaacauuuugucacaaggaauuucuuucuuccuuucuuuucuuuuuuuuuagauggagucucacucugucacccaggcuggagugcaauggcgcgaucucgggucacugcaaucuccgccucccggguucaagcaauucuccuuccucagccuccugaguagcugggauuacagaugcccaccaccacaccuggcuaauuuuuguauuuuuaguagagacgggguuugaccauguuggucaggcuggucucgaacccccaaccucaggugaucugccugccucggccucccaaauugcugggauuacaggugugagccacugugcccagccuauaauuucccuuuuuuuuuuuuuuugagauggagucucgcucugucacccaggcuggagugcaguggcgcgaucucggcuuacugcaagcucugccucccagguucacgccauucuccugccucagccuccugaguagcugggacuacaggugcccgccaccacgcccggcuaauuuuuuuuguauuuuuaguagagaugggguuucaccauguuagccaggaugaucucgaucuccugaccucgugauccgccggucuuggccucccaaagugcugggauuacagacgugagccacugugcccagccuagaauuucuuacuuauaagauaauucuacuuuaaaaucaguaucuuucuuuuugccccaaccagaugcccagggagccaacaauccuggaacguagagggacuuuuacuuguguagcaugaugcccaggaagggcccugcaguugauuugagggguuccaaaaagccccuuaccaaaaaaauccuuguccucccugugaagcccacauuggccauucuguauuacuuauuuauuuuauuuuuuuaauuuuauuuauuuauuuuuugagacggaguuucgcucuuguugcccaggcuggagugcaauggcgugaucuuggcucaccacaaccuuugccucccagguucaagagauucuccugccucagccuccagaguagcugguauuuuaggugccugccaccacacccaguuaauuuuuuguauuuuuaguagagaugggguuucaccauguuggccaggcuggucucaaacuccugaccucaagugaucuguccaccuuggccucccgaaaugcugggauuacaggcgugagccacuucacccggcccuauacuggccauuuuuuaacuuuaagaagccaaaguuuccuguuuaaaugagcauaaauuaaauuuuacauacagcuugaugucaacuacauuagaaaaaggccaaaaggaaauuaugagaauagcagcuaccauggaugugucauaccuuucccccugugaaucgcaaagcacccauuccacgaucggcucuggaacgcucucagauaugcagaccagggcguccugguuuuccauuuuucuaaaguaaggucuucuuaauguguaaagcaggguaucuaaagcaucauaaguuauuaacauuuuacuauuuuaaaaauaauucucuuagcagccccucagaaaaggauucuaugucauuaugaaaaguucucaaccauuacguauacauauuuuuuucuuuuuucauaauaaaggcaucaaaagcaaaccaaccauuauauuaaauuuagcuguggcugcagugucaacuugaacauuucuccucuuggccaauuucuuuggguauuucacaaauccacagcuaacuaaaguagucgagugaagccaugugaaaauacaaauauugauaggcacaggaaaaaggaaauuagcaauaacauauggcuuaaacccuuguuuaacacauaguuuagaccucaacuuucuuccuauaauuugaucugcaacuaggcagaaauauacuaagauuuagaaagacagaagaaacaugguaggguggaguuggaauugcaacagaacuuaagagguuuaguugagccucccacucacccuggaucacacacacacacacacacacaccauccuucacucccagcuauuucuaacauaaacuuucuacuucuacuuugacucuucuagagacuggaguucaugaccucccagggcaggucauucuaauuucugacaaacuuuuuuuuuuuuaaagaaaguuucccuauacugaauuccagccucucuccuuacaauaaauuuuguuugaaaauacuauguacuguuugauauauauauauauauaugaaagaauauauggaguguaaauuucaaagcauaacaacaacaaauacccacggagccacuauccaccuaauaacuagaauauuaauaaauaccuuuugaucuacuuuuaugcuucuccccaccucucaacugcacguauccuuuauccugaauuuuguugauuauucgaggacucuucaaaguaguuauaccaaauaaauauguggcacuaaacaauauauugauuuuuucauucuugagcuucaaaauaguguuaucaaucaauauguaacuucuacaacuucauuuuuucauccaaccuuauguuuuuaaaauucauccaugguuuuacauguagcuauacuuuauucauuuuuuuuuuuacugcuacauaauauucuauugguaaauauaucauuauuuuuucauuuucuugcaguagacauuuggguuguuuccuuccgugugugugugugagacagggucucugucacccaggcuggagugcaguggugcaaucucagcucacuacagccucaaccucccaggcucaagugaucuuccugccuuggccucccaaagugcuuggauuacagguaugagccaccacacccggccacaguuuuuuguaugaucaaccaugugcucugaacauucuacacauuuguacugaggcauguguauaacaguuuccuuaauaacauucuuaagaguggaacugcuggucuacaugguaugagcacauucagccuuacacauaaugaucauuuguuuuccaaagugguuauacuaauuuauguuacacagcaggauaugagagcaccuauugcuuuauagacuuaccaagacuucuuaauuuucagcaauccagcaaguauaaaaugguauuucauuguggucuuaauuuaauuucuccauuauuaauuuaacauguguuaaaauaauuaauugggaguccauuaggcugagacaacucuaacagcuugaguuccuagguaaacaaaucacaacacaacucaaaaaaaaaaaaaggaaaagaauaaaggccgggcaagguggcucacgccuguaaucccagcacuuagggagggugaggcgggaggaucgcuugagcccaggaguucgagaccagccuagguaacaugccaaaaccccgucucuacaaaaacaacaacaacaaaaagcaaaaaacaaacccaauucaauaugagcagcaaaaugcaacuuagcuuaaucaaugaggaacugcaaacugaccaauccagggacuguccuucuuuaaacaaucaaauuuuuucuuugucuugcuuccgggaacacauuauagaaagaagucuuacccuugaaucuccucacuggagcccaccugcuugccaucugguacugccugauucaugaauugcuuucugcucaaauauacucuuuacaacuuuaaagugccuaaguuuaucuuuuaacauguuucuugaccauuuagguuucauguuccaaaaaugaaaugccuacucauguccuuuguucauugcucuacuagguuuucauuuuguucguuuuucuuauugacuuauugacuuauauagauuguuuaucuuauugacuuuacauauuaugacuauuaauccuuuguugauugugaacugcaaguauuuuuucccaucuugaggugauuuuuacuuuuucucccuguaauuucuaacaauugguucuuaucauauccucuagagcaacuuuuuuaaagucuagcuuugauuccauaugaaaaucuuucaaauauuuaaaaucagaaaccgagaucaagggagauaauuaccauacaagguacuuuaacuaguuagcucagguuuccugacucaaaucccaaaagaauuuccucugcauuacacugcaaucaaucuuaucgucuccucaaaacauuuccuucuauauacuacacauucccaauuccuucaacugcuccuaauuuaaagaauuccaaguuuuccacuauccugguugcucauuuugucaguauucaucuuuaaaaaaguagaacugaaaugaauaagcuucuauuaauuuccuuaauuuagacguuauauuuucaugaacacugccaagguucaaauuuacuuuuuuggcaaccaugccacgcuggugguuaauacugagcuugugguugacuaaacccuuuccucuuuuucacacugacuguugccacaucucucccaccuauuuuuuggaucccaccaccuugcagaaugcuaaaaauaaguuauaauuuaccugaauaacuguuguuacauuuuuacauuguaaaucuuaagugaaaggaauauacccuaaguauaacagagacacagcagaugcccacuuaccuuauacaacuguuuauacuuggcaagaaaauuuuaaaaggagagaaaaaaggagaaagaggaagagaaguagagaacaagaaacguccuagcuucauccaaccuggggcacguauuuacugucccacagaggcggugagggacuagaaagggggcagggaacaugaccgacauuaaagagcaacauaaggugauucucggcuuuggagcuuguagggcucugguccuaucauuuucagaguaauuaaaggacuuuccagaauaaauuuuggguaauuuugacuuuagcucauguauaccuuacaggcugacuuuagaaccuuacuccacccccaaccccaguaagaugaugcuucugggacucuugcgugcucucuucuguuaguagcuuugacagcaagacccacacauucucacacaagacccagggcaguguggugcagaaagccuccagcugugcccaccaccacaccucucagaggggcuguuuucucaucuacaugcaugcaggaucgcugugagcaucugagaugaaacaggcagaagaucuucagcaaagggcaguugugguuacuccugacccagggcaccucugugggccggacauuuagucacugacaaggaagaggggagccuggcaaguugugucaaugugucggggggaccuaauuucaagugauauuaacccaggguuuuuggagcacugcacuggccccuaaaggcacgaggaccuaagugaaugcagacaccuuuaguccuucuuggucauggaaggcgaagcagcaaguucagugugcauagcacggagucugugcaugauggggacgaaacaaggagaagccagaaagcacacgcagguggugccucugccaacugcacagcugccucccuuggucagaacaucuggaccguuccuuacaguuugcauauggucuagcacgcaugugggcccgcgcuguccaacacaguagccccuagcugcauggggcuauuuacauuccaauuuuaacaaauuaaaauuaaauaaaauuaaaacuuuaguuccucagucaccuuagccaccuuucaaguguucaacagccccauguggccaguggcuacuguauuggaaagaacagacaagaucauuuucaucaucucagaaaguucuauuggaucacgcugagaccuuccaauccugugagguacguauuuuuauccucauuuuaccaauaaggaaaucggggcucagagaaauugugaccugccauaggugguaguaucagaaccagaauuagaacagaggucuucugauuccaaggucaaaauguuuuccauuucuucccugucagccaucugcuacugaacagaggacgucccaggcguuuuuagcagcagucacauucugagagcccacggcacacaucagugauucaucagugauucucaguucucuauagguucuacagaggguugacaggaaucuaaucaauccaacuacguaucaagggaaaccugaauaugucuagaggagcuggucaagcuaacggguucuaaaccacuccuuugaaauauugugguauuccaggcuggaauacuaguagcaggcuggacuuacuucuuauacucacuguaaacaauauuguguaauugguagcuucacucugaauaaaaaguagguauucuccagcuuggguuucugucauuuucaaaaugaccauggaaacaacuccucugcaaaacaggaaagagaacuaguuauuuuggaaaaugugugaaacuaaaaacaaaauuucauagugacuaaaaaggcaguuugguacuccagcguuccccgacuggcacggaagccgcucuguggagaacacagcuucugucaugugcccagcacucagccugggcguugcucguugaacccugacuuuuaaccaguccuccccuugagggugggagagcuccauuccggugccaucaucucaccuucucugagcuucuaggaucgaaaacucccaucuaaaaacacacaggaggccgggugcgguggcucauaccuguaaucucagaacuuugggaagccgaggcaggcagaucaccugaggucaggaguucgagaccagccuggccaacauggugaaacccugucucuauuaaaaauacaaaaauuagcugagaauggcgcaggcgccuguaaucccagcuacucaggacacugaggcaggagaauugcuugaacccaggagguaaaggcugcagcaagcucaggucgcaccacugcacuccagccugggugacaagagugaaacuccgucucaaaaaaaaacugaaaaaacaacaacaaaagcacaguaagcugggugcaguggcucacacauguaaucccagaacuuugggaggccaaggcuggcagaucacuugagcccaggaggucaagaccagccugggccacauagugagacccuaccucuauuuuuuaaaaauuaaaaaaaaaaaacaaaaaaaaaaacggccagguacaguggcucaugccuguaaucccagcacuuugggaggcugaaguggguggaucaccugaggucgggaauucaagaccagccugaccaacauggagaaacccugucuacuaaaaauacaaaauuagcugggugggguggcgcaugccuguaaucccagcuacucaggaggcugaggcaggagaauugcuugaacccgggaggcggagguugcggugagccaagaucaugccauugcacuccagccugggcaacaagauugaaacuccaucucaaaaaauaaaauaaaauaaaauaauaaaauaaguucacacuuucugaccuuuagacccuuaacugugcaaaguguagucuuucucuaacaguguuagcaucagcugggaguugacaaagauguagaaucucaggucccacugagaccuacucaucagaaucugcauuuuaaacaagauccccaggcaauccaaauacagguuauauucgagaagcccugcuuuaaagcagcaagcagguucaauagaacaugggccugcauucuuaaacacagucaauuagcaggauauauacuugauuugcuucugcagaucuauuuugaugauaugcuuuuuuucucugaaccauucgccuggcaugagccaccacgucugcagucgcagaaguuugggaggcgagguaggaggaucacuugaggccaugaguucaagacuaaccugggcaacauauugagaugccuucccaauaaaaagaaaaaauguggcuggcacuguggcucacgccuguaaucccagcacauuugcagccaaaaaacaagaagugaguaauacaaucgcaaaagaggaaaggaaaaugaaugcguuccaagauuuagaacucaacuucagaacuauacucacuguccugcaaaucacuuaagagaagaauguauuugaccuuaaaaacaaauacaaauaacugguacaaguugaucacagagacguucuccaagacccuaucaaggggcccgauaccccuugcaggccauuuggguacuguuuacuacauaguuccuggaaagcgcgugccuucucuacaccuaagggacaacaggacagccacaagaauguaaaagaaaggcugcguuaagagggcauuuaauugaccuauguccuuugccccaucucauuucggcaagaggacaaggacagcagggggcagcaaucagcauagagcuauacaggguuaggacauuacccacacaucuuggcuaagacauuuuucuggaugagaucgauguuccucacagacagaucaaugucuuacuaaauaaucuguagauagcacauaacauugcaauucugcuuaucauauugugaaacaaaauagauaagaucaaauguucuuuucccaagcauuucccaagaauaaauuuccuuuaaaaaaauuuuuuuuuaaagaauuucuuggcuggaugcuguggcucaugccuguaaucccagcacuuugggaggccgaggugggcagaucaagaggucaaaagacggagaccaucuuguccaacauggugaaaccccaccgcuauuaaaaauacaaacauuagcugggcgugguggcaggugccuguaaucccagcuacucgggaggcugaggcaggagaauugcuugaacccaggaggaggagguugcagugagccaagaucaugccacugcacuccagccuggcaauagagcaagacucugccucaauaaauaaauaaauaaauaaauaaauaaauaaauaaauaaauuuaaaaaagaaauuucuugcuacacuaacaagaaugaaaugaaaacuuucuaaauuuuaucuuuaacaugauauccaacuaaaaaacaagacacuuaaaaaaucccaaauagacccagugcgguggcucacgccuguaaucccagcacuuugggaggcugaggugaguggaucaccugaggucaggaguuugagaucagacuggccaacaugaugaaacccugucucuacuaaaaauacaaaaaaaaaaaaaaaaaugaaaacaaaaaacauuagccaggaaugguggugggugcuuguaaucccagcuacucaggaggcugaggcacgagaauugcuugcagcugggaggcagagguugcagugaggugagaucgugccacugcacuccauccugggagacagagcaaaacucugccucaaaaaaaaaaaaaaauucuuaauuguaaauaagguaaaaauauuuaaaaaaaaaaaaaagaaaaaggaaaaaaaauccuagauauucuuuucacuauuuguuuuacauuuugccagccacucacugcuuucuauauacuuauauaugugucuguguguauagguuuaacuuaauagacuuguuucuuuuuuucuuuuuuuugagacggagucucacucuugccucucagguuggagugcaguggcgugacaucggcucaccgaacaucccccucugggcuucaagcuauucuccugccucagccucccaaguagcugugauuacaggcccgcaccacuaugccaggcuaauuuuuuuauuuuuaguagagaugggguuucaccauguuguccaggcuggucucgaacuccugaccucaggugauccucccaccucggccucccaaagugcugggauuacaggcaugagccacugcacccaaccaacuuuacuuuuuagagaguuuuagacuuacaggaaaauugagcagaagacacagaaagaugccauauaugcccuucccuccacacacaguuucccuuauuauuaacaucuuguauaggugugauauguuuguuacaauugaugaaccaauuuuaaaguucauaguuugggccgggcacgguggcucaugccuguaauuccaguacuuugggaggccgaggugggaggaucaucugaggucaggaguucgaagccagccuggccaacauggugaaaccccaucucuacuaaaaauacaaaaauuagcugggugugguggugugcgccugugauccccgauauucaggaggcuaagacaggagaauuacuuuaaccugggaaacagaaguuucagugagccaagaccaggccacugcacuccagccuggaugacagagcgagauaguucgcauuaggguucauuuuuuguguuauacauccuaugagauuugacagauauauaaugucauguauugaugcccuaacuguauuuuuaguucauuauuucacugaagauaagaguuacaaaaaacaggccgaggccaggcgcagugacucacaccuguaaucccgguacuuuugaaggcugagguggguggaucgcuuaaacccaggagcucaagaccagccuuggcaacauggugaaaaaccauggugccuagaaaaaauuuaaaaaauuagcugggugugguggcacgcgccuguagucccagcuacuugggaggacugggguggggggauuacuugagcuuggaaggucgaggcuacagugagacaagauugugccacucuacuccagccugggugacagagagagacccugacucacaaaaaaaaaagguuuacaauaaacaugaacagaaacuugaaacaaaauuccaaaugaaccacauuuuaugucaagaagguauuccuccacuuaccuguuuuguaaaucaaaauguggcuggcaauucagggagcugugcuuaaagacccagagacaggaaauguucccuggggcgucgaccagcacuugcagugugauggaagcagauacauccacuuccacagcggcagcuucguacacugucccugagcucuggggucucaacgcacacccgaggucuuccggggauucugauaccuacguugcagauagaacaaagugaauucaugaaaacugcaggucuaaggccuccccuucuucacaucaaaacuuuaucaaacauaugcaugcugacacacugcacgcaacacccacacaagcuggaacccacugagaacacguugccgacugaagguccuauuaauuauaauucucuaaagaaaagauaaauaacauugggcugcauuucuaaaauguuguacggacugucauggcgugugucccccuaccucugcaaguucauauguugaaguccuaacccucaaaugcaacuuuauuuggagauggucuuuacagugguaaucaaguuaaaaugggucauuagggugggccuaaauccaguaugacucguguccuuauaagaagaggaggcagggcacgguggcucacaccugcaauccuagcacuuugggacgcggaggcaggcagaucacuugaagucaggaauucaagaccagccuggccaacauggugaaacccuaugucuacuaaaaauacaaaaaauaagcuggaaguggugguuggcaccuguaaucccagcuccacgggaggcugaggcaggagaauggcuugaacaugggaggcagcgguugcagcgagcugagaucgcgccacugcacuccagacugggcaacagagugaaacucugucucaaaaaaaaaaaaaaaagaggagauuugaaggcagauacacagacaguaagaacaccaugugaacagaaagacagccaucuuccaaccaaggagagaggccuggagcagauucuugcucacugcccuuagaaggaaccaacccugcugacaucuuaauuuuggacuucuagcuuccagaauugugagauaauaaauuucuguugguuucaguugcccagucugugguaguuuguuguaucaccccuagcaaacuaaucagaccguaauuauaaaaucuauaauauauagguaaauauuuuugugauuguugguauauagauaaaaauuuauaaagcaaugguaaauugguaucuguguuagaggaaauuuaaaaaccaaauuuucugggcagauguccccauagccacacugccaccacacuucuugccugcuuuaaauaauugagauauaugaggccaggcgcuauggcucacgccuguaauuccagcacuuugggaggcugaagugggcagaucacuugaggucaggaguucgagaccagccuggccaacauggugaaaccccaucucuacugaaaauacaaaaaauuagcuggguguggugguaggcgccuguaaucccagcuacucaggaggcugaggcaggagaaucacuugaaccugggagauggagguugcaaugagccuagaucccgccaaugcacuccagccugggggacggagucagacucugucucaaaaaauuaauuaauuaauuaauuaagauauauugacagcagggguuggagcagcuucugcuguggagucccccaccuccuaucuccuuuacauggcugaacacagcaugcacacaugcacacacaugagcacacacauauuucuucaggugaagagcaggguagcucuucugcuaccagucaaaaaccauauuucuggucuuauuuguucacuuacuaugauaagugcaagaccaucugcugaguacuaugagacuagaaaaaaaaaaaagacuaaucuugcccuuaaagaguuugagucuccuaggaauaaauaaguaaaacacaggagaaauacaagugucccauaaaaagauaccaaauacuuugaaauguaaauuguaagugcccuggaacuucaaaggagggagaagagauuucuaagccggauguuuaaguuuuucacccaaguccaguaauugagcuggaucauaaaagaugggcacaagauaaaguaaaaaauaauagacaagucaagcauggugguacaugccuguaguuccagcuacucaggaggcugagguggaaggaucacuugagcccaggaguucaaguccagccuggagaacauagcaagaccccgucccaaaacaaaaaaacccagcugacauacuagaagaaaauaugccaacauauauuacaaguaaagggcgaauaccccuaauauaaaaagaaccuuugaaaauugagggacacagaaccaaaacacaguagacaacugggaaaaagaauugaauacacaauucaagaaaaaagauauaaagaauggcccucagccaggggcgauggcucacuccugaaaucccagcacuuugggaggccaaggugggcggaucacaaggucaggaguucgagaccagccuggccaagauggugagacccugucuguacuaaaaauauaaaaauuagccgagugugguggcaggcaccuguaaucccagcuacuugggaggcugaggcagagaacugcuugaaccugggaggcggaggcugcaguaagccaagauggcacuacuguacuccagccugggcgacagagugagacuccaucucaaaaaaagaaaaaaaagaauggcccucaagcauaugagaaaauauuaaaccuacuuauaauuagaaauccauaaguuaaaacaagacuaauauaucacuucuccucuaucagacuggcaaaaaauuaaaaaauaugacaacacauuuugucggugaggccauggggaaacaguuuucuccugcauugcugggggaacacacccugcacaacccuucuggagaagaauuuggcaauaccuaauaaaacuugcgauucacucaccauuugagccagcaaucucacuucugggaauaagcacaccucuagcaauuaauugcagcacaauucauaauugcaaaauacugaaaacaaccuaaaugcucguacauagaugagugguugaacaaauuaugguacauccacaccaggggguacuauguagcuauaaaaaagaaugaagacaaccucuaagaacugauuugcaaugauuuccuggauguacuguuaagugaagaaagcuaggugcaaaaaguaucuaccuucaaguaugcuaugcuauguaagaaagaggagaauauaaggaaauauauauguaucuggucacuugugcacaauaaauacuggaauaauagcaaaacaucuaaagggauugguuaauuacagggauauguagaaagaggguggaaacuugucaguaggagugaggagacagugauacuucucugaguauacuguuucacauuguuuugacuuuuaggacaagagucaugucaugucucaaaaaacaaguaauuaaaccaaccaggagggucaggcacaguggcucaugccuguaaucccaggacuuugugaggccaaggcaagaggaucacuugagcccaggaguucaagaucagccugggcaacaaaaugagaccccaucucuacaaaaaauuaaaaaauuagccaggcaugguggugcaugccugugguccuugcuacccgggaggcugaggcaggaggauugcuugagccuaggagguugaggcugaagugagcuauguuugugucacugcacuccagccuggacaacggagcgagaucuugucucaaaguaauaauaauaauaauaauaauaauaauaauaauaauccaggugugguggcucacgccuguaaucccagcacuuugggaggcugaggcaggaggauugcuugagccuaggagguugaggcugaagugagcuauguuugugucacugcacuccagccuggacaacggagcgagaucuugucucaaaguaauaauaauaauaauaauaauaauccaggugugguggcucacaccuguaaucccagcacuuugggaggccgaggcaggcagauugcuugaguccaggaguucgagaccagccuuggcaacaugguguaacccugucucuaguaaaagaauauauaauaaauaaaauaaauaaauaaaccaacuagaauaugugaaaugagggggcuggaagaaauaucaagacggaauacgaaccaaauuaauucaauuguaucacaaauaaauaauaacaccauagugaagggaugggaaagaaaggaacuaaccuaaguaacuucagaaaauaauacuuuggaucccuuaaggcuaaagacaaaaagcacuguacacaaauacuguccuuuaguuaguaaaucuauuucucaccaggguauggguuaguaauucuaaaauuagauuaucuauauauuguauuuccaggcucugccugccgagagggccuagaagcaaugauaucccagcagcaaugggcacacccaacucucagaucuugguuccuaaauacuaccccccagagaagccagugcucuuuggagaagugcugaauuccagggguaaggcaagaaaagaaaaauacaagaugaaccugaacuaucugguagugugucaaaaauuaaggaagggcuuggaaaaagaugaggagauguugaaaggacacaggagcaaaacugaaguaguuccuaauggccaaagcuggaagaauuugagcaacaaaauaaauaaugauuguauuggguuacaauccagaggauaaaauaaauauucaugggccucuacugauauaaauaaaaaauugaauaaauacauaaauaaaaugaggggaaaggggcagugcuuccuuacaaagcauuccaauuaacauagagggaauguaggaaaaagaaaagcaccauuaggcaaacaccaccauaauaaucguaggcaagauccaccaaugggugcuaaaaucaguaggugaaaauuaaagaaggaacaggauauuugcauccccuccaagacacuuauuaauuauaagugaagaaaauaguaacuuugcaguggggauaccuggcaugcacugucuaacucuaaugaucaagguucacaucuucauaaugacaccaaaugacuuccugucacucugaauaugaugcucugggaagggcacgcuccugggaaauucuugccagaaauccauaaucucguucuuguugccaggcuggagugcaaugcaugauuucagcucaccgcaaccuccgccucugggguucaagcgauucuccugccucagccucuugaguagcugggauuacaggcaugcgccaccacgccugguuuauuuuguauuuuuuagcagagacggaauuucuccauguuggccaggcuggucucgaacucccaaccucaggugauccaccugccugggccucccaaaaugcugggauuacaggcgugagccaccgugcccagccccuguaaaaaguuuuuaaaaauuaaagcuggguacaauccacaaucuggauagacaaaucugcgggcuucagaggagagagaauagcaugauaaaugcacaguacagaggcagugggcuccaccgcuggcaguccgggaauagcuugagccaggcugaccaggagccaagggauguucuugaaggccaggccacguucuucaccaccuggcagagcugagucccacagagccaugaaggcacuggaauuuaagagacugugauaucucaaaaucacaauguuaaaaaaaaauacaacuuuuguaauaacacugaaauucagucuguugaucuucuuauaacaaguauagcuaacuaaugaggacaugaaaucacuaacacaguuguugucugcuuacguaaguaaaacagcugcacaagcugugaaaaguccagagaaagcacguaaaaugauccaucacacaaaguccaccauucuuucccaaauccuuguuacagaaaaccaaccaacaaacaaacaaaucaacaacucauucucuagaaguacagggugggacauggcaaauaaagaaaauaagcuggcuugugcaggccaccugccugaaauaugaggucaugauugucaaacacauuuggucaacuccaguaacuucaguucuucacaaagagaaaaccagucauuaaaccauaguggagacuuuuuguuuuuauuauuuuuguuuuuauuauguuuuguuuuguuuuguuuagacugugccgcaauggcacaagaucuguucaggaggaaugugacauuaaaugcagcuuugacuuucuggaggaagggagguauaaaugaaccuauuugguaaggagagauaauuuuagaguuaugguggauugccugccuaugcucucuaaucacugacaggaaaaaaaaaacaguacaucucacucagcugcugugaauacuuggugccuuaguauagucaucucuuaaaagcaaauuugaagaauauggaauaguuggugauaugguuuggauguguguccccuccaaagcucauguugaaacgcgauucccagccaggugcagugaguggcucaugccuguaaucccagcacuuugggaggccaaggugggcggauaaccugaggucaggaguucgagacccaucuggcuaacauggcaaaacccgucucuacaaaaaaaaaaucuaugauauauaucauauauauauaugagauauauaucagccaguagcaguggcucaugccuguaaucccaacacuuugggaggccaaggcaggcuggagggcaguggcacaaucuuggcucacugcaaccuccaccucccugguucagaugauccuccggccucagccucacaaguagcugggaccacaggcgcacaccaccauggcugguuaauuuuuuuguuguuguuguauuuuugauagacacgggguuucaccauguuccucaggcuggucucaaacuccucagcucaagcgauccacccaccuuggccucccaaagugcugggauuacaggugugagcuacuguaccuggcugauuucuacuauuuucaguucuccaucacuuaagcuucccuugaguaaauuuacuaaauauauguuuuuaaaauagagggguaggaauagcacaagagaggggguaaugaaaaacaagacgaacagcguaaaagagaggagucaugaaaaacaaagucggaacuugaaggagccagagccagauuacugagcaaucuugguaucagucuaaguaaugggaaaucauggaggguucagagccaggcaaugaaggaugugccugcuucagggaggcuagcccagcagcuaccucugagaugaauuguagcaggaagaggccacuuaggauaucacugugauuaugagggaguuaacgagggcuugacuuagggaaguggcagugagacuagagaauaugagaugauuauaugagaacuccuaaaggggaucgacaacacuugguaacugaccaaaugugaaaguaauagaaagaaaguaguccaaaaugaugcugagcuuucaagccugggaacuaaacagggguauaaacagaaaucaauaaauacaagaauaagagcaggcuuggggaaauagaaaugaaauaaaauaaaugacauagguggauuuugaugugcaaauggaaaaucuaccuauauacugggggcagcuggaagugagggauucaggcuuggaagaaaagccaggauucucuuuaaggagaaaaggaaauacaguaggcccucuguaaccauggguuccgcauccauggauacaaccaaccacagauugaaaauauuccgaaaaaaaugggguugcaucuguacugaacauguaccgacuuuuuucccuugucaucauuauucccuaaacaauaggguauaauaacuauucacauaguuguuuagguauuauaaagcauuugcaucguauuagguauuauaaguaaucuagagauaauuuuaaaaguauacaggagggucaagcaugguggcugaggacuguaaucccagcacuuugggaggcuuaggugguaggaucaguugagcccaggaguucaagaucagccugggcaacagagugggaccccaucuuugcaaaaaauaaaaaaaauuagccaggugugguggcaugugccuuuagucccagcuaguugggagguugaagugggaggauugcuugagcccgggagggcgaggcugcagugagcuaugaucaugccacuauacuccagccuggucaacagaaugagacugucucaaaaauauacagaaucugcauagguuacaugcaaauaccaagccauuuuauaucagguacuugaguauccauggauuuugguauuagugagagucuuggaaccauccccgcuguauaccaagggacgacucuacucauuacuucaugcuaguuaucaaucaguguccuuccuaaauccucauaugaagaauacgguucuugaaggaauggagugccagggagcuaggaguauagaugcucuguugguaccagaugugaggccauaauauacuuaaauacauaaagagaagcccauuuagccaugguaggcuucaauaacuuacaaauuacguucucuagagaaaaacagcuaaagguauaauuuuaauguuacuuuaccaugggauaugaugaugacuuccccacugaugaaucauuguucuuaugauugauuaaaacacacuugaucacaggcagaucuugauuuguaauagucccaaauaucauugcagaaaaaacaacuguaaaacaaaauaaaaaugauaauguugauacaugcacaccuuaaaaagaaaacaugcauuuaucuugcaaccaaacaacaaaacaaaguguaaucagaggaaauuggccacuaugaaaguauguaggaaauuugauuuuaugcaaguuuagucuaguuuaaaucaggagcagagauacuuagagcagggcuguccaauaaaacagucugcagugauggacauguucuaugccugugcugucuaauaugguagcgacuagcuacauguggcucuuaagcuuuugaaaugaggcuaguuugacugaggaaaugauuauuuguauacaugauuugugugugugugugugugcacuuuuuauuguauauagauuucuaccuuuuuuuuuuuuuuuuuuuuugagauggagucucgcucugucgcccaggcuggagugcaguggcgcguucuuggcucacugcaagcuccgccucccaggcucaagugauucuccugucucagccucccgaguggcugggauuacaggugcccgucaccgugccuggcuaauuuucuuucuuuuuuuuuuuguauuuuuaguagagacgggguaucgccacguuagccaggcuggucuuggacuccugaccucaggugauccacccgccucugccucccaaagugcugggauuacagguguaagccacugugcccggccugguauauucuuuuuuucucuaugggugcuuauagaaucuuuucuuugaaaccacagcacuaaaauuuucaaaauuaugugccuuccugagagucuauuuucauccauugugcuggguacucagugggccuuuucaaucuagaaauucauaucccucuguuuggcauuuucuugaauuauuucuuugauuccuucucuccucuuuacuuucuguuugcccaugauuuagauauuuuccccaaaugacugacaaucuuugacagucucuucacauauaagaaugaagugcugagcgucuauccuaagcucuaugauguggcuuguggcucaaucucuguagguguauauuuaggucuuuucucaccgguugguccgacuccccagagaagauucucucucuugcuugcugccuguguccugcgagcuggucuuggcaaguuauacuauugugggguccugcaaugaaaagcaggcugcuucucagcuuucucaacccccaacuauaauucagcuuucaucaucugcuucuucuuuuuaauuuuuuuuuuaagagacaggaucucgcuauguugcacacagugacuucaaacuccuggacucaagugaucccccugccuuggccucccaaguuguuggaugauaggugugagccacuacacccagcuuuaucugcuuuaaagcucucaaaguuuuacuuucuccuucuccacccucuuugucuuucuauguuuauaucuuuguuucuuuggggguauuagguauaauuggcaaauaaaaauugcaguguacaucauauauucacaguguacaucauguaauuuucauauauauauaaaaauauauguguauuuauauauaauguguguauguauauguauauauuaaguauauauacauauauaugggcuucucuuuauguauuuaaguauauauguacauauaaguauauacacauauacauacacacauugugaaacgaauaccccaaacaagcuaacuaaccuauccaucagcuuguauacuuaucuuuuucuuuuucuuuuuuggugaugagaacauuuaagaucuacucucucucgcucucucucucucuuuuuuuuaaauugagacagagucuugaucuguugccgaggcuggagugcaguggcacgaucacugcucacugcaaccucugucuccgggguuugagugauucuccugccucagccucccaaguagcugggaucacgggugugcgccaucaugcccagcuaauuuucguguuuuuaguagagacagcauucaccuugcuggccaggcuagucucaaacuccuggccucaagugauucagcugccuuggccucccaaagugcugggauuacaggcaugaaccacugugccuggccaagaucuauucucuuaacaaauaugcggccgggcgugguggcucacaccuguaaucccagcacuuugggaggccgaggcggguggaucacgaggucaggagcucgagaccauccuggcuaacguggugaaaccccgucucuaccuaaaaaaauacaaaaauuagccgggcgugguggcaggcgccugcagucccagcuacucgggaggcugaggcaggagaauagcguaaacccgggaggcggagcuugcagugagccaagaucgugccacugcacuccagccugggcgacagagcgagacuccgucucuaaaaaaaaaaaacaacaacaacaaauaugcuuaucucuuuaaaagcauuuuuuggccgagccugguggcucaugucuguaaucccagcacuuugggaggcugagguggguggauugcuugaggccaggaguuugagaccagccugggcaacccaguaaaagcauaucucuaaaaauuuuuuuuaaauuaacugggcauaguggugugcgccuauagucccagcccagcuacucagaaggcugaggugggaaaggaucgcucaggcaugggauguugaggcugcagugagaugugauugcaccauugcacuccagccccugggugacacagugagaccucaucucuggaaaaaaaaaaaaaaaaagcauuuuuuacugucacuugaguggucuguagauagcgacaggagguaauauauguguccagccaucuuuguaaucucauaaucugagacagucucagaaaguaagaacuuuuccugcuccacucuguaauguuuucucucuagucuuuaaaaaaauaguaauuuaaaaaauauuuuauaaguauaauuaacuuauaauaaaucgugcacauuaaaaguauacaauuuaguaaauucauacauaucugcaaauccaucaccacaaucaaaauggugaauuuaaggcugggcaugaugcucacaccuguaaucccagcgcuuugggaggccaaggugggaggaucacuugagaccaggaguuagagaccaggcugagagauagagugaaaccccaucucuacaaaaauuuguuuuuaaaacauuagccaagugugguggcacgagccugaagucucagcuacuugggaggcugaagugggaggauagcuugaggccaggaguuugaagcugcaaugagcuaugaucacgccucugcacuccagccugggcaaaagagccagauccugccucuaaaaaaaaaaaaaaaagaaaagaaaaaaaagaaaacaauuuuuuuuaaaagauaguaaaguuaccuaucacucucaaaaguuuccuuaugaagcuuugauaucacgcccugcuaccaaccccauucccccacacccaagccaccucugaucuauuuucuguaauuauagacugguuugaauuuucuaaaauuucauacaaauggaaucacacaguaugaacuguuuuuuuauaggguggguggucuggccucuuucauugugcauuuuuuugauauuuguccauacuguaguagauaucaguaguucauuccuuuuaauuaccaaguaguaaucuguuguauagauauauaacacaauuuguuuuaaucuauucaccuguggacacacauuugggcuguuuccacuuuugcuguuacuaauaaagcugcuauuuauauaaaagucuuaauauggauauauacuuucauuucucuuggguaaauacuaaggaauugaaugccuagguuauauggucaguguauuuguaacuuuuuaagaaagugcccaauugucuuccaaagagguuagagcuuuuauguucccacucgcaguguauggaauuccaguugugucacauccucgcuaacauuugguaugaugagacuuuaaaauuuuggccuuucuaauaaguguguuguaucucauuguguucuuauuuauuuuuauuuuuuauuuuuugagacagggucucacccugucacucagguuggaguauaguggcgugaucacagcucacugcggccuugaccuccugggcucaagccauccccccaccuuagcuucccgaguagcugggacaacuggugcgcaccaccauaccuggcuaauuucuguauuuuuguaauuuuuguauuuuuuguccaggcuggucucaaacuccuaggcucaaguugucugcccaccuugggcuccucaagugcugggauuacaggugugagccacugcgcucagcccucauugugguuuuaauuugcauuuuccuccugacuaaugaacauugaacauccauuuagaugaugcuaucacauuccauaacuucucuggugguguaucuguucacaucuuuugcccacaucuaaccuuuuuuaaugagauugcucauuuuaaaaaguauugaguauuguauaauugacaaaaauauauacucacggaguauaaugugauguuuuaauauaugcauacauuguggaaugauuaaaucaagcuaauuaacauauacaucauugugguuuugauuugcauuucccugaugauuagugauguugaacauuuuuucauauauuucauauauuucuuggacuugaaauguucccaacacauagaaaugauaaauauucaacgugaugauuaccucaaauacucugaguuggucauuacacauucuauggaggucacaaaauaucguauguaccccauaaauauguaaaauauuauguaucaauaaaaaauagaugcaucacaaggccgggcaugguggcucacaucuguaaucccagcacuuugggaggccgaggugggcagaucacuugaggucgggaguucaagaccagccuggccaacauggugaaacccugucucuacuaaaaauacaaaaauuagccgggugaaguggcgcaugccuguagucccagcuacucaggaggcugaggcagaagaaucacuucaaccugggagguagagguugcagugagcagggaucacgccauugcacucuagccugggcaacagagugaggcucugucuaaaaaaaaaaaaauggaugcaucacuucauguauuuauuuuuucauguugagacaucuaaaaccuacucucuuagcaauuuuuuuuuuuugagacagagucugacucugucacccaagcuggaguacaguggcaccaucucggcucacugcaaacuccaccucccagguuccagugauccuccugccucagccucccaaguagcugugauuacaggcaugcaccaccacacccggcuaauuuuuuguauuuuuaguagaagugagggucccccauguuggccaggcuggucuggaacuccugacuucaagugaucuguccgccucggccucccaaagugcugggauuauaggcgugagccacugcacauggcccuucauagcaauuuucucauauacaaugcauuuuuaaaauaugagcauuuugacauuuauuuauucauccauccaugcaauuaacaaauauuaaguaccuacaauggccccaaaaagagaaaauauauuacaaaacauaaucaaaugcugacguuuauuuuauuucauuuuacacaauacauuuguaguagccuucuccagagggacaaaaccaauaggauauauauacauauauuucauauauuuguauaugaaagggaauuuuuuagagagaauuggcucaugugauuacaaaggcgaaguuccaggacaagcggucugcaagccagaaaaugagaaagaaaagccaguaacgugucccaguccaagaccaaaagccucaaaaccaaggaagccaacaaugcaaccccagucugaggccaaaggccugagagcccccagaaggcugcuggugcaagugucagaguccaagagccaaagaaccuggagucugauguccaaaggcaggaggagaaaagguguucuacuccagaaggcagagagaaggcaguguuuguagcaugagugaggacuguaaucucagcacuuugggaggccaaggugggaggauugcuugagcccaggaauucgagaccagccugggcaacacagugaaacucugucucuacaaaaaauacaaaauuagccaggugugguagcauguaucuguagucccagcuacucaggaaacugaggcaggaagaucaccucaacccagggaggucaaggcugcagugagcugugaucaugccacugcacuucagcuuggaugacagagugagacccugucucugggugacagagcaagagggaaggaaggaaggaaagaaggaagggagggaggaagggagggaagagacagacagaaaggaaggaaggaaggaaggaaaagaaagagagagagagagaggaaggaaggaagggaaagaagaaagaaaagaaagaaagaaagaaaaagagaaaaagaaagagagagagaaagaaagagaaaagaaagaaagaaaaagaaaacaaaagaaaagagaguuuuauuuggcucacaguuacauagugugugugagaagcaugaugcuagcaucugcuucuggugaggaacucaggaagcuucauauauuaguccguuuucacacugcugauaaaaauauacccaagacugggaagaaaaagagguuuaauuggauuuacagcuccacauggcuggggagguuucagaaucauggcaggaggcgaaaggcacuucucacaugguggcagcaagagaaaaaugaggaagcagcaaaagcagaacccccugauaaacccaucagaucucgugagacuuauucccaucaaaucucgugagacuuauucacuaucaugagaauagcaugggaaagucuggcacccaugauucaauuaccucccccuggguccuucccacaacacgugggaauucugcgagauacaauucaaguugagauuuggguggugacacagucaaaccauaucauucugccccggccccuccaaaucucauguccugacauuccaaaaucaaucaugccuucccaacagucccccguagucuuaacucauuucagccuuaacccaaauguccacaguccaaagucucaucugaggcaaggcaagucccuuccaccuaugagccuguaaaaucaaaagcaagcuaguuacuuccuagauacaauggggguacaggcauuggguaaauacagcuguuccaaaugggagaaauuggccaaaacaaagggguuacagggccuaugcaagucugaaauccagcaaggcagucaaauuuuaaagcuccaaaaugaucucuuuugacuccaggucucacauccagggcaugcugaugcaagagguggauuccuauggucuugggaagcuccgccccuguggcuuugcaggguacagccucccuccuggcugcuuucaugggcuggcauugugucugcagcuuuuccagguacauggugcaagcugucaauggaucuaccauucuagggucuggagggcaguggcccucuucucacagcuccaguaggcagugcuucagcagggacucugugugggggcuccgaccccacauuucccuuccacacuacccuagcagagguucuccaugaggacccugccccugcagcaaacuuuucucagggcaaccaggcuuuuccauauaucuucugaaaucuaggcagagguucccaaaucucaauucuugacuucugugcacccgcaugcugaacaccacguggaagcugccaaggcuuguagcuuccacccucugaagccacagccugagcuguacauuggucccuuucagccauggauggagcugcugggacacagggcaccaaguccuuggcugcauacagcauggggauccugggcucagcccaugaaaccacuuuuuucuccugggccucugggccugugaugggaugggcugcugugaaggucuccaacauggccuggagacauuuuccccauggucuuggggauuaacauuaggcuccuugcaacuuaugcaaauuucugcagcagcuagaauuucuccccagaaaauggguuuuucuuuucuuuuuuuuuuuuuuuugagaugcagucucacucugucacccaggcuggaguacaguggcaccacuuuggcucaccacaaccuccgccucccagguucaagcgauucuccugccucagccucccaaguagcugggacuaaaggugcacgccaucaugcccagauaauuuuuguauuuuuaguagagacaggguuuuacuguguuugcuaggcuggucuugaacucccgaccucgugauccccccgccuuggccucccaaagugcugggguuacaggcgugagccaccaugcccggccuggguuuuucuuuucuauugcauaauccugcugcaaauuuucccaacuuuuaugcucugcuucccuuacaaaacugaaugccuuuacaaguacucaagucaucucuugaauguguugcugcuuagaaauuucuucagccagauacccuaaaucaucuuucucaaguucaaaguuccacaaaucucuaggacaagggcaaaaugccuccagucuuuuugcuaaaacauaacaagagucaucaccuuugcuccaguucccaacaaguuccucaucuccaucagauagaccaccucggcuuggaccuuauuguucguaucacuaucaggauuuuugucaaagccauucaacaagucuuuaggagguuccaagcuuucccacauuuuccugacuucuucugagcccuccaaacuguuccaacuucugccuguuacccaguuccaaagacacuuccacauuuucagguaucuuuucagcagcaccccacucuacugguaccaauuuacuguauuagucuguuuucaugcugcugauaaaaacauaccugagacugggaagaaaaagggguuuaauugggcuuacaguuccacauggcugggaggcuucaaaaucauggugggaggugaaaggcacuucuuacaugguggcagcaagagaaaaaugaggaagaagcaaaagcaaaaacaccugauaaacccaucagaucuugugagacuuauucacuagcacaaggauagcacgggaaagaccagcccccacgauucaauuaccucacccuaggucccucccacaacaugugggaauucugggagauacaauucaaguugagauuuggguggagacacagccaaaccauaucacuuccacucaugacagaaggggaaagggagcagccaucacauagugagaaaggaaggaagagagaggagggggaugccaggcucuuuuucacaaucaugucuuguaggaacuaguaaaaugagaacucacucauucccacaggaugacaucaagccacucacgagguauccacccccaggacccaaacaccucccacuaggcuccaucuaaaacacuggggaucuggccgggcacgguggcucaugccuguaaucccagcacuuugggaggccaagguggguggaucaccugaggucaggaguucgagaccagccuggccaaaauggugaaaccccgucucuacuaaaaauacaaaaauuagcugggcgccauggcgcauuccuguaaucccagcuacucaggaggcugaggcaccagaauugcuugaacccaggagguggagauugcaguugguggagaucgcaccacugcucuccagccuuggugacagagagagacuccaucucaaaaauaaauaaauaaauaaaacauuagggaucaaauuucaacaugagauuuagagcaaaaaauauccaaacuauaucaacauuauuaucagcuauagucaucaugcuguacaauagauauccagaacuuacccuccuaacugaaacuuuguauuauugaguuuugagagguuaaaauuauauauauucuggauacaaguccuuuaucacuuauguaauuggcaaauauuuucugccagucuguggcuuguuuuuagaggaucagaaauuuuuaaucuugaagauguccaauuuaucaauuuuucuuuuauggaucaugcuuuuggcuuuguaucuaaaaaaucuucaccuaaucuuaaaucagaaagguuuucuccuagaagucauauuuacauuuaauuuuauauuuaggucuaugauccauuuucaauuaacuuuucauacauuaugacauauggaucaaaguuuugcacaugaauaugccauuguuccaguaccauuuguugaaagacugauuucuccacugaauuaccuuuacaccuuuaucaaaaauaaauugaccauauauuuuuggucaguuucuaggucgcaaaucacuauacuguuccauuaaucuguuugucuaucuggaugccaauuccacauugucuugguuacuacugcuuuauaauaagccuuggaaucuacuacaaauucucuaacuuuguucuuuagaguuguuuuggauauucuaguucucuugcauuuccauaugaauuuuagaaucagcuugucaauuucugcaaaaagaucuacagggauuuuaaaaggaauuucacugaaucacuagaucaauuugggcaaaacugacauuauaacaauauugaguuuucuaauacauaaauauggcauaucacuccuuuuaauuagaucuuacuuaauuucucuuaucaauguuuuauaguuuucauuaugggucuugcccaucuuucucccuguuucauauuuuuggauacuauuuugguauucuucccuucaauuucugauuguuaguugcuaggacauagaaagauaauuaauuuuuuuccacacugauaguacauccugcaaacuuacagaacucacuuauuaguuacagucacuuuuuguagguucuauagaauuuucuacauagguuaucauguugucuguaaauaaagaguuuuacaucuuccuuuucaaucuggaugcuuuucauuucuuuuucacgucuuaauacguuggcuaaaaucugcaguauaaaguugaauaaaagaagugaagaguggauauccucgccuuguuucugaucuuagggaaaagauuuauuaauuuacuaugaaguauaauauuagcuauugguuuuucauagauacccuuaauuagcuugaggaagauaaguucuuuucucuucuguaauauuuuuauuauaauuuuuacuuugauuuacuuugauuuuuuuacuuugauucuuuuuuuuuuuuuuuuuuuuuuuuuuuugugagacacagucuugcucugucgcccaggcuggaguacaauggugcgaucuuggcucacugcaaccuccaucucccggguucaagcaauuuuugucccuuagcuucugaguagcugggauuacaggugcccaccaucaugcccggcuaauuuuuauauuuuuaguaaagacaggguuucgccauguugcccagguuggucucgaauuccugacgucaggugaucugccugccucacccucccaaagugcugggauuauaggcgugagccacugcaccggccuacuuugauucuuauaggcaggaucuugcucugucgcccaggcuggaguguagaggcauuaucauagcucacuccaacacugaacuccugggcucaaacaguuuucccaccucagcugcccaaguaccuaggacuacaugcacauaccaccacacucagcuaauuuuuaaaaaauuguuuaacuuuuuguagagauggggucuugcuauguugccaaggcuggucucaaacuccuagccucaagcaaccccccuugccucguccugccaaaucacugggauuacaggcaugagccacugugccuagucuuuuauuuuuuguuuuuucugcugcucacuccaggaggaauuuuuuuuuuugagacaugaucucacugugucaccuaggauggaguccaguggugcgaucucagcucacugcaaccuccaccucccaugcucaagggauccuccaaccuuggaagggacgcuuccaaguagcugggacuacagucaggagccacgacgcccagcuaauuuuuguuuuguuuuguuuuguuuuguuuuguuuuguuuuguuuuguuuuuugagacggagucuugcucugucgcccaggcuggagugcaguggcgcgaucucagcucacugcaagcuuugccuccuggguucacgccagucuccugccucagccucccgaguagcugggacuacaggcacccaccaccaugcccagcuacuuuuuuuuuguauuuuuaguagagacgggguuucacuguguuagccaggauggucuugaucuccugacuucaugaucugcccacuuuggccucccaaagugcugggauuacaggcaugagccaccgcgccuggccaauuuuuguauuuuuuguagagaugaaguuucaccauguugcccagucugguguuggucucuugagcucaggcaauccuuacaccuuguccucccaaagugcugggauuacaggcaugauccaccacgugcccagccgaaucacuucuaugccuaguuugcuaagagguuuuugucaguaauggauauugaacuuugucaaaugcuuugucuguaucuauugagauaaucagauagacuugguuuuguucuuuuuuuuuaguaauaauuuucuuuuuagucuguaaauauagugauugauuuucaaauguuaaccaaccuugcauuccuggaauaaacaucagcgggacaucaccuguuaucuuuuuuauauaucauugaauucaauuuguuaaaauauuacuaaggauuguuacauuuacacucauggaaguuauugaucuauacccuucuuuuaaccuuugucugguuuugguauuagaguaaugcuggcuucauagaaugaguugagaagugucgccuucucuucaguuuucuggaggagucuguauagaauugguuuuauuuccucuuuaaauguuugguggauuucccagugagagccaucugcucuaauaauuuuccuugugggaauauuuuuaacuacagauuaaauugcuuuaguagagcauuauuuagcuuaucaauuuuucuugaacaagcauugauaguaugugucuuuuauuuuuuuucuguuaaucaaaguugucaaaguauagguauaaaguuguuaguaauauuuccauauuaaccguuuaauaucuguagauuauguagugauacuacuucucucauuccugauauuggcaauucacgucuucacucuuuuuuucuaaucaguuuggcuagagguuuacugauuuuauugaucuuuuacuguucuuaguuuuauuguuuuaauuucuaauuuuuuuguuuucuuuuucuuugauuuuucacccugaugauuauuacuguguuuccuuucuuuugcuuacuuuuuuucuuuuuuuuaaaagaaaugguguuuugcuguguugccuuggcuggacuugaacucuuaggcucaaaugaucaucccacaucagccucccaacuagugaggacuacagacauaggccaccacgucucccuaauuuuuuuuuauuuuuugggagacgaggucuugcuauguuacccaggcuggucuugaacuccuggccucaagugaucuugccaccucagccuccaaaaaugcugggauuacaugcgcaagcuacuguacuggccucuuucuguuauuaauuuuaauuaauuaauuuuuuauuuuuuuacaaaaauguccugcaguuauuaauuuuguuuguuuuuuguuuugagucucacucgucacccaggguggacugcaguggugugaucacgguguacugcagccuuaacuucccugggcucaggugauucucccaccucagccuccuguguagcugggaguacaggcaaaugccaccaaccuggcuaauuauuuuuuucuaauuuuuguagagauggggauuugccaccaaccuggcuaauuauuuuuuucuaauuuuuguagagaugggguuuugccaucuugcccaggcugaaauuuuaauuuaaugcuauuguagucagaagauauacuuuguauguauugaaucuuuuaaaauuuacagccgggcgcaguggcucaugccuguaaucccagcacuuugggaggccgaggagggcggaucacgaggucaggagauugagaccauccuggcuaacacggugaaaccccgucuauacuaaaaauacaaaaaauuagccgggcgugguggcgggcgccuguagucccagcuacucgggaggcugaggcaggagaauggcgugaacccgggaggcggagcuugcagugagccgagaucgcaccacugcacuccagccugggcgacagagcgagccuuccucuaaaaaaaaaaaaaaaaaaaauucacugacacuuguuuuaugguucagaauaugcuuuaccuugguaagugugcaccugaaaagaugugcaagccggggcgguggcucacgccugugacaccucacuuugggaggccgacacgagcggaucaccugagaaaggaguucaagaccagccuggccaacguggugaaacccuguuucuacuaaaaauacaaaaaauuagcugggccugguggcgcacgccuauaguuccagcuacucgggaggcugaggcaggagaacuacuugagccggggaggcagagguuguagugagccaagauugugccacugcacuccagccugggcaacagagccagacuccaucucaaaaaaaaaaaaaaaaaaaaaaaaagaaaagaaaaaagaggugcauuugacuacugugacuauuguuagguggaauguuccauaaaugugauguggucaaguugcuugacaaugcuguucaagucuucuauauccuacuuauuuauuuguccuuguucuaucaauuauugaaggagaaggagugucauacacuuugaauauaauuguguauuuguuuauuucuccuugcaguucagucagauuuugccccauguauuuucaaguucuguuauuaggugcauacguuuaggauuguuauguccuuuugaugaaucaagccuuauaacauuaugaaauggcucucuuuguuucuagcaauauucuuuucucugaaauguacuuugucuaacaucauuaccucuggcucucuuuugauuaguguuagaaugggauuuuuuuccccauccauuuacuuuuaaccuauuugugucuucauaugcaggacuagggcugggcaugguggcucacaccugcaaucccagcaccucgggaggccaaugugggcagaucauuugagcccaggaguuugagaccagucuggguaacaugacaagaccccuucuuuaaauaaaaaauuacauuaaaaaaauauccaggacugguuucauuuaugaugcauauaguugggucuuacuuuucuuuagccaaaucugaaacuucugcuuuuuaauuaugauauuuagaucauuuuaacuuacagaaaguauugacaugaucagauuuaaaucuacuauauuguucuuuguuuuccauuugucccuucuguuuuuuauucuuucuucucuuuuuucugccuccuuugggaauaacugagcuuuuaaaaaaaugauuccacuuuauuuccuuuuguggauuauuagcuauaaugcuuuguuuuguuuuaguagucgauuuaagguucauaguauuacauguuuaccauaacacagucuaccuuuaggugauguuacauuacuucguaucuaauacuaggaccuuacacuggcauauuuccguuucauuucuuucaggcuuugugguauugcugacauacacuguacuucuacguaagcuauaaaccccacaagacauuauuauuauuauugcuuuaaacagugaauugucuuuuaaagagauuuaaacaauaagaaaaaaaggcuauacuuacucaaauaguuuccauucccacuauuuuguauuccuuuguguaaauccagauuuucauuuuguauuauuuuuccuucugucugaagaacucguguguguguguguguguguguguguguguguguguguguguguuugagauggaguuugcucugucacucacacuggagugcaguggugaaaucucugcucacuucaaccuccgccucccagguucaagcaauacuucugccucagccucccgaguagcuggaauuacaaacuugcacaaucaaacccagcuaauuuuuguauuuuuaguacagaugggguuccaccaugcuggccaggcuggucuugaacuccugaccucaagggaucugcccaccuuggccucccaaagugcuaggauugcaggcaugaaccaccaugcccaccugucugaagaacuuucuuuaacaguuccuauugugccagucugguagugauuguuucuuucaguuuuuguacaucugaaaaacuauuuguuucucuucauuuuugaaaguguuuuauuuuuggauauagaacuacacauuuauauuauuaguuuugcucuguuguccaggaugaaguacaguggcaugaucauagcucacuacagccuugaacuccugggcucuagcaauccuccuaccucagccucugaaguagcuuugacuacaaggacacaccaucaugccuggccaauucuuuuauuuuucguagagacaguggauugcuauguugcccaggcuggucuugaacuccuugcuucaagcaauccuccugccucagccucccaaagcguccuucaguucuuuaaagauguugcaauguuucuucacugucuuuugacuuacauaguucaugacaagaagucugccaaaugaauguaucuuuuuuucucuggaugcuuuuaagauuuucucuuagucucuggcuuuaaccaauuugaugauaauuagccuuuuguaguugucauaagucauguguuugaguuucacugggcuucuugaacccauagguuuaucauuuuuauccgauuuugacaauuuuccucccuuauuuuugacauaucuuuacugucaucuuccuuuccuccauucucuccuuuagggacucuaauuacauguauaucugacgaccugaaguucuguaccucccuaauucucuguuuacguuauuuggucuuuuuugcucuguucauuuuggauaguuucuguugcuaugccgccaaguccacuaaucuuuucuccuacaauguuuaaucugguacuaauucucuccaguguaauugaguuuucauccuuaguaguucaauuugaguaauuuguuauauuugcuaugucucuucuuaacauguacaaucuuuccucauucagaaagauuuggaauauuguuauaauaaccguuuuaauuuucuugcccacuaauuccacauuugaugucauuucugggucccuuuugggugacugauuuuucuccuuaaguuaaauauuucuuguuccuuguuugucuaguaaauuuauaacugggugucagacauugugaauuuuaccuggugcuggauguuuuugucuucuguuaaauauucuugaacuuuuuucugggaugcaauuaaauuuauggugagcacuuuguucuuucaugucuugcauuuaagcuggguuaggugggaucaaagcaguguucaguuuagaguuaauuuucuuuuacuaguggacuucaccaaaaugaaaaacuuuugcuccucagaaaacauucuuuuuuuuuuuuuaagacggagucucacucuguugcccaggcuggagugcaguggcacaaucucagcucacugcaaccuccaccucccagguucaggugauucucacaccucagccucccaaguagcuggaauuacaggugcacaccaccaugccuggcuaauuuuuguauuuuuacuagagacaggguuuugccauguuggccaggcuggucuugaacugcugaccucaggugauccaccugccuuggccucccaaagugcugggauuacaggugugagccauccaaaaccuuuuuuuuuuuuuuuuuuugagacagagucucacacugucaccugggcuggagugcaauggugcgaucuuggcucacugcaaccuccacccccggguucaagcgauucuccugccucagccucccgaguagcugggauuacaggcgcccaccaccacgcccagcuaauuuuuuuguuuuuucguagagacgggguuucacuauguuggccaggcuggucuugaacuccugaccuggugauccgccugccucggccucccaaagugcugggauuacaagcgugagcugcccacccagcccagaaaacauucuuaaaaaaugaagacaagccacagacuggagaaaauaguuugaugauauacaugugaaaaaggacuuguauccauaauaugcaaagaacccuuaaaacccaauaauaauaaaacaaacacuccaguuuuaaaaaugggcaaaagauuuugggagacacuucaccaaacaaaauauaggaugacaauuaaacacaugaaaagaugcuuaacaucauuagucauuagggaaaugcaaauuuaagccacaguacacauugcuacacugcuauuagaaugguuaaaaacccaaaccaaaaaacugacaauaccacaugcugacgaugaccuugagcaaaugcaauucucacacauuguuggggaaaaugacaaaugguacaaucacuuugaaaaacaguuuggcaguuucucaugagguuaaacauucacuuagcauccagugcagcaauacaauaccacucugagguauuuacccaaaagaaaugaaaaccuaugcuuacacaaaaaccuguauucaaauauuuauagcuguuuuauucaucauugccaaaaacuggaagcaaacaaaugaccagucgcugguuaauggauaaacaaacugaggccuauccauacaauaggauacuacucagcaccagaaagaaaaaauuacugauauacguaacaaucaccugaucagauaaaucugauaauucugcuaugugaaauaaacacacucaaaggcuacguaucauaagauuccacuuacaugacauucuauaaagggaaugaaaacaggaaagagaguacugguugugaggggcuugggguagggaucaggguugacuacagaagggcaugagggaacuuuuuuuuuuuuuugagauggagucuugcuguguugcccaggcuggagugcaguggagugaucuuggcucacugcaaccuccaccuccuggguucaagcaauucuccugccucagccucccgaguaacuaggauuaaaggcgccugccaccaugcccggcuaaguuuuauauauauuuuuuuaguagagauaagguuucaccauguuggccaggcuggucucaaacuccugacuucaaaugauccgcccgccucggccuccccaaaugcugagauuacagacgugagcuacugcgccccgccgugagggaacuuuuuuuuuagauggagucugucucugucacccagggugaaguguggcggcacaaucucagcucacugcaaccuccgccucccagguucaaaugauuauccugccucagccucccgaguagcugggauuacaggcgugcaucaccaugcccaauuuuuuguauuuuuaguagagacaggguuucaccaugauggccaagcuggucuugaacuccugaccucuugauccgccugccucagccucccaaagugcugggauuacagguucgagccacugugcaccaccaugagggaacuuuuaaggggaauggaaaugucuauaucuugguagugguggcaguuccaugacuguauuuguuucuuaaacucauagaacugcauacuaaagaggaugaaauuuacuguaugaaaauuguaccucaauaaaccugacuuuuuaaaaagcuggccagaugcgguggcucacacuuauaaucccaguacuuugggaggccgaggcaggaggaucacuugagcucaggaguucgagaccagccuggccaacauggcaaagccccaucucuaccaaaaauacaaaaacuacccuagugugguggugcacaccuguggucucaacuacucaggaggcugaggugggaggaucacugaagcccgcaaagugaagccugcagugagccaagaucaugccacugcacuccagccugggugacagagugagaccuguccgccccugcccccucaacaaaagaacaaagccaaaggaaauuugccaccaucaauauuaagguucuuuccaaaaauucauucuaaaaccuuaauggaaauucccagaauccaguuccaaacacauucugagcggugaggacaacuuuggaauugaaaaagagcucucaaagugguacacuuugaagggacaguacugggauggggguggggguaaguaaaacaaaaguugacauuaaucuaaaacuuuaaagaguuguggcuuuauuuuacacaucaugaaacaaaccagaggaugucaagacacuucauuuucaagcucucuucugugaggcaaagaguuggagaccagaguuccaagucccucuucugaaaguuaucagcuuugaaaacugaauuugagcaacucauuuauccucuuugggccccauuuucuuuuuuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgccaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccccccauuuucuuccugugguaaaugagggcaguagacuggguaacuccaagguuucauucucugaacucauucauucaauguucuuucucuauaaauucucauaauuuuaacuacugucuaucugcuggugaggcugggugcaguggcucacgccuguaaucucagcacucugggaagccaaggugggagggucgcuugaacucaggcauucaagaccagccuggguaacacagcaagaccucaucucuauaaaaauaaaaaauaggccaggcguggccaggauuacgccuguaaucccagcacuuugggaggccaaggcagguggaucgcuugacgucaggaguucgaaaccagccuggccaacauggugaaaccccgucuuuacuaaaaauacaaaaauuagccaggcgugguggacagcaccugcagucccagcuacucgggaggcugaggcaggagaaucacuugaacccaggaggcagagguugcagugagccaagaucgcgccauugcacuccagccugggugauggagcgagacuccgucucaaaaaauaaaaauaaaauaaaaaagaauauaucugcucacaaguuccuaauucauaccuucugugucuuuaacuauauaucuggguaacccccgccaggaaccuuaaacucaaauggaaauuuaacucaccuuucuccucccuaagccccaccucuuccuaucucccucucuccucccucuccccaaauccuccucaguggcaaaccuccagugucacaggauccagaaacccagaagccauuuuugacuccucccucucccucauuucccauuacccaggcaauugccaacccuuauauuuugacuguuuuuuuuagauagggucucgcucuaccacccaggcuggagugcaguggcaggaucauagcucacugcagccucaaucuccugggcucaagugauccuccugccucagccuccagaguggcugggcuuacaggugcacaccaccaugcucagcuaacauuuugacuacuugauaauucucaaagcaauucucagcuccacaucucuaucaccauuacccuaauucaagcccucguuaucaucucuggccuggacuacugccaacaacuucccugccauaguucuguuggccccauauucauccucuacacagacaccagaagugucuuucuaaaauacaaaucagagcaugucacaccucugcuuaaagcccuccagaaccaacagcaaugauuacccuuucuugagucacaaaucccuuugaaaaucugaaggucgcaauuaacucacuuuccaaaaaaaaaaaaagcaugcucacacacacauacacacacagagggaagauauaacaaccccccugaaauccauccagagacuacuuuuuuuuuuuuuuuuuuuuuuuugagacagggucucgcucugucacccaggcuggaguacaguggugugaucucggcucgcugcaaccuccacaucccagacucaagcaauucucuugccucagccucccuaguagcugggacuacagacaugugccagcacaucuggcuaacuuuuuuuguauuuuuuuauagaaaugggguuuugccauguugcccaggcuggccucaaacuccugggcucaagugauccacucaccuuggccucccaaacugcugggauuacagguguuagccaccacaccuggccucuuuuuuuuuuuuuaauuagagaugggaucuugcuauguuggccaggcuggacuugaacucuugggcucaagcgagccucccauguagcugggacuacaggcauggauccccacgucagaccaaccauccagagacucuuggucuacaugauaaaguccaaccacuuaacauaacacaucaccaaaguaucccuuacacauuacauguuaugcucaggcaacccugaauuuucuuuuuuuaaaaccuauucauuagaaaucuucaaauaauuugcugaauuacaacuuuauaaaugauaguuacucuaauccuggcgaccuuauacauugugucacaacaacucggaaugaaaucauaguuuuccaucuguggaaaacuccauuugcuguccuauuuaccuggaacauccucacccucuucuuucucugacaagucuuacuucucuuccaguaugacucuggcaucaccuucucuuggaagcuuugcuuuaccuucucagucuggguuagagguucagccacugugcauauuucuaaaacuccacugcaauuuucuuucuauaugucugaccuucucccaccaacaccccuaacauuauacuuugagggcaggaaacaguacuguguagcauuuaacacagguccuagacauagacggcgcucaaaaacaucuguggaaggaggaagggugggaaggagggagggaauuaaaaaagaagggagggaaggagagaggcaggcaaaucuugugacuccaaauccuaaugucuucagacuucauauauuuuucuuucugcaaaacacgugccuaacaaggagugcagcugugcuuuacaaguauuaucugaugaaggaguaagauacugcuuaucuccuuuuuacaaaugaggaacuuaagugcagagacauucucugccacagaaaacagcacguuucuuaaauguguuuuuaguccuaauauaucuaugggcauuaccuccaagaacauaauaucaaacauuaggaaaagcauaacucaaauaacaaaauauuccaagaccgaauucagugacuaucuuauacacugucuuauacacuaaagccugcuuuagcauagacuguaaauaauuguauggaagauucuuggcuaccaauugaccuuauaaugacagcaguaaaaaaauguauauuuuuuuacuguuuaaccuaaaaaaaaaugguuccucuuuuaggaucuuaugcaauuucuguggccacaaaagaacacugugugcacuuuauauauuuuuuuccuuucuuuuuucuuuuuuuagagauagcaucuugcucugucacccacguuagaguacaguggcauggucguagcucacugcagccucaaauuccugggcucaagcuauccucuuaucucagccuccugaguagcugaggcuacaggcaugugccucuacgcucaguuaauuuuuaaauuuuuuuguagagacugggucucgcuguauugcccaggcuggucuugaacuccugggcuccagugauccucccaccuaggccucccaaagugcuggggauacaggugugaaccacugcacucugccuacuuuuauauuauuuuaaaauuuccuucacauguguugguacucauagaacagaauugcgugagucaaauuagugaccaguagugacuucuacaaaagcuuucauuacuucaaaaccacugauaaugcagccauagaaaguaucaaccaagaauaacuaaaucacuuagguauaaaacucgcagauuccccaaagacagaaaaaucuucgacccuauaacugugacuaccugagaaguggauacagcuuuucuggaagucauagaaaaacaucuuaagaucacaaagucuccugauaaaaaccaaaaagcuugcaggugagcagucuggguauauaagaaaaaacaaaaaaccaaaaagcucuacucagacaaaccaccuacugugaaguucacaagaauuugcuauuucagagggaauaaaggauacagcacagugucaagaccaagcuaagccaauuuccagcccuucaguuuccccucucuuuuuuuuuugagaaggagucucgcucugucuccaggcuggaaugcaguggcaugaucucggcucacugcaaccuccaccucccagguucaagugauucuccugccucagccuccugaguagcuggaacuacaggcgugcgccaccacacccagcuaauuuuuguauuuuuaguagagacaggguuuuaucacguuggccaggauggucuugaucucuugaccucgugaucugcccaccuuggccucccaaagugcugggauuacaggcaugagccaccuugcccggcccccucuccaaauucuuacuccuguuaucuacaagaucccuuucaaaguuaagaaaaaugauaaaauacaauacucuugagauuauuugcuuuuugucaaaucaaaaucuuugcccaaagauuaaggcaaugucugguagguauguggggaggcagcaagacuguaaucuugaacuugaaugauagggguuaguuacugucacccugcuugccgagugucaugcaaggaugagaugagaggaacacaaagaaccguggauauguuguugaagccgaggcauuuugugggcuucucaaaugagcaggaauacccucccagaguaaaauguggucaauaccuuugcuuaaagaaugauuuggaaaagugcuucuucccaagaccuaaaagaugaccauauuuagcuuuggaacaguuuguuccuuuuacuuuaaauggaagagcauuuucuuucccauaagcauuaaauacaguacuauaucuccauuuuuaaguaguuuuaggcugggcgcacuggcucacauguguaaucccagcacuuugggaggcugaggcaggaggauugcuugagcucaggaguucaagaccagccuagacaauacagugaaaccccaucucuacaaaaaauacaaaaauuagucgggugucauggugcaugccuguagucccacaacucaggagguugagguaggaggcuugcuugaguccguaaggcagagguugcagugagccgagacuguaccacugcacuccagccugggugauagggccaggucuugucucaaaaaaaauuuaaaaaguaguuuuagggggcaaaaaacugggaucccuuuucugaccaggcuaaagcuuccuucauugacgcaugcaauuuuuuuuuuuuugagauggagucgcacucugucaccaaggguauagugcaauggcgcaaucuuggcucacugcaaccucugccucccaggcucaagugauucuccugcuucagccucccaaguagcugggauuacaagcgucugccaccacgccuggcuaacuuuuguauuuuuaguagaaacaggguuucaccauguuggccaggcuggucucaaacuccucaagugaucugccugccucagccucccaaagugcugggauuacaggcaugagccaucgcacccagccagacucaugcaauuuuuaauguauauuuaguaaucauaauaacuguguuggaagguuuaauaaaagaaagcauacugaaauacuuuuccuggggaaaggcaaugaccacacauuucuuaaaaaaauaaaauugguuauuuauacacaaguuccccuaccuccaucucuuuaaucuuuguacugcuugugccuagcaagaaauagguauucugucaggcacgguagcucacaccuguaauccuagcacuuugggaggaucacuugagcccaggaguucaagauuagccugagcaauacagugagaucucaucucuaccaaaaaauuuuucaaaaaauuaaugaggugugguggcacgugccuguggucccagguacucaggaggcugagguaggaggcuugcuugagcccaggagguugaagcugcagugagcugugaucacaccacugcacuccagccucaaugacaaagggagacugucgaaagaaagaaagaaaaagaaagaaagaaaggaaggaaggaaagaaggaaggaaggaaaaaaauggguauucaauuaaaguuuguuaaauaaaaacagauuuuuucuuccuaaugcauguuuucucuucauuuuucuuaucugaagucuucccuuggaauauaaguaagucuuccuccuucccauuuaauaucucauugccugauuguuuuucaguuuaaacaacaggagaauccaauaacaaauauuuaccaauagcuaagaguuacugaaagugccuucuuaguuauaaaaaguuaauccauuuuuaauguaaggcaagaaguucacaauuaaaccuaagaggauaauuuacuauagauagacgugaaguaccuaaaaagaaaugaauauccaaucuacaccuauauaauggcaaaaauuagaacuagaguuucagagucagaggggacauuaaugucaggucggcaggucugggcucacauccaauccaaaccaagcuuugcugagugucccuucccuccacuuucuccugaaucauucccccuugggcuaggaguuuccaagaaggcaaauaaacuaagauaagcaacaagagcaaagaauggcaacucaaaugugcaguucaaggcuuugaauacgaauuuuuuuuaacacuaaugaaaaagguaguaucauagcucuuaaaauauugaaauacuucucucuguccaguaucagcagauaaugcagaaaagcccauugggaacauguuccucuccuucaaaugccacuuagaaagcuucaucauuauucauaaaugaugaauagaagucugggcauggccgggugugguggcucauaccuguaaucccagcgcuuugggaggcugagguggguggaucgccuaaggucaggaguucgagaccagccuggccaacauggugaaaccucgucucuacuaaaaauacaaaaauuagcugggugcgguggcacgcaccuguaaucccagcuacucaggaggcugaggcaggagaaucgcuugaaccugggaggcggagguugcagugagcugagaucgcgccacuacacuccagccugggugacagagcaagacuccgucucaaaaaaaaaaaaaaaaaaaaaaguaguguuuacaauauaagggaaauugggaucccauguucuaauucaaagaauuuaaggcuauuaaccauuuuaaaguucucauguuuaagcuucucacuuuauccuucuuuauucaagaaaauccauaauacaaaguauuggcaaagaugugaggaacuggaacugccauacacugcuagugggaguggaaauugguguaaccacuguggaaaaccguuugacgguaucuaccaaaccugaacauaucccuucccuaugauccaggaauucuacuugugggcauaauccuuuauacugguguuuauguccaccauauauaaaacaauguucacagcagugcuaugcauaauuacacaaaauuggaacaacuuccaugugcuucgugaacauaauggauaaaauaaauuauaagaucuauucauaccacggaaugguaccagcaauuaaaaaaaaaaacacugcuacagagaacaagguugaaucuuauuauuauaauguugaguaaaagaagguggacauaaaagagcacacgaugaugguuugguuuacaugaaguucaaacauaggcaaaagcaauccauggcaucagaagucagaauaguggcuaccuggggaggggguacugacagagaggguggagcuagaauugcucuauaucucagucugaucgugguuauuugggcacguacauaugugaaaacuaaugaaauuguacucuuaagaugugugcauauuuacugugugccaauuauacuucauuuagaaauaucuggagagagagacauagaaauuucugaauucuuuccuaaauagaaaagaauuccaugcagcuuaaauaucguugcaaguauugaugcuuauaccuuuagaaagcccauuaugcuucugaaaaaugcacuuacuacuuaauaucauacauaauagaaagcuaacauuuuguauuaacggaaucuggaaaacauauuguacuacacauuugaaauuacagauuuacuaacuaguaaagauaacuauuuaagaacuaaaaugucuuuguuuuucaacucuuuucccccgauuuccauuuuuuacuuuuuauauuucagaauuauuuguaacaaaagcuauuggauauaauuccugcacuucuauauugcaagcauuuucucuauuuaccacagagacuucaaguccuagcauuucagagcugaaggggacucggacggacucccucacugcacagaugaggacgcggaggccgggggaggugagugucagucccaagguugcagaccuaggacagggaccggagcugccgggcacccagaacucugucgccuucaacccaaauucgauucaguccucucaucuuuccaaauagaaagcugacgcgaaccgaugggaagauuuuuuuuuucaauaacaacuaugcuacccagcagauucuuuggggacaguccucggaguccuugaaaaccccuuugggguuuaugccaggauaagaagagacuagaagaaagggacagcuaguauuuuaauauguaaaucuguuugcauaauauuuccuagguaaacuauucguugauccaaccaaaauucggcggggcugggggguaucguuauugaggaugacucgcucuaggggagaacgcggacgcauuuucccaucagaguucccuccauaaaucaaaaccucaaaagaagaguuaaagacgacacccaggugucuacaguauccaagggccgggccaggagagguccuuggccaccuggcgccgaguucgcggccgcagacucccacggacggcccagcacccgagcgcgcgggccgagcugccccagacccggcgcagcgccucggcgaggccgucugcgaaguccgggccgccacucgggaccgcggcccgagccagaggagagacuucggagaagagggaagaggacgcggggugggaaacgccggggccgcaggcaaguagugggcgaguccggagggcgcgaaagaggggaggggcgcgggaggcaauggaaggagcgagcgcggggaggagcgaggcggcugggccggaggaggcgcgcgcccggguccacacugcggggugggggcugagggaccgcgaggggcugcgagcgagcgagcggggccuuaccgagcagcggcagcuggccgccgucgcgcgccaacgccggcauggccuccggagcccgggguccccaggccgcgccggcccagcccugcgaugccgccuggagcggcgcgccucgcgcugcaggu

SEQ ID NO: 193013 - RNA, 102270 nt, Homo sapiens
aggaggagggccgggcgggcaggggaggaggaggaggcgggcgccgugucgcacgcagcuccaggcggggcagccccgguagcugagggacgcagcuagaccuuggcgggacggggcuuucgccggggcccaggcccagggaccaggcggaggcgucgcgggagccuuuggggcaccacagagaugcgggugagugucggcagccgccggggccgagaggagguggcggcggcggcggcggcgcaggcccggccccgagccgcggugucgcagugacucgggccgcgacggccgaaaccaggcgccuggcgaggccugagccgccgaaacgcggccgggcagaauggcggccgggccgggggacucgugggcggaggacgccgaagguggcagaggagcgagcggggccgggcccugagucaccccggacgggccggggcggccaggccuggacuacgcacugggaaaaagcacgauucaucgcgccuggaggcggcggccugguggcgccggccccuuuccccgccgcgaccgggcuggguucucggagggugggccgacguguggcccggggcggcucgggcguccgcgccucgccuggugaggcgaccuccgcgggacgccgggacccgugcccuugcccccucgcgcccacgcuucuucccggcgcugcuuuccggccgacgcguguuccccugugagcucugggcucaagcgcaggagcagccgcggagccgggcucucucgcuuuccgguucccugcccgcggcucucggguuccccgccugcauuguugcgaacgugcagggcgcuauuauuggguaacagucgcccuuuugccccguucuccugggagagcgggccggggcaugcgcgcagggaugcuagcccggcggccgaaccggacagagccccccggcgcccgccuaucgcucgcuagucgggccgggcccugcgcugcggccucggcgcgcccccggucccaacgggagcgcgcgcccugacccugaggguagccgugcgcccgccaggccgcugggacuugggguccccagacucgggggucgucgcuuuuuuuucccuuaagaucugaaagacccccguuucugccacccgugcaguauuguguagcgcagacauaagauaagaaagagaggaaugcuuguagacauuccuugaaaugaauccccaaaguuaggguuuucucccuggcuggcuuugccaaaaagaggauucucuuuuccgauugggucacucuugguugcuucugguucguaguagggguuagugguaagugcgcaaauacugaauugcagucuacuuaaauauuuguuugcucuguguaauugcucuuuccuguaguagcauuaaaaucgucaaaaguucugaguggaguaaacgaucacacuuuuuggaaugcacuuaacgaagcggcagaagaggaacuagauuccuuuuuuacuucaagccaugagcuucuaggaccuaagcauagcuuaacgccucgcagaagugugugcaguuuuaaguuuaacacuucauuucauggugcacccgaaaauguacccgauuuucugaaauccuggagaguguauuacguaguaaaauauguaaugauguuuaaaauguaaaaccagucauucuguuugaaaaagauauuuggagaugagauuuuucuuuguuuaaagaagguuuguuuuuggauauugaaaaauguuuuacuugaagguucuauuuguuguuuuccauggugagucgaaauaguugcguuacauuucaaauuccaaagcaugcaaacacaagacuggcucgcuuuaacucuauuaaugcccauuuuuggagguuucaggagaguguuccuuaagcuugagagggauggcugaauugcuuucuaaauauguuaaacuuuuuuucucauuggcuucaucuuuuaaaaacgauuuugucaaaaaacaaaccaaauuuagauaugcuaggguuuuucaccaauuuauaaaagccucccucccugagagccacaugcucagguccuuauagccagccccaccccccacuccuaauguguguaccacaucagaagacagacacgcaugccugagcugauucugcaugguuuccuuagauauuacaguucauuagacucuugccacuuacugaauauuaucuucuagcuguaauuaacuacaugacagccuuauuucccauacauuuccgauugugaauuccuccagcgcaggagauauuccuuauuuguuuuugcguccccagaguaacagaacuugguugugguggugccucaguugcuuuuuuuuaaugaaugaguuuucuggaauaauucuaacuuaaacuuaacguuugaaaacaugcgcugauuuuuggcuacagaaaacacagucguugugcuuaagccgguuaagaauucaagcuuuauuauacacuucucgaguaaaauugaucgucucucucaucccuccuuuucuauucccccuucccucuucacuucccuucucccugaaacaccccaguaucuaguacagggcccuaacagaaaaaugcccagguuuucuauaccuauggaagucugggaaagugccaagaaaacagguugugaaacuuuaacuuuuuucccccuuaaaacuaguuuuaagguguggauguuuuuacuuuuuguguuugguguuuuuuuggaaacacgaucagguuuuuccccccagguugaguauccagccuugccuuugcaaugaagcaguuugguaguuaaggcuccuccuuguagaugaggcaagccccaugguucugcuggagugggauaggaaguugcuguaggaggaaccaucccuuggucucugagggccauucaucagaaugucauucccaguauacccaguggugucugucuuucagcauggaaaauuaaaaugaauguacuuuaaauugaggaguuguuacuugccauucuucaaauuaaaaauauuagggccuuaaaaacuuaggaacuugguuuuuuguuuguuuugcuguuucagccuuccguagguccuaaagccagugaccuugagucauucuggaauaaaaugucuuugggggacugucagcuucauuuugaacuugucuuuuagguaugucuggagaaaagaguguuaaccauuuuaagggccaauucuaagguugccuugcuuuuuaaaaacauuugguaguuuaucaguguguuuguuuugcuuccaaaugaagaaaugagcauuaaaugaaaaauagauccuauuuggauaaaagccuuauguuuacuacugaggacauaauuuccuguuuauaggagguuuccuguuuauaauaugaagauuuaguaaacacacuauaaacagaauuauuauaacauuuaaugacuuaaguuuuuuauucacucauggagguguuucauuucuaaaaauuccgugagggagagagauugaagucauuuauuuuugcuuagguauagaacaucuugcuugggagagaagacauggagucuaguucaagcuuaccuuugcagggcauauauuuccucguuuuuaaaaugagaugguuuuuaauugacacuguugauuuccuuaggccccgaaaguauguggauuccaugggaaugccacagcuuuuaacauuaacaggauuuuggaaaaacggucuuaaagaacauuaaguauuguauucauguuuaaaaagcaggguugugaagccuaaguuugauaguuaaauuuuuucccuugggaaacuuggaccaaguaagcacuggucugccuuuccuaguguugacuccaugcuucagcgcuauugcaguuccauucuggaucugacucuuugccuuuucuaucaccugacggcucacacaucaccaucucuggaaagcuggcccugauguccuggucuggguuaggagccuucucuggguucccauguuguccugccuaugucacuaucacaguauuuaaccuuuugauuguaguuggugguuucucccaccaaacugaccuccuuugggacagggacacugugauaugcaucuguccccagugccuagcauacugcaugcaucaacauucacauacauccuuccacuggaaaucuuuacagugcccucugaaguguggguacuaugguuuaacccacuuuacagaauauaggugaaggagcugagacuuugaguggugcagguaagggcuaggaagguagucaagcccgaguuaaacgggacaggauaacuccggagcucaggcuuuuaaccagauguucccugaguguuugacuaguuuaugugaagauggaagaagacuagaagagauuaaaaugaaaaugcuuuaaggacugauaucugaucauuauggcagaauucauuaugcagaacugugauccacuaccaagaaugagcuuauucuuccuggucuuuuaguaacauugugggagaguaauugggcacugauagcauagacacgaacaguucuggaacuuuggggcuauuguuaaauugggugugauguuaugacucauuggccuugcaaaaauuuauaaaaccauucaagacuguucaaauauaacaagcugcaauuuuuuuaaaggucuguguuagaaaauacuucggaaaauagauuguaugaaaugggugcagccauuuaaaauauguauaaaguguguauguacuagugaagguuuuuuuguuuuuuguuuuuuguuuuuuuugagacagagucucacucugucgcccccacuggagugcaguggcgugaucucggcucacugcaaccuccgccuccuggguucaagcgcuucuccugccucagccucccgaguagcugggauuacggugccugccacuacacccagcuaauuuuuuguauuuuuaguagggacgggguuucaccauguuggccaggcuggucucaaacuccugaccucgugauucaccugccuuagccugccaaagugcugggauuacaggcgugagccacugcgcccggccgugaggauauuuaaaguaguaaaaauggcugucauuuuagggggguaagcuugggugcuuuuaaaauauuuuuucaagaaaaaauuuaagaaccaaaaaguaacagcauggcgaucucaagauggagaagaccuagauauaacaccaagcacgggaacuguaaaggaaaagauuugaguacuuuagaauaauaaaacuucucuguguuaaaauuccauaaacagaauuaaaaggugacuggcaaacagaaaaauauuguaacuuacaagcaaauuuacuuuccuuacuguaaaaagagggcaugugaacaccaccaacaaaagcggcccccccccacccccguggaaaaaaaugggcaaacugguaauuuauaaaaagaggagcaggaaacaugaaaaaacuuucagcuuuacuagcaguacucccagaaaugcaaaucagugagauacuguuguuguuuuuuuaauuggcguagauuaaaaaaugaacuacuuauggugaagguauggagaaaugagcucacucauaccuugcuagaaagaguguaauuuaauaugauuuuuugagagcaaaguacguaacaaaagcuuguaaaauauguaugugcuuugaaauagcuauuccauuucuaagaauuuagucuaagaaaauacaaaaaaaaugacuacuagauuaauauucuguccagggugugcuguuauuuaacuaauacccucuuaagcauuuguuuucguuuuuuugcuguuguuaaggaugauuauuucagcauuuagaucaaucuuuaacuuccauaauacuguauuuaaugaacauuuaguuaguauuaaugauaaaaugcaacauaaaacaacauauguaaguaauagcuaaacuuuauuuuggugugugaguauaugcauuuuuuaaaaagaugaaaaccagaauguuagcauugauugucucugagcaguggaguuauuuuuaguuucucuuagcaguagguuauuauuuuuuuuuuccuccaacuuucuacagugcacauauauuuauaguacaguggauuaauuuauaaaaucaagaaaucccaaaacaggagaagcaggggagcuacuugcaaggaagacauuucugcuuaguuuaaugcugaaaucacuuaguguuugccguacuggcagccccuuuccagguguguugaugcacaggguuaaauaucugacuuccguugggcuguauuuccagcggucagguucuccuuugcuggacuaaucuucuucucauuuauuuccccauaucuuaauccuucagauacuuuaguccccucauuuaaugcccuccaugaaacuguccuaaucucaugaaacugauugauguuuugaugguuuauuguaacacuagauuagguacuaaugaauugucuucaguguggaaguuucuuuuuuuuaguaauagugugaacuuuuuuugcuuaguucacaacuccuagugauaguagauguguuuuaaauuaaucuuuaaacuuaaugucauuaugcuuaagauaagaauuugcuaaaaauuagaaaaaguauuuuggucuaguuucugcaguagcuuggaaaauucagaggcuaccaucaauuauuuaagaaguguaugcuaaauaguacaaaugaggaauacuguuguaauuaugagaaaaccguugcacagaaacgugucaccuaaugcugggagggggcaccuuugcuaugucgaaauuaauuaaaugcuaacuaaaauaguuacgugugccuaauaggcauccgaaagucagaacgggggaaaaaggcugacagcucagaccuccuuuucucaaggcaggaaggaggcuuuggugagacuggaaggaaagguuuggaauccuagaugaugucaauaaaccagacucuuugaucccaaguggaauucagggaauagacaugaagacuaggccauuucccccuccccaaacuucaagcuuaucuauaggaacuuggagacuuuggugugggggaugguggagaagaaaaauuccagacugauucuucugacuucucucauuuuaaauacguaaaaucuuuaaaacguuugcuugccauuuuaucuuacaugcaauaauaacccuuagucuagguugagcaucccuaauuugaaaauccuaaauccuccagaaucuaaaacuuccuuaguuaccaacacgaugugacaaguggaucauuucaccccgaccucaugugaugggccacggucaacaugcaggugcacaacaguuuauucaguguccccaaggggaaaguaaaauuaccuucaggcuguguguauaaggucuauaugaaacaugugaauuccccguuuagauuuggaucccauccgcaagauaccucaaauauuccaaaauaugaaacagucugaaauucaaaagacuucuggacccaagcauuucagauaaaggauacucaauuuguguucagugcuugguaugagccaaagacugugccgagcuugcuuugugacucccuagcugcuugcccucagcuuucugcugcuuggagauaccucaaaugggacagaaggcugucuaaugcaguccugguugaggauggacuuugacacacagcaugggaauauauuacaucaaucauaaaguagagacuacugaaaugagagggucuccuauuugauguguugaugaaaggcuacuugggcaucuguguagaguagguccuaccaacaagggacucaaaacacacaaagggaagaaggguuaggaaugcugaagacacauacugaaauuggcucuucaguagugccuuuguuacauguucuauauauaggggacuuugcccuauacaggguauguguguugggggugggggcggcggggggcgggguggguguuuaaugucugcaguuuagcuggggcuuuacaggugaaacguacuguauguguucucucgacauuaugaagauuuuguuuguuuuggucacugguauuuuuauaauggagcucugccuuacuacucuacuuguuuuacugcauuuucaggauuuuuauuuaggccaauauuuggcugucuguguucugugauauguaagguaugggaauaggagggaagaucugugaauaaacguaggaaaugccagguggcauauugaagggccuuuaaaaucuuaauuuguuuugcugcuguuacagggagauauaucuuauaggguauguauauauguauacauaccuacauucauauauauuaaaagguccacuccuaauuuaauaagaaauuaccuuugaaggaagaaaacuccccuaccauauuaacauguuuuguagaacacauacugauuuuaaaaucaucgaauguggaaaauuaggucuuuacaguagagauuugauauggagugaauugauguguucauuuuuuucucuuggaacgagcaccuggaaauauucgugguucuuuguagcacagugugggaagugccauagaggccaggauccuaaugaguaugguuauaaguuuagugucuagaaauaauuuuugcuucacccuaguccuuguuuaaauccuaaauacuaucagaggaauuauauuaaaaaaauuuuaaagcauaugggagacaacacaaucaaagccugugucauuuacauguuauugguggugucauguugagaucacuuuuuauuuuuuuaaauaauaauuuuuuuuuuaaguuucaggguaccacagguucguuacauagguaaacgugugccauggugguuugcugcaccgaucaacccaucaccuagguauuaagcccugcauacauuagcuguuuucccugguguugguccccacaccuucccugacaggccccagugaguguugugcccuucccgguguccauggagaacacuuuuuaaaccuguaaaauaaugguuuaacuacaaaguuguuucacauuuuuucuuuaaaaaucuaaaacuuccuggguuuuaaaagcaucucaauacuucucuugaaggcacucuuagauuuguacuugauucauuagauugguucucuugcauuuccaauucaugguuuccagagggugaacgcuguucucaggaugucuugcguuagaggaguuuaggaagcaucaccaggucuguucuccaguguccccuucugaguaggggccacaucgcucauuucccagacuuguggaccagguuaccuuucuuuuuucuugggugaccuccugagguuaggguucugugcagaauacuugcuguuccaguucaucuuaucuuuucuaacucuucaugagcauucaggagauagcuuuaacuugauccucucuucuagucuuuuuugcuuugugguuucucaguuuuuucagguuaagcaauucucagcaacuucagcugagagccuugcaguccugcuaauagccuucagggcuuuugcauuugacuaaccuggccuuucuuccaacuuggcuugccccaaacugaucucuuuuuugcucccuagaccauauccgacaucucuauuucuagcguugugucagagacacagauuucagacuugacuucuuuuguuuguccauauucagugaucuaccaaaucuuacuaguuccucccccauaacacuauguguuuauaccuuccucuuuggccccgcugucaccagcuucauucugcccucacgccuggcgaugcagugcgcugcugauugcugcuucauucaggacuugccuggcuuccuugauuacagaggcucuccagggcagguauugggcugcuagcauuugauagagugggcucugcucuuugucuuugcagcccuuugccacaaccauccuaucucaucuucauaagcuuaaaaaaauccugaaaaucuagcuguguguaucaugcuaacaugcuuuuuaaaaaaacuggcucugcugcaauuuucacuugaaaguagcuggauguugguucuggguauuugucucuaucucagcucuucaaacugggaaugugauuucuaguaacaacauuuagcaaaauuucaacaaagcaaccaauuugcggaaguuguguuaacuuugagguuuugccauaauaaauuauaaauguuggaauuuuucuauugauaaggcuaacuuguggaaaacugauuaaauaauucacugauuauaaccagcaaaccauauauuacacuaaaguuuuguuucaaaaauauggauauuguggaagaugaguauccacauagcuuuuuaugguaaacauaggugagcguguauguguaacuaggauagugauucccuuaauaguuauaggaaaagugauucuaaaaagcauucugacgccucucuuggcggcagugaaugaaacuacaguuucacauuaaaaagaguacuuuccccgccaaaaaugcagaggaggauuuguuuuacugacaauugaguacaggccaaacugcguauaugcgcauacauacucugggcuuugugugugugauuuggcaaaaagaaaaauaguccuaaagugugcaucucuuuauuccauuguauuuauauuuuucagaaguuuauuuauuugcaguuuugauguguacauuuuauuuuagaaaauugaaugaaguuugugagauucaaguccucuaaaguaaguuuauuauauaugaguucuugacgauaacaaaacuauggggaaaaaucuggauuuugugauguuagcauuaguucuuuaccuuguuaaaaauauuaacuauguuuucaacugggaacaugcauuuauguuuuucaaaguaagcuacuugaaguauaagcuuaaaaagcuugcuugagaaaauacacaaguuaauguaaauuguaugaaauaaaaaauauggaccgacuauuguugagacuuuccacaugaaacuuaggcugggcagugaagacuaugguauugucccagccacagcuaggguggugacagaaaucaguagcaaucuuaacaugcaggauauucuuuaugccugcuuaagguauggguuuugccaggcgugguggcucacgucuguaauuugaauacuuagaaggccgagguggccggauugcuugagcuuacgaguucgagaccagccugggcaacguagugaaaccccaucuguacaaaaaaugaaaagauuagccaggugugguggcccacaccuguggucccagcuacuugggaggcugagguggggggaucgcuugagcccuagagggagggagauguugcagugagccgagguggcaccauuucacuccagccugagugacagagugaaacccugugucaaaaauaaauaaguaaaauauggguuuaaguuauuguugaugcuuuugugucucugccccuuagcaauaaccuccaaaacccaccacucuuagggugacaaauaaauacaaauuguacagaccaugagggaaauugacuagaaaauuuuguaacuacaaagaaaggugcaucuugacuaggggcauuacuauaaaaaauaccagugggccgggcgcgguacgccuguaaucccagcacuuugggaggccaaggcgagcggaucaccugaggucaggaguucgagaccagccugaccaacauguagaaaccccgucucuacuaaaaauacaaaauuagccaggcaugguggugcaugccuguaaucccagcuacucaggaggcugaggcaggagaaucgcuugaacccgggaggcggagguuguggcgagccgagaucacgccacuacauuccagccugggcggacagagcgagacuccgucucagaaaaaauacgagcaaauguaaaugucuagaggcuuacugcuguuucggaaucauaagugaagcugaugcuacagguuuuaccacauuuucuccuuuuuuuuuuuugguugggguuucgcuguugucuccuaggcuggagugcaauggcacgaucucagcucacugcaacccccgccuucugguugguuuucaagcaauucuccugcgucagccucccaaguagcuaggauuaaaggcgcccaccaccaugcccggcuaauuuuuuuuguguguuuuuaguagggacggguuucaccauguuggucaggcuggucucgaacuccugaccucaggugaucugcccgccucggccucccaaaguacugagauuacaggcaggagccaucgugcccagcccacauuuucuccuuuauuauagguauggccagauuguuuugagacagagugggaagcaaaauuuaaaaaguccccuucccaaaagaacccugcuucuuauugaauguugucaucgaguuacagauuuuugugagcucagaagacauacucaaaucauugagaaacuguuuuuccaaauuauuuauucuugacugauuuaaauguacacuucugugcauauauguuucuccucauacucucuccccaguguccauaauuucggaaaauacuaaaaaguucuuaguacuugauguuguaauagcuaguaaggaaauuuucagcaagaugcuuuuuagcaaaugcagcauugaacauaugugcagagaaugggggugcaaaucugacagguggaaccacaggugcggugggugacaucacucacugugagccuugagugguucagggaccacgggggacaugugucaggagcaucuuaccagaaagaggugucgcuuaacugugcccaguuccuucaggagagcgguuaaagugguaaauugucuuuaaaacaaaaaacauaaaagcccuaaaucaaauaaagagcacgguagcgccguuucuccuuuugaaccaguuuguagugaaacgggaaguguauuugaaaguuugcucagcuagggaaaauuacugaucagaguuuucgacucaggguuaaauuaucuuagucgaaagaaaaauaauagaaaggggugucuuauugaugaauagauucauguucacuuagugauacacuagcuuccaaaaucugcuuauugagcagauacuuauucaaggccccacaaucaacugcagggcaaacgguucaccacacaugagggaaauuuggaaauuaguugaagaggauugugggaacugugaauugagauuguucaucuaaaugggaguuaauagcguuugugguugacuaagggcauccuuuacggaaguggaccucacgugcacaccucacugggagagggagagaccugccaggaggugcacaucuggccuuccacgcuuaguggccugaggauguuucccuggggcaccacuuccacaggcccucuaaaaggagggcagaauggcuugcuguuuguaucuuuguauuuguguuaagcuggguucugaaaauacaguggugccaagacagaagagaaacuuuuuggaugcugaugugcagugaaagcucuccaguagcggcuuuuccaaagucaguggguuucauacaacagcaucccauucauucacuagcaagagagcuaggaaguccuguggagcugguguuuuaaaguauucuguuaaacauguauuucaugguagaaugaaagauucaugugaauuuuaagauagagugauauuucaaggaaaauuuaacucugucacagcuuaggcuggauccccaggucugucccgauacaaaggauuccuccacccugugcugaaaguuacauuuuggugggaauuuuagagaagugccaccucuggugucaucaguuaucaaagguauuguggaguuuucagguaacguuaauuuacuucauuuugacuucaaaaauaagcaugggugguuuaacauuuaaauacuaucuuaggaauugcauagauauuagaaacccuuuauaguaguguuaacaugaauaguagcaaaugcuuaccgugugucaaggacucugcuaagcauuuuauuuucguaacucacuuauuccucauagccaccuuauacaacagguacuacaguauuaucucuaguacagaugaugaaauacaggcgcagaaguuaaggaaucugaccaagcucacacugccagugacuuguggagccagaacugugaaguucacagacaucccacgcauuuccauauuagcuguuugcaauuugucacuguguacugucaaucagugccucuugaauuauuucuuuaguaaaauauuuuuugugggauaacccagcacccacacagacauaacugggaaaaaaaaaugcacugaguaauacuuaaccuuguuacauucuaugagcucuuuuucuuuauuugauuuuuuaaaaaguuccaguucccuuuuacuaaguugguuucaugaucuacacaauaaugaauugcagcccucaguuugaaaagcaugugugguguagaugaucaugaucaaauguaauaccguuuuuucuugcccuaaagugaaugcaaguacuuggaaacaaaauacacgcaaguaccaaucuagaccauugaguaagcaugauuuaaucuagguaauugaguaaaagcauugugcugaaacugagaacugauacucaguccucagcaguuaaaacuaguuuauuuggacaaacugggcagucuuuauaacaccuguuaaauauaaugugauugugauuuucuguaaguuuucagguuuuccggagcaauuuauaccagugacgcuuguggcaucuuacuuggaagucauguaguaaaauaggaagaauauagauguugacuuaauuaagauucauuucugaauugagcaauauuuaaggcauuuagugcuuguguguggauuuuuuaggauuuaaaaggaccuuccucuauuacuuauucaaguaucaacucuaagagaaaaaaaauuguuuucuaauuccuaagauguuuauaggagaaaauucuguacuucuggguaaugauaugugagaauucuuguaauuacaaaauguguguauuugaaggaaugaauuaaauuagcauguguguguauuuuauauuauauauauauuuuuugagauggagucucauucugucgccuaggcuagagugcaguggugcaaucucggcucacugcaaccuccaccuucuggguucaagugauucuccugcuucagccucccaaguagcugugacuacaggugugugccaccacaccaggcaaauuuuuguauuuuuaguagagaugggguuucaccauguuggccaggucuugaacuccugaccucaggugauccaccugccucggccucccaaaguucugggauuacaggcgugagccaccacgccuggcugcauguguguauauuuauauaauuagaaggacaaagauugaucacaacgagaagccugcuauauccauuuaguaaaacuuugaggcucuacuaauuuauucuuuauagcaauucugagaagucgguauuuugguguuuaauucccacucccagcuuuauuaagguauaauugacaaaacauaauagcaugcaaccugaugauuugauauauguacgcugcacaucaugaaaugauuaaaucaaguuaauuauauccaucaccucacauacuuaacauuuuuuugugguaagaacuuuuaagauguacuauaagcaguuuuuucucuuuuguuuugcuuuuaagcaauuuucaguuuucaaaauacaguacauuauuauuaacuggagucaccaugcugggugcuggaucuccugagcuuauuccuccuaucuaacugagacuucgcaccuuugaccaguaucuccccaucccccuccuuggugcuugauuuuuuaaggaaaacuuaaaaaugaaugaacagaauuagaauuggccuuauagaaagaaccaaugucccuucuaagagaaucugaauagcagugcuggcugguuuggagucugucugucuucucuguagugauaggugugguauuuucucauugccaucucguggugaucugagugggugucaucuuguugagguugccaaagggacucauuuuagagggcaguggaaagcaugaacacaccugggcagaacauggucgucuuuauaccagacuuugaauccaggguugcauaccuccagcugagagacaugcacagaaguucuguugugagacuucugcuguaaguaaguaucauugguuguacuuuguuuuuuguuuguuuguuuguuuugugugugagagggucuugcccugucccucaggauggaauguggucacaugaucacaguccacagcagccuggaacucaugggcccaagcccuccuccugccucagccucccaaguuguaucuuauuuuugaauaagguaugugguuuuggaagacaugauguuugucaugucuguucauuugcaaguuuguuguaauuaugcuuguauacuggcuuuagaauuuaaaaggaaaauucauuucucauuccuacccaucauuguaucauggugaaugggguaauaagucaucacguucucugagucaguccugaggauccucuugugacagcaauguugggagaggcagguaucuggugauuucugcuagcaacagaguccaccauugucuucucaccaucguguugagcgagucguuuccauuucuacuuggcugcagccagguuucauugcuuucuacucguucagagcuauguucuugaaggccguggcuccuggcacuuaccacagucagugacuuuucauaauagaccuuuuccuugauuuaccuucaaccuuaacacugucgaacuaaaaguuucauggaugagccuccuuuggcuugccuucuguccuccugguucucuuauauauucugucucuugcaagcauucucucuccuuuuugggaggggugggaggcaagggacuacuuugcccacguccuuuaagcacaaaauuuuaguccucaucucuauuaaguucuuucuucacacuuugaagauuuuuguuugcgcuguugccaacaauuuuacuuuuuugucaguuacuaaauuuauuucuacaggugugauuuccuuugggcuacaauuuuuaaacugccaaccuuuaaaaaaaacacauucaacuuaucuaaaauuaagcucuucaucuucuuucuaguuucaggcuucuucucguaacuuaucuauuucuguuaauccucacuuucuuauauagaguuguuccucucuaacucccuuuacuccugggguuuugcuaguaugagaauuuuuaaacugaguguuuaauuuagugauacaaagaauuucauauaaauacacuuauaugucuggaugaucauccuguaaucuagaacugccaugauauuucguacuugugaguucauauuuauuuacaauuauauuguugccggguaauuaccuaagacagaggcuauaauugcuugagauccugcaggccacauauggcuccaagauguucuucuagauuuuacaguacaacuuuuugcuuuuuuuaaucauaaaaaaugucaaaaguguagcaaacauguccauuccugagaauuccacaugcuaacacaugcagacaucuuccuauuuaagaucuaguaguuauagacuuuauauguaacuacuauaauuucaagguguugaugagcauaaaugauacuggcaugucuagcauggaauaaugaaaaucuuugugauuucuugcugacgaaguuagacacuuugcuaaaaguacugcaucuguugccugcauucauaaucaaaggaacugucaaauuuccaucagagguuagugaaaauaaagauguaauuuuuugucccaucuacauugagaagcccccugaaauccgcccauggaccccacuguagucucacuuccacccuucucccacacuguuuucuccuuccgccauggguaaccaauuuuauuaguguucaguuuagccucccaauuuuucuucuugaaaagaaaaauguaucuacacuuacguguuaguauuuacucccaucacacacaaaaggugccuguuuucaguuaagugucugcuaagaauuuacuuucuuaucaguauguggagguccuuucuuuuuuucuuaacaguuuucaucauugcgcagugcucuauuguccuaacuuagucuuccuguccccuacugauagauuuggggcugauuucaagucuuuugcagugacaaaacuugaauuuaccacuucucguggcuuuggcugcacauuuugggaauagauuccuagaaguggauugcuaggucaaaggguaaaugcaucugucauguuauuagaucuggcaaauuccuguucuuaccauggaacauuucuucagcaauagcuauguuguuuugaauuuuguuuuucauuuuuguuuuguuuuguuuuguuuuguuuuguuuugagauggaaucucgcucugucacccaggcuggagugcaguggggugaucucugcucacugcagccuccaccuccaggguuccagcaauucugccucagccuccuggguagcugggauuacagccaccugccaccacgcccggcuaauuuuuauauuuuuaguagagaugggguuucaccauguuggccaggcuggucgcgaacuccugaccucaggugaucugccugccugagccuuccaaagugcuaggauuacaggcuaccaugcccggccuuguuuugaauuuugaaaguagugucugacaauucuggaauccagaaauaaauuguuggaaguucaaaaguauaaauuugagccuuugucauccugaauucuuucuuaccugugucaccccauccggucugaccaguuaccacgauaacugcuuugugucgccugugucuugggccucucucuuuccauugcuguuggucuaaguugagccguuaucucggugucacuugucuucuccgaaaccuuccauaacucugucacccucacagaauaaagaccuugcauccucuucccacugacccagccgccaccucucaugacuugcccaaauccuucaccgggcuccugugaucaguuuucugccucaugcuugucuucccuuggacaucagccucccuguaccucuacugcuguucaaauccugcucauccucugagaaacgcucaaagcacacauucuguaaaggcuuccugaucuuguagccugaaacgacuucuuuccccuauuaacuuguauugccauuuuugucuguauguuuaauauggcagcaaaucauccaugccauaugacaucucuuccaauaccugcaggcaaaacuuugacauucguguuuucaccuguuuauauauuguugcaggggaguauaaaccccucucuauugguaaugucuuacauagcauuucuuaaagcuaacuuucugguagaauacucaguaauacugcuuuuagcgcugauaccaagacccauauguacacagaaccugguugucuuggagagaugcauuccuuucugugaaugaacugaauuugaaccauaagauuuacagcuagcaugcuuuaagucuguucuuuguuuuuucuuaacaacuuuauugagauuuaaugcacaugcuauaaaagucacucauuuaaaauguauaauucagugauguuuaguaaaguuagaguuguguggccaucacuacaaugcaauuuuagaacauuuccaucacccuguaaagauccuuugugucucuuugccgucacuccccauucccaccauccccacaaccccaggcagcuacuaaccugcuuugucucuauagauuugccuauucuggacauuucauguaauaaauggagucauaugauacgugguguuuugcaucuggcauucauuuaguguuaauauuuuugagguucauccacgcugcaucaguacuugauuuuuuuuuuauugccaaauagucugacuacuuggcauuauugugugagugccucacauuuugcuuauccauucaccuguugguggacauuuguguuauuccacuuuggggcuauuauaaagugcugugaacauucauguacaagucuuuggguggauguaugauuuuuuuuguuuuugggggguagauaucugguagaauaauggggcaugugacagauuuauguugagugaacaugguuuuuaaugccgcagauguuuaauuauuagcuuuggguaacaacaggaaccaggcaaugcaagcauaugugauaaauucaagucuugagaauuugacuuggaauucguuauuugagaagcagaaaccauuucuuaauuugaguauguguuuauuuuuauuucucugacuuuagagccaguggacuuaaagguuuagaauggcuuuaaguaaguagagagaaaacuuagcuacuguuggccgggcgcaguggcucacaccuguaaucccagcacuuugggaggccgaggcgggcggaucacgaguucaggagaucgagaccauccuggcuaacauggugaaaccccgucucuacuaaaaauacaaaaaauuagccaggcgcgguggcgggcaccuauagucccagcuacucgggaggcugaggcaggagaauggcgugaacccgggaggcggagcuugcagugagccaagauugcgccacugcacuccagccuuggugacagagcgagacuucgucaaaaaaaaaaaauaaaauaacuuagcuacugucucuaggaagccaucuauuaggguguuaguugaaauuuuuuuaugcugcuugucaauuuuaauuguuugaaugagaguuuccauaguuuuauauagaaagggauagcauaaaucuuauaaauaagugcaaauuuuucaagccuugaauuucaguaacgaacuuaugaagucuuaucuaauuagauaauccuucuugguagauguccaaauacugaaugcacagguucuuggucuauauuuacaagaugcuggucccuguccuggcaucuuuaguuaaagaauuuucuugauuaaaaacuguagaauaauacaacauucaaauaguaaccagcgaagauccaacaaaguagagcuuuaacuagcuuuggacauguaaauauaaauaaaaggcaagcucaugaauucgcuaguucuucccugaacuauucguuggcagcaguuuggacgugucauuacguauucauaucaugaagcuuucaccugucuuuuugcaugcuuccuuuugaagccagguuguaaugucaaaugcaggaguaacucuugguagcacacuucuuaaggagguggaaugagaaacuccuaccuucuaaggaagcagcauggguaacaccucugagccugggcuuccucauuugugaaacguagcuuguacaugcagagaauauacuuacugugaggaguaaaucagugaaagcauuaaagcuguuguacagagucuagcguagcagcuacaguaaauauuaacuccuuucuuuauauaguuaauaagcugacauggaacaguuguacucaguggacauucuggaggugccauggguguggguaaauaaaacgcagcguauagaagaaggucccugcaguucauucaguuaacagagugagugccuguuuguguuuuagaaauuguggggcaacaauauggaggauggauuggaggggacgaggccagugaagacccuuuaguuagugagccagaugggaguuaauaaugccuagacuccggcaguugggaguguaaagagaaguaggauaagaaggagauagaauucauagaacugauuuuucaucagggguaagaauagagaggaaucaaagcugaugggaaaugcagaagggggagugaguuugaagggagagagaccaguccagaggcuaagcaugacccucaguugaaagucuugguagagggaauggggaggaaaagugagauugcacgcaacaugaggaaaauagauaggauuagauauuugggcaguuaguagagaggguggugcuuucguaacuccuaggauuccaagcugggcagcugaggcuucugacaacuaagucaggaagaaaggcagggagagaggaguucuguguugaacuugugagucuguggcuuuuggaagauccagcggaaggaggaggaagagcuagagugaggagcagcuuggaguugucgucgaggguugagcaaaguagaaggugccacaacagaucugguggcuuguugcugguuucuuacuccugaaauuauuaacuugaaacuguagaaauguauuauuaaaauccucaacagagguuuuuguuacaugaauauauagccuaaagcuucaguuuucuugccuaggcaguuuuaccuaauauuggcuguacacuuaaaacucagguuggcuguauuagccucuuuucuuuucaggcauuccauucauuuaaaacuuaaagggaauuuaauaauuucuuguggaauucaagaauuucugagcuugaacuuuccagucucaguucugaguggcuuagaguauccuuuaacgugcuaaauuguuuucuuauguauguagcaaauagaucacaagagaacauagcauguuccauguuaagaagcaagcuuacuacugcagugaacacccgccaacccauuccccacuaagaaauagaguauuuccaguacuguggaagcucccugagcacuucuucccaaacccaucguuaccccacaauauuuuaauugccugccccucacccuaaaugcuuuugcuuuucuauuuuuacuuaugcuauauagguuugcugagguuuuuguuagcuuuuuauuauggaaaguagaaacugcaguguaccugucucucagcuuuuuuuuuucucugcaaaauuuuaaaguaaaucccaggcaucauaucauuucaaucacaaaaauauguaucccuagcuaguauauauauuuuucaacauauguacaaugaaaccacaguagccaguguuuuaagcagauaagugugugugguucacuguggugccuuccauucaugucggggagagcuaaccucucccuucguagaaguacucuuuuaaaauuaaucuuagauauaaaaaugauauacuguauauauuccuuugucaccuuuuuuuuucacucaagacuccaggaauucacuuguguugaagcguguagcugaaguuggcucauuuuguguggucuguugugugacuguccuacugcuuaguugugaauucuccuguugguggacauguggguuguuuccagguuuguuuguguuuugcuauuauaaacagugcagcaaaugcauguguuugcauauuuucuggcguucauauacaagaguuucuguaagucuaaauuguuuuacugucgguuucauaucuuaugugccacacugcaaguaaaagcuuaaaauucuuaaaguuuuaauaaguuauauucugcucuacuguauauuuaggaauuaucaaaggagugagauuaggaaaauacauaagguguaauugguuagauaggugaugaagaaaugcuuggcccuguccagucuugggaccauggcugaaccuugcaaagcagaagcucuuccuuccugaagcuggagguuugaauccucaguggcucucccuguggucaccgacuaacacaggccaucaggucaucuuucugucaucugcacuaacgaaugcccucagcugccugcuacauccucggauugggacuccccacuccacuccccucacuucuuuacccaccucaguucuuggaccucucuagaguccucauccaugaaugcgaaacuccuccauagccgcuucucacacugcuucaaccccauugcucuuccauaaagaccaagaccccuuaaagcccucuccagauguggcuguuccugucccccgccauccugcaggccuccaggcugcaggcagggguccaccuccuccucaugcggguugacagccguagacccagagaaagacucuggaguuccucucugcacuagccauuucuaucccuacaguggucaucugcuaaccaccagaguucagaaauuaauuggacacuuuggcacagcccagaaccuuccucuccacuccugaaaccuauuauuggagaugguugcaggccaccccaggcuucagccuuguuuccuugagcuguguuuuguucuagucauuugcagguggggcccugcugagccuucccagcuggacuguggcacucccacagugccccuugauugagaacccucuucccagccagaggcaggaagaggacgaggcacaugagccugguuggcaucaugcccuaaucaugcccuuugcagccuucuuacuccuucacagcccacaugcucaaggucgucugucuuuucugucccuccccaccuguuccaguuagauuucuacuaaaguaauaguuagcauuuuugaaacaguguuggcuuguuuaauccucaccacaaacccaugagguggguuaagagagaugaaagaacuuacaaggucacacaguuuuacgcaacugcugccuuuucuucucuuggcuuccaggcuuggguuccuucucuuugugucuggcuguaccuuugcaguuacaaacucuauggguucuccaucaucuugucaguuuuuaaauguuacucaggacucaguuugggccgucugucugccguauuccccugaggaacugugguucccaggaucaggugguaaaccccagagaucagcuguguagggccaccuucucuucugugcugaggcccuguguguccagcugcuugggaugauucacaaggaccucagguucacacauccaaggacaacugcccuccuguagagcuguuccucucugauguuugcugucuugguagauggcaucauagucaauaucauauuuaucagauagguacauacagguguuuaucaaucacucaaguaagcaaaaaguaaauacuuauaaggcugcuuguugcaguauuauaauuguuaaaaaguaaauacuugaaagcuuuuuguuagguacuguuauugauaaauaauagaauauaugacucaccaaaaaaaaaaaagagguauauuucauuaagugaagugagguauaucauuuuuaaaugaaaaaaguugccgaaccagugugcgauugauccccaaagagcuagaagucaguaggggucagcacagaucuuuuuuuuuuuuucuuuuuaaagccauguuccuugaaauacuggaguuuucuugaauuacuacuggucucaagauacguucaggaaaaaauauuucauggcuaaguaaguuugagggaagauguuuuauacuguguuuuucugauggaaauucauaagacacguucacuuaucaagaccucugaagucuucuagcaaacaaaguauuuaacuucacuaaagcuagucaucccuugauguucaguucaguugauguugcaauuaguguuuaguggaagacuguuguaagugcucuuuuucaaaagcccuuccaguauguauggaugaaacugaauuacuaauaucaaagaagauauauuuuucaggaguuuugcaggucauuuaguucacacuucuacucagugaaggaaucuuaugcaccguuaaucuugagaaacagccuguuugauuaguucacaguuggaauuguuagggagcuuguuucauauugauucuguuggcuuucaucuucuuuuggaauaacagucuuuucugugagacaaguucuuaaauauaugacugcuuuucuucuguuagaccuguuuauuuugacuguuguguuccauuauuuuccaaggguuagaugaaagugaaguauaacuguggcgcgugugugugucugcacgcgugugugucugugguaaaaacucaugcgggcuccgggagccagcagcuaguguguguguggaagcacagcuggcucugccauugcuucuuguccuugacuaauugcaucuucugccuugguuuccugucaagaaaaugauaaucccucuccggggauuggccgucuagagaacacugaaguugugaggggcccuguggcugccccugcugucguccugcuucacucaccagccaccuguguguccaagucaggagguggcacaucugcaggguacacgcccgaaacgcguggacauucauaaccacacuuggcaacuccugcgaugccaaggaucuccuauaccugaguacuuuugaaaacuaccugauuuccuaaguauauuuuguuuuuuuguuuguuuuuuguuuguuuuuaauaucuuuagguuuggggaccuccuagguuuucuagcuaugagacaugauuuaugaggaaaauauuuuuaccccuuaccuaaaaaccauuugaaccucucugacuuaugaaaucugcuuaagagugacauuuuuugauggcuugauuauaagauauggauauauaguuuguaaaguaaaauucaacauuaacagagaagcaaguguuuugugggcaccuguauucuauuuuauugucccaggcaguuuuacaaucaguucaguucaccagacacuugagugacgcaucaauagauuaagcaugggcaugcagcgcacaugcgcgcguguacacacacacacacgcgcgcgcucacacacacacacacacacacacacacccguaccccucuaaacuggaaaacuucauugccugagccucuuguauccauuggagcaggcugguagauacacaggugacacacccagaugccccuucaaggaaggacuugacucccaguguuagcgccaucgggccucagcugcagagcugccuggaccgggcugcacccuucucagcccagcgggaguuaaaggccuggccugcagcccaugugagacccucuggcaacgcuuguuacagaguucccugccagggugaugcuggcucuauagggccuacaucacaguucaucuuuucucugccccgucugcuuccuccuugucaucucgugggugcccaucucuaagaagcaucuuccacccaagccaggucucagcaucugcuccgagagcccugccugggaccuccucacaggucucuguugcugcccagcaugugugugaccuaucuguccuuuuagacauuuucaugaugugccuacuucuaacauuuccuuguagacguuguuugagguuucuuugcuguauuaguuauuaauguuuuaaguacauaggugaggcucuuuaggggauaucaaaaauguaagauuaggucauccucuuuaaacccgcccacuuaaguaugaauuuuugaaaaccucagaucaucugugcaugaauuuuagauacucagugggaacaacuagaaaaagggaauggauagagaagaauaaaucacauagcagcaggaauagaagauuuugcuaauuuuucagcauauuuggaauauaaacugaggugugauguggcauaaaguuaccaugcauagaucuggacacaaaaaguguacagcaaguaaacuugacgagugugacaugaaaaguuguauuugaucucauagauuaacaguacguuuuaauagaguaagauucauaauuggaaucagaaauguaauaaaaagaauagagaauauguaaagaacauauuugaugugcuuaugcugagacaggagaauggagguguuauggagaaaaauccacauugaccauuuuauuugguauauuuuaacuuugcuagaggauaacugguaucuugacuuuaucuuuuaaauuguccugauuguugcacaguuuaucuugguuuuucaaaagucaagcuuuaaaaaaaaaaaagggcuuucuuaaauuucaaaauaucugaguagauuuaauacugauacaauuaggacugacuuauuaacucuuuaaagcuaucggcucuuuuaauuggagauguugagguuuccucauuuaacaaauaggcaguuguuggugguuuuuuccuaugacuuacagugguuucacuguuuugacacuuuaaaaacggaagaaccuaaaauucagacuagaguguacuaguuugugguccugcuacuuuguagcauuagaagcuugccaaguuugauugcuucuuugaauuaguuucuucaucugaagaggaagggucagaacuaucauuaagguuaaccucuaauugccagugauuguauuuggcucuuaagaacaaaugcuuuugguacacaaaugcauagcacauaaaguaacaugacgaaaccccaucucuaccaaaaaaaaaaaaaaaaauuuuuuuuuaaauuagccaggcaugguuguccuaaccuguagucccaguuacuugagaggcugagguggaaggaucaccugagcccaggggguugaggcugcagugagccgugaucacgccacugcacuccagccugggcaacagagugauacccuauuuaaaaauaaauaaauaaauaagcaugcuuuauuccgucacuguagcauuaugagcguagacgaugucuguuuaccauuaagaguaaauaaugccuaggacagugccuggcauaugguagcauccuacuaaauauucguuaaaacuaaguagucacuaaaauccuguaauuuucguaagccuguuuaaacacuguguugggguauguauacauuugcagugaccaaaauaauacaaaacaugacuaaaugaaacagcaagacauaaauuuuagcccagaauccaauauuuuaaggaaaaaguuuagaagaaacgagauagaauuuuguagagauucuaaagagggauuuugagcaaguucagaugcuugaugauacugguauuuuauuccuaaaucuuuuuaagacauaaagcuuuucaauuccuugauuuauuccuucauuuauuuauguaaaauauguauugagcggcaugccaggcucuguaugagguucucaugagccuguggggcuugcaccccggugaagucagggaguuacaguaaagaaacaagugcagguuuauggccuggaguaaguguuaagaagggaaaaucccauuuaaagcaaaccuguacgucuucugggacuuccuaguaagccuccuuugaaaguaugacuggaaggcaacuugaagaaggggaggaacucucuagaacucucuaggcagaagcaguagcagaugcagagauccuguggcggggaaaggagacugagguggcaaggggggacaucuguguggcugaaccugaggggagggagggggagaguugagguuuugugagaggcaaaugaagagagaaaaggaucugauagugccauauuaaggauuucccuucuucagacucugccuuggcucccuguugcucuuagggugacagccuauucagaauuaggaugacaccgucuuaggaugacagcgauuuuagacagcugacggccaugucaagaaugauacaagcagacacaagguauuggaaucuaguuuagacaacuaaaauagucgcccagguaagagauggcgaggaugauuacuagaggaggaaguggagaugagcuaaugcauuugaaaugaaguccguagcaguugaaugugaaagaugagggcuguggcaucagacucauucccagguuucugacuuguggauacauguggcauugccacucgcugacacggacaacacugauggagaaaggcauuugggggccagaguagaacuuuuuuuuuuuucaguugcugauagaaauuauaagagaaggaaaaggaguaaaagagcaucuagagagguaugagaaagcucauccaagacagaauuaacuggacuaugaguuugggaaauuuaagugauuauuuccccuuagggaaaaauuaagugauggggaaaguaggguagguccaaacaguugaugcuaucagaugcaccaccaguccaaaacaugguuauuauuauaggugugcuguuaacccuccccaaguagaugaugaaaggaaagcacauggaaacuacacauaggaaacauuuccagagugguugcugaguuguuaguuucuuaaaacuugagggaguccuuguguuaaauauuuuuauauuccacauuugaacauaccaauucgaauguaagacauaaaauacuuucaggaucaggaaugauguuguagauucauaaaauauuaagacccauagcccagaauauaaauaaauauuagagaauagguuucagugguucagacuuacuccuuaagcaugaccucacagggucccuaaaugugccuuaguuuacacagagcucuguaaugccauugaggauauaggaugagcugaauuacuugacaagguaacugggacauagguuugcaggcuuugauaaccuagccucauuguuccagaucucguuuacuucccaauaacauuugcuuuaugaaaccauucaaauaauucaguguuucuugauuuacacuagaaauaacuauuuaaaaccuuuacguuuugaugugacguacauagguaguccuuaaauuaugucugugauacugugcauugagaaguauugguuugauacaauauugaauaccuaaguuacuuuauuuauguguccaagaugcugaagcauuauauauuguauuugucauuaucuucauauacuuggaaauaauagccacuaccauuguuaagcauuuacucuguguuaaguauuuucuaauacauuaucuuauuuaaacucugcauauccauuugaggaaaguaauuggccuccauuuugcagacuaggaaauuagagcuuagagagguuaagaaacucacccaguagcacauguaccuaucuaguagauguggcacugagcuucaaacucaggucucucugaauucagaguacauuuugaaucuugauaauucuugccagauucccuccuuaaaaagggagugccuauuuccuuuuauuuucagccucaccaacauuugcauucuugcugaguucuaagugaagagcuacuaaaagucauagguaacccgugagauuguaugauuuuuccuauuuauuagcuguuuguguuccugggaauuuccugagcauauccuuugcccuuuuuucuuugaguuugucuuucuaauugucaucuaggucaagugauauauauuuuugauaacuuccgaaggcaaaggaaggcaacauaguugugcuugugcaaacuuuuacccagguuuucucuugagugcugauaucauaaugauuuugaacuaaaauucuaagcguauuuuuguacacagaccauaugguuaacaugaauguguuugcacauagaaagagaaauggucucuagagugggcccugcagacugaguuuuucugucagugugucucaccuuauuacaguaccccagagacaauccacugauucucuuuauuucuuccucagguuugccugcaaugagauuucauucucuacauuuaaaggacauccuuucugagcugcugugaauaaauuuggaaugguacuguauauuuucaucuaauggagaacuagcuguacuuugaauaaggauugcugcacuggacgacuuuagaacaucccucacaaugucgucaacccggagccagaacccccacggccugaagcagauuggccuggaccagaucugggacgaccucagagccggcauccagcagguguacacacggcagagcauggccaaguccagauauauggagcucuacacguauccuccugccuagcgcagguugauugcuuagaguuuugauuauuuacuaguaugacuuaugaauuauuagaauuuuauauuguuuucuccucccaguucaucauguaaaauaaucgcaggguucauuuuuagccuuaaguuuuugaacagaguagaacugguucauuuuuagucaaaugcagcacugggcaguacagucaccacugggcacauguggcuguuuacauuugaaauauuuuaaaguuccuuaggcacacuagcugugugauuaauaaauaaaacauuucugucauguagaagguuccguugggcaaagcuggucuaaagcaagguccugagguucucagcagaucauuuguuuuacguccauuuguuuauauauugucuaugacugccuuguguuaugggaacagaguuaaguaguugugucagaaacaguuuuguccaugaagccuaaaauauuuacuaccugcccuuuuacaggaaaaguuuguuuaccugaucaaaagggauaggacaucgagcaaaaguuuuccuguuauggcccuauuuuuuuguguuuuugagacaaggucucgcucugucacccaggcuggagugcagugguaugaucacagcucaccgcagccucaacuaccugcacucaagcaauccucccaucucagccucccaaguagcugggaccacagacacgugccaccacaccuggccaauuuuuuuuuuauuguuuauagagacagagucuugcuauguugcccgggcuguggcccuauuuuuuaaaguacaguauuuaaaaagaauuuuauuccuuuaguuuuugguccacgaugugcaugggggacugugcugugugccacaaaggugaugaggguggaaaagaugcggcucccacuauucgugugguuggagaugcaccagcuaauuuggaggcuuucuugauuccauacaaauaugacauugaaauuagaguuaagcucacucaggagagaggagauugccacuguuucuaggacuuuaaaguugcugauucaacggagcuucagguuuaaagucuucagguuugauagacuauaucaguucuaucaaacuaguuuuugugauauuccaguauguucuugcauguuaauauuuuagaauccuaaaaaaaauuuaaguagauauaaaacuaugucaaucucugaauuagcauaaaauguguguuugcauauuuauacauguauauacacuuacauauagaauacuuuuaaaauaauagcuuuauugagauguaauuauguaccauaaaauucaaccuuuuaaaaaguauacagugcagugguuuuuaguauauuuacagaguuuugcaccuaucaccaccaucuaauuuuagaacauuuuaaucaccccaaaacgacaccuuguacccauuagcagucacuccucaugcccucuucccccgaggcccuggcaacuacucauuuacuuugucucuaugaauuugcccauucuguacauuuugcauacauggagucauaugaucugugggcugccuauguggcuucuuugacugagcaugcuuggaggcuucauccuuguagcgcguaucacuguguacgucauuccuuucugugacucaguuguauagcuagucuacauuuuguuugcccauugaucaaugauggacauuuggguuauuuccaccuuuugacuguuacuaauaccacuguaaacauugugugcgaguuuuugaguggcucugugacuucuggucuccaggguguguauguaggagugggauugcagggugcuaugauggguagguugcuuuuaaagaagauagagucuuugccaagugagaagauauuaugcccccaacaggguucuggcuugcuagguauggcauuuucuuaauucuuguaggaaagcugaaggugguaguuccacuggugagggaagacacuggugggauuucugauguacaggaagcaggagagcacugcuccagagcucaaggaggugucauuguugaucugugucuggagaauuucuuuuuaaaauccaccuuauugagauguaauuaauaugccuuguaagucauccauuuuuuuuuuuuuuuuuugacagagucucgcucugccacccaggcuaagugcagugucaugaucucggcucacugcaaccucugucucccaggcuuaaacgauccucccaucucagccuucaaguggaugggaccacaggcacgcaccaucaugcccggcuaauuuuuuuuuuuuuuuccuagagacuuucaccaaguuacccaggcuggucucaaacuucugggcucaagcauuccgccuggcuuggccuuccaaaggcugggauuacaggugugagccaccacguccagccuugggaauuucuuaauguguucuuuuuuaaaucagguugguccuuuuucugauggguuauuuuugcucauaaggcggugagacuuuguaugcuagcagaaguuacugaauucuuguauucuacaaauaauuaaauucguauaauuuguaguuguuuugguaccugcaacuuuaauuuuuuuuaggacugccucucaaauuggguaguuuuuuuuccaguuuugucugagaaauaauagcuccauauauuuacaaaaaauuggagaaucuaaaccaagucuaaaauaucuuucuuuaauucuuuagacauuauaaugaaauaauggcuacagcugucaggcuuugugcuuggaaccauccacaccucauuaagccuuaucucaccgcgggcuggugguagucaccuuucucuguggauaagcuccaggaaccugguuguacagcagccaguggugguggugaggcgggucuuaagguucucagcagucugacucuagaauugccuuuagacacucuauguagucuucagcuacuguauuugaauggaucacauuucucagaguauuacauuucuauauuuucuuugagaaguugugaagaaguauuuugauuaacucuucaauguauuaggguagaagugaaacaguagaguguauacuuauguuuauuaauuguugaaaaucauaaaauauaauuuuacccccuaacucuucacauaucuuuucagcaucauugugagaacugaaagaauuuugagucaucugucauguuuuuguagagccaucuucacuuaaagccauuuacgcauaguacucuuuggaauugcguauauguugccauuauugcuguuuuauuccagcccagguugcauaacagagcaguuuuucagaaguuuucucuuacugguguauauuuggucauuuuaaaauaaucuccuaaaggcuugcucgcugugacaucuaauacuugcaguuguaagguuguguuucagggaaggaggugcuuuggaccggggaagaaggagcuggcagugccucucacuguucuaguaucacucugcaaaauuagacaugccucaucagcaguuggcaaaggaaguggguuagaaaggaaaacugguugagagaaaaaggagggauucuuuuccuucccauaacucuggcuaguaguuaacagcuagauuuuuacccauugucuauccuggaggagaaaauuguguguuuuuuuuagaaaaagcaacuacuucuugcuguaaaacaaauauucuuggaggcuuuaggaaccugugacauuugugguugcuguagcagagagguggguuauuauacagcauaaauauuuaucuugacuuuucaacucaaaauggugaaagaagggaauuuuggaaaagccaaaaaaaaaaagaaaagaaaagaaaaugaccagagcaucugcagacagaaagauccacuuuaguuaacuugguuuucagccauuucucagacuugguuuuucuccuaaaguuuuagccuuaagccaucacucuucacugugagucugucuguuaagcgcuuccaacuauucacuucuaguuuucuaugaugucuuacauguguauaguuaccaugcagcaacuguguguguguguaagacagagucucacucugucaacccaggcuggagugcaguuguggguucauggcucucuacagccuugagcuggggucaggugaucaccccgccucagccuccaaguagcugggaccacaggugcacaccacugcaucugucuaauuuuuguauuuuuuguagauacaggguuucaccauguugcccaggcuggucucaaacuccucgacucaaguuauccgcccaccugggccucccaaaaugcuggggugacagguaugaaccaccgcaccuggccuguuuuucuugugcaauaaaauacauagaguaaaauucuaugcagguggguaaauaauaccagguuucuuuccuuuugaauuugaaauagguauuggcauuucuuauucaauuuauugacaccgcuauauuucagguguugugcuuagguuggaacacaaacaugggugcuggcuagaggagagguauuuaaggggaugcagugaaguaugagaguccggccuagcucgugcaggugucaggucaccuguuggagguuucuguucauuguucugggcuccagaccuaccugugucuuguuuccaggucagguaccucagauucauaauuuuaccuucccuuggaaucaguuuaaacuuucauguugaugucuuuuuuuucucucuaccugaauaaauguucaugaacuuugacguuucuauuugucuuccuguacauugcuguggccugaaucaguuuguucuguuccuuagccuguuuuuuccagucuucuuuucccccacuagcaccguaagaaucucauucauauuugagaaugagauugguugauuugagaaucauucauucauauuugagaaugagaaugagauuggucuugguugcucucaguaagucauaacauaagcacauucagaauucacauuuaauugucuauuuugacguuuagugauaagguucgugauugcugggggucggggcacuuuuucacccgagucaaucugcugagcccuuggagccugcggcugugcuuugcagggacaccgugccaggacacgcuggucccugcugcagcucugcaccugccaguugagcagucccgucuuggcugccgccaccacucuuuucagguccacacucugaccaucgccuucccuuccauaggagcugcacugcaggggagugcucagguggcagccuuccugcuucgccugcucacugcaaaauucucuccuuuauagaaaaccaaaauuucaaagaacagcagaucacacagaaggaauaacaaauugucuucaaaguagauuaaugaugauccaugucuguuuuagaauaaccauccaucccaacagauguguuuggacacuuuucaucuugcacucuuaauuuaggagucuuacauuaaucugauucugcucaccuaaugagcauggcuuacaucaaaugaaccuaaacauagaaaguuuucauauuuuucagauguaaucuauccuucucguguguguguguguauauauauguuuauccauacuuuuagcauaagucuguaaaaggacauacugguucacagaagaaaugcaaauaguaagcauauggaaaaauguucaaccuuauaacuguuaaaugaagaauuaggccagccaugcucacgccuuuaauucccggaauuugggaggccagggcagguggaucacuugagcucaggaguuugagaccagucugggcaacauagcaaaaccuugucuuuaaaaaaaaaaaaaaaaaaaagccaggugugguagugcaugccuguagucccaacuacucaggaggcugaggcaggagaaacacuugcgccugggaggucgaggcugcagugagucaugaucgcaccacugcacuccagccugggcaacacagugagacccuguuuuuaccuaucagguugacaaacauuguuaagaaaugacuauuacagccaguguuggcaaggagaccaagcucuacagugcaggcagaaauguuaguuugcugugaucuuucuggagggaaauuuagagauauauuuuuuuguuuugagauagagucuugcccuuucaccuaggcuggagugcaauggcacuaucauagcucagugcagccuccaacuccuggacucaagugauuccaccccccaccccaccucaaccuccugaguagcugugacugcaggcgcacaccaccacaccuaauuuuuuauuuuuugcagacauggagucuugcuauguugcccaggcuggucuugaacuccuggcuucaagcaguccucccaccuuggccucccaaaguugugggguuauaggcaugaaccacacaagccuggccuuucuagagacauaaaaauguacuguggcccagcaauuuauuuuuuaaacuuuauccuaaggaaauaguuguauucaaaauugcaugugcaaggcucuucagcauauuuuaauaauaggaaacaauggaaaacaaccucaaucuucaauauuaaggauaacuauaaacugcuauuaaaaacacaaugaagacuguugacauggaauaauguucauaauauauugcugugggaaagcaggauaugaagugguaugugaauugugaaccaucagcacaugcuccugcuuuugaaaaaguuuguguacaccauauggaaaggaacugucccuuauaaggugguggacuucuauaugaguuuuuaaaaauugcucuucuuugccuucuagauuuucguauagagcaugcauuuaaaagugcaguuuauuaguuugccuuuugcaaauguuaagccuaguuugcaaaguucuugcuaucuuuuacuacugaccugguacuauuaaaaucauucuuaggauugagaaauuguauaucugucuuaaaguaagacccuguagaaauuaugagauuguguacuugucacaagugauuuuuuuuuuuuuuggugggguaggcgguuaguauaaauauggcauguucuucagcuauuuuucaaaguuugauucacgguaauuauacucagaguacuuugaacauuauguaacacauuuuuuaguucauuauaaucaauugcaauuaguuuuuacuuuugaaguaugcuauuagaugugaauuuauuugcuuuguaugggauauuucuuuucagaaaugcacguacccacagacuggacaggacuuuauucuuuuauaacuacagacggauuauacaggauaguaugugagccugcuguucugccauuugguacagguuaacuuguuaauguuugaagauaggaaguacgauauauguguguguguguauauauauauauuuuuauauuuauuuauuuauuuauuuauuuauuuauuuauuuauuuucagagggcgccucacucuguugcccaggcuggagugcaguggugcaaucuuggcucauugcaaccuccgccuccuggguucaagcaauucucauaccucagccucccgaguggcugggauuacaggugcgugccaccaugcccagcuaauuuuuguauuuuuaguagauacgggguuucauguuagccaggcuggucuugagcuccugaccucaagcaaucuguucaccucggccucccaaagugcugggauuacaggggugagccaccacacccagccuaggaaguacuguauuuuuaauaaaacuuuuagugcagagucuuuccaugugauuuuaauagaaguuacuuguuuaaauuuccacuucuuaagucgcauuugggaaacaagugguaguaggaagugauucuguucuguuuaguuuugcuucuuugauugaauuggcuuuucuuuuagcuaaugagaaugguuggaguuuggcaauaacuaaaagucaagaauugauuccccagguguguucacuucagaaauaaggcauggugcuguggguaacagagacauuugagaauacuggcuccgucauccugcugcucacuuuauauuacguuaguaguagaugcugaacuccaggaaggcagucuguuggugaggccuaagucacacacaugguaccuggcacuggacaggugcccagaaggugucugcuugcugaaaggugagaugugaagcuuugcaucugauaggacccuuucacagugacuugccccuccccaucaguacagaagcaugccuuggcagacaacguuucuaggaugacagaagaguuguaggaccuauuuuggaggcugaaccaggcuuggcucuuggacauaaaccccuguaccaccuuacaccauuuccccaccugccugcggaggaggccccagauaccugcuuacguucucaccugcuuucuggccaaagaagcuuucagaggaccuucagcaaagaaccucagaguuuuaaaagucaaauguauggguuuguuagagucuauggcugccuuaguauaaaauaccuaaucuauugucugcugaaugaaacuucuauuuuauugccuuguagacuuuuaauuuuuuaucucugauguuuuugcuuuuucuuauuucaucuuaauuccuauauuuaacuuguccucauacuguuuuaauuuuuuuucccuuuaagaauaacuuuagaugugaccauuuuucuccuaaagauuagucauaguucguuuuucuacucuucuaaaguaaaugauuuaugaacacuuaauuugugugcauguugaggcaacagguggugaguguggcauuguggggggcgguggguucagggagcagcaggagcccaggcauagagagcagcggggaggcuccggcccuguccuuucacacaggcgcccuucagggcucauucuucaggaaaauggcacaccucauaauucaggaauacauccguuucacaguccuuccuugaacauggggaauucuccccuuccagauaauacacuugaauuaucccaauagcgcuuuuuccucaggucucauaccagugaggugugaggaggggcugguggccuggacagaucucccucaggcagcuucugaucacaugaagagccugcucauuccauuucugauaacauuucuccauauaguucaguugauuuaaagcugagauaaaaauacugugaagcuaagacugugugucaucagagcuauauaagaucugcuuucacuccugccucugcugacucagccuggauucaaagcacaguugauccuguucuuuaggcgaaggugcccuaaaccgggggcaccucucgggcugccauguaaacuucguguccguugagcaccuuuuuauaugcucguugaccauucguaugucaucuuuuguaaaguguccaagucuuucgccuccuguuuuuuccauuuuggggauauuuugcuuuuuguuaguuuuaguucuuuauaugucaaggauaccaguguuuugucagauauauuuugcuaauauuuucuucaagucugaggcuugcuaaucauuuucuuaauggugucuuugggugagcaaauguuuacuuuggggaaaccuaauuuauugguuuuauuuuauuuuugcaguuauugccucugugacauaagaaaccuuugccuagaucucaaauauauuuuguguuuuccucauaagacuuuaugguuugggcauuuacuuuuagaccugugauccaccuggaguuaacuuuuguauaugguguacaguaaggcuuaagguuaaauuuccccuguguggauauccaauuauuccagugucauuuguugaaaaaaacuuuuccucaauggacugucaacuucuugucaaugucuaccccaaaaguugauugauuggaaugguauugaauuuuuuuaauggcuuuuuuuuuuuuugagacaguuuugcuguuuuugcccaggccggagugcaauggcgcaaccuuggcuuacugcaaucuccaccucgcagguucaagugauucuccugccucagccuccugaguagcugggauuacagacgcacgccaccacgccuagcuaauuuuuuuguauuuuuaacagagacaggauuucaccauguuggccaggcuggucuugaacuccugaccuccaguaauccaccuaccucggccucccauagagcugggauuacaggugugagccauugugcccagccuuaauggcucugagaucuaauucacauagcauacaaugcacucauuuaaaguguacguuucaauaguuucugguauauucacagauaauguucaacugucacauucaauuuuagaagauuuucaucaucucaaaaagaaacccugugcccuuuaguugucacuuccuucuuaccccuaccuucuacuaauguacuuugucucuauaaauucaccuauucugaacauuuuguauacauguaacuauaugauaugugguguuauggacuuaauugugccucuccuccauucauaucuugaagcccuaacccccaguauauuuggaugguauuuggagguaaggcuauuugggggaauaauuaagguuaaauaaaaucgugaggguggggccuuacccugauaggauugguguccuuauaagaagaggaagagacaccagagagcucucucuccacauacacagaggaaaggccaugugaggacacagugagaagguggccgucugcaacccuggaagagagcccucaccagaaaccaacccugacaguaccuugagcucggaccucuagucuccagaacugugagaaaauaaauuccuguuguuuaagccgucuugucugguauuuuguuauggcagccuaagccgacuaauacauguggucuuuugugacuggcuuucuuccauuuaguauaauguuuucuaacuucauccauguuguagcauaugucaguacuucauuuuuaugguaaaauaagauuccauucuguggauauaccacauuuuguuuauccauucaucaggugauggacaguuggguuauuuccaacuuuuuacuauuacgaauagugcugcuguaaauauuuguguacagguuucuauguagacauauguuuucauuuuucuuagaugccuacaaguguuauuucugggucagaugguaacuguguguuuaaccauuugcagaacugccaaauuauuuuccaaaguggcugcauuauauuacuuucccaccagcaguguaugaggguuccaguuucuccacauucuggccaacacuuguuguguuguguuguauuuauuuauuuaguuauuuacuuacuuauuuugagacagagucuugcuguaauucaggauggagugcguggcgagaucucagcucacugcaaccuccuccucuuagguucaagcgauucuccugccucagccucccgaguagcuggaaccgcaggugugcaucaccaugcccagcuaauuuugguguuuguaguagagacaggguuucaucacguuggccaggcuggucucgagcuccuggccucaagugauucuccugccucagccucccgaguagcuggaaccgcaggugcgcaucaccaugcccagcuaauuuugguguuuguaguagagacaggguuucaucacguuggccaggcuggucucgagcuccuggccucaagugauucuccugccucagccccccaaagugcugggauugcgggcaugagccaccacauccggcucaacacuuguuauuuucugacuuuuugauucuagccauccuagugggaaugaaguaguaucucauugugguuuugauguucacccuuauugaaaaucagguccacagauucaugaguuuauuacugucauuuuguaguaaguuuagaaauugugauguuugaguccuccaauguuguucuuuuuguagauuauuuuggcucuuuugagucucuugaaauucuauauguauuuuggaaucagcuuguuaacuuccuacaaugaagccaacugggauucugauagggauuacauugaaucuuuggaucaauuuggggaguauauuagucuguucucauacagcuaauaaagauauacccgagacuggguaauuuaugaaggaaagagguuuaacggacucagaguuccacguggcuggggaggccucacaaucaugguagaaggcaaaggagaagcaaagucaugucuuacauggcaguaggcaagagagcuuaugcagggaaacucccauuuauaaaaccaucagauucuaugagacuuauucacuaccacgagaacacuaucggggaaacugcuuucaugguuugguuaucuccaccugaccuugcccuugacagauggggauuauuacaguucaaggugcuauuuggguggggacacagccaaaccaugucagggaguauugccauuuuaauuaauaauucuuaaaucuuucuaccuuuucugguuuuuuuuuuuuuuuuuugaguuggagucucacucacucuguugcccaggcuggagugcagugcauguucuuggcucacugcagucucugccucccggguucaagcgauucuccugccucagccuccugaguagcuggaauuacagacaugcaccaccacgcccagcuaauuuuuguauuuuuaguagagacuggguguuugaccauguuggccaggcuagucucaaacuccugaccucaagugauccaccucccucagccucccaaagugcugggauuacaggcaucagccaucaugcccaacucuuucuaccuuuucugauauaaguauuugaaaguauaaauuuccuuuuaaggauuuuuagccuuauucugcaaauuuugauauguuguaucuucauuaccauuuaauucaaaacacuuuauuugaccuuugaauuauauaggaagauauuguuuagaaauauuggauuuucccggguagcuuauuguuacuaauuccuaauuauaauuccauuuugaucagagaacacacuguauaauuuccguccuuuuaaauguauugaaacguguucaguggcccagaaaauagccuaucuuggugaaugugccauguacucuugaaaagaauguggguucugcagcuguuggcuguagauggugaugugcuggagcuggaucagaucagcuugcgggagaugauugugcccaucucucucccaucucccugugugauauuguccuguugguagcuugcaucugccauggugggaaccuuauacaauagacaucuauggaggcuacaaaucagggcuuuucuuuuuuucuuuucucccugcucagagagccaauuuaccaguauaccacuggguguagaauguuacaacugcccauacagaucauccaaguugugauugauauuuuuccuauggucuaguugcugagaggaauguugaaucuuauccuaugauugugaaauugucuccuuuacccuuuaauucugucaaauuuucauauauuuuaagccaggugugguggcucacaucuguaaucccagcacauugggaggccaaggcgggcagaucgccggaggccaaggcgggcagaucgccugaugccaggaguucaagaccagccuggccaacgugaugaaacccugucucuacuaaaaauacaaaaauuagccggucaugguggugggcgccuguaguuacucuggaggcugaggcaggagaaucgcuugaaccugggagguggagguuucagugagccgagauggcaccacugcacuccagccuaggugacagagcaagacuccaucucaaaaaacaaauuuuuuuucauauauuuugaaacucuguuguuagacaaaaauacauuugcgaauaugucuuuuaaguacauuuauuaugaaaugugucccuuuuuaucccugguaguaauuuguugccugauaguuauuagcuucuuuaaccucuuucuaugcuuaauguuugcaugauaaucuuuuuccauccauuugcuuucaacuuauguguauuuuuauauuuaaauugugucccucaugucaacauauagagcggucuugcugcuuugccccuucugaccaucucugucuuuuaauuguaguuuuagcccauuaacauuuguuauaauuauuaauagauuaauuuuaggccuaccauuuuguuuuuuucuccccuuaaaaaguuucuuuguucuugcuuuccacccuucuuuaggauuauuugaaauuuuuuuauaguuccuuuuuaauauauuuguugguuguuucugcagugugugugugugugugugugugugugugugugugugugugaaagagaagaaggaauaaagagauugcucuaaggauauaauacacauuuuucuuaacauuccacuuagaguuaagauuguaugacaucauagaaaauguagaggaauugugguuguauaguuccauuuacuacucguaucgcucuccuuuauauuaccucuacauauguuuuuaaacccacaagacgauauuauaaauuuuuguuuuaaaccauccuuuguauuuuaaagaauuaagaaaaguauauuuacccagauacuuacuguuucuacugcucuucauuccuuccuaaagaugcaggauucuauuguagugucaguuugcuuccacccaaaaugcaggucucuacuaugaauucccuuaguuuuauuuuaccugaaaauagcauuauuuugccuucaucuuugaaggauauuuucacuggcuauagaacuacaauuacuuuuuuucuuucagcauuuuuuuuucuuucaccacuuaaacauguuauugcacugucuucuggccuuuguaguuuuugaugagaaguuacuggucaugugaacucuuuuucuguguuacguucuuuuucccuguccgcuuucaagauuguucccccuuugguuuucuagaaguuuuaaucuuuuuuuuccucucaagaguugaucguuucuguuggucucugugcaaacccaugacucgucuuuauuuugcugucaagaccauccaaugaguaauuuauucuagauuuccugguauuucaguucuagaauuuuuauuuuguucuuuuucaugguuucuguuuuugugcugcaauuuucauugauuaugaacauauuuuucuauaucuuuuauuauaacuauaauaguugcuuuagagucuuugucuccuaauuccaacauuugggucaacuacagcuggucucuguugauugucuuuugucuugagaguggaucucauuuuccuguuucuuuuacaucaaccauguugggcugugccauucccuucuuccaacacuaggccacuuuucaguauacaccuucuuuuggugguucucuggugccuucaagaucauuguuuuaauauuuuuucuagaguuuaucguuauuugccagaaaugugguuagguacuucgguacauuuaaaauuggaaucaugguuuaaguaacugaaaguuucagaggcuccauagugacuauuaggaugaagauggacuggagguaggggguagaaaggagauguguucucuauucgcaggaaaucaauaauuuacgcaaacguugauuggucaaagaacaaaacaagcauaugacuuaaagacauguacauauccagcuaaaaaugaagaacuaacucuagaaacaguuaaagauguuucccacuauggguggggagggugggaucauaacauucuggcuuguucuucaguuguuuugcuuguuucaucucuucaauuuagauauacguugaaccuaaauugucauaagcaggaagucuccuaaccacuaucaucuaaugcuuuccauuccugacuagauaauggugaggagugaugcugauuugggaaugaaugugauguuaaacugaguagaaacuucaaaacagcuuuuaagaagcauucguuuuguuucaauugugccuuucaaucuguuuugugaggccccuugccugugugugugugagguccucucugaggggugggcuugggggaggaaguaaugguggggaggggcaguguucugggcacugagcuuuccuccacaaagaacacuuggugagaaugaaaggauucuguggccaaaaguuuaaaaccccuagcccugcucucuggaagcaacugcuacauugauucauugauucgagugcauugcaaagucagugcacauaguacaguagcuggccagguaucagugaugaccuagucaucaucauugcaucagugcacacuugcgugcagccuuguucuuucugucagcaaacuauuuaaggaccauugcaagaaucugcccugaaagaacaaaccuuuggauaucaagaaagcucaggaucagacuuagaaaauggaugggcgcagauuaggagaaaauccuagaauuagccuuggacuacuacuaaggagugcuaacauacuuaguggcucggaggacaacguuauguggaaaaacacagacauccuuaguaagagucaaaaugauucagaauggacucuauguaaaaccauuuuggcaauauccuagccaaucuauuuagcuuuucuuuauccacuuacgagaauguuaggauaaaucuguuuaagucuaaaacaggugauucuuuaguaaguaaaaguaaaaauuccaucugaugaaaaugcauucuaguuggcagcauuuucuuuucuuaaauauacuuaaugauacauguuacgauugaugucuuagcugaaaugugauaaauauauugcagucuuuuuaaccaccaucuauuccaugacauuguuaaaagcugcguacucuaucuucagguggacccgagaguggguuuaacuaaguuugacaaauagcuuguuacgaguuuuuugccauuaggagcaaugcugugauaguuugcuagcuaaguauuuguacauuuccgugaugauuucccugugauaaaugcuuaugaauauaauugcuguaucaaaaggaaugcacuuguugaaggcuuuugaauauuccagauuuuacuucagaaacgguguaauuguguacacucuuaagcauauggaagcucccauuuugcugcacuuuagcuaucauuggguuuguuuuuuuaaaaaccuuuguuaauuuaguagcugggaagccauagauugccaaggaacagcagucaggcugaacuaaauaaccugaaacauccuggaaccaagcaccuaaaacugggugcugugugaaauacagcaaaguguaaugcucugcacaaaaguaagagggaauucccaggcaucugaagaagagaagagagcugaaaaugaaggugcuaaccauugugagccucuguguggcagcauaaggacuugagcaagguaggcuggccgguaggggucacacagaaaaggaaacaaagccuuacaccuggcugggaggggcugagagcugacguuuccauggaaaccuggaagacagaagccuaaauacccuuaaguguauaggugaacugaaaaaaauaauaaucaucgaccuacucucccaggaaggcaacugcuaaaggauuuaagcugagcucuggauauaaggagaguggggaaaguugucuuuagaaucaaggagcaaaaaccacuauggaaaacaagacagguuuuuaaaagagaaauucuauaaauguaaaaugaagucauuaaaauuaaacacuaaauuugacacaaccaaaagagaaucacuuaaccagauggcagaucaggaaaaauuagaaaguuugaacaaagauaaagugauagaagaucauugaagacuuucaaccaagguauagaagguaacaugaaaauaucucacauagacguaauagaagagcuaggagaaaauagaaaggggaccggaaauauuugaagagguaauagaaucuuccaaaauuguugcaagguaaagugggcaugucauauuuuaagguaauuaaccauuucaagaauguauaacuccaaaauaaaacaagagcuauaagggaacaaguaaacuaccauuccaguagaaggggaaagggaggaaaaccggaaacauagaaacagaguuaaaauagaaaauacaaaacaggaucguagaaauuaauccaaauaacaguaugaaacaguuuaccuaaaaccaaacucgucuaucagauaauacuagacucaguuuuuuuaaaaagucaauuaugcuguggugauuuacaguagacacaccaagacacagaaacaaagguugaaaauaaagggcuggaacaaagacauuuaaggaaaauuccaaccgaaagguauaauaaugucagauacaauaaguuucuaaggcaauguuguuaggaauaaacgugguuacuuccuaaucauaaaagguacagguuaccaggaauauaauuucaaauauguauauuaguuaacacugccucaaaauauggcagauauuuuagagaauuauaagauaaauugauaaaaccauuugggagauuucacuaaaaauuucuugguaauuaauaagcagacaaaucagaaacaauauagaagaucugaaaaauagaguugaccagcucuaaugggucccuguauccaauaguuagagaugggcauuguuuuuaggcacaugugaaauaauggcccccccguucuggcccagcagaaauuauauacuuggcaacaagucucaucacauuuuaaauaaacugucaaaaagauaacauucucauguuuccgcaauuuaauuuuaaaaugaaauuaaauuuuuuugaagguaaaauacauuuuggaaaucuaaacuguuuaacucuuagaacgaacaguggaaaagagaaaauauaacugaaugauaaggaaaauauauacacaucagauugaugugaugcagccaaguggcauguagaagaaacucuaguauuaguauagguuuuuccuauacuuuccauguaguaugaacauuuuauauaaguauuuuaaaugcuuauuuaaaaaaggaaauuacagaguuaaccaaaacaaggauuuguagagaaaaggcauauguaaggaaagaaguagucugggcgugguggcucacgccuguaaucccagcaccuugggaggcagaggugggcagaucaccugaggucaggaguucgagaccagccugaccaacauggagaaaccccgucucuacuaaaaauacgaaaauuagcugggcguggugaugcacgccuguaaucucaguuauucaggaggcugaggcaggagaaucacuugaacccgggaggcggagguucagugagccaagauugugccacagcucuccagccugggcaacagagugagacuccaucucaaaaaaaaaaaaaaaaaaaaguaaaaagguacagaaaugaaauaaagauacaguaaugaaaauuauuaaaacccaaaauaguucuuuaaaaaaccgacaagccucuggcaaaaucaaugauaaaaagaauggcuuugaggcgccacacacugcacccaucuaaaacagcaaacuuaauccauaaaugcaugugucugcuccaccgacuggccauucccccaucucucuuuggccuuccuacucccugagacacaacaaucuugaguugaggccaguugauaacccccacaauggcuucagaguguucaaguaaaaugaagaguugcauuucucucacuuuagaucaaaaacuagcaaugauuaagccaaaugaggaaggcauguugaaagcugagauaggccaaaagcuaggccucuugugcuaaacaguuagccaaguugugaaugcuaaggaaaaguucuuggaggaaauuaaaagcgcugcuccagugaaugcacaaaugauaagaaagcgaaacagccauauugcugguaaggagaaaguuggaguggucuggauagaagaucaaaccagucacagcauucccuuaagccagugccuaauccagagcaaggcccuaacucucugcaauucuguaaaggcugggagaagugaggaagcuacagaagaaaagcuagaagcuagcagagguugguucaugcgauuaaagaaaagaagccaucuuuuauaacaguagugcaaggugaagcagcaagugcugauggagaauagcaaguuagccagaaaaucuaggaucauugaugaagguggcugcguaagcaacagauacucaauuuagucaaaacauccuucuacuggaaggagaugccaccuaggacuuuuuuuuuuuuuuuuaaauuauacuuuaaguucuaggguacauaugcacaaugugcagguuuguuacauagguauacaugugucauguugguuugcugcacccauuaacucgucauuuacauuagguauuucuccugaugcugucccuucccuagccccccgccccacgacaggcccuggugugugauguuccccuuccuguguccaagugucuucauuguucaauucccaccuaugagugagaacaugcaguguuugguuuucuguccuugugauaguuugcucagaaugaugguuuccagcuucauccauguccgugguaaagaacaugaacucauccuuuuuuauggcugcauaguauuccaugccaccuaggauuuucauagcuagagagaaguuaaugcuugugucaaagcuucaaaggacaggcugacucucuuggaggugaauguagcuggugacuuuguugaaacgagugaucacuuaccauucugaaaauccuaaggcccuuaagaauuaugcuaagucaagccaauguggugacccgugccuguauuuucagcuucacaggaggcuaaggugggaggaucacuucagaccaagaguuugaggcaguagccugcuaugaucaugucugugaauagccacugcucuccagccugggcaacauagugagauccugucucuuuaaaaaaaaaaaaaaacaaaacaaaacugucuaugcccuagaaauggauauuaaaaccauaauaaaccacaguaugaaugcaaggccaagguuguggucgaugaaaacucaugcacuacagggugcuggauagccgcuuuguagcacuaaguuggcaacucuuaauaaaguuaaacccaccacuuugggaggccaaacaggaggauugcuugagcccaagaauuuuggaccagccagggcaacauagcaagaccccaucucuacaaaaaauuguuuaaaagggccuggcaagguggcucacaucuguaauccuagcaacuuugggaggucgaggcagguggauugccugaggucaggaguucaagaccaaccugaccaauauggugaaacccugucucuacuaaaaauacaaaaauuagccaggaaugguggcaggcgcccguaaucacaucuacucaggagaaucgcuugaucccgggaggcagagguugcagugagccgagauuacaucacugcacuacagccugggagacagagugagacucugucucaaaaaaaaaaaaaaaaaaaaccucucuugucacuuugucacuuaguauuucugugcuccaagaaacuuguacucaaggagaccugcuaguuuuauucuuugcagcuuuguaaauacacaaaaaauagguaucugccaaaaggacuauuagcaagguccaccaccaagagaguugaugaaguauuguaaaugugcguuacacaguauauuacagcugcggcuaugucagauaccaucaaaaacaaauggcagagcaaauguacauauuacaguuuguauaauuuaaaaauguagaacauggccagacgcgguggcucacgccuguaaucccagcaguuugggaggccgaggaggcuggauagccugaaguugggaguuugagaccagccugaccuacauggagaaaccucaugucuacuaaacauacaaaauuagccaggcgugguggcgccugccuguaaccacagcuacucgggaggcugaggcaggagaaucgcuugaacccaggagguagagguugugagcugagaucacgccauugcacuccagucugggcaacaagagugaaacuccaucucaaaaaaaacaaaacaaaauguagaacaugugaaauauauuugauacacauuuauccagcaaaauauaaaaacauaggaaugauauauaccaaaucauggugcuauuugcuaggguaagaggaaggagugggaugaaagagggagaauauagugcuucacuuauaaccuguaauauuuuauuuucucaaaaguugagggaggcuguagguggaauaugagacaagugugggaaugcaguaagaucuaucaaaacugggucaugaguauacaguaguuguuuauuguaaucugugauucucuauacaauugaaauaguuaauaauuuuucauuguuuuaaaguauaguucuuugauuauuaccuagauugguuauuuuauuagguuugggggcauuaguauauauuuauuuuaccuuuuagauuuucugugguauauuuuguucauguuuccauagagauucauuuuuuuaauugcuuuaaauuaccuuaauuuauuaaagauaguuuaagguauuucaucuuaaucuacaauuuugaauuuauuuauuuauuuuuugagacagagucuugcucugucgcccaggcuggagugcaguggcaugaucucagcucgcugcaagcuccgccucccggguucaugccauucuccugccucagccucccgaguagcugggacuacaggcgccugccaccacgcccggcuaauuuuuuguguguguuuuuaguagagaugggguuucaccguguuagccaggauggucucaaucuccugaccuugugauccaccugucucggccucccagagugcugggauuacaggcgcgagccaccgcgcccagccugaauucauuuuuuugugugaucuuacuuagaaagggccgcuccagccugagaacagauaagcguucacauauauauucuugguuuuacuguuuuagcuuguauauuuuaaaucuuaauccauuuguaauauauuuuggaauauaacauggaauauuuagaaauaucuugcccucaugccauuuauuagauaaucuaucuuuuacccguugucuugaaguaucuuuauauaguaaauucuuaauuauaccagaauauuguuuuguucuguuuuguugaucuuucugaguauaaguaucuuuccguucauuuuauucaauuaauaauacaugcagauaagcucaucauauuuaaaggauacaacagaacacggugguuuucugcccugccuggccccaucuucucauucucugcgcucccccugcagaugcagcuguuuugcaaucagcugucugugcugugguuuauacaucucucucuuucucaggaguguguggacacugcugccguucacugauaaguuuuagauggcuaugacuauuguaauauaaggacuuggcucucugagucauuuuaaaauaaaguuuguguuauuucaauauuuagaaucugugccucugaaaaaguuacagcugagcaucauaauagacagugcuuauuguuagcuuuuuguuuuuccuggagucaguaauugcauuuuucuuuugggacaguuuuccacaaggucagucacaucagauaaucuaaaagguccagauuuuuuuauaggcaaccucccuccuggaauguucccuucuccaccuuggcgguguugcucucaaggccuaccaacaaccuugugaauggggcuuguugacuuuuagcuuuauggauagugugaaugggaucuuuguuccauucuaguuuuuaacagguuuugguugauauauugggaaugcauugguaaugaaauauaagaaaauauguuuauguuaaugaccguuaacgucugugauauauguugguuuccuuaacuuuucuccaagucauguuuauaacuacuguacuaguguucaccagucaaaccaagcacgaggagcuggaguuccuccuucuaagucgaaaaaggggcagacaccuggaggagcucaguuuguuggccuggaauuauauaaacgacuuaaggaauuuuugaagaauuacuugacaaaucuucuuaagguaagauguuuuauauauauacugaguauucauaacaggauauaaaaaaagugaaauaaugguucuaacuuguuaaaucuuucacugucaucuguuacuguuuuagacacuaacguaggugacaguguuuugcuauugcauagucuuuuaccuacugugaauaugaaaucaccauaaacuauauucuaggguuuuguuuuuucgagauggagaucucacuauguugcccaggcuggauuuuugaucuccugggcucaagugauccuuccacuucggccuccugaguagcugagacucugcaaaugcucaccaccgugcccagcucuuucuguuuuuuaaaauuagaaagcuuugauaaccuuuuagcauaauagugcuuucguuaaauuaccaaccauuuuggauuugguuguuagaaaugaugaacuuuuucauuuaaagcaaauauguauucaaauuaucugcauuuuacugugaacccaaugugguguucccuaucaagguguagaaauaauuguaagguuauucagucuuggaaaccauguuuuucaaaugugaucuugcucuuuacacaugguuaugaaguacuuuuuuucuuuuccuuuuuuuuuuuuaagacagggucuuguucugucacccaggcuggagugcaguagugcaaucauaggucauugcagccuccaacuccugggaucaaacaauccucccgccuuagccuucugaguagcuaggacuacuggcauguaccaccauacccagcucccagcuaauuuuuaaaucuuuuguagaaucagggucucuuuauguugcccaggcuggucuccaacuccugggcucaagcaguccuccaccuccaccucccgaaguguugggauuacaggugugagccacagugccuggccaugacguguauuucaaaacugcugugaaauugugcucgugacuacgaugaguuucacugugaauauccauuuccuucuagcguaggucccucccacuccaagccuuugguugggcagugugguggagucuuuuccccuucaucucccgccuuuucuuccuuggucuucauccuuuguagcaaaggcagugugacuccuuguaucuagccacaagaugagcaaguggguccuucaucugguucuacacugucaaagagugaagacgucuauacugugaccccagggaaauuugcaggaacucuucuguguauauauuuuaaauauuuuuuauuuacacaaugugcaaaaauucugcaugcugcaaaauuguuuuaccuaauuuauuuuugcaagcuaauugaaaacuuuaaaacaucuugcuaacagacuguauguaguuggcuggccauaaguugugacuaguguauuauuuucaucuuccccaaaugguguuucuaaggucuugcugaagccacuguucuuuuuauucacaacacaucauaaagugaauguuguaauuaauuaauuauucuuuaguacuaaaguaagaaacaguauauugugcuaaguaaaaagguugaugaccaugccaucagugauauuuuugcauuuuaaaaaggucaaguaccaucauccaaaauagcuuagcuuuacauuuuaaaguucauuucauauuauuuaaauuuaaaugaacaaaaaauuauuugucucaagagaugauccgguuuuuacauggcuuguuuggucacucguguaccuuauacauguggagcuuccagucuguuguagccauuuaguuuucauugaagacacugaggcucagagaagccagugggcucgccccagcccuuccugcagcccuccugcccccaccuuccucuuucgugcuucucugcugcacacaccuaaauggcagugcugccauacaguaccauuaacguuuuuaaaggguaagguuuacuuuguagaugccauuaaucccuaagaaaaaaaauuccgguuagucuccuucaaauaaaaauuugugacucaaguuguggaaaucuggauaaaaauaauuuucguaaaugcacauuuucuugaaauauuguuauacuauuguacuuaccuuauuuuuacagaucaccacaaaaaaguguuuuuaugguuuuuaaguaaauuuaaagaaggaagaagaugcauguaaaaauugaauaguauuagucucauugucugaauugcuaaguaggacauguugauuucuuuuuuuuuugggaaggggugcggcggagucuugcucugucgcccaggcuagagugcaguggugcgaucuuggcucacugcaaccuccgccuccuggguucaagcgaguccccugccucagccucccaaguagcugggacuacaggcaugugccaccacgccccggcuaauuuuuguauuuuuaguagagacaggguuucaccauguuggccaggcuggucuugaacuccugaccucaagugaucugcccaccucggccucccaaagugcugagauuagaggugugagccacuguacccagccaauuuuuuuuuaaacaaauaucaaaaauacagaugauuuugugguauauuucuuaauaaaaaggaauuacccgcauaucaaauguucaggguacuuuuuuugaguguguuugcauauuuaauaccaugaaaaauguuccaguuuaauuugagaugaaagaauuauuuuacuauauucuugugaguuuauauauauuagcauguuuuuguauacagaauaauuuaaagaagccaucuaaaaucacaugugucaauguauuuuaauacaguagauguuauucaccguuauuuuuaauuuauaaugugacaaauuagucaucuuaaagcuuuaguuaacuuguuuuuaggauggagaagauuugauggaugagaguguacugaaauucuacacucaacaaugggaagauuaucgauuuucaagcaaagugcugaauggaauuugugccuaccucaauagacauuggguucgccgugaaugugacgaaggacgaaaaggaauauaugaaaucuauucgguaagaguuuuguuuuaaaacguuuuaaauuuguuuuuguuuuuguuuuuuuuaauggcaaauugucuuucagcaagagaaucuaggcaaauauuaagcuuuuuucagaauaguaaacuaauuuucauuguuuuaucaauaaaugucacuuaaauauuuuuuagcaagaaaguagaagaauggguaaauuggaguucuaaaauacaauuugcccauuucugcauuugcuuuuuaaaaauuucuucuuuaauuaccugacccuaccaucacaguuugccuggaacugccugaguuuucgcacugaaaguccugaguccugguagucccaggcaaaucaggugccauaccugagggcgagcccugaggauuagcccucccaugcuuuagagucugggaaacgcugcuucauggagaggacccugaauuaauuaauuacuaaaucacccucaguaauauacguuucuucagucaaugaaagggguuuuuuugguccauugguuuucaaaguaugguccuguauuagucuguuuucauacugcugauaaagaccuaccugagacuggguaauuuauaaagcaaaggaaguguaaugggcucaacaguuccacguggcugggaaggccucacaaccauggcagaaggcacaucuuagauggcggcaggcaagacagaaugagagccaagcaaaagcggaaaccccuuauaaaaccaucagaucucgugagacuauucacuacuaugagaacaguaugggggaaccacccccaugauucaguugucucccacugggugccucccgcaacaugugggaauuacgggagcuauaguucaagaugagauuuggguggggacauagccaaaccauaucagguccccaaaccugcucugucagcaucaccuggggacuuguuagaaaugcacauucucaggccucauccuagacuuaaagagaaacucuggagauggggcccagcaauguuuuaccaagcucuccagacaauucugaugcaugcuccaguuugagaaccaguguucuagagcaguuaagggaggacucagaacagucuguucauaggcugucagauccacacagacaaugcccuuuaaaacuaguuuuguuaaaaugucagauucuacauaaaggaguuaaucaccauauccaagaauguugcuauaauagcaguacuuuguagcuucacuuuugacaaauuuaaaagaaaaacaaugcugguugcaguggcucaugcuuguaauccuagcacuuugggagaccgaggcaggagaccagccugggcagcauaaugagaccuacaaaaaaaauauccaggcauggugacgcaccuauagucccagccacacaugaggcugagguggaagcaucacuugagcccaggagguggaggguucagugagccauggugguaccacuggacucuaccuugagugacagagugagaucaugucucaagaaaaaaagaaaagcauaauguaucccagaugcaugacuaguuuuuauugucuguauagcuccaguuucuauaccaaaauuguuauugcuucauaaugauacuuugcuauguaguuaauccaguucuaacaaaacuuucuagguuuaguuguuugauuugggguuuuugugcuuccccuuuaacauuuuauuuauuuuuuuaacugacaaaaauguguacaccaugccuuuuugaaauauguguauauuguggaauggcuaaugggauuuuuucuuuuucacauauaaaugcuuucuugagacucaaaaguuguuaguguaggaaucaggauggucuugguucauuuccuuuuggaaaccugcuugaccuaaauguguaccuuacaguaacaucacagacuccuaaaaaucauuacgguuuuuaaacuuuuccuauacuguuuccaacaacaguuaaagaaaauguaaauaaagaaguugagcugacaaaugucugugcuuggauaccucuugaaguuguugacucuagagaguggcuuucugcuuuuguccugauagcagauuuugaccaacuuguaaucuagaaauuuugauaaaguaauuugagauuuagguuauuuccuaugacuucaaucuuggaaaaacaugguaaaaguauagacauuuuguacuuuuuuuucuccagcuugcauuggugacuuggagagacugucuguucaggccacugaauaaacagguaccuacuggugugagcgugugcauguuccuuuuaaaaucccuucgcaguuucguugcuuagcuuuugucucgucacuccuucggauuaucccaucuuacauuguuuaguggcugugaauguuuaagggauauguaguaauauauaucauauucuauaaccuguguaauauuuuucuacauccuuucuaaagguaacaaaugcuguuuuaaagcugauugaaaaggaaaggaauggugaaaccaucaauacaagauugauuaguggaguuguacagucuuacgguaaauaauuucccuuuaguuuauucaaaguuuucacaucaaauggcaauuacaacaaugcucuaacagaugucauuuuuaaaauauuuuaauauuauaaaggauauuguuagcauuuacgaagguacuuacauuucuuuuuaagucagugugacuuuauuuguuuuuauccaucauaaaagcuguuugauccgugugccuuaaggaaauuuugaugaaauagacauuuugauuauuuucuuuucuggucucauagugaauuacuggauauguuagagugugagcucaaugauaaccagaaaucuauaucagcuugaaaaauugagauugagaaacugauaaaguaauacaaugucuuaaaaacuuggguagcauuguauuucuuugcaaauuuaaaauuaguuauuuuuauugcuuuuggaaauacaaaaguucucuaaaggaacuucauaauuuugaagcauaccuggccaugggucagaauuacuugcuuuuuauacgucuuggauuuuuuuccuuuuuuauuuuauugaaagaguguacuuuaauacuagugaguaagaguuacuuauguccugccauuucacauuuaccuuuuaaacauaacuuaaacugaaugcuacaccuaaguauauucugugaaauauaaccaaaaaaauaggguaauugaaauauagcucauauucauuucuaguggaauuggggcugaaugaagaugaugcauuugcaaagggcccuacguuaacaguguauaaagaauccuuugaaucucaauuuuuggcugacacagagagauuuuauaccagagagaguacugaauucuugcagcagaacccaguuacugaauauaugaaaaagguaagcuuaaauauaguacuuuaaguagacuuaaguuaaagucauugcuacucaagugaguucuuuuuagcauauacagcuuucuuuacaagucauuuguugggcauuguuuuucuagaguguuuuuaucaggugcaagugcuucuccuaauucuccaaggagcuucuauaaauuaauuugguaaucgugacugagaguucuccuugcuguucuaaggauauaaccacaauagcuacaugaauuuuuuuuaacuguuuauuguagaauguggauuuauauaaaaugggcaucacagucaugucaaugagaaaauuuuaagaaacaaauauuuucagauuugcaaacuuuaauuuuuugcuucuaaaauaucccuaagaaucuauuacauagcuuucaugauuauauuagaggaaaaguucuucugaaacuaggcuuuaaauucuaauaugagaggacggcuguccucccgcuucagccuccagaaguaaugggauuagaggcgugagccaccacacucagcuaauuguuuuauuuuuguagagauagggucucgcuauuuuuguagagauagguugcccagguuggucucaaacucuugggcuuaagugauccugccaccugggccuccgaaagugcugggauuacagaugugaguaaccauggcccgcugauaauaaagaucuaguagaauuacucuuuguucucuuucuuagaaauauagauauccuggcugggcgugguggcucaugccuguaaucccagcacuuugggaggccaagguggguggaucaccugaagucaggaguuugagaccagccugaccaacauggugaaaccccguuucuacuaaaaauacaaaaaaauuuaucugggcaugguggcacgugccuguaaucccagcuauucaggaggcugaagcaggagaaucgcuugaaccugggaggcggagguugcagugagccgagauugugccacugcccuccagccugggugacagagugagacucugucucaaaagaaaaagaaaaagaaauauggauauccuggauuuagacucuaaggaaugaccuaggucuggagucagcaaacuuaucuuguaaagggcuagaaaggaaauacuuuaggcuuugugagcuaugugaucucuuuugcagcuguucaacucugccauugcagcacaaagcagccagugggauauguacacaacugaguguggccggguuccaauaaaacuuuauuuacagaaaaaggcaggcaggcagaauuuggccuacaggcuacaguuugcugacccuugaccuagcuguacuaggacaaugguccccaacccuuuuggcaucacagacgguggcugggggaagaagggggaugguuuugggacgaaacuguuccaccucagaucaaaggagcgugcaacauagaucccucacguguguaguucacaguaggguucgagcuccuaugagaaucuaaugccgucccugaucugacaggaggcggagcucagguaguaaugcucacucauaugcuggucaccuccuguugugcggcccaguuccuaacaggccacagacccauacuggcccacagccagcgauugaggauccuuguacuaggagaucuccaggagucuggaucuuuccaagccugacaccugcuugcccuguauucccuguucacuuggaguaugaauggacugcggaaucucuuuuccguaugcugagauagaaagucaauuaaaagcaacagcucugcucuaaccucauagagaaaguccuauccgguuuguuuguggugaccugaaugcauuuuccuauaggagauagugguuauaaaugggcuuagaaguuugaaguugaaaguccuugacaaaucucugcuaucucaaaaucuaacaaaaauggaacuauucgggguauuauacuuggaauauuaaugguuccuuguguauaauggugggcuaaauugacuuuccuaugccaaucuggaaccuaaccagcucacccagaguuucaaacaacugccuaacaaaugaacuuuugaaacagucuguuuuaaacguuaacauugccuguuauuucauuguuuaauaugacaguguuguauuccuaaacacuucucuuaugaaacucugcuguauauggugauucuuuuaaaacuauauaucccaaagaccucuuauccagaugcacauccacgacaguggcgcgagccuguucuuuuuauggguuuauuagaggauuguggucaucuccuuuguccacacugaugaaguaguagugcucuagggcaaggaaaccaguguucuagggcagagcuacugaagcacucccagaacagguaaaucuguuuuuaaaaccaggccuaggccgggcgcgguggcucacgccugugauccuagcacuuugggaggccgaggugggcagauugccugaggucgggaguucgagaccagccuggccagcauggugaaacccucucucuaauaaaaauacaaaaauuagccaagugugguggcggacgccuguuaucccagcuacuugggaagcugaggcaggagaaucacuugaaccugggaggcggagguugcagugagccgagaucgcgccauugcacuccagccugggcaacagagugagacucugucucaaaaaaaaaaauaaaaauaaaaauaaaaccaggccugacaccaaagacgguugaggagcaagaauuuccaauggccucgauguuuucaauccagcaugaggcccgccuucaaggaagcagugugcuuccuacauccugguucccauagaggggauucauuucuagaagaguuaaagguuuggcccggauccacuuggaucacaccaaacacgacuuccaucauauucugaaagaugauaaugcagagagucuauaagcauaaaacuggaauuugaccauguaauucugcucucauccuauagccuugcaucucaaacugagcuaugagucuauuuuuaaauccccaccccaccauuuauuagggggaugaccuuaaugcuucuguuccucaaauuccuuaucuguaaaaugugaauaauaauaauagguaauaaugaggauuaagugagcuuuaguauuuacaaauuuuaacaugagguauuuauuuguuaaaaggugcuuagauugguguguggcaaagagcaaagcuaauguauuugguauuacaaauauacaucccacaaaaccuccaguguaugccugggaggaugcaaaaccacaggauaaaggguggcaaaucuuacucaauaacuuagggagcaauuguguuuacauuacaacaaacauucuaucaggaaauagaacaacuaugagauaaaacaugacccuucaagaaauacucugcaaauucuagccaguugagagcaguucaaauucccugggucuguguucacuuuucucuauuaggaguguuuuacaggaaacaucuaagaauauuuggcuugucuuuccaaggauggcuuugaagagugaaccauguuaguguuucuaaaagauuugacugucucaugcgauugagacugaucugagcuacagaaacucuguaugacuacuguagguuucuaaugucauuuuuuaaaaacuuuaaaaauauaccauacuucauuaauuugcuugucuuuuuugguuuuuauuuuccuuuuguuuuuacugagaaccgauccuagugaauuaauaaagaccaucuuuaauugcauacuuuuauuuagucauuugaauuugaccuugguguucuaauacaacagucugccaaguacagugaugaucaggagccuauuugacuuggaaucauuagagaaccuaaauggcuguccuuucugaaaccugaugacaauaccuacgaccuugguuuccuugccaauauauaaaauaagcuaguguugaggccccuuggccaugaauguuucuguaaucaccuaggcaccuguucacucuuccugcccccucagccccugcaggaagggucuguagacuaagagguggagagccgugccucucagaggaugaaucaggaauggcaucaaagccuaaucuuucaucucggaagggguaaaacuauguuuugcugccugagaugauuauguucuuccaagaaagaguuauaacuuaaaacagaaaaaguggugcuguuugguuugcauguucuauauuccaccagcuuuagguucuugaguuaucagucuuaguggaacauuagauauaaagcagcauuuauuguuuuaaaauaucuuuauaaucagaaaaacaaaauuacacauuaacuguagacuuuuuggaaaauacaaauaacauaaaccuacaagccuggggcacuguugcugauuauauaaaccacauuggaaucaugguauagguuuuucguaacuuguucacuaaugauuuguuauuaguaguugguguuuauuuuaguggguaaucauaguucauuaacugaacauauaauaacugccucuuauuggaaauguauuaacuucaagcuuuuuucuauuucuucauuuaugaguugucuuuucuuccuuguguuuuuauuugguuguacucacugcuuugcuggagaucauuauguauuaagaauauugaccuuuugauacauacugcagauauuuuccaaguuuauuuuucacauuuagcuauuuagaacguguaauaagguucugacuuacgugguuuaaacaguugucccauuauuauuaguucuugauaguacaagucccgccuaaucauuuuuucauuuuauuuuuucuuggcucuugaguauugauucauuaccaguugaauuuuuccagauuucuccaaaauuauaccaaauuugaaaaucugggcaaggcacgguagcuggacagccuauaaucccagaacuuugggaagccgaggcaggagaauugcuugaagccaggaguuugagaccagccugagcaacauagugagaccuugucucuagaaaaaauuaaaaaguuagccggguauggcggcaugcaccuguagucccagcugcacagggaggcugaggcaggaggaucacuugagcccaggaguuugaggcugcagugagcuaugauugugccacugcacuucagccugggagacagagccaagauccugucucugaaaaaaauauauuuaaaacaaaaaucauuuuggagaguauuggcauuuuuauaaugcaaaauauaauucucuuuacucagaucaccugaauaauuuauugaaauuucuuccuugcuuugauaauuuaauaguuucucucuaaauuuuugaacagucugauuucugaugaugauuuccauguaaucacuucagggcuuauauuugugugacucuuggcuucaaguaguuuuuaaucuaaaguaccacaucuuaguaucugcacagaagaugcauucauuucuuagaguggcagagacauuaccucaaaaagauaaaauaccauucucugagggaucaaaaugauguaaagacauguuaacuguuaauaacgaugauguuguuagggcacuuaaaaaggaaguuugaaauggaaauacguauuacagagaaaauggcagacaucaguggcuguuuaaauaugguuguuguuuaccguaaaaucaaagaacuuuuuccuuuuucuuucuguuuuuugagaaacggagucuugcucuguugcccaggcugaaaugcaguggcacaaucauagcuuacuauguccuuuaacuccuaggcucaagccauccucccgccucagccuccugaguagcuaggaaggacuacaggcgcgugccacaccuggcuaauuuuuuuuuuagagacagggucgcacuguguugcccaggcuggucucaaaauccuggccucgagcaauccuccugcuucagccacccaaaguggcugagccaucaugcccagcccucccuuauuuucuuaaucgcauuuuauuagagcuggcaugugaauuuaauuugccauuuuucaguuuccuuuaauuuacauauuaaagaauuguaacaguucuuuaccaaugaaucaaaaccauucacuugaauuaauuuucuccaggcagaggcucgucugcuugaggaacaacgaagaguucagguuuaccuucaugaaagcacacaagaugaauuagcaaggaaaugugaacaaguccucauugaaaaacacuuggaaauuuuccacacagaauuucagaauuuauuggaugcugacaaaaaugaaggugagccacaagacucauaaaauguagguauuuauaauuaucuguaguuuugauauugcuuuugauucuagacucucgagucaacggcauuacuugcccaugucaguuuuaaaaagaugcauguguuuguacaucguuaugugccaauuucagacuucugcagagcauuuugguuugacuuagggggaagaguguauuuagaauaugacuugcuccauacacuuuagcauuaaaugaugcuaccccaaguuuuuucuugacuguucuuccuuugaaaauucucugagaugaggagacugucaucuuauauuucccuuaaccacucccauguuuuacuggggcauguuaggagcucaauaaaagauugaaguuuggauuuuucuucuaugguccuccuaaaguaaccacaugcuguauacacgucuuaaaucaauuugggagaccuuuucucaacucauuuguuuuuauaauugagauagaaauccauauucuccuuaaauguauucauuauuuuuaaacaaauauuugagugccuauuaugugucaggcauaaauacuauuucaaucuugagaauuuuaggaagcauuagaguuguuucugauaauuuuuuuuuuuugcuuagucuuaaguuagugguuucucacaguaagggggaaaauaaauuuacaauaguaaauuuauaguaaauaguaacaauuucauuguuacuuuuagcaaaauauacauauaccaaauagagaauauuugguuauaauuaaaugcuauugauuauuaaagucuaaaaacaugguuaucuuuugcagaguauuuuucaucucaguauaaauacauaauuaguagaauggauaugcaaaauuuuuuucagugcauaaaagggguuucuuccucuuucagauuugggacgcauguauaaucuuguaucuagaauccaggauggccuaggagaauugaaaaaacuguuggagacacacauucauaaucagggucuugcagccauugaaaaguguggagaagcugcuuuaaauguaagugagauuucauugaaaaucagucaggcugauuauuuccacaugcgaacugcaagcauauguuaugcgucucuacuuccaaaucuaaaugguaccauuuucauuagaacucugagaaccauguuuugucuuuuugaaguagauaguucacagacaucuuuguuuaguaaauaccuccguaaguuuuucccucgcacuuuuuaggcguuaauaauguuauuuuuuuuuuccuuuuaugccuucucacuguuaaauuccuugcacucacuagaagaagcugcuucccuagaaacaaaaggcuccuggaagcuguuacuuugccacucacaguccacagguugugccuuacaggaacuuugaucuggauaguagccucuggcugaagaccacagggcuguacucuggagaggcccugcaguuuauagcauuucucuacaccccuccgcuuccccagggcuacauagaauauuccugcuaggucaucuguaauucaggucaucuguaauucaggugauaauuucacauuggaaauaauugcguuuuuaagacacaaaugaguugccuucaguuuugcuccuguugugaacuucaguuguaacugggagaacaauagagaagaaaagcucuuuuuuuuuuuuuuuuuuuuuuuugagaaggcgucuugcucucuugcccaggcuggagugcaguugugccaucucggcucacugcaaccuccgcuuccuggguucaagugauucuccugccucagccucccaaguagcugggauuacagccgcucgccaccauucccggcuaauuuuuguauuuuuaguagagacaggguuucgcuguguuggccaggcuggucucaaacuccggaccucaggugauucgcccgccuuggccucccaaagugcugagauuacaggcgugagucgucacgugcggccgagaagaaaaguuucuaaaacacauugguucuuacaucugaaugcagaaagcuucucuuguuuugacuuuauugugcuuaaugauuauuuuugauagcauuaucaaaaauaguauuuuuuuaauccuuauuuuucuguuaucuuuugaaggcuucuuuuccguguuuaauuuugggaguugcugcugacacucagccgccucuaugaauuauuaaaggguugaguauaaagcuuuccuuuagguuuuuaaaacaauuuuaugcucacaagaugggagggaacuggcucagccguggauuuuaugaaaaagaucucuagguuuuaguaaaaacuuaaguacagaguccucagugucggcacauacagugucuuuaccguguggugauuacagagccuggccaggcugccugcacucggaucucagcuccaccauugacagcuaucucacccuuggcgaguuacuucugucucugucauuuuauuuuauuuuuauuuuuuuaaauagaaugauaaugccuaucccauaggauauuugugaauaaacaauacauguaaagugcuuaaaucagggcacauaauugcucagcagugaugacugcugcacguucuuaugaguacacauaauuuuuuuaauuuaaaaacucauuucaaaauuacccuucaguuuuuaugacuuuauuuccaagcuaaauguuccuuuaaagggccugauucacacacacacacacacacacacacacacacacacacacacacacacacacaaaacgcucacccuccugugauucagaaggggucaauucggugaagacauuuuuucaguaauauaaggugccuucccaguuguugauucagaacucaauuuaccuauaugggcagcagagccaaguaaaugacuugacuuuccuugaaaugaguuaagugggaagucuguuauuucaucagauagauuaaugaagcaguuuuugcuuuuuucauuuaaauugcuauauacuagguaugagauuggccuuagggaacucguguucuaugugaauauaguuagauuuaaaauaaacaugauagcuggguguagugguguguaccuauagucccagcuacucagaagccugaggcaggagggucacuugagcccaggaguucgggaccagcuagggcaauguagugagacccugucuccuuuaaaaggaagaaagaaaaaaaaagcauuauaaauuacuuuuucaguuuuauaggaaagaugggacguuaauucuaauguucaucuuuuccaaaccaaaguaaggugcuaaauuggagaaauaaucaacuaugauucucauguuccauuguuucuuucuuggauacaaucagcugccugauauuuuaggcacugaauaaaugcugccgauugacuuugucaaugagucuugaaucugacauuuaccuaacucgaucaguuaaagcaaaaguauaccuucuauguaaaucauuucucuauuugaggaagcuucauccgucagcaaugacagcacaaauaaacugccuuuaacagcaguuacauuuuacgagaaaucaagcuuuuaaacaaugcuuguguuacuuaaaucuaagccacugauuaaccugaauuuaagaaccaaaacaagauuuucucccgugaagaagaguuauagcucaguaaacccacguugcaucugccuucacucacaaaagucaaauauuaguuuuuuuuaguaaguuacugauucuaguuauuauuuacauaagcacuguuucuacauugaacucaugaaacucugaguuuuuuaauuguugugcuuaugaaguaaaauguucgggaaagcaaauacuuuuccaauuuucugcaaaaggaguguuuccuaaaaugcaguuuuauucuuauuuguaaacuugccguuuggcuccuucuguuggaaugcugucugucuggugcauggguuccucgugcccuucccugcucugggcucacacuugccaccuccauucgccaucucugggaaagcccacagaauugaagcucagggggagcgugggugcccgggccauagccuggcacacaguaggugcuugauuacuuauuguaagaaagaaacacagcugcuaaaaaacaaauacuuuuaaauagguuuuaguuuuuaucauuuaugugguaaauguaaaagacacauuguaacccaaccauaauuauuuucaaaaacccacugauuaugaaaaaucaggagaaaaaaagguuaguaaaaguuagaaucauuguacaugauuuuaagugggauuuaauuaccuugagaacacaauuuuuaaaguuuaaaaauuuuugccuaauuaaguugaaucauaguguacgagaaucauuuauaauuagcauauuaaaugccauagaaggcacuaccuaagugauuuuuuuuaagugcaaaaauguguaauaucagucccgugucuuucucuggacuagaacacuauauauguuacacugaagcuguucuugaugaaauaaacuccuuugagaggccaaaaaaaaguuuuuuaucuggcuaauccuuuuauaccacuaauuugguuagaaaaccagcuuuacugcuaauaccuggccuagacugaaauucguagagguuuccaguuuaucauguaagucaaauauuuuuuguguucgaaguuuuagaaccuacuuaugaauuuuucuuaaggcauaucuuuucccuaguuaaaaccaauuuaaacauuaaaggcuauuucuggaaaacuggcugaaggggaauuucccucauggcaucucccucucgccaccuaaaagcuggcagcccucagugacgugaaacugaagagagagcccuccgaaccucggaguggggaggggacuguccgucaggauuccacucuguuuggaagcguucucuccagccuucagagagccucgugaucaagggcauuugugcucaacugauaugugaggcgaucaauuagccuauugcacuggggcaccaggaggacuuugggaaccuugcacacaaauauucaaggaugagauuucaaacugguuucgagcugagcaagggauaggagaaauggcuuguuuaauaggcaaguaaccccaugcaugauugcuggcccaggaacagguugggaauguaucaaaaaauagucuauauuaaaauauagaaggugauggccuccauucacuuagugaggcuugaaggggagcaucuucaaagcagagaccauuccuucacguggucauuuuaaaaagaauugaaugcccacugugugugccuggcccugugcuaggcucuuaauuuuucuuauuugaccaaagcaacugcaaacagucuccugcuuagaauggcucaccuuaaugauuuuuuugacuuuaaaauggcaugaaaacaauaggcauuuaugauacuuucaauaaacucaucguacauugaaaauacugucacacauucagguccgggcgcaguggcucacaccuguaaucccagaacuuugggaggccaaggcaggcagaucaccugagaccaagaguucaagaccagccuggccaacauggcgaaaccccgucucuacuaaaaauacaaaaauuagccgggcguguuagcaggcaccuguaaucccagcuacuccagaggcugaggcaggagaaucacuugaaccuggaagucggagguugcagugagccaagauugcacugcugcacuccagccugggugacagagagagacuccgucucaaaaaaaaaacaaaaaaaaaaacccacacauucaguuuaugaugggcuuauugaaacauuaucccaaauugaggaguauuuuuagcugcaugauguggucaguguuucaaaucaaagggcaaacaaauuuugcagaucaaacugaaaucguuguuucauuucuuuagcaagcauuuagggcauuccuguaguagacgugaugucaagaacucugaauuagaaugccuugccuuuguccuugucacaucuccgugaccucaucugccuaguuuagugccuacauugcagguucauuugaaacucaccucuucuccauuccuuagcacagagguggcagcuguguagcaugagucacccugcccucaugccuuguucaucauaagcauuaguaaucuaauaggguauaauuuccugcagggucuggacguagccucagaauccuccucaaagcaguaagcagccugccugucucgguagcaagcugucuccuccucugucuucugggaugagucaguggagcaugggaauuccuccucccuuggcucuuacuguuuucuaugcauuuucucuccagucccaaggcuaccaucuuaaucugggcuucguuuaucacugcaccucccaaauggccccacaucucucccauucccauucaucccucaugauaauuagcaguuucgucuuucagaaauaccacuuaauacauuuauaauuuuacucuguguucuuuucauccuuuguuuuaaacaaagcagaauaaagcccuuccuugugauaauauaaaucauaauauuacacuaaaucaaaauccucuaauuagcccacauuuucaugaacccugucuuccagugaaacuauuauaauaucauuccccuaccccaaaacucuggcuaaugucucuacuuauaacacagucauccuuaccuucugcuugucuuaguccugcuuuuaaggccagcucaaauccucccuucuagaaagagcugaccuuaacucuucuauccuaagcccuauuuguaaaacucucauuacaaguguacaugugguuauaacuuccugugcuuccugucacugcaccaugggugguacagcccuugagagcgaagcucacgccucauuauaguuuuaugcucugugguuucgggccuagccucuuacccagcgaggaucuguggaugauaauggugaaggccgucugcugcagggcugccgucucggcugcacgacucuugaccccgcugcgugugucuucucagcuggaacucaccauuguguaaauuugccucacucugcuuuccuaguucuucugucuucucuucuuagagacaguccuucuuuuuucuaccugugaaauaccuauuuaucucucaaaacccagcucaaaaguuuucucagucaccuuggaaugguagcaucucccccuugaaauaauggcacauuggacuguuuaugugacacugcuuuaugcuuuagauguccgugugaacgucccucuauuguagcagagauggcucuauccaguuuuguguccucagagcuuauuaugacaccuuaucaguauacuuacaucuuaguuacacuucccauugcuccgaaaaggacuuggggcugcucacacaauacgugaaauaaaauaagauaaauuaaauaaaucggagaauagcaaaauaaggauaugagacacaaaauagagcuuaauauaauucucaaagugugugcaaugcaguccguuacucuuguuagagguaggucaugauuugccucgaaaucguuguagucaguacagagagcuugccauuaaagacagccagcgccgugggguacgaucggcuaguaacucagaagaaugauuuuucuugauggucagagcugaggauacuuucuccaguggcucauccuaaaaagcaugguagugccguggacagcaucaucagcaguacacucacaaggaaauaggaugucaaguccuuggguaguuugauaguuuuccaugacaccagcuuauagcacaaugccaaaauaaaguucaggagaagggucaaauaaugcagacuuguaaguuccuguuaauucuugacuauacaauugauuccauuuugaauguuuaacacacaguugcucagcagucuggauguuacuguauucccccacaaagacagcucuguaaaugaacauaaaucaggcuauaagagaauaucuccuuacacuuggucuucagggcagaaguagcaacaaaaaagcacaaguccucuuugaaaccauaucuugauuuaguguccucagccuaacagguauugcaguguggcccaacagagaugggucugugagauacuucaacacccggcagggcugcugggucuaacauuggaguguugggcugcagacacugacuggggagaaauguugugaacuuuauuugcaguucugagagaaaugcuguguugaaacaggagagguuuucagaagcugcucucaguagcuggcuccaggauuggggugaugguauaauacuuacaaaaggcagcacaucagauagagaauuugauaggcagaaauuagguagcuccggcaaguuauuuuucaauggaagacuaagggguagauccgaguacauuagcagaaaaaguucugugauuuagauugggaaguugaguuagaaauaauuauaaaagcccagucaugugugaacuuagaccagugaacagacgaauguacuaccagcuacuucugguagauuugaguuuggguuuaguuuagacauccaagauccccuuucucuucuguagugaagugcgugauuaaauaacugagucuugaugcaaacauucucuggaugguaagaaaagaacacuguccagucauugauaaaauuagcuacagaaccuuacauuuggaguguaacccagcuugguuuguucaaaggagauaggauacacauggauaaagucagcuuacacacacaggaagagggucagaugagaaacucauagacucuuagagccauagcuauuccuuaaagcuggcuaauggguuuauggggguugauuuuacuauucuuuucucauuuugaacauauugaaaauuuucuauauuaaaacauuuuuuuaagaaacaaaugugcagguuuugauugaguggauguuggaaaggagaaagagugucuuuaggacaaaaggaagcacgguuuuguacaguaagucagacauuuaauuacacaaaaagcugauauaugcugauaauauacauugauucauauagcacguagcuaaauuugugaauuacagguacauaacuucagagaaacaaggaugguuuggauuuauuuugucuguuucccuccccugagaaauucguaugaccuugccuuaaaacuuuuaaagaauacauuuuuaaaucuauauuccugcuaaagaaaacagugaaucauuaaaauaccaccagaaaaaaaaaaaaaaagguuugauuuuuaguucaggucgguaauggccuguaaguaccuugaagaugguaucuuccuaucacuuaugccuugggacaguacccaagaguggcugaacuuuuuaccuaauuaaaaaaugagucauuuauuugaaaaauuccacuuccauuuauuuuaucugauuucuuaaauauccggucaacugcuaauuugucagaugucauaauucgucaguccuacccuuuucuacaggcugaauuuuuaauuugaaacaacuacaccucuaccgaguguuacuuucagacguaaauuacugcaggaagaccccccucugccuugguuaacauuuaaaugagaugccuccuguccaggacgccaugagacgaagagaauaaucauuuucccuaaacgaaaauguacacauuugucauuuuggagucuaacauaaccaggcuuuuuuuuuuuuuuuuuuuuuuuuuuugagauggagucucacucuuucacccaggcuggagugcaguggcaugaucucggcucacugcaaccuccaccucccagguucaagcgauucuccugccucagccuccugaguagcuaggauuauaggcaugugccaccacaccuggcuaauuuuuguauuuuuaguagagaugggguuucacuauguuggcuaggcaggucucaaacuccugaccucaggugauccacccuccucagccucccaaagugcugggauuacaggugugauccaccacguccggccgaggcugucauuuuuauauccaacauacacccuucuuucucuuaauuauagggaagacuuuaaucauuucacaagcaaauccacuauggaugcacgucccuacccaaauuugacuuuauacccacaucaacuaaauuguaguuuaaauaaguacugaaguaacccuugauuggcucaaggccaauuagagacccugcccaugaacuucucuuuccuguccauccucacugagucaggcagcccuauacucaucuuccuauacacuacuucuauuucagaacuaacuuaauuauuccuuucugaaacauucuaccuggggaaucuuuucauucucuucagagaagucagucuucccuggcaagucuuaguucugcuuucaaaguuuaacauuuucgucuguaaacacucagccccuaaaucuaguccaccuacagccuccacauuuacagaguacauucugaaaggcugaaaacaaggacuucagccucaccuugaacuaaaggaaauguaggugucagccaggacuaggggaacaaccagggggcguaaccaaggccggaaucaaaaugaaacccacacaguuauggugcugggaucaggaauguguagauaguagaucagaauccaaaggugacaaugagaucaaagauuuaaaaauuguggucugaggugcagagccaugauuccaagauagauauugaugauugaagcaaaaaguagcagcagguaggccgguuaaaauaaugagaaaagguuggacgugguggcucacaccuguaaucccagcacuuugggagguugaggcagguggauuugaaaagaaaguauauucugcuguuguuggaugaaguaguccauagaugucaaccagugguuuauuauuagucaugugaguccuggggaacccagaggaacucccucuucaaacaaauguuuuaccugagucugcacguguuggagaguucuccaaauuaacucucauguagucauaugaugcguaguaaagggaagacuuaaaaugugcucauuccaauccuacgugccccugaaauccaggggcaacugcagcaacauuuuugaauuuagaccaauagaggcuuugggggaggagcauuuucuugcuggcauuguuuaacauugccaggacaucaccaugaaaauaaugaaggucaggcacggugggugaugccuguaaucccagcauuuugggaggcugagucggguggaucaccugaggucaggaguuugagaccagucuggccaacauggugaaaucccgucucuacuaaagauaaaauuagcugggugucauggcaugcaccuguaaucucagcuacuugggaggcugaggcagaagagucacuugaaccagggaggcagagguugcagugagccgagaucaugccacugcacuccugcacuccugccagggugacagaagaagacccugucucaaaaaaaaaaaaaaaaaaaaaaaaaaagaagaagaagaagaaugaggaaagagagcacuuacugaauuguuaguguuuuugucucaguauuuuaaacuuuaaaccaugcuccaucugaagaacuguugguuucugcuuauugaaagaggugagaugauacaguagaaaaggccuauuaagaaaaugcaagauuauuucuaaaugauuuuugagaucuaacauuuaugucccccuuuuuuugccuauuaauaucaaaauuaauguuuuccccugagcacgcacagacugguaguggugggaaccucagaaccaugcugggugguggggauaccauugagcaccuucccagauaaugguccaagugcauggucugcacacauacucucuaugguuuuauuucugaagccuuugcuucucuguguuuugcauggagauaauguuacuugaagaccaagugcugaugcuaaugggaagaaugacacugcccccaaacaacugcacgauauguuuuuguuacuuaguggggccucauuucucuccccuuuuuaaggaaaaauuaucuagagguaagacuguggacagugucaagccagguccugguguccugagguugaucuguucuuguugacugccuguccucagggaacucuccuaaagcucuuguaauugaucugcucucuuuagccccuggcuggaugaaagauguggaggcugaauguacccucagagguaguguaggcaagagcagcuuuccacggacugucagaucuguccccucagccuggagagcaccaguuuauguagaugaaauggugaaggaugcuccccucgagccuguagcaccccauuauuccucuuuagcaauauucuugaauggugcuggguuacuaggaaguguucgaguguuaaaguaucacuuagcaccacaacugauccccagaaauuguguguaaauauauaccagcucuccaugagaugaugcccucacaccucuuguaugccauauucgguuuaccuuuuuaagaaagaguaagauaaaaaguuaugugagacucuuaacgugauuuucucuucgugaaauuggccuuuagaauuauccuuuuaguggaaauguauggaauaaaaggucgcaauucaguugugauuaucauuauguuccugguuuagccauuuaggagauuauuugaugaaugccacuucacuagguacuuagaaguacggcagugguagcaggcagacacggucccagugggcaacacugagauguacccagcaaggaauuggcaggugugauuaguguugggaugggguuugggaagucuuaacagggcagccucggccuaucuuggaaauucagagaaagcaucccugaaaaaaguguuugagauggagaaaagaguuagagcuagcuaggcaaagggggaucccagacacaacaaagccccucagugggcguacacacagcccauucuaagaacgaagaaggcagcaugggcuggccagaccagggaaaaccuugaaagcuguauugaugauauuggcuuaauccugagggugcaagaggaaaccaacggagagugauacagucauggaaucgacgggauauaugugcuugcugccauguagaaagugggugaaaaggaagaagaguuguuacaaguugugaugauuaauauugagugucaacuugauuggauugaaggaugcaaaguauugauccugggugugucugugaggguguuggcaaaggagauuagcauuugagucagugggcugggaaaggcagacccacccucaaucuggugggcacaaucuaaucagcugccagcgaauauaaggcaggcagaaaaacgugaaaaggcgagacuggccuggccucccagccuacaucuuucuccuaugcuggaugcuuccugcccucgaacgucagacuccagguucuucaguuuugggacuuagacuggcucuccuugcuccucgagcuugcagauagccuauugugggaccuugugauuguguaaguuaauacuuaauaaacucccguauauauauauaucuccuguuaguucuguccuucuagggaaccuugacuaacacacaaguauaccaguuagguuaguuagguuuguugucgugguucagauagugauaguggcccacuggagacugggcuggucgugcggggaauggagagaagaaugaugcagagacacuggcuuuguaauggacagguuuuguguuucgauauuuguuaaaacugaaugaugaguacaugggguaaguuuuacuacucuuucuaauugugaauauauuugaauuuuuuccacaauaaaacguugaaaagaaauggacggguuguauggauugaguggauucacaggauucaugagucggaaagcaggaacugaguccugggugccuggcucgagccgcugggugagugguggcacuugccgagaagagcuccagagaacacaggacuggggagcagaucaggccauucgugacauaggcuuuggaaaucccaugauagcccagggcaggccacacgggcucaccugggggaaguuugguguggaugugaauguguccguccuagguauaacaacaacugaaaucauauaggaguugaaugagcccuuagggacaagcccugggagauguccuguuucuuacaugugaaaagcucucgugaauacacagaggguccugaaucaaacccauuacuacuuuauuuuuuuaaaccucaaaccuuuguucuuugcuuucuugaaaaaacauccauuugauccagcugaucucucuccucucuguuuuauaaccugucuucguuguuuaccuccugaaugcuaaaucuacuccccuuuugaacaucuuuucucuauuugcugacuaguuccuuaaaauucucucccguauauuauucuaguguguugucugcuucuugaccaguuccuaaauggcuuuucucugaaccucaaaugcuaaauucacauuuucaaggccagauuuuuuuuuuuuuuuuuuuuuugacagagucucgcaccgucaccugggcuggaaugcaguggcgcgaucucggcucacugcauccuccaucucccgguucaagcgauucuccugccucagccucccgaguagcugggauuauaggcgccugccaccacccucagcugauuuuuuuguauuuuuaguagagaugggguuucaccauguuggccaggcuggucuagaacuccugacgucaugaucugcccgccuacgccucccaaaguucugggauuacaggcaugagccaccgcgcccggccaaggccaguguuuugacacuuuuccuuuaguagguuccaugcaaguccucccaucucaccagccagacugcuguaguugaaagaauuuuggaauuggagucugaagacuucuuuacuccuggagauuuggcuuuccaugugagaaguuguuccuggcauuccuugggaaauugguauuuuuccaaauuacaaaucugaggaaaaauggccaaaacauuuugagaaaauacagaaaaguauuauaauuuggaaacguuauagucaacauagagacaucacugguucagaggaguccaccaaugacaagucgcaagcaagagcgugaguaaguugaggcuggcguuuucgggaaugagggugaaggcguguggcagggaagccgugcaggccgaguggucaggcugccaggugggcaaggccuucuaaguguggaucuguagccccucugcugcuaagggugaagucauucuugcaaauaaaauaaguauuaauauuuauauacauaacaugcuauauauaaacccugugaggggucuuccaaaaaaauagcaaguuuuggaagcaaauugaguccuucaauuggcaguugugacacgcaguucuuuguagggccguuaacuuguuaaggauccugcauguuaccguauucgaaaacuacccaauagcguuucuagcauuuuccaguguuugaauccucgcuguaggcuggagcacuuuguaaauacuguaacagaaggaaggcagagagaagaauaugugaauguucuggaauaauuugacaugaaaucugaaagugaucuaaaaucugaauuggcagaagcaauaucuauuucagugacaaaaccacaauuaggucaagcagaaaauauuuucauuguuuaaaagaagcaagcuuauaugaaguaagauauggcccaacuuggaggugcuuuugguucacucugaagauuaagaccauccaggcaaaguggaagaaguuucccuacgucugggauagccaugaaacaaagagcaaggcuaucugguagugcaguucacgcucuguguguuuuaacauuuuuaagaugguaauuuuaaaauauuaaauaucugcaauacugccuuucaauauuaagugauuuuuauuuggcaauuauuuugcauuaaguucccuuuuaauguuuucucuuaucaaauguuuaugucagguggagaccauauuuauaucuuauugaacuuagcacaauauauucauaauaaaccuugcauuuauuauauagagcuuuuuuuaacaggaaacuucugacacucuuaaguguaacccuguugcagaaaaaucauucauccuuacugauacucauuguuauuuaaaaacaaguaaaucaaauguuauaaaaaaugcagaauagguagaauugggaaugcugauuucuggcaccugagcccugcagauuaauguaucgugauguggaaacaugggcgugccgcggcgccuggaucugugcuuggcugggggugacccggagcucccucccaccaaccuucccagccgggcucccucgcagcccggagccaagccugugccugccaccauuuccuggcagugugcuuagcugugacaguuucuacgucuguagaauggggaugaaaacagcaccugcugcccagugugggcuuucgcggucucaugaagggugguggcggcgugcgcugcaugccuagcagcagcgcuguuuuucucauuagcacuuagcuccgucuccuuugccuuccauugucgccgccuuccuuuggccacaggagccucugcggccagccuucccguugcauuuccauguuguuccuuguuccggggaggccccuuugcugcccugcgccgcgcuccgccccucuucccguccugcgaugaggcccuggcccccggcaucgccacgcggauccgcgccucugguuugcagugggugggggccgcagucagacucccgcccugagccccgcuuucccucgcguugccugcccagccgggcugaugaccgaccucggcggcuaaacgccuucuccagcugaaacagaguccagaguuccacuguuuaacaaggaggaauuggcaaagcagaacugucacuuggaaaaugcuguuuucaugaucucuuugaguuuucacuguuuuuaaugcaagcucggaaucaauauuuaguuuugaguguggagaauagauuguuuuuucuuuuauauauauaaacaaaauguccuauguguuucaacgaugguaccaaaaguauuucuugcucuuaucucuuaacuuugaaaagguaucuauagcuuuuagaauauuuuguaugcuaguacaugcauuguauaccuuaauacacaauuuaauccccaauaaccaacuuuuguuucuauuucugcccccauuuaaggaccccaaaauguauguacagacagugcuugauguucauaaaaaauacaaugcccugguaaugucugcauucaacaaugacgcuggcuuuguggcugcucuugauaagguaggugcgugaggguugugacuugccuguaguauguauggauggggcguuugucucuaacuauauuccguguaacgcaggcuuguggucgcuucauaaacaacaacgcgguuaccaagauggcccaaucauccaguaaauccccugaguugcuggcucgauacugugacuccuuguugaagaaaagguauuaaaugacccuauguuuucuuaguaugccuguuuaaaaucucagcuuuuauaugaggaauuaaaaccuacauuacauuuuacauacauuaaauuggaauuuuuguaccuuaugagaaaaaugcuuaaacauaaucguccuugccguugaaaaucugcauucccucccacuggcuguuuuucaaacagaaaugucucaauguauugugggacuuugguuauucuccauccaagcacuaaccaggccccacccuguucgcuucugagaucagacaagaucgggcacguucaguucagagugguauggccguagauugccuuuguuauucuguguaguuuuaaauuuauuuuuguuagaugaguuuuuguugcuguuucauauucuuuacuuuugaaucuuauuucucaauugauguuuucuaaucaauuuauguguauuaagaucuggaagcaauauaauauauagcuuucuccucugcguguguuuuuugaaguucucauugaguuuuuuguuuguguguucugguuuuucucagcuucucuuucacuuuaaguuuccuucaguuuagaaaugcucuauuucagauaucacaacaauaaguuuuaaagauuuuaaugaaggaagcuaaucuccuucuggcuuucuguugcaauaguuuuccacacgccaaaauuauauugguuuugauauuaauaaauuauauuuuaaacagcucuugaaggcuagcauaaccccgauacaaaaaagaccgagaaauacccacauaccagaaugaaaagacuacaaacaagugucacuugagaauagaguuguagaaaucuuaaguaaaauauuaacaagccagauuucccagugaacuaaauaauaauucuucaaaacauaguauagcuuucuaggaacauaaggauaacccagcaguaccaagucugauguaauuuacuacauuaacagagaaccauguaccaacuaugugaccuuuuugguaaaugaugggaaaacauuugaugaaggucaauagcuuucucuuaacgcaguuuacccaaggccagugagaaacucugaguguuugauuuuuuuuuccuguuuauugcaauaaacaggaguauuuauuccugguuuaauguguaauuuaacaauugcgaucagauccucuccagaaaugagaggggacuuuaaauuggaaggccucugaugacuugguuucauuuuagggggcugcauguuaugacuauggagauacuccacugggucuucauucaguuuguuugacagaacacuuaguguccuuuuuuuuuugagacuuagucuuacucugucgcccaugcuggagugcaguggcacaaucucggcucacugcaaccucugccuccugaguuuaagugauucucaugccuuagccuccugagcagcugggacuacaggcgugccaccacacccggcuaauuuuuuuuuuuuuuuuuuuuaguagagacaggguuucaccauguuggccaggcucgucucgaacuccugaccucaagugauccacccgccucagccucccaaagugcugggauuacaggugugagccaccacaccuggccuuaguguccuuuuuauccuuugucuuuucauaaaugucccucgucaagucuacugauacuaguuaaggccacugaugcagacagaauggcagagacauuuccacagcaccucuuuaaugagcguguguugggugaguggagucagggaggcacuaaguuaaacugcuccaagggaagaggaacaccccugacccaagagugccaagaauaggguuggguuuucugaaccaacuuuucuaaaguuggagacaccucuucagaguuucugugguggcugauucguuuuauaugaauuagggggucuuguuuauaaagcagucuuguagaaaagaccuguacaaaaauucaucuaccuuuaauucaccuuugaauuauuauuuguucauagaaugaaucaguuguuaaaggacaaucaucucuuguauauacaacuacagagggcagcaguuuaguaggaauuuaaaccccuucaucaucuuuaaugacugggccaugaaagggaaucuaugugccuuuuuauuucuccaaaguuaaauuacagcagacuagaaagcaauugguaaagugaauuuccuuuacugaaguuuaaguggauuaucuuaaaggcaaacuucuucagaauguuuuuggaaauguuuuauaaauaucuccuguugguuuucaccuuggauauucuaaaugacuacuucauaaucuguucuucaguguugagguuacaguaugagauugccaguuugcuguagguaaggaaagucaaccuucccucuuccucugcacuaaucugaugagaacugaucuuuugaaugcuugaagcugcauucuggcuaaguggugcuuguuuaaacguacugauguuuuaaaacaugguaucuuuuuaaaauuuucaguuccaagaacccagaggaggcagaacuagaagacacacucaaucaagugguaagugcuucaugagcauacccauuuccaguagcuguguauuucacaagcuguuuguaauguuauuuguagauggccucugaaaugugaaaaguaauaaucauugauuuuauuuugaaucucugguuuuacuuccuaaauugaguuacuacuuuuagcauucauacuuuucucauuaauacucagucaguccaacucacugaauuaagggacucacaaaacuuucaagacucuggaguggagauuuugccaucauaaacguuggcguacagaccugcccaaagccaaaggcacaucuuggcuccuggcuuguggccggugacagucagcucugcacuguuggcuugugugugugcugguuaaguguguugucucgguggcuuugccagaugguugucuucaaguacauagaagacaaagacguauuucagaaguucuaugcgaagaugcucgccaagaggcucguccaccagaacagugcaagugacgaugccgaagccagcaugaucuccaaguuaaaggugaguuucaucuuuuccugaaaaaucccagcuucugagucauuauuaaaacagcucuauggccgagcgcgguggcucaugccuguaaucccagcacuuugggaggccgaggcgggcagaucacgaggucaggagaucgagaccauccuggcuaauauggagaaaccccaucucugcuaaaaauacaaaacauuagccgggcaugguggugggcgccuguagucccagcuacuugggaggcugaggcaggagaauggcaugaacccgggaggcagagguugcggugagccgagaucacaccacuacacuccagccugggcaacagagugagacucugucucagaaaaaaauaaaaaagcucuuagucucuccagguuaugaggcaggcagaggaguuugugcagugguuuguacaagaagcucugccacugcucuucugaaagccucccacaacuaucacucuacucucguugggccccggugccuucccaaccccuuccccaccccacuguggggcuuccauccuacccaggccuggcugggcucagcucaccaucuguggggccucuccugccucccacaccuuuagccuugcagcacauucacacuuccacacugugcuggccuggagcugaguggagguuuuguuugcucugggcuugguuacuuugcugucacgcagcccuuccucugccaccuccuuugcgugccugugugucggcgcugucgagugcucuuaucugacuugggacauacuuuacuuuggccccaaauuauguagguaucuuugucagcgugggcugccaugacggaauaccauagaccagguagcuuaaacaacagaaauaguuucucacaauucugggggccacaaguccgagaucagggugccagcugauucgguuccuggugcaggcccucuuccugcuuuguaggcagccaccuucuugcagugccucacgugucagagagagagugcagagcucuugcacaucucuuacaagcacaccaaucccauugugaggccccaugcucaagaccgcauaccuccacacagcaucacguuggagguuugggcuucaacauagggauuuugggggcacacaguucagcuucugguaagagauagagacagauuauuucaucauuguauucuaccagugucaggacaccuugcucuuaaaugcucacaaauuguguaugaauugugugugugaacacuucacugugcaacauagaguugugggguuuuuugacaguguauuaauauuaauccaugcauauuuguacuguaaaauauagcaaaauguuacuagcuuugcuaguaguuccauauaauuaaguauauauuguauacucugauuucucuaagauucccuuguauacauuuguauuuuuguacaaauuaauaagacagucaucuggguucuucucagcaagcuugcggguucgaguacaccucuaaacuucagcgcauguuucaagacauuggcgugagcaaagaucugaacgagcaauucaaaaagcacuugacaaacucagaaccccuagacugugaguauccgugugucucuauguuguguuuacaggcagaguucucuguagcaaaugaagaaaugacaaaauauuaggugaagaugggaggggcuuugucagaaauucaagaacuaagaagcgggagauuccucccaaaugcccagcccuccucccccgacucccgugugacauuaggagaugacaacccuugaaguggugucagcucuacuggggcaaggucaccaccuguugggaucuggggagggacucacaggcgugguuuugucuuguaaaccuuagcuuggauccauucuagcauuuauuuuaauguucacuuggccugcauagguaacagucaagcuaaagaccuguggcuucagacugggauuagggaucaguacaggcaggugcaggugauucaguucuccaggagaggcagcugggcugguauuuuagggccuugcauaguaguaggauggcggauuuaugcuuacaucaucuuuugaucaucuuugucuuuuuaaaugaaaaauggagaauuuuauuuuucccaaaucagaaugacaauucuauuguaaaacuggacaguuuugccagugggcuuuuuaacuaucugcgaagaugaaauuacuguuauaauuuauagaccauguguggcguuucccaguaauaagugaaacauacacuauaaugaaguuagcgguuuucuccugcuugugaguuugcaugagucuggggcugugaugaugccgggccuggcaagcacaggcguggcuugaguggacugagugauucaggacagaaaaggaaagcaagggaagcagggcaggcgugugacagcagaauuccgagguggaagcaaaaugaagacucucacucuuuggaagaaaagaguaucuggcucuugcacuuuuugcuaauuuuaauugaauaaaauguucaauucuuaauuuuauauucaagcaggauuuuuauuuaaugugcuuuuuaauaaagagcaauccacauucaucugaaaugauugaauuuuucaguuuauaaacuaauuaauguauuccagaauguucacucuccccucucuuccgucccacaguggauuucagcauucaagugcugagcuccggguccuggcccuuccagcagucuuguacauuugccuugccgucagagguaaggauggguuugucugccaucccauuagugcuaaguggaggguggggcagggcagccuucacuguggaaggggacaggccugcagauggccuuccugcuggcuggcugcaucacggugaaccaugggggcaacacucagggaagagcccugugcaguggggcaggucuggaugucuaaaggugggcugucugucccagcucuacagacauguuuccuuaucuuguaaagcagaaccuaauuaguuguguaaugaacaccucgauggaccugcuggucuugaaguacaaaccuuuuuuaagauuguaccuuccagugcuuaaagugcuuuacaagagaggcagacaccuggcguuuguauuuuacuuuuauguaagcacugacuuuguacuguaagcuuggaacagugggcuuuacuuagaaacgcugccuguaggauguggugagaucuguauuccauauaaugcuguccuuuuaucuaguuggaacguaguuaucagcgauucacagcuuucuacgccagccgccacaguggccgaaaauugacgugguuauaucaguugucuaaaggagaauugguaacuaacugcuucaaaaacagauauacuuugcagguaagaucacauuuuuaucuuaaaauuuuucuauucuaaaugaacauaaggcaaauuauggaaaucauuaucagcugacucagcagcagaaucuagaauucagcuucuggugaaauaguggcagguuuaaagcauggaguuguaagaaucagaugaaccaaauuccaauucuuucuggcuggggagcaaguuauuuaaugauugugagccucaguuuucuccuccauuaaugggaguguuaguacuuuauaguugggaauugaugugaaaauuaaauaauguauuuaguaaguguuuggcaccgcuccugccugacacacaucagcuguucagguagugacuucaaaagcuggaguugcaugcauuucauuauaucagcucuccaccuuacacagagcacuuucacauuaauaacacucagugcugacaacaauauugaguacaaccuaauuuauaccuauguaacuaagaauauuuccauuucuuagaggagaaaacugaggcuuggguuaauuuaagugaauuucucugaauccuagcuuauauguagcugagccaaaauuucaguuaaagucuuuucucuuaaagucuaggcuugggcuggugugguggcucacgcuuguaauccucacgcuuugggaggcugagaccagagaaucacuugaggcuaggaguuugagacaagccuggacaacauagcaagaccccaucucuagauauuuuuuaaaguaaaaagaaaaaaaaguccaagcucuuucuacuuccacuuuuguacugaguggucuucacaaguaauggcauauuuuagucucugagaaguuuucaccagugaguuucuaagaagaauugcaaaucuguguuuaaguauuaagaaacuccagaauggguuguucugcagacucaagcugcucauuaauuuaaacuuuucguaaaucuacugugacuuaaaauuguuaaaaugcauaguauuaugcuggcuccagaggucuuuaucaacuugaauguuucuuacuauacaauugaaauuuuguuucauuuauccccaaauauacauagaagaauccauguguuccacuacaguaccuggaauuucaguguccaguuuuugacgguggaggcuuugccuagggugugucugccguguuaaggcagcccggagcgggcccaauagaaaacauuagcaacacgcucguucccuuguaucucuguucaaggcccuggaagcaguguugucugugggccgcccugaaacaggcauguggcguuuuuuguuucucuuuccauugaccaaggucuugccgagaggcaagcagugacugacagucaugggucauuacuuguugcugucgauuaugcaagaaaacagggagaagagaaggaaggcguccucgggguguucauucgcuugcacacacucagcaaucaggaaccaacacgugcuaccugucuuuuagaagauacuuuagggccgggugcaguggcucagccuguaauccuagcacuuugggaggccaaggcaggcagaucacaaggucaggaguucgagaccagccuggccagcauggcgaaaccccaucucuacuaaaauacaaaaauuagcugggugugguggugcacgccuauagccccagcuacucuggaggccaaggcaggagaaucccuugaaccugggaggcggagguugcagugagucgagauugugccacugcacuccagccugggugacagagcaagacuuugucucaaaaaaaaaaaaaaauagaaauuuaguacacuugccauuucauacuuuacuuacuuuuuucauacuuucauaguaaaguacuuaggauuagaaaaccaaauauaauuugauauuuguguuguuuuacaucaauaaugugccaaaagauaauauuccuuagcucaugugccaaaaacagauuuggagauugaugcuuaacauguccauauauaccagguguguguauaugugauugucucuauaaaugcguggggacguaucuauaguauguauccacauagacaauacguuuuuuaaaaaaaacccucaaauuauuuuaauguuuguaaacauggaaaaugaaugacuuugggaaaauguugcauuguaguggcauugccacguuuuauauucccuuuuaaauagaucugugcuuuuuuuguacuuguuuaaagaauuuguuucauaaauaaguucuucaaacuugggcuguauauuuugggagguguuuccaugcauguaaauuuuccuucuuuuucuuuuauauggggggccgcaaaggcgucgacauuccagauggcuauccugcuucaguacaacacggaagaugccuacacugugcagcagcugaccgacagcacucaaauuaaaaugguauucucaucucaggcucguuguucuaucagcuugccguuuccuuguucucguggauauuguuaggaaagauaaggaagaggauaugggcaucuuuaauuugaaauagauguuugccucaugaauaugaauauggccuuauuccaggauuuuaauacgcacuacaaaaagcuucauguuaaaacucauuguugagccaggcaugguggcacaugccuguagucccagcuucuugggaggcuggggcgggaggaucacuugagccugggaggucgaggcugcagugagcuaugaucgugccacuguacuccagcgugggugacagagacccugucucuuaaaaauaaaacuacguguaacacacacacacauacuccucauccaugcuuuucucucauucauuuaaccaguuaggcuuuucuuacuaagcuuaaauuuccacuuuaguauuauuuuuccugcuagccauauuuuuuauugagauauauuuuagauaauaaaauuugacauaacauaaaagucauuuuaaaguguacaaagugguuuuuaguauauucacaagcuuauagaacuaccaccauuauccaauuccagaguguuuuaucaccccaaaaagaaaccugcacccauuagcaguaacugcccgcuagcucccagccccugacaaccauuaauuugcuaucaauuugccuacuccagacauuucauauaaauggaaucauauaacacaugacuuucugugccugccuucuuucccucaguguauacuguuugcaagguuugcccauguucuagcauguguugguacuucauuucuuuuuguggucgaauaauccaauguauagauggaccacauuuuauuuguucaucaguugauguacauuuaaguuguuuccaauuaugaacaaugcugcugugaauacauguuuucaauuuuccuggguauauaccuagguauagaauugcugagucauguaauagcugaauuuuuugaggcacugccagacuguuccauaguggcugugccauuucauauucucaccaacaguguaugaaacuuucaguuucuccauauccucaccaacauuuguuauuuucauuuuuaaaaaaaauuauagccaucccaguggaugugaaguaguaucuugcaguuuuugacuugcauuucucuaacaacuaaugauguguagaaucuuuuuuguguuuauugccauuuguauaucuucuuuggagaaauguuugaucaaauucuuugcccauuuuucaguuggguuauuugucuuuuuguuguugagucguaagaauucuuuuaauauucuguauacuagauccuuaucaaauauguaauuuacaaauguuuuuucccauucuguggguugucuucuuacuuucuuauauacacacauuuuuaauuuugaugaagccuauuuuaucuauuuuuucuuuauauuguuugugguuuuggugucauuuuuaaggaaucauugccuagucugaggccaaggacuauucucucccuauuguuuggugcuggcaaacuugucaaaagucaguuggccauagguauauauggguuuauuucuggauucucaauuauuuuccagugaucuguauaucuuuacuaugccaguaucacacugucuggauuacuguuguuuugcaguaaaucuugaaaucgagaccccuaacuucguuuuauuuucccccaagauuauauuggcuauucuggaucccuuauguuaccuuaugaauuucaagaucagcuuguccauuucuacaaaaagugcaguugagauuuugauaaggauugcacugaaucuauagauugcuuuggggaguauugccaucucagcaguauuuuaagucucccacuccaugaacaugggaugucuuuucaucuauuuagguugucuuuucuuucaacugugucucaugguuuucaguguaugcaucuucuacuacuuucaauuuauuccuaguuuauucuuuuugaugcuauuauaaauggaauugguuuuuaguuuuuuaauugagacggagucuugcucugucuccuaggcuggagugcaguggugcaaucuuggcucacugcaaccuccgccuccuggguuccagcaauucucccaccucagccucccaaguagcugggauuacaggcgugcgccaccaugccuggcuaauuuuuuguauuuuuaguacagacaggguuucaccauguugaccaggcuggucuugaacuccugaccucaagugaucugccugccucggccucccaaagugcugggauuauaggcgugagccaccgugccuggcagaguuguuuucuuaauuucacuuuuuucuguuuuuuugagacagggucucuugcucaggcuggagugcaauggugcagucauagcucacugcgguaucaaaugauccucucuccucagccuccugaguagcuggcacuacaggcgcuugccaccaugcucagcuaauuuuuguauuuuuuguagagaugguguuucacuguguugcccagauuggucuugaacuccugggcucaagugacacuuucaccuuggccucccaaagugcugggauuacacaggcaugagccaccaugccagccuguuccacuuucugauugcucguugcuaauguauagaaguacaacuaaguaccgcagggugugguggcucacgccuguaaucccagcacuuugggagcccgaggcgggcggaucacgaggucaggagaucgagaccauccuggcuaacauggugaaacccagucucuacuaaaaauacaaaaacaaaauuagccgggcgugguggcaggugccuguagucccagcuacucgggaggcugaggcgagagaauggugugaacccaggaggcgcagcuugcagugagcccugauugcgccacugcacuccagccugggcgacagagcaagacucugucucaaaaaaaaaaaaaaaaaaagguacaacuaauuauuguauuuugauucuguuuccuauaacauugcuaaauguuuauuagcucuaauuuauuagcucaaauaguuuuuggggggauuccuuagaguuuuuugauauacugucauaucaucuauaaauacaggcaguuuugcuucuuccuuuucuuauuuggcugccuuuuauuucuuuuuuguuugucuuuguuuuugccugauucuucuggcuagaauuuguggcaagaacaagcauccuugucuuguuacugcccuuauugggaaagcuuccagucuuuuacuguuuaacugugauguuaaagagugaugguguuagcugugagcuuuuacuagauguccuuuaucagacuaaagagguucccuuuuauucuuaguuuauugaauuuuguaucaugcaagaguguuguauuuugucaaaaugcuuuuucuacucugucaaaauaacugcuuuuuugucuguuaauaugguguauugcacugauguugaaccacccugguguucuuagggugagucccacuuggucaugguauauaauccuuuuucuauguuguuggguuuagcuugccgguauuuucucgaguuuugcauuuauauucauaagggauauugcuccauuguuuucucaagauguucguuugguuuucgugucuggcuaauccuggccuuauggacugaguuaggaaagucauuuugaaugacuauuuuguaaucauucuucgaauuacuccuaaauauaucuucagauucuaauaacaaaaugaguuugugccuuuguagguuggaggccugguugcccccuagacuguggggagggcugugcagacggguccugaggacagggcugacagguguggacugucaggucuuugcuuggcugcuucugaucaggauuuuaggccagucuccugagugguucucaguguuagaacucccucaggaggcugccgcugcucucuccuuucugcccacaguagaugcuguccaaucagaccuggcucaggaagugggcacccccgcacccugcucuagaugcagugggcaguauucgaauggcugcuggcaguucugggucaguuacuagacuagagagaggccucucgcuuugacagcuuucaccacguauccucagaccagaauggguacccauuaugacgacaggacuccacugcccguggguuguaagaguccgugugacucugugagugcccucaggcuggucccuuggauuucaugggaucauaaagcugugaggcugaaggagggcugggaagcguuuaccacacccaccauucacagaugagaggccacacaacgugcuugagugcaucaaaggcaaguugacaaggucgccugccgcugagccccacuguucucaugagcaggacauuauuuucagucuugcugggcagcucuuuaauauuucuuuugugaugaucaguguccaagaugagcugucaggcacuuaagaagugaagaguuccugaagauuucauugugcaugguuuccaauacagguucaacaucccuaauccaaaaauccagauuccagaaugcuccacaauccaaacauuuuugagcaccaacaugaugcucaaaaaaaaaaaaaaaaaaugcucauggcgcaguugaaauuucggauuuuccaaucagggcugcugaaucuguaaauccagugcaguauuccgaaauccaaacacuucuagucccaggcauuucagauaaggguuacucaaccugauuuaaguauaacagaauuguucauuucuauuauugugugaucaaggccagaaagggguugauuucacuucuagaagucaggguggaaggaagcaguaaauuuagugaacuucuaagaaguaccaacuuuuuuuuccuuccagcauacucuucuuuugggugauuuuuuuuuuuuuuuuuaauggaaaauggacugugagguugccuguggugguuauugcaaagaaaaaugcauuuucccuuuaacuuccucuuuuucucuuuaauugcaggacauuuuggcgcaaguuuuacagauuuuauuaaagucgaagcuauugguagguuugcgcccuuuuaucuuacacuagaagaagccuuuuccugagauuguagaguaacaauuguuuucuuacaggucuuggaagaugaaaaugcaaauguugaugagguggaauugaagccagauaccuuaauaaaauuauaucuugguuauaaaaaguaagaaaaaucuaauaaguagauggcccuugaccauagacacgucccccgggagcccuagcacggaucucaguauuguuacaaaccaagggagaccggggacucagugugaagcgacaggcacuaggcugggagugugagguaggccuuugauuccauucagcgagccugauguuucuccaauucugagcuucugggauuuuuauuauuuuggcaaauaagucuccuuaaauggcucaccaagaaaguuuggaccuuuguguccaaguggcuugauuuuaucucacuugacaaaauuugggagagcagauuagggaccuggauuuucuguaauguggaugucccuguuaauggccgaguaggaaacuaggccaugaucggacucuacccagugcuggguagaggacauuuucacggagagcucacagaaaucaacauucuccccucugucuagggaagcagggcacuucuuaaagguugaaaaauagaaagcagccuucacugccuaccuuuuaauauaauagugaucgguuuccucauuuuucuugauaguaagaaauuaaggguuaacaucaaugugccaaugaaaaccgaacagaagcaggaacaagaaaccacacacaaaaacaucgaggaagaccgcaaacuacugauucaggugacuuaucuguaugccugugccaggugugcugucccucacgcagggauggcucgcaaggacgggccgugggggguaggcgggggugacaaaggagugauugccagaugaaugggucugugauggcagaagguggcaaggccgagagccagggccuuguuaucugaauuaguccuuuaugucaccaggcaaaacagggcaguccucuugcucuaaauguuggaaagcaaacauuguggcagguuuggcugaaaugagggggaaggagaguucuucaguggggaggaugggcagcuuccguggccuugaagauuuaauuuugucuccuuuuuuuuaaugcuuuaugguugaguuaaauuauugagguaaaauugcucaaaagacccaaacauuguaauguuugccacguuagaguugaaacauaggcagguagaauugguucccucucccgucucaccugcaggauguuuguugccuguuaggaaauugugauccugugcauaggcgucggcagccucugugcagcuuguccuuaacuaucaauacaacguuguuacagcucuaaaugcacuucuuuuuccuuaucuuguugcauaggcggccaucgugagaaucaugaagaugaggaagguucugaaacaccagcaguuacuuggcgagguccucacucagcuguccuccagguucaaaccucgagucccugugaucaagguacaggacuuuacauagcagucacauuccuuucuuaauuuagaagauaaaagauguagcaaaaaguggauugauugcuguagcaugaaggaggagggagcuggcuucuuuguauguagauuucuauaaaagaaagucggcuucaguuuaacuguugaaacacacauacaaagugcacagaugaugaagugccagcuugaugacuuucacagucaauacacugugugaucagcacccagguaagaauugaaacaugcccggcaucccggaagcccacccaccccagccagcaccugugucccauagaaaaucacugucgugucuucugacaccauaaaacaguuuugccugcuuuugcgugauacauaaacagauucuagagcacacacucccgugccugguaagaauuuccucagcaguaucuucgggagguucgucgcauugcgguaucgagaagcacugggucguuuuuguugcuuuuauggguguuguguuaugggaacacaccuuccuuuauguagccuacugauaauugacauuuugcuuauuucugauuggguuuguuuaaaaugguaacuaagcaggacuuuccuuuuccuaaaccacuuggguaagucacagccaguggagagacucagggguggcauugacaggugacuuccccaacaggcaggaggcccagugucccuccuggguuacauuuggcacaggugccaguucguucauggcuguucagggaguuccccacaguccccuguucccuguucauggccucuucuugugagacugaguccugccgcagaggcaggcagauuuuggugguagaaagggagacuggcccacggggcucccgaagcaccugacuccaguuccuagggcgggugcaggagggacucggagucacccucagcaagugucagggagcuccgugcaugaaggcuuagcugccaggaaguaaaacucuaugcuaacagaucuggggcggggacacugcuccccacugagcuccgaaucaggggagauuuguggugggggcagccucucucuguucugaugauaauuuguguuuuucuucucuuucacuaccucuuccuuuuuaaaaauaacacccagaaaugcauugacauucuaauugagaaagaauauuuggagcgaguggauggugaaaaggacaccuacaguuacuuggcuuaacccuucuggaagggucugacugugugacccgcagcaaauaguucauguuggaaagaaugaaaacaacucaaguucauagcagccagccugccgccauuggaccucccuuuuaaaaacugagaccaagacucccaucagcuggucucggauuuacaucggaacugcucaggauugauacauuucaagucuguaaauacggacaccaacgccauuuacccuaauuuaagaacagcggggacugacccuccgugccgagggcugcaugcuaccgcacuaagucaauacaugggcuccccgauucgcagcugucgucuuggcagcacuugucacguuggcagcacuuugagagcaagucugaguggacccacauguaaccugcuaugaaaaccauuuguauaguguguuucauuuuuuaaugugugaaaauaaagaaaauuaaaggauuucuguacaagucgcauuggguuuuguuuuaaguuuuacuaauuucuauauguaaauaaaagauauaaugauugugcaaauuua

SEQ ID NO: 193014 - RNA, 102270 nt, Homo sapiens
uaaauuugcacaaucauuauaucuuuuauuuacauauagaaauuaguaaaacuuaaaacaaaacccaaugcgacuuguacagaaauccuuuaauuuucuuuauuuucacacauuaaaaaaugaaacacacuauacaaaugguuuucauagcagguuacauguggguccacucagacuugcucucaaagugcugccaacgugacaagugcugccaagacgacagcugcgaaucggggagcccauguauugacuuagugcgguagcaugcagcccucggcacggagggucaguccccgcuguucuuaaauuaggguaaauggcguugguguccguauuuacagacuugaaauguaucaauccugagcaguuccgauguaaauccgagaccagcugaugggagucuuggucucaguuuuuaaaagggagguccaauggcggcaggcuggcugcuaugaacuugaguuguuuucauucuuuccaacaugaacuauuugcugcgggucacacagucagacccuuccagaaggguuaagccaaguaacuguagguguccuuuucaccauccacucgcuccaaauauucuuucucaauuagaaugucaaugcauuucuggguguuauuuuuaaaaaggaagagguagugaaagagaagaaaaacacaaauuaucaucagaacagagagaggcugcccccaccacaaaucuccccugauucggagcucaguggggagcaguguccccgccccagaucuguuagcauagaguuuuacuuccuggcagcuaagccuucaugcacggagcucccugacacuugcugagggugacuccgagucccuccugcacccgcccuaggaacuggagucaggugcuucgggagccccgugggccagucucccuuucuaccaccaaaaucugccugccucugcggcaggacucagucucacaagaagaggccaugaacagggaacaggggacuguggggaacucccugaacagccaugaacgaacuggcaccugugccaaauguaacccaggagggacacugggccuccugccuguuggggaagucaccugucaaugccaccccugagucucuccacuggcugugacuuacccaagugguuuaggaaaaggaaaguccugcuuaguuaccauuuuaaacaaacccaaucagaaauaagcaaaaugucaauuaucaguaggcuacauaaaggaagguguguucccauaacacaacacccauaaaagcaacaaaaacgacccagugcuucucgauaccgcaaugcgacgaaccucccgaagauacugcugaggaaauucuuaccaggcacgggagugugugcucuagaaucuguuuauguaucacgcaaaagcaggcaaaacuguuuuauggugucagaagacacgacagugauuuucuaugggacacaggugcuggcuggggugggugggcuuccgggaugccgggcauguuucaauucuuaccugggugcugaucacacaguguauugacugugaaagucaucaagcuggcacuucaucaucugugcacuuuguauguguguuucaacaguuaaacugaagccgacuuucuuuuauagaaaucuacauacaaagaagccagcucccuccuccuucaugcuacagcaaucaauccacuuuuugcuacaucuuuuaucuucuaaauuaagaaaggaaugugacugcuauguaaaguccuguaccuugaucacagggacucgagguuugaaccuggaggacagcugagugaggaccucgccaaguaacugcugguguuucagaaccuuccucaucuucaugauucucacgauggccgccuaugcaacaagauaaggaaaaagaagugcauuuagagcuguaacaacguuguauugauaguuaaggacaagcugcacagaggcugccgacgccuaugcacaggaucacaauuuccuaacaggcaacaaacauccugcaggugagacgggagagggaaccaauucuaccugccuauguuucaacucuaacguggcaaacauuacaauguuugggucuuuugagcaauuuuaccucaauaauuuaacucaaccauaaagcauuaaaaaaaaggagacaaaauuaaaucuucaaggccacggaagcugcccauccuccccacugaagaacucuccuucccccucauuucagccaaaccugccacaauguuugcuuuccaacauuuagagcaagaggacugcccuguuuugccuggugacauaaaggacuaauucagauaacaaggcccuggcucucggccuugccaccuucugccaucacagacccauucaucuggcaaucacuccuuugucacccccgccuaccccccacggcccguccuugcgagccaucccugcgugagggacagcacaccuggcacaggcauacagauaagucaccugaaucaguaguuugcggucuuccucgauguuuuugugugugguuucuuguuccugcuucuguucgguuuucauuggcacauugauguuaacccuuaauuucuuacuaucaagaaaaaugaggaaaccgaucacuauuauauuaaaagguaggcagugaaggcugcuuucuauuuuucaaccuuuaagaagugcccugcuucccuagacagaggggagaauguugauuucugugagcucuccgugaaaauguccucuacccagcacuggguagaguccgaucauggccuaguuuccuacucggccauuaacagggacauccacauuacagaaaauccaggucccuaaucugcucucccaaauuuugucaagugagauaaaaucaagccacuuggacacaaagguccaaacuuucuuggugagccauuuaaggagacuuauuugccaaaauaauaaaaaucccagaagcucagaauuggagaaacaucaggcucgcugaauggaaucaaaggccuaccucacacucccagccuagugccugucgcuucacacugaguccccggucucccuugguuuguaacaauacugagauccgugcuagggcucccgggggacgugucuauggucaagggccaucuacuuauuagauuuuucuuacuuuuuauaaccaagauauaauuuuauuaagguaucuggcuucaauuccaccucaucaacauuugcauuuucaucuuccaagaccuguaagaaaacaauuguuacucuacaaucucaggaaaaggcuucuucuaguguaagauaaaagggcgcaaaccuaccaauagcuucgacuuuaauaaaaucuguaaaacuugcgccaaaauguccugcaauuaaagagaaaaagaggaaguuaaagggaaaaugcauuuuucuuugcaauaaccaccacaggcaaccucacaguccauuuuccauuaaaaaaaaaaaaaaaaaucacccaaaagaagaguaugcuggaaggaaaaaaaaguugguacuucuuagaaguucacuaaauuuacugcuuccuuccacccugacuucuagaagugaaaucaaccccuuucuggccuugaucacacaauaauagaaaugaacaauucuguuauacuuaaaucagguugaguaacccuuaucugaaaugccugggacuagaaguguuuggauuucggaauacugcacuggauuuacagauucagcagcccugauuggaaaauccgaaauuucaacugcgccaugagcauuuuuuuuuuuuuuuuuugagcaucauguuggugcucaaaaauguuuggauuguggagcauucuggaaucuggauuuuuggauuagggauguugaaccuguauuggaaaccaugcacaaugaaaucuucaggaacucuucacuucuuaagugccugacagcucaucuuggacacugaucaucacaaaagaaauauuaaagagcugcccagcaagacugaaaauaauguccugcucaugagaacaguggggcucagcggcaggcgaccuugucaacuugccuuugaugcacucaagcacguuguguggccucucaucugugaauggugggugugguaaacgcuucccagcccuccuucagccucacagcuuuaugaucccaugaaauccaagggaccagccugagggcacucacagagucacacggacucuuacaacccacgggcaguggaguccugucgucauaauggguacccauucuggucugaggauacguggugaaagcugucaaagcgagaggccucucucuagucuaguaacugacccagaacugccagcagccauucgaauacugcccacugcaucuagagcagggugcgggggugcccacuuccugagccaggucugauuggacagcaucuacugugggcagaaaggagagagcagcggcagccuccugagggaguucuaacacugagaaccacucaggagacuggccuaaaauccugaucagaagcagccaagcaaagaccugacaguccacaccugucagcccuguccucaggacccgucugcacagcccuccccacagucuagggggcaaccaggccuccaaccuacaaaggcacaaacucauuuuguuauuagaaucugaagauauauuuaggaguaauucgaagaaugauuacaaaauagucauucaaaaugacuuuccuaacucaguccauaaggccaggauuagccagacacgaaaaccaaacgaacaucuugagaaaacaauggagcaauaucccuuaugaauauaaaugcaaaacucgagaaaauaccggcaagcuaaacccaacaacauagaaaaaggauuauauaccaugaccaagugggacucacccuaagaacaccagggugguucaacaucagugcaauacaccauauuaacagacaaaaaagcaguuauuuugacagaguagaaaaagcauuuugacaaaauacaacacucuugcaugauacaaaauucaauaaacuaagaauaaaagggaaccucuuuagucugauaaaggacaucuaguaaaagcucacagcuaacaccaucacucuuuaacaucacaguuaaacaguaaaagacuggaagcuuucccaauaagggcaguaacaagacaaggaugcuuguucuugccacaaauucuagccagaagaaucaggcaaaaacaaagacaaacaaaaaagaaauaaaaggcagccaaauaagaaaaggaagaagcaaaacugccuguauuuauagaugauaugacaguauaucaaaaaacucuaaggaauccccccaaaaacuauuugagcuaauaaauuagagcuaauaaacauuuagcaauguuauaggaaacagaaucaaaauacaauaauuaguuguaccuuuuuuuuuuuuuuuuuuugagacagagucuugcucugucgcccaggcuggagugcaguggcgcaaucagggcucacugcaagcugcgccuccuggguucacaccauucucucgccucagccucccgaguagcugggacuacaggcaccugccaccacgcccggcuaauuuuguuuuuguauuuuuaguagagacuggguuucaccauguuagccaggauggucucgaucuccugaccucgugauccgcccgccucgggcucccaaagugcugggauuacaggcgugagccaccacacccugcgguacuuaguuguacuucuauacauuagcaacgagcaaucagaaaguggaacaggcuggcaugguggcucaugccuguguaaucccagcacuuugggaggccaaggugaaagugucacuugagcccaggaguucaagaccaaucugggcaacacagugaaacaccaucucuacaaaaaauacaaaaauuagcugagcaugguggcaagcgccuguagugccagcuacucaggaggcugaggagagaggaucauuugauaccgcagugagcuaugacugcaccauugcacuccagccugagcaagagacccugucucaaaaaaacagaaaaaagugaaauuaagaaaacaacucugccaggcacgguggcucacgccuauaaucccagcacuuugggaggccgaggcaggcagaucacuugaggucaggaguucaagaccagccuggucaacauggugaaacccugucuguacuaaaaauacaaaaaauuagccaggcaugguggcgcacgccuguaaucccagcuacuugggaggcugaggugggagaauugcuggaacccaggaggcggagguugcagugagccaagauugcaccacugcacuccagccuaggagacagagcaagacuccgucucaauuaaaaaacuaaaaaccaauuccauuuauaauagcaucaaaaagaauaaacuaggaauaaauugaaaguaguagaagaugcauacacugaaaaccaugagacacaguugaaagaaaagacaaccuaaauagaugaaaagacaucccauguucauggagugggagacuuaaaauacugcugagauggcaauacuccccaaagcaaucuauagauucagugcaauccuuaucaaaaucucaacugcacuuuuuguagaaauggacaagcugaucuugaaauucauaagguaacauaagggauccagaauagccaauauaaucuugggggaaaauaaaacgaaguuaggggucucgauuucaagauuuacugcaaaacaacaguaauccagacagugugauacuggcauaguaaagauauacagaucacuggaaaauaauugagaauccagaaauaaacccauauauaccuauggccaacugacuuuugacaaguuugccagcaccaaacaauagggagagaauaguccuuggccucagacuaggcaaugauuccuuaaaaaugacaccaaaaccacaaacaauauaaagaaaaaauagauaaaauaggcuucaucaaaauuaaaaauguguguauauaagaaaguaagaagacaacccacagaaugggaaaaaacauuuguaaauuacauauuugauaaggaucuaguauacagaauauuaaaagaauucuuacgacucaacaacaaaaagacaaauaacccaacugaaaaaugggcaaagaauuugaucaaacauuucuccaaagaagauauacaaauggcaauaaacacaaaaaagauucuacacaucauuaguuguuagagaaaugcaagucaaaaacugcaagauacuacuucacauccacugggauggcuauaauuuuuuuuaaaaaugaaaauaacaaauguuggugaggauauggagaaacugaaaguuucauacacuguuggugagaauaugaaauggcacagccacuauggaacagucuggcagugccucaaaaaauucagcuauuacaugacucagcaauucuauaccuagguauauacccaggaaaauugaaaacauguauucacagcagcauuguucauaauuggaaacaacuuaaauguacaucaacugaugaacaaauaaaaugugguccaucuauacauuggauuauucgaccacaaaaagaaaugaaguaccaacacaugcuagaacaugggcaaaccuugcaaacaguauacacugagggaaagaaggcaggcacagaaagucauguguuauaugauuccauuuauaugaaaugucuggaguaggcaaauugauagcaaauuaaugguugucaggggcugggagcuagcgggcaguuacugcuaaugggugcagguuucuuuuuggggugauaaaacacucuggaauuggauaauggugguaguucuauaagcuugugaauauacuaaaaaccacuuuguacacuuuaaaaugacuuuuauguuaugucaaauuuuauuaucuaaaauauaucucaauaaaaaauauggcuagcaggaaaaauaauacuaaaguggaaauuuaagcuuaguaagaaaagccuaacugguuaaaugaaugagagaaaagcauggaugaggaguauguguguguguguuacacguaguuuuauuuuuaagagacagggucucugucacccacgcuggaguacaguggcacgaucauagcucacugcagccucgaccucccaggcucaagugauccucccgccccagccucccaagaagcugggacuacaggcaugugccaccaugccuggcucaacaaugaguuuuaacaugaagcuuuuuguagugcguauuaaaauccuggaauaaggccauauucauauucaugaggcaaacaucuauuucaaauuaaagaugcccauauccucuuccuuaucuuuccuaacaauauccacgagaacaaggaaacggcaagcugauagaacaacgagccugagaugagaauaccauuuuaauuugagugcugucggucagcugcugcacaguguaggcaucuuccguguuguacugaagcaggauagccaucuggaaugucgacgccuuugcggccccccauauaaaagaaaaagaaggaaaauuuacaugcauggaaacaccucccaaaauauacagcccaaguuugaagaacuuauuuaugaaacaaauucuuuaaacaaguacaaaaaaagcacagaucuauuuaaaagggaauauaaaacguggcaaugccacuacaaugcaacauuuucccaaagucauucauuuuccauguuuacaaacauuaaaauaauuugaggguuuuuuuuaaaaaacguauugucuauguggauacauacuauagauacguccccacgcauuuauagagacaaucacauauacacacaccugguauauauggacauguuaagcaucaaucuccaaaucuguuuuuggcacaugagcuaaggaauauuaucuuuuggcacauuauugauguaaaacaacacaaauaucaaauuauauuugguuuucuaauccuaaguacuuuacuaugaaaguaugaaaaaaguaaguaaaguaugaaauggcaaguguacuaaauuucuauuuuuuuuuuuuuuugagacaaagucuugcucugucacccaggcuggagugcaguggcacaaucucgacucacugcaaccuccgccucccagguucaagggauucuccugccuuggccuccagaguagcuggggcuauaggcgugcaccaccacacccagcuaauuuuuguauuuuaguagagaugggguuucgccaugcuggccaggcuggucucgaacuccugaccuugugaucugccugccuuggccucccaaagugcuaggauuacaggcugagccacugcacccggcccuaaaguaucuucuaaaagacagguagcacguguugguuccugauugcugagugugugcaagcgaaugaacaccccgaggacgccuuccuucucuucucccuguuuucuugcauaaucgacagcaacaaguaaugacccaugacugucagucacugcuugccucucggcaagaccuuggucaauggaaagagaaacaaaaaacgccacaugccuguuucagggcggcccacagacaacacugcuuccagggccuugaacagagauacaagggaacgagcguguugcuaauguuuucuauugggcccgcuccgggcugccuuaacacggcagacacacccuaggcaaagccuccaccgucaaaaacuggacacugaaauuccagguacuguaguggaacacauggauucuucuauguauauuuggggauaaaugaaacaaaauuucaauuguauaguaagaaacauucaaguugauaaagaccucuggagccagcauaauacuaugcauuuuaacaauuuuaagucacaguagauuuacgaaaaguuuaaauuaaugagcagcuugagucugcagaacaacccauucuggaguuucuuaauacuuaaacacagauuugcaauucuucuuagaaacucacuggugaaaacuucucagagacuaaaauaugccauuacuugugaagaccacucaguacaaaaguggaaguagaaagagcuuggacuuuuuuuucuuuuuacuuuaaaaaauaucuagagauggggucuugcuauguuguccaggcuugucucaaacuccuagccucaagugauucucuggucucagccucccaaagcgugaggauuacaagcgugagccaccacaccagcccaagccuagacuuuaagagaaaagacuuuaacugaaauuuuggcucagcuacauauaagcuaggauucagagaaauucacuuaaauuaacccaagccucaguuuucuccucuaagaaauggaaauauucuuaguuacauagguauaaauuagguuguacucaauauuguugucagcacugaguguuauuaaugugaaagugcucuguguaagguggagagcugauauaaugaaaugcaugcaacuccagcuuuugaagucacuaccugaacagcugaugugugucaggcaggagcggugccaaacacuuacuaaauacauuauuuaauuuucacaucaauucccaacuauaaaguacuaacacucccauuaauggaggagaaaacugaggcucacaaucauuaaauaacuugcuccccagccagaaagaauuggaauuugguucaucugauucuuacaacuccaugcuuuaaaccugccacuauuucaccagaagcugaauucuagauucugcugcugagucagcugauaaugauuuccauaauuugccuuauguucauuuagaauagaaaaauuuuaagauaaaaaugugaucuuaccugcaaaguauaucuguuuuugaagcaguuaguuaccaauucuccuuuagacaacugauauaaccacgucaauuuucggccacuguggcggcuggcguagaaagcugugaaucgcugauaacuacguuccaacuagauaaaaggacagcauuauauggaauacagaucucaccacauccuacaggcagcguuucuaaguaaagcccacuguuccaagcuuacaguacaaagucagugcuuacauaaaaguaaaauacaaacgccaggugucugccucucuuguaaagcacuuuaagcacuggaagguacaaucuuaaaaaagguuuguacuucaagaccagcagguccaucgagguguucauuacacaacuaauuagguucugcuuuacaagauaaggaaacaugucuguagagcugggacagacagcccaccuuuagacauccagaccugccccacugcacagggcucuucccugaguguugcccccaugguucaccgugaugcagccagccagcaggaaggccaucugcaggccuguccccuuccacagugaaggcugcccugccccacccuccacuuagcacuaaugggauggcagacaaacccauccuuaccucugacggcaaggcaaauguacaagacugcuggaagggccaggacccggagcucagcacuugaaugcugaaauccacugugggacggaagagaggggagagugaacauucuggaauacauuaauuaguuuauaaacugaaaaauucaaucauuucagaugaauguggauugcucuuuauuaaaaagcacauuaaauaaaaauccugcuugaauauaaaauuaagaauugaacauuuuauucaauuaaaauuagcaaaaagugcaagagccagauacucuuuucuuccaaagagugagagucuucauuuugcuuccaccucggaauucugcugucacacgccugcccugcuucccuugcuuuccuuuucuguccugaaucacucaguccacucaagccacgccugugcuugccaggcccggcaucaucacagccccagacucaugcaaacucacaagcaggagaaaaccgcuaacuucauuauaguguauguuucacuuauuacugggaaacgccacacauggucuauaaauuauaacaguaauuucaucuucgcagauaguuaaaaagcccacuggcaaaacuguccaguuuuacaauagaauugucauucugauuugggaaaaauaaaauucuccauuuuucauuuaaaaagacaaagaugaucaaaagaugauguaagcauaaauccgccauccuacuacuaugcaaggcccuaaaauaccagcccagcugccucuccuggagaacugaaucaccugcaccugccuguacugaucccuaaucccagucugaagccacaggucuuuagcuugacuguuaccuaugcaggccaagugaacauuaaaauaaaugcuagaauggauccaagcuaagguuuacaagacaaaaccacgccugugagucccuccccagaucccaacagguggugaccuugccccaguagagcugacaccacuucaaggguugucaucuccuaaugucacacgggagucgggggaggagggcugggcauuugggaggaaucucccgcuucuuaguucuugaauuucugacaaagccccucccaucuucaccuaauauuuugucauuucuucauuugcuacagagaacucugccuguaaacacaacauagagacacacggauacucacagucuagggguucugaguuugucaagugcuuuuugaauugcucguucagaucuuugcucacgccaaugucuugaaacaugcgcugaaguuuagagguguacucgaacccgcaagcuugcugagaagaacccagaugacugucuuauuaauuuguacaaaaauacaaauguauacaagggaaucuuagagaaaucagaguauacaauauauacuuaauuauauggaacuacuagcaaagcuaguaacauuuugcuauauuuuacaguacaaauaugcauggauuaauauuaauacacugucaaaaaaccccacaacucuauguugcacagugaaguguucacacacacaauucauacacaauuugugagcauuuaagagcaagguguccugacacugguagaauacaaugaugaaauaaucugucucuaucucuuaccagaagcugaacugugugcccccaaaaucccuauguugaagcccaaaccuccaacgugaugcuguguggagguaugcggucuugagcauggggccucacaaugggauuggugugcuuguaagagaugugcaagagcucugcacucucucucugacacgugaggcacugcaagaagguggcugccuacaaagcaggaagagggccugcaccaggaaccgaaucagcuggcacccugaucucggacuuguggcccccagaauugugagaaacuauuucuguuguuuaagcuaccuggucuaugguauuccgucauggcagcccacgcugacaaagauaccuacauaauuuggggccaaaguaaaguaugucccaagucagauaagagcacucgacagcgccgacacacaggcacgcaaaggagguggcagaggaagggcugcgugacagcaaaguaaccaagcccagagcaaacaaaaccuccacucagcuccaggccagcacaguguggaagugugaaugugcugcaaggcuaaaggugugggaggcaggagaggccccacagauggugagcugagcccagccaggccuggguaggauggaagccccacagugggguggggaagggguugggaaggcaccggggcccaacgagaguagagugauaguugugggaggcuuucagaagagcaguggcagagcuucuuguacaaaccacugcacaaacuccucugccugccucauaaccuggagagacuaagagcuuuuuuauuuuuuucugagacagagucucacucuguugcccaggcuggaguguaguggugugaucucggcucaccgcaaccucugccucccggguucaugccauucuccugccucagccucccaaguagcugggacuacaggcgcccaccaccaugcccggcuaauguuuuguauuuuuagcagagaugggguuucuccauauuagccaggauggucucgaucuccugaccucgugaucugcccgccucggccucccaaagugcugggauuacaggcaugagccaccgcgcucggccauagagcuguuuuaauaaugacucagaagcugggauuuuucaggaaaagaugaaacucaccuuuaacuuggagaucaugcuggcuucggcaucgucacuugcacuguucugguggacgagccucuuggcgagcaucuucgcauagaacuucugaaauacgucuuugucuucuauguacuugaagacaaccaucuggcaaagccaccgagacaacacacuuaaccagcacacacacaagccaacagugcagagcugacugucaccggccacaagccaggagccaagaugugccuuuggcuuugggcaggucuguacgccaacguuuaugauggcaaaaucuccacuccagagucuugaaaguuuugugagucccuuaauucagugaguuggacugacugaguauuaaugagaaaaguaugaaugcuaaaaguaguaacucaauuuaggaaguaaaaccagagauucaaaauaaaaucaaugauuauuacuuuucacauuucagaggccaucuacaaauaacauuacaaacagcuugugaaauacacagcuacuggaaauggguaugcucaugaagcacuuaccacuugauugagugugucuucuaguucugccuccucuggguucuuggaacugaaaauuuuaaaaagauaccauguuuuaaaacaucaguacguuuaaacaagcaccacuuagccagaaugcagcuucaagcauucaaaagaucaguucucaucagauuagugcagaggaagagggaagguugacuuuccuuaccuacagcaaacuggcaaucucauacuguaaccucaacacugaagaacagauuaugaaguagucauuuagaauauccaaggugaaaaccaacaggagauauuuauaaaacauuuccaaaaacauucugaagaaguuugccuuuaagauaauccacuuaaacuucaguaaaggaaauucacuuuaccaauugcuuucuagucugcuguaauuuaacuuuggagaaauaaaaaggcacauagauucccuuucauggcccagucauuaaagaugaugaagggguuuaaauuccuacuaaacugcugcccucuguaguuguauauacaagagaugauuguccuuuaacaacugauucauucuaugaacaaauaauaauucaaaggugaauuaaagguagaugaauuuuuguacaggucuuuucuacaagacugcuuuauaaacaagacccccuaauucauauaaaacgaaucagccaccacagaaacucugaagaggugucuccaacuuuagaaaaguugguucagaaaacccaacccuauucuuggcacucuugggucagggguguuccucuucccuuggagcaguuuaacuuagugccucccugacuccacucacccaacacacgcucauuaaagaggugcuguggaaaugucucugccauucugucugcaucaguggccuuaacuaguaucaguagacuugacgagggacauuuaugaaaagacaaaggauaaaaaggacacuaaggccaggugugguggcucacaccuguaaucccagcacuuugggaggcugaggcggguggaucacuugaggucaggaguucgagacgagccuggccaacauggugaaacccugucucuacuaaaaaaaaaaaaaaaaaaaauuagccgggugugguggcacgccuguagucccagcugcucaggaggcuaaggcaugagaaucacuuaaacucaggaggcagagguugcagugagccgagauugugccacugcacuccagcaugggcgacagaguaagacuaagucucaaaaaaaaaaggacacuaaguguucugucaaacaaacugaaugaagacccaguggaguaucuccauagucauaacaugcagcccccuaaaaugaaaccaagucaucagaggccuuccaauuuaaaguccccucucauuucuggagaggaucugaucgcaauuguuaaauuacacauuaaaccaggaauaaauacuccuguuuauugcaauaaacaggaaaaaaaaaucaaacacucagaguuucucacuggccuuggguaaacugcguuaagagaaagcuauugaccuucaucaaauguuuucccaucauuuaccaaaaaggucacauaguugguacaugguucucuguuaauguaguaaauuacaucagacuugguacugcuggguuauccuuauguuccuagaaagcuauacuauguuuugaagaauuauuauuuaguucacugggaaaucuggcuuguuaauauuuuacuuaagauuucuacaacucuauucucaagugacacuuguuuguagucuuuucauucugguauguggguauuucucggucuuuuuuguaucgggguuaugcuagccuucaagagcuguuuaaaauauaauuuauuaauaucaaaaccaauauaauuuuggcguguggaaaacuauugcaacagaaagccagaaggagauuagcuuccuucauuaaaaucuuuaaaacuuauuguugugauaucugaaauagagcauuucuaaacugaaggaaacuuaaagugaaagagaagcugagaaaaaccagaacacacaaacaaaaaacucaaugagaacuucaaaaaacacacgcagaggagaaagcuauauauuauauugcuuccagaucuuaauacacauaaauugauuagaaaacaucaauugagaaauaagauucaaaaguaaagaauaugaaacagcaacaaaaacucaucuaacaaaaauaaauuuaaaacuacacagaauaacaaaggcaaucuacggccauaccacucugaacugaacgugcccgaucuugucugaucucagaagcgaacaggguggggccugguuagugcuuggauggagaauaaccaaagucccacaauacauugagacauuucuguuugaaaaacagccagugggagggaaugcagauuuucaacggcaaggacgauuauguuuaagcauuuuucucauaagguacaaaaauuccaauuuaauguauguaaaauguaauguagguuuuaauuccucauauaaaagcugagauuuuaaacaggcauacuaagaaaacauagggucauuuaauaccuuuucuucaacaaggagucacaguaucgagccagcaacucaggggauuuacuggaugauugggccaucuugguaaccgcguuguuguuuaugaagcgaccacaagccugcguuacacggaauauaguuagagacaaacgccccauccauacauacuacaggcaagucacaacccucacgcaccuaccuuaucaagagcagccacaaagccagcgucauuguugaaugcagacauuaccagggcauuguauuuuuuaugaacaucaagcacugucuguacauacauuuugggguccuuaaaugggggcagaaauagaaacaaaaguugguuauuggggauuaaauuguguauuaagguauacaaugcauguacuagcauacaaaauauucuaaaagcuauagauaccuuuucaaaguuaagagauaagagcaagaaauacuuuugguaccaucguugaaacacauaggacauuuuguuuauauauauaaaagaaaaaacaaucuauucuccacacucaaaacuaaauauugauuccgagcuugcauuaaaaacagugaaaacucaaagagaucaugaaaacagcauuuuccaagugacaguucugcuuugccaauuccuccuuguuaaacaguggaacucuggacucuguuucagcuggagaaggcguuuagccgccgaggucggucaucagcccggcugggcaggcaacgcgagggaaagcggggcucagggcgggagucugacugcggcccccacccacugcaaaccagaggcgcggauccgcguggcgaugccgggggccagggccucaucgcaggacgggaagaggggcggagcgcggcgcagggcagcaaaggggccuccccggaacaaggaacaacauggaaaugcaacgggaaggcuggccgcagaggcuccuguggccaaaggaaggcggcgacaauggaaggcaaaggagacggagcuaagugcuaaugagaaaaacagcgcugcugcuaggcaugcagcgcacgccgccaccacccuucaugagaccgcgaaagcccacacugggcagcaggugcuguuuucauccccauucuacagacguagaaacugucacagcuaagcacacugccaggaaaugguggcaggcacaggcuuggcuccgggcugcgagggagcccggcugggaagguuggugggagggagcuccgggucacccccagccaagcacagauccaggcgccgcggcacgcccauguuuccacaucacgauacauuaaucugcagggcucaggugccagaaaucagcauucccaauucuaccuauucugcauuuuuuauaacauuugauuuacuuguuuuuaaauaacaaugaguaucaguaaggaugaaugauuuuucugcaacaggguuacacuuaagagugucagaaguuuccuguuaaaaaaagcucuauauaauaaaugcaagguuuauuaugaauauauugugcuaaguucaauaagauauaaauauggucuccaccugacauaaacauuugauaagagaaaacauuaaaagggaacuuaaugcaaaauaauugccaaauaaaaaucacuuaauauugaaaggcaguauugcagauauuuaauauuuuaaaauuaccaucuuaaaaauguuaaaacacacagagcgugaacugcacuaccagauagccuugcucuuuguuucauggcuaucccagacguagggaaacuucuuccacuuugccuggauggucuuaaucuucagagugaaccaaaagcaccuccaaguugggccauaucuuacuucauauaagcuugcuucuuuuaaacaaugaaaauauuuucugcuugaccuaauugugguuuugucacugaaauagauauugcuucugccaauucagauuuuagaucacuuucagauuucaugucaaauuauuccagaacauucacauauucuucucucugccuuccuucuguuacaguauuuacaaagugcuccagccuacagcgaggauucaaacacuggaaaaugcuagaaacgcuauuggguaguuuucgaauacgguaacaugcaggauccuuaacaaguuaacggcccuacaaagaacugcgugucacaacugccaauugaaggacucaauuugcuuccaaaacuugcuauuuuuuuggaagaccccucacaggguuuauauauagcauguuauguauauaaauauuaauacuuauuuuauuugcaagaaugacuucacccuuagcagcagaggggcuacagauccacacuuagaaggccuugcccaccuggcagccugaccacucggccugcacggcuucccugccacacgccuucacccucauucccgaaaacgccagccucaacuuacucacgcucuugcuugcgacuugucauugguggacuccucugaaccagugaugucucuauguugacuauaacguuuccaaauuauaauacuuuucuguauuuucucaaaauguuuuggccauuuuuccucagauuuguaauuuggaaaaauaccaauuucccaaggaaugccaggaacaacuucucacauggaaagccaaaucuccaggaguaaagaagucuucagacuccaauuccaaaauucuuucaacuacagcagucuggcuggugagaugggaggacuugcauggaaccuacuaaaggaaaagugucaaaacacuggccuuggccgggcgcgguggcucaugccuguaaucccagaacuuugggaggcguaggcgggcagaucaugacgucaggaguucuagaccagccuggccaacauggugaaaccccaucucuacuaaaaauacaaaaaaaucagcugagggugguggcaggcgccuauaaucccagcuacucgggaggcugaggcaggagaaucgcuugaaccgggagauggaggaugcagugagccgagaucgcgccacugcauuccagcccaggugacggugcgagacucugucaaaaaaaaaaaaaaaaaaaaaaucuggccuugaaaaugugaauuuagcauuugagguucagagaaaagccauuuaggaacuggucaagaagcagacaacacacuagaauaauauacgggagagaauuuuaaggaacuagucagcaaauagagaaaagauguucaaaaggggaguagauuuagcauucaggagguaaacaacgaagacagguuauaaaacagagaggagagagaucagcuggaucaaauggauguuuuuucaagaaagcaaagaacaaagguuugagguuuaaaaaaauaaaguaguaauggguuugauucaggacccucuguguauucacgagagcuuuucacauguaagaaacaggacaucucccagggcuugucccuaagggcucauucaacuccuauaugauuucaguuguuguuauaccuaggacggacacauucacauccacaccaaacuucccccaggugagcccguguggccugcccugggcuaucaugggauuuccaaagccuaugucacgaauggccugaucugcuccccaguccuguguucucuggagcucuucucggcaagugccaccacucacccagcggcucgagccaggcacccaggacucaguuccugcuuuccgacucaugaauccugugaauccacucaauccauacaacccguccauuucuuuucaacguuuuauuguggaaaaaauucaaauauauucacaauuagaaagaguaguaaaacuuaccccauguacucaucauucaguuuuaacaaauaucgaaacacaaaaccuguccauuacaaagccagugucucugcaucauucuucucuccauuccccgcacgaccagcccagucuccagugggccacuaucacuaucugaaccacgacaacaaaccuaacuaaccuaacugguauacuuguguguuagucaagguucccuagaaggacagaacuaacaggagauauauauauauacgggaguuuauuaaguauuaacuuacacaaucacaaggucccacaauaggcuaucugcaagcucgaggagcaaggagagccagucuaagucccaaaacugaagaaccuggagucugacguucgagggcaggaagcauccagcauaggagaaagauguaggcugggaggccaggccagucucgccuuuucacguuuuucugccugccuuauauucgcuggcagcugauuagauugugcccaccagauugagggugggucugccuuucccagcccacugacucaaaugcuaaucuccuuugccaacacccucacagacacacccaggaucaauacuuugcauccuucaauccaaucaaguugacacucaauauuaaucaucacaacuuguaacaacucuucuuccuuuucacccacuuucuacauggcagcaagcacauauaucccgucgauuccaugacuguaucacucuccguugguuuccucuugcacccucaggauuaagccaauaucaucaauacagcuuucaagguuuucccuggucuggccagcccaugcugccuucuucguucuuagaaugggcuguguguacgcccacugaggggcuuuguugugucugggaucccccuuugccuagcuagcucuaacucuuuucuccaucucaaacacuuuuuucagggaugcuuucucugaauuuccaagauaggccgaggcugcccuguuaagacuucccaaaccccaucccaacacuaaucacaccugccaauuccuugcuggguacaucucaguguugcccacugggaccgugucugccugcuaccacugccguacuucuaaguaccuagugaaguggcauucaucaaauaaucuccuaaauggcuaaaccaggaacauaaugauaaucacaacugaauugcgaccuuuuauuccauacauuuccacuaaaaggauaauucuaaaggccaauuucacgaagagaaaaucacguuaagagucucacauaacuuuuuaucuuacucuuucuuaaaaagguaaaccgaauauggcauacaagaggugugagggcaucaucucauggagagcugguauauauuuacacacaauuucuggggaucaguuguggugcuaagugauacuuuaacacucgaacacuuccuaguaacccagcaccauucaagaauauugcuaaagaggaauaauggggugcuacaggcucgaggggagcauccuucaccauuucaucuacauaaacuggugcucuccaggcugaggggacagaucugacaguccguggaaagcugcucuugccuacacuaccucugaggguacauucagccuccacaucuuucauccagccaggggcuaaagagagcagaucaauuacaagagcuuuaggagaguucccugaggacaggcagucaacaagaacagaucaaccucaggacaccaggaccuggcuugacacuguccacagucuuaccucuagauaauuuuuccuuaaaaaggggagagaaaugaggccccacuaaguaacaaaaacauaucgugcaguuguuugggggcagugucauucuucccauuagcaucagcacuuggucuucaaguaacauuaucuccaugcaaaacacagagaagcaaaggcuucagaaauaaaaccauagagaguaugugugcagaccaugcacuuggaccauuaucugggaaggugcucaaugguauccccaccacccagcaugguucugagguucccaccacuaccagucugugcgugcucaggggaaaacauuaauuuugauauuaauaggcaaaaaaagggggacauaaauguuagaucucaaaaaucauuuagaaauaaucuugcauuuucuuaauaggccuuuucuacuguaucaucucaccucuuucaauaagcagaaaccaacaguucuucagauggagcaugguuuaaaguuuaaaauacugagacaaaaacacuaacaauucaguaagugcucucuuuccucauucuucuucuucuucuuuuuuuuuuuuuuuuuuuuuuuuuuugagacagggucuucuucugucacccuggcaggagugcaggagugcaguggcaugaucucggcucacugcaaccucugccucccugguucaagugacucuucugccucagccucccaaguagcugagauuacaggugcaugccaugacacccagcuaauuuuaucuuuaguagagacgggauuucaccauguuggccagacuggucucaaacuccugaccucaggugauccacccgacucagccucccaaaaugcugggauuacaggcaucacccaccgugccugaccuucauuauuuucauggugauguccuggcaauguuaaacaaugccagcaagaaaaugcuccucccccaaagccucuauuggucuaaauucaaaaauguugcugcaguugccccuggauuucaggggcacguaggauuggaaugagcacauuuuaagucuucccuuuacuacgcaucauaugacuacaugagaguuaauuuggagaacucuccaacacgugcagacucagguaaaacauuuguuugaagagggaguuccucuggguuccccaggacucacaugacuaauaauaaaccacugguugacaucuauggacuacuucauccaacaacagcagaauauacuuucuuuucaaauccaccugccucaaccucccaaagugcugggauuacaggugugagccaccacguccaaccuuuucucauuauuuuaaccggccuaccugcugcuacuuuuugcuucaaucaucaauaucuaucuuggaaucauggcucugcaccucagaccacaauuuuuaaaucuuugaucucauugucaccuuuggauucugaucuacuaucuacacauuccugaucccagcaccauaacuguguggguuucauuuugauuccggccuugguuacgcccccugguuguuccccuaguccuggcugacaccuacauuuccuuuaguucaaggugaggcugaaguccuuguuuucagccuuucagaauguacucuguaaauguggaggcuguagguggacuagauuuaggggcugaguguuuacagacgaaaauguuaaacuuugaaagcagaacuaagacuugccagggaagacugacuucucugaagagaaugaaaagauuccccagguagaauguuucagaaaggaauaauuaaguuaguucugaaauagaaguaguguauaggaagaugaguauagggcugccugacucagugaggauggacaggaaagagaaguucaugggcagggucucuaauuggccuugagccaaucaaggguuacuucaguacuuauuuaaacuacaauuuaguugauguggguauaaagucaaauuuggguagggacgugcauccauaguggauuugcuugugaaaugauuaaagucuucccuauaauuaagagaaagaaggguguauguuggauauaaaaaugacagccucggccggacgugguggaucacaccuguaaucccagcacuuugggaggcugaggaggguggaucaccugaggucaggaguuugagaccugccuagccaacauagugaaaccccaucucuacuaaaaauacaaaaauuagccaggugugguggcacaugccuauaauccuagcuacucaggaggcugaggcaggagaaucgcuugaaccugggagguggagguugcagugagccgagaucaugccacugcacuccagccugggugaaagagugagacuccaucucaaaaaaaaaaaaaaaaaaaaaaaaaaagccugguuauguuagacuccaaaaugacaaauguguacauuuucguuuagggaaaaugauuauucucuucgucucauggcguccuggacaggaggcaucucauuuaaauguuaaccaaggcagaggggggucuuccugcaguaauuuacgucugaaaguaacacucgguagagguguaguuguuucaaauuaaaaauucagccuguagaaaaggguaggacugacgaauuaugacaucugacaaauuagcaguugaccggauauuuaagaaaucagauaaaauaaauggaaguggaauuuuucaaauaaaugacucauuuuuuaauuagguaaaaaguucagccacucuuggguacugucccaaggcauaagugauaggaagauaccaucuucaagguacuuacaggccauuaccgaccugaacuaaaaaucaaaccuuuuuuuuuuuuuuucuggugguauuuuaaugauucacuguuuucuuuagcaggaauauagauuuaaaaauguauucuuuaaaaguuuuaaggcaaggucauacgaauuucucaggggagggaaacagacaaaauaaauccaaaccauccuuguuucucugaaguuauguaccuguaauucacaaauuuagcuacgugcuauaugaaucaauguauauuaucagcauauaucagcuuuuuguguaauuaaaugucugacuuacuguacaaaaccgugcuuccuuuuguccuaaagacacucuuucuccuuuccaacauccacucaaucaaaaccugcacauuuguuucuuaaaaaaauguuuuaauauagaaaauuuucaauauguucaaaaugagaaaagaauaguaaaaucaacccccauaaacccauuagccagcuuuaaggaauagcuauggcucuaagagucuaugaguuucucaucugacccucuuccuguguguguaagcugacuuuauccauguguauccuaucuccuuugaacaaaccaagcuggguuacacuccaaauguaagguucuguagcuaauuuuaucaaugacuggacaguguucuuuucuuaccauccagagaauguuugcaucaagacucaguuauuuaaucacgcacuucacuacagaagagaaaggggaucuuggaugucuaaacuaaacccaaacucaaaucuaccagaaguagcugguaguacauucgucuguucacuggucuaaguucacacaugacugggcuuuuauaauuauuucuaacucaacuucccaaucuaaaucacagaacuuuuucugcuaauguacucggaucuaccccuuagucuuccauugaaaaauaacuugccggagcuaccuaauuucugccuaucaaauucucuaucugaugugcugccuuuuguaaguauuauaccaucaccccaauccuggagccagcuacugagagcagcuucugaaaaccucuccuguuucaacacagcauuucucucagaacugcaaauaaaguucacaacauuucuccccagucagugucugcagcccaacacuccaauguuagacccagcagcccugccggguguugaaguaucucacagacccaucucuguugggccacacugcaauaccuguuaggcugaggacacuaaaucaagauaugguuucaaagaggacuugugcuuuuuuguugcuacuucugcccugaagaccaaguguaaggagauauucucuuauagccugauuuauguucauuuacagagcugucuuugugggggaauacaguaacauccagacugcugagcaacuguguguuaaacauucaaaauggaaucaauuguauagucaagaauuaacaggaacuuacaagucugcauuauuugacccuucuccugaacuuuauuuuggcauugugcuauaagcuggugucauggaaaacuaucaaacuacccaaggacuugacauccuauuuccuugugaguguacugcugaugaugcuguccacggcacuaccaugcuuuuuaggaugagccacuggagaaaguauccucagcucugaccaucaagaaaaaucauucuucugaguuacuagccgaucguaccccacggcgcuggcugucuuuaauggcaagcucucuguacugacuacaacgauuucgaggcaaaucaugaccuaccucuaacaagaguaacggacugcauugcacacacuuugagaauuauauuaagcucuauuuugugucucauauccuuauuuugcuauucuccgauuuauuuaauuuaucuuauuuuauuucacguauugugugagcagccccaaguccuuuucggagcaaugggaaguguaacuaagauguaaguauacugauaaggugucauaauaagcucugaggacacaaaacuggauagagccaucucugcuacaauagagggacguucacacggacaucuaaagcauaaagcagugucacauaaacaguccaaugugccauuauuucaagggggagaugcuaccauuccaaggugacugagaaaacuuuugagcuggguuuugagagauaaauagguauuucacagguagaaaaaagaaggacugucucuaagaagagaagacagaagaacuaggaaagcagagugaggcaaauuuacacaauggugaguuccagcugagaagacacacgcagcggggucaagagucgugcagccgagacggcagcccugcagcagacggccuucaccauuaucauccacagauccucgcuggguaagaggcuaggcccgaaaccacagagcauaaaacuauaaugaggcgugagcuucgcucucaagggcuguaccacccauggugcagugacaggaagcacaggaaguuauaaccacauguacacuuguaaugagaguuuuacaaauagggcuuaggauagaagaguuaaggucagcucuuucuagaagggaggauuugagcuggccuuaaaagcaggacuaagacaagcagaagguaaggaugacuguguuauaaguagagacauuagccagaguuuugggguaggggaaugauauuauaauaguuucacuggaagacaggguucaugaaaaugugggcuaauuagaggauuuugauuuaguguaauauuaugauuuauauuaucacaaggaagggcuuuauucugcuuuguuuaaaacaaaggaugaaaagaacacagaguaaaauuauaaauguauuaagugguauuucugaaagacgaaacugcuaauuaucaugagggaugaaugggaaugggagagauguggggccauuugggaggugcagugauaaacgaagcccagauuaagaugguagccuugggacuggagagaaaaugcauagaaaacaguaagagccaagggaggaggaauucccaugcuccacugacucaucccagaagacagaggaggagacagcuugcuaccgagacaggcaggcugcuuacugcuuugaggaggauucugaggcuacguccagacccugcaggaaauuauacccuauuagauuacuaaugcuuaugaugaacaaggcaugagggcagggugacucaugcuacacagcugccaccucugugcuaaggaauggagaagaggugaguuucaaaugaaccugcaauguaggcacuaaacuaggcagaugaggucacggagaugugacaaggacaaaggcaaggcauucuaauucagaguucuugacaucacgucuacuacaggaaugcccuaaaugcuugcuaaagaaaugaaacaacgauuucaguuugaucugcaaaauuuguuugcccuuugauuugaaacacugaccacaucaugcagcuaaaaauacuccucaauuugggauaauguuucaauaagcccaucauaaacugaauguguggguuuuuuuuuuuguuuuuuuuuugagacggagucucucucugucacccaggcuggagugcagcagugcaaucuuggcucacugcaaccuccgacuuccagguucaagugauucuccugccucagccucuggaguagcugggauuacaggugccugcuaacacgcccggcuaauuuuuguauuuuuaguagagacgggguuucgccauguuggccaggcuggucuugaacucuuggucucaggugaucugccugccuuggccucccaaaguucugggauuacaggugugagccacugcgcccggaccugaaugugugacaguauuuucaauguacgaugaguuuauugaaaguaucauaaaugccuauuguuuucaugccauuuuaaagucaaaaaaaucauuaaggugagccauucuaagcaggagacuguuugcaguugcuuuggucaaauaagaaaaauuaagagccuagcacagggccaggcacacacagugggcauucaauucuuuuuaaaaugaccacgugaaggaauggucucugcuuugaagaugcuccccuucaagccucacuaagugaauggaggccaucaccuucuauauuuuaauauagacuauuuuuugauacauucccaaccuguuccugggccagcaaucaugcaugggguuacuugccuauuaaacaagccauuucuccuaucccuugcucagcucgaaaccaguuugaaaucucauccuugaauauuugugugcaagguucccaaaguccuccuggugccccagugcaauaggcuaauugaucgccucacauaucaguugagcacaaaugcccuugaucacgaggcucucugaaggcuggagagaacgcuuccaaacagaguggaauccugacggacaguccccuccccacuccgagguucggagggcucucucuucaguuucacgucacugagggcugccagcuuuuagguggcgagagggagaugccaugagggaaauuccccuucagccaguuuuccagaaauagccuuuaauguuuaaauugguuuuaacuagggaaaagauaugccuuaagaaaaauucauaaguagguucuaaaacuucgaacacaaaaaauauuugacuuacaugauaaacuggaaaccucuacgaauuucagucuaggccagguauuagcaguaaagcugguuuucuaaccaaauuagugguauaaaaggauuagccagauaaaaaacuuuuuuuuggccucucaaaggaguuuauuucaucaagaacagcuucaguguaacauauauaguguucuaguccagagaaagacacgggacugauauuacacauuuuugcacuuaaaaaaaaucacuuagguagugccuucuauggcauuuaauaugcuaauuauaaaugauucucguacacuaugauucaacuuaauuaggcaaaaauuuuuaaacuuuaaaaauuguguucucaagguaauuaaaucccacuuaaaaucauguacaaugauucuaacuuuuacuaaccuuuuuuucuccugauuuuucauaaucaguggguuuuugaaaauaauuaugguuggguuacaaugugucuuuuacauuuaccacauaaaugauaaaaacuaaaaccuauuuaaaaguauuuguuuuuuagcagcuguguuucuuucuuacaauaaguaaucaagcaccuacugugugccaggcuauggcccgggcacccacgcucccccugagcuucaauucugugggcuuucccagagauggcgaauggagguggcaagugugagcccagagcagggaagggcacgaggaacccaugcaccagacagacagcauuccaacagaaggagccaaacggcaaguuuacaaauaagaauaaaacugcauuuuaggaaacacuccuuuugcagaaaauuggaaaaguauuugcuuucccgaacauuuuacuucauaagcacaacaauuaaaaaacucagaguuucaugaguucaauguagaaacagugcuuauguaaauaauaacuagaaucaguaacuuacuaaaaaaaacuaauauuugacuuuugugagugaaggcagaugcaacguggguuuacugagcuauaacucuucuucacgggagaaaaucuuguuuugguucuuaaauucagguuaaucaguggcuuagauuuaaguaacacaagcauuguuuaaaagcuugauuucucguaaaauguaacugcuguuaaaggcaguuuauuugugcugucauugcugacggaugaagcuuccucaaauagagaaaugauuuacauagaagguauacuuuugcuuuaacugaucgaguuagguaaaugucagauucaagacucauugacaaagucaaucggcagcauuuauucagugccuaaaauaucaggcagcugauuguauccaagaaagaaacaauggaacaugagaaucauaguugauuauuucuccaauuuagcaccuuacuuugguuuggaaaagaugaacauuagaauuaacgucccaucuuuccuauaaaacugaaaaaguaauuuauaaugcuuuuuuuuucuuucuuccuuuuaaaggagacagggucucacuacauugcccuagcuggucccgaacuccugggcucaagugacccuccugccucaggcuucugaguagcugggacuauagguacacaccacuacacccagcuaucauguuuauuuuaaaucuaacuauauucacauagaacacgaguucccuaaggccaaucucauaccuaguauauagcaauuuaaaugaaaaaagcaaaaacugcuucauuaaucuaucugaugaaauaacagacuucccacuuaacucauuucaaggaaagucaagucauuuacuuggcucugcugcccauauagguaaauugaguucugaaucaacaacugggaaggcaccuuauauuacugaaaaaaugucuucaccgaauugaccccuucugaaucacaggagggugagcguuuugugugugugugugugugugugugugugugugugugugugugugugugugugaaucaggcccuuuaaaggaacauuuagcuuggaaauaaagucauaaaaacugaaggguaauuuugaaaugaguuuuuaaauuaaaaaaauuauguguacucauaagaacgugcagcagucaucacugcugagcaauuaugugcccugauuuaagcacuuuacauguauuguuuauucacaaauauccuaugggauaggcauuaucauucuauuuaaaaaaauaaaaauaaaauaaaaugacagagacagaaguaacucgccaagggugagauagcugucaaugguggagcugagauccgagugcaggcagccuggccaggcucuguaaucaccacacgguaaagacacuguaugugccgacacugaggacucuguacuuaaguuuuuacuaaaaccuagagaucuuuuucauaaaauccacggcugagccaguucccucccaucuugugagcauaaaauuguuuuaaaaaccuaaaggaaagcuuuauacucaacccuuuaauaauucauagaggcggcugagugucagcagcaacucccaaaauuaaacacggaaaagaagccuucaaaagauaacagaaaaauaaggauuaaaaaaauacuauuuuugauaaugcuaucaaaaauaaucauuaagcacaauaaagucaaaacaagagaagcuuucugcauucagauguaagaaccaauguguuuuagaaacuuuucuucucggccgcacgugacgacucacgccuguaaucucagcacuuugggaggccaaggcgggcgaaucaccugagguccggaguuugagaccagccuggccaacacagcgaaacccugucucuacuaaaaauacaaaaauuagccgggaaugguggcgagcggcuguaaucccagcuacuugggaggcugaggcaggagaaucacuugaacccaggaagcggagguugcagugagccgagauggcacaacugcacuccagccugggcaagagagcaagacgccuucucaaaaaaaaaaaaaaaaaaaaaaaagagcuuuucuucucuauuguucucccaguuacaacugaaguucacaacaggagcaaaacugaaggcaacucauuugugucuuaaaaacgcaauuauuuccaaugugaaauuaucaccugaauuacagaugaccugaauuacagaugaccuagcaggaauauucuauguagcccuggggaagcggagggguguagagaaaugcuauaaacugcagggccucuccagaguacagcccuguggucuucagccagaggcuacuauccagaucaaaguuccuguaaggcacaaccuguggacugugaguggcaaaguaacagcuuccaggagccuuuuguuucuagggaagcagcuucuucuagugagugcaaggaauuuaacagugagaaggcauaaaaggaaaaaaaaaauaacauuauuaacgccuaaaaagugcgagggaaaaacuuacggagguauuuacuaaacaaagaugucugugaacuaucuacuucaaaaagacaaaacaugguucucagaguucuaaugaaaaugguaccauuuagauuuggaaguagagacgcauaacauaugcuugcaguucgcauguggaaauaaucagccugacugauuuucaaugaaaucucacuuacauuuaaagcagcuucuccacacuuuucaauggcugcaagacccugauuaugaaugugugucuccaacaguuuuuucaauucuccuaggccauccuggauucuagauacaagauuauacaugcgucccaaaucugaaagaggaagaaaccccuuuuaugcacugaaaaaaauuuugcauauccauucuacuaauuauguauuuauacugagaugaaaaauacucugcaaaagauaaccauguuuuuagacuuuaauaaucaauagcauuuaauuauaaccaaauauucucuauuugguauauguauauuuugcuaaaaguaacaaugaaauuguuacuauuuacuauaaauuuacuauuguaaauuuauuuucccccuuacugugagaaaccacuaacuuaagacuaagcaaaaaaaaaaaauuaucagaaacaacucuaaugcuuccuaaaauucucaagauugaaauaguauuuaugccugacacauaauaggcacucaaauauuuguuuaaaaauaaugaauacauuuaaggagaauauggauuucuaucucaauuauaaaaacaaaugaguugagaaaaggucucccaaauugauuuaagacguguauacagcaugugguuacuuuaggaggaccauagaagaaaaauccaaacuucaaucuuuuauugagcuccuaacaugccccaguaaaacaugggagugguuaagggaaauauaagaugacagucuccucaucucagagaauuuucaaaggaagaacagucaagaaaaaacuugggguagcaucauuuaaugcuaaaguguauggagcaagucauauucuaaauacacucuucccccuaagucaaaccaaaaugcucugcagaagucugaaauuggcacauaacgauguacaaacacaugcaucuuuuuaaaacugacaugggcaaguaaugccguugacucgagagucuagaaucaaaagcaauaucaaaacuacagauaauuauaaauaccuacauuuuaugagucuuguggcucaccuucauuuuugucagcauccaauaaauucugaaauucuguguggaaaauuuccaaguguuuuucaaugaggacuuguucacauuuccuugcuaauucaucuugugugcuuucaugaagguaaaccugaacucuucguuguuccucaagcagacgagccucugccuggagaaaauuaauucaagugaaugguuuugauucauugguaaagaacuguuacaauucuuuaauauguaaauuaaaggaaacugaaaaauggcaaauuaaauucacaugccagcucuaauaaaaugcgauuaagaaaauaagggagggcugggcaugauggcucagccacuuuggguggcugaagcaggaggauugcucgaggccaggauuuugagaccagccugggcaacacagugcgacccugucucuaaaaaaaaaauuagccagguguggcacgcgccuguaguccuuccuagcuacucaggaggcugaggcgggaggauggcuugagccuaggaguuaaaggacauaguaagcuaugauugugccacugcauuucagccugggcaacagagcaagacuccguuucucaaaaaacagaaagaaaaaggaaaaaguucuuugauuuuacgguaaacaacaaccauauuuaaacagccacugaugucugccauuuucucuguaauacguauuuccauuucaaacuuccuuuuuaagugcccuaacaacaucaucguuauuaacaguuaacaugucuuuacaucauuuugaucccucagagaaugguauuuuaucuuuuugagguaaugucucugccacucuaagaaaugaaugcaucuucugugcagauacuaagaugugguacuuuagauuaaaaacuacuugaagccaagagucacacaaauauaagcccugaagugauuacauggaaaucaucaucagaaaucagacuguucaaaaauuuagagagaaacuauuaaauuaucaaagcaaggaagaaauuucaauaaauuauucaggugaucugaguaaagagaauuauauuuugcauuauaaaaaugccaauacucuccaaaaugauuuuuguuuuaaauauauuuuuuucagagacaggaucuuggcucugucucccaggcugaagugcaguggcacaaucauagcucacugcagccucaaacuccugggcucaagugauccuccugccucagccucccugugcagcugggacuacaggugcaugccgccauacccggcuaacuuuuuaauuuuuucuagagacaaggucucacuauguugcucaggcuggucucaaacuccuggcuucaagcaauucuccugccucggcuucccaaaguucugggauuauaggcuguccagcuaccgugccuugcccagauuuucaaauuugguauaauuuuggagaaaucuggaaaaauucaacugguaaugaaucaauacucaagagccaagaaaaaauaaaaugaaaaaaugauuaggcgggacuuguacuaucaagaacuaauaauaaugggacaacuguuuaaaccacguaagucagaaccuuauuacacguucuaaauagcuaaaugugaaaaauaaacuuggaaaauaucugcaguauguaucaaaaggucaauauucuuaauacauaaugaucuccagcaaagcagugaguacaaccaaauaaaaacacaaggaagaaaagacaacucauaaaugaagaaauagaaaaaagcuugaaguuaauacauuuccaauaagaggcaguuauuauauguucaguuaaugaacuaugauuacccacuaaaauaaacaccaacuacuaauaacaaaucauuagugaacaaguuacgaaaaaccuauaccaugauuccaaugugguuuauauaaucagcaacagugccccaggcuuguagguuuauguuauuuguauuuuccaaaaagucuacaguuaauguguaauuuuguuuuucugauuauaaagauauuuuaaaacaauaaaugcugcuuuauaucuaauguuccacuaagacugauaacucaagaaccuaaagcugguggaauauagaacaugcaaaccaaacagcaccacuuuuucuguuuuaaguuauaacucuuucuuggaagaacauaaucaucucaggcagcaaaacauaguuuuaccccuuccgagaugaaagauuaggcuuugaugccauuccugauucauccucugagaggcacggcucuccaccucuuagucuacagacccuuccugcaggggcugagggggcaggaagagugaacaggugccuaggugauuacagaaacauucauggccaaggggccucaacacuagcuuauuuuauauauuggcaaggaaaccaaggucguagguauugucaucagguuucagaaaggacagccauuuagguucucuaaugauuccaagucaaauaggcuccugaucaucacuguacuuggcagacuguuguauuagaacaccaaggucaaauucaaaugacuaaauaaaaguaugcaauuaaagauggucuuuauuaauucacuaggaucgguucucaguaaaaacaaaaggaaaauaaaaaccaaaaaagacaagcaaauuaaugaaguaugguauauuuuuaaaguuuuuaaaaaaugacauuagaaaccuacaguagucauacagaguuucuguagcucagaucagucucaaucgcaugagacagucaaaucuuuuagaaacacuaacaugguucacucuucaaagccauccuuggaaagacaagccaaauauucuuagauguuuccuguaaaacacuccuaauagagaaaagugaacacagacccagggaauuugaacugcucucaacuggcuagaauuugcagaguauuucuugaagggucauguuuuaucucauaguuguucuauuuccugauagaauguuuguuguaauguaaacacaauugcucccuaaguuauugaguaagauuugccacccuuuauccugugguuuugcauccucccaggcauacacuggagguuuugugggauguauauuuguaauaccaaauacauuagcuuugcucuuugccacacaccaaucuaagcaccuuuuaacaaauaaauaccucauguuaaaauuuguaaauacuaaagcucacuuaauccucauuauuaccuauuauuauuauucacauuuuacagauaaggaauuugaggaacagaagcauuaaggucaucccccuaauaaauggugggguggggauuuaaaaauagacucauagcucaguuugagaugcaaggcuauaggaugagagcagaauuacauggucaaauuccaguuuuaugcuuauagacucucugcauuaucaucuuucagaauaugauggaagucguguuuggugugauccaaguggauccgggccaaaccuuuaacucuucuagaaaugaauccccucuaugggaaccaggauguaggaagcacacugcuuccuugaaggcgggccucaugcuggauugaaaacaucgaggccauuggaaauucuugcuccucaaccgucuuuggugucaggccugguuuuauuuuuauuuuuauuuuuuuuuuugagacagagucucacucuguugcccaggcuggagugcaauggcgcgaucucggcucacugcaaccuccgccucccagguucaagugauucuccugccucagcuucccaaguagcugggauaacaggcguccgccaccacacuuggcuaauuuuuguauuuuuauuagagagaggguuucaccaugcuggccaggcuggucucgaacucccgaccucaggcaaucugcccaccucggccucccaaagugcuaggaucacaggcgugagccaccgcgcccggccuaggccugguuuuaaaaacagauuuaccuguucugggagugcuucaguagcucugcccuagaacacugguuuccuugcccuagagcacuacuacuucaucaguguggacaaaggagaugaccacaauccucuaauaaacccauaaaaagaacaggcucgcgccacugucguggaugugcaucuggauaagaggucuuugggauauauaguuuuaaaagaaucaccauauacagcagaguuucauaagagaaguguuuaggaauacaacacugucauauuaaacaaugaaauaacaggcaauguuaacguuuaaaacagacuguuucaaaaguucauuuguuaggcaguuguuugaaacucugggugagcugguuagguuccagauuggcauaggaaagucaauuuagcccaccauuauacacaaggaaccauuaauauuccaaguauaauaccccgaauaguuccauuuuuguuagauuuugagauagcagagauuugucaaggacuuucaacuucaaacuucuaagcccauuuauaaccacuaucuccuauaggaaaaugcauucaggucaccacaaacaaaccggauaggacuuucucuaugagguuagagcagagcuguugcuuuuaauugacuuucuaucucagcauacggaaaagagauuccgcaguccauucauacuccaagugaacagggaauacagggcaagcaggugucaggcuuggaaagauccagacuccuggagaucuccuaguacaaggauccucaaucgcuggcugugggccaguaugggucuguggccuguuaggaacugggccgcacaacaggaggugaccagcauaugagugagcauuacuaccugagcuccgccuccugucagaucagggacggcauuagauucucauaggagcucgaacccuacugugaacuacacacgugagggaucuauguugcacgcuccuuugaucugagguggaacaguuucgucccaaaaccaucccccuucuucccccagccaccgucugugaugccaaaaggguuggggaccauuguccuaguacagcuaggucaagggucagcaaacuguagccuguaggccaaauucugccugccugccuuuuucuguaaauaaaguuuuauuggaacccggccacacucaguuguguacauaucccacuggcugcuuugugcugcaauggcagaguugaacagcugcaaaagagaucacauagcucacaaagccuaaaguauuuccuuucuagcccuuuacaagauaaguuugcugacuccagaccuaggucauuccuuagagucuaaauccaggauauccauauuucuuuuucuuuuucuuuugagacagagucucacucugucacccaggcuggagggcaguggcacaaucucggcucacugcaaccuccgccucccagguucaagcgauucuccugcuucagccuccugaauagcugggauuacaggcacgugccaccaugcccagauaaauuuuuuuguauuuuuaguagaaacgggguuucaccauguuggucaggcuggucucaaacuccugacuucaggugauccacccaccuuggccucccaaagugcugggauuacaggcaugagccaccacgcccagccaggauaucuauauuucuaagaaagagaacaaagaguaauucuacuagaucuuuauuaucagcgggccaugguuacucacaucuguaaucccagcacuuucggaggcccagguggcaggaucacuuaagcccaagaguuugagaccaaccugggcaaccuaucucuacaaaaauagcgagacccuaucucuacaaaaauaaaacaauuagcugagugugguggcucacgccucuaaucccauuacuucuggaggcugaagcgggaggacagccguccucucauauuagaauuuaaagccuaguuucagaagaacuuuuccucuaauauaaucaugaaagcuauguaauagauucuuagggauauuuuagaagcaaaaaauuaaaguuugcaaaucugaaaauauuuguuucuuaaaauuuucucauugacaugacugugaugcccauuuuauauaaauccacauucuacaauaaacaguuaaaaaaaauucauguagcuauugugguuauauccuuagaacagcaaggagaacucucagucacgauuaccaaauuaauuuauagaagcuccuuggagaauuaggagaagcacuugcaccugauaaaaacacucuagaaaaacaaugcccaacaaaugacuuguaaagaaagcuguauaugcuaaaaagaacucacuugaguagcaaugacuuuaacuuaagucuacuuaaaguacuauauuuaagcuuaccuuuuucauauauucaguaacuggguucugcugcaagaauucaguacucucucugguauaaaaucucucugugucagccaaaaauugagauucaaaggauucuuuauacacuguuaacguagggcccuuugcaaaugcaucaucuucauucagccccaauuccacuagaaaugaauaugagcuauauuucaauuacccuauuuuuuugguuauauuucacagaauauacuuagguguagcauucaguuuaaguuauguuuaaaagguaaaugugaaauggcaggacauaaguaacucuuacucacuaguauuaaaguacacucuuucaauaaaauaaaaaaggaaaaaaauccaagacguauaaaaagcaaguaauucugacccauggccagguaugcuucaaaauuaugaaguuccuuuagagaacuuuuguauuuccaaaagcaauaaaaauaacuaauuuuaaauuugcaaagaaauacaaugcuacccaaguuuuuaagacauuguauuacuuuaucaguuucucaaucucaauuuuucaagcugauauagauuucugguuaucauugagcucacacucuaacauauccaguaauucacuaugagaccagaaaagaaaauaaucaaaaugucuauuucaucaaaauuuccuuaaggcacacggaucaaacagcuuuuaugauggauaaaaacaaauaaagucacacugacuuaaaaagaaauguaaguaccuucguaaaugcuaacaauauccuuuauaauauuaaaauauuuuaaaaaugacaucuguuagagcauuguuguaauugccauuugaugugaaaacuuugaauaaacuaaagggaaauuauuuaccguaagacuguacaacuccacuaaucaaucuuguauugaugguuucaccauuccuuuccuuuucaaucagcuuuaaaacagcauuuguuaccuuuagaaaggauguagaaaaauauuacacagguuauagaauaugauauauauuacuacauaucccuuaaacauucacagccacuaaacaauguaagaugggauaauccgaaggagugacgagacaaaagcuaagcaacgaaacugcgaagggauuuuaaaaggaacaugcacacgcucacaccaguagguaccuguuuauucaguggccugaacagacagucucuccaagucaccaaugcaagcuggagaaaaaaaaguacaaaaugucuauacuuuuaccauguuuuuccaagauugaagucauaggaaauaaccuaaaucucaaauuacuuuaucaaaauuucuagauuacaaguuggucaaaaucugcuaucaggacaaaagcagaaagccacucucuagagucaacaacuucaagagguauccaagcacagacauuugucagcucaacuucuuuauuuacauuuucuuuaacuguuguuggaaacaguauaggaaaaguuuaaaaaccguaaugauuuuuaggagucugugauguuacuguaagguacacauuuaggucaagcagguuuccaaaaggaaaugaaccaagaccauccugauuccuacacuaacaacuuuugagucucaagaaagcauuuauaugugaaaaagaaaaaaucccauuagccauuccacaauauacacauauuucaaaaaggcaugguguacacauuuuugucaguuaaaaaaauaaauaaaauguuaaaggggaagcacaaaaaccccaaaucaaacaacuaaaccuagaaaguuuuguuagaacuggauuaacuacauagcaaaguaucauuaugaagcaauaacaauuuugguauagaaacuggagcuauacagacaauaaaaacuagucaugcaucugggauacauuaugcuuuucuuuuuuucuugagacaugaucucacucugucacucaagguagaguccagugguaccaccauggcucacugaacccuccaccuccugggcucaagugaugcuuccaccucagccucauguguggcugggacuauaggugcgucaccaugccuggauauuuuuuuuguaggucucauuaugcugcccaggcuggucuccugccucggucucccaaagugcuaggauuacaagcaugagccacugcaaccagcauuguuuuucuuuuaaauuugucaaaagugaagcuacaaaguacugcuauuauagcaacauucuuggauauggugauuaacuccuuuauguagaaucugacauuuuaacaaaacuaguuuuaaagggcauugucuguguggaucugacagccuaugaacagacuguucugaguccucccuuaacugcucuagaacacugguucucaaacuggagcaugcaucagaauugucuggagagcuugguaaaacauugcugggccccaucuccagaguuucucuuuaagucuaggaugaggccugagaaugugcauuucuaacaaguccccaggugaugcugacagagcagguuuggggaccugauaugguuuggcuauguccccacccaaaucucaucuugaacuauagcucccguaauucccacauguugcgggaggcacccagugggagacaacugaaucaugggggugguucccccauacuguucucauaguagugaauagucucacgagaucugaugguuuuauaagggguuuccgcuuuugcuuggcucucauucugucuugccugccgccaucuaagaugugccuucugccaugguugugaggccuucccagccacguggaacuguugagcccauuacacuuccuuugcuuuauaaauuacccagucucagguaggucuuuaucagcaguaugaaaacagacuaauacaggaccauacuuugaaaaccaauggaccaaaaaaaccccuuucauugacugaagaaacguauauuacugagggugauuuaguaauuaauuaauucaggguccucuccaugaagcagcguuucccagacucuaaagcaugggagggcuaauccucagggcucgcccucagguauggcaccugauuugccugggacuaccaggacucaggacuuucagugcgaaaacucaggcaguuccaggcaaacugugaugguagggucagguaauuaaagaagaaauuuuuaaaaagcaaaugcagaaaugggcaaauuguauuuuagaacuccaauuuacccauucuucuacuuucuugcuaaaaaauauuuaagugacauuuauugauaaaacaaugaaaauuaguuuacuauucugaaaaaagcuuaauauuugccuagauucucuugcugaaagacaauuugccauuaaaaaaaacaaaaacaaaaacaaauuuaaaacguuuuaaaacaaaacucuuaccgaauagauuucauauauuccuuuucguccuucgucacauucacggcgaacccaaugucuauugagguaggcacaaauuccauucagcacuuugcuugaaaaucgauaaucuucccauuguugaguguagaauuucaguacacucucauccaucaaaucuucuccauccuaaaaacaaguuaacuaaagcuuuaagaugacuaauuugucacauuauaaauuaaaaauaacggugaauaacaucuacuguauuaaaauacauugacacaugugauuuuagauggcuucuuuaaauuauucuguauacaaaaacaugcuaauauauauaaacucacaagaauauaguaaaauaauucuuucaucucaaauuaaacuggaacauuuuucaugguauuaaauaugcaaacacacucaaaaaaaguacccugaacauuugauaugcggguaauuccuuuuuauuaagaaauauaccacaaaaucaucuguauuuuugauauuuguuuaaaaaaaaauuggcuggguacaguggcucacaccucuaaucucagcacuuugggaggccgaggugggcagaucacuugaggucaggaguucaagaccagccuggccaacauggugaaacccugucucuacuaaaaauacaaaaauuagccggggcgugguggcacaugccuguagucccagcuacuugggaggcugaggcaggggacucgcuugaacccaggaggcggagguugcagugagccaagaucgcaccacugcacucuagccugggcgacagagcaagacuccgccgcaccccuucccaaaaaaaaaagaaaucaacauguccuacuuagcaauucagacaaugagacuaauacuauucaauuuuuacaugcaucuucuuccuucuuuaaauuuacuuaaaaaccauaaaaacacuuuuuuguggugaucuguaaaaauaagguaaguacaauaguauaacaauauuucaagaaaaugugcauuuacgaaaauuauuuuuauccagauuuccacaacuugagucacaaauuuuuauuugaaggagacuaaccggaauuuuuuuucuuagggauuaauggcaucuacaaaguaaaccuuacccuuuaaaaacguuaaugguacuguauggcagcacugccauuuaggugugugcagcagagaagcacgaaagaggaaggugggggcaggagggcugcaggaagggcuggggcgagcccacuggcuucucugagccucagugucuucaaugaaaacuaaauggcuacaacagacuggaagcuccacauguauaagguacacgagugaccaaacaagccauguaaaaaccggaucaucucuugagacaaauaauuuuuuguucauuuaaauuuaaauaauaugaaaugaacuuuaaaauguaaagcuaagcuauuuuggaugaugguacuugaccuuuuuaaaaugcaaaaauaucacugauggcauggucaucaaccuuuuuacuuagcacaauauacuguuucuuacuuuaguacuaaagaauaauuaauuaauuacaacauucacuuuaugauguguugugaauaaaaagaacaguggcuucagcaagaccuuagaaacaccauuuggggaagaugaaaauaauacacuagucacaacuuauggccagccaacuacauacagucuguuagcaagauguuuuaaaguuuucaauuagcuugcaaaaauaaauuagguaaaacaauuuugcagcaugcagaauuuuugcacauuguguaaauaaaaaauauuuaaaauauauacacagaagaguuccugcaaauuucccuggggucacaguauagacgucuucacucuuugacaguguagaaccagaugaaggacccacuugcucaucuuguggcuagauacaaggagucacacugccuuugcuacaaaggaugaagaccaaggaagaaaaggcgggagaugaaggggaaaagacuccaccacacugcccaaccaaaggcuuggagugggagggaccuacgcuagaaggaaauggauauucacagugaaacucaucguagucacgagcacaauuucacagcaguuuugaaauacacgucauggccaggcacuguggcucacaccuguaaucccaacacuucgggagguggagguggaggacugcuugagcccaggaguuggagaccagccugggcaacauaaagagacccugauucuacaaaagauuuaaaaauuagcugggagcuggguauggugguacaugccaguaguccuagcuacucagaaggcuaaggcgggaggauuguuugaucccaggaguuggaggcugcaaugaccuaugauugcacuacugcacuccagccugggugacagaacaagacccugucuuaaaaaaaaaaaaggaaaagaaaaaaaguacuucauaaccauguguaaagagcaagaucacauuugaaaaacaugguuuccaagacugaauaaccuuacaauuauuucuacaccuugauagggaacaccacauuggguucacaguaaaaugcagauaauuugaauacauauuugcuuuaaaugaaaaaguucaucauuucuaacaaccaaauccaaaaugguugguaauuuaacgaaagcacuauuaugcuaaaagguuaucaaagcuuucuaauuuuaaaaaacagaaagagcugggcacgguggugagcauuugcagagucucagcuacucaggaggccgaaguggaaggaucacuugagcccaggagaucaaaaauccagccugggcaacauagugagaucuccaucucgaaaaaacaaaacccuagaauauaguuuauggugauuucauauucacaguagguaaaagacuaugcaauagcaaaacacugucaccuacguuagugucuaaaacaguaacagaugacagugaaagauuuaacaaguuagaaccauuauuucacuuuuuuuauauccuguuaugaauacucaguauauauauaaaacaucuuaccuuaagaagauuugucaaguaauucuucaaaaauuccuuaagucguuuauauaauuccaggccaacaaacugagcuccuccaggugucugccccuuuuucgacuuagaaggaggaacuccagcuccucgugcuugguuugacuggugaacacuaguacaguaguuauaaacaugacuuggagaaaaguuaaggaaaccaacauauaucacagacguuaacggucauuaacauaaacauauuuucuuauauuucauuaccaaugcauucccaauauaucaaccaaaaccuguuaaaaacuagaauggaacaaagaucccauucacacuauccauaaagcuaaaagucaacaagccccauucacaagguuguugguaggccuugagagcaacaccgccaagguggagaagggaacauuccaggagggagguugccuauaaaaaaaucuggaccuuuuagauuaucugaugugacugaccuuguggaaaacugucccaaaagaaaaaugcaauuacugacuccaggaaaaacaaaaagcuaacaauaagcacugucuauuaugaugcucagcuguaacuuuuucagaggcacagauucuaaauauugaaauaacacaaacuuuauuuuaaaaugacucagagagccaaguccuuauauuacaauagucauagccaucuaaaacuuaucagugaacggcagcaguguccacacacuccugagaaagagagagauguauaaaccacagcacagacagcugauugcaaaacagcugcaucugcagggggagcgcagagaaugagaagauggggccaggcagggcagaaaaccaccguguucuguuguauccuuuaaauaugaugagcuuaucugcauguauuauuaauugaauaaaaugaacggaaagauacuuauacucagaaagaucaacaaaacagaacaaaacaauauucugguauaauuaagaauuuacuauauaaagauacuucaagacaacggguaaaagauagauuaucuaauaaauggcaugagggcaagauauuucuaaauauuccauguuauauuccaaaauauauuacaaauggauuaagauuuaaaauauacaagcuaaaacaguaaaaccaagaauauauaugugaacgcuuaucuguucucaggcuggagcggcccuuucuaaguaagaucacacaaaaaaaugaauucaggcugggcgcgguggcucgcgccuguaaucccagcacucugggaggccgagacagguggaucacaaggucaggagauugagaccauccuggcuaacacggugaaaccccaucucuacuaaaaacacacacaaaaaauuagccgggcgugguggcaggcgccuguagucccagcuacucgggaggcugaggcaggagaauggcaugaacccgggaggcggagcuugcagcgagcugagaucaugccacugcacuccagccugggcgacagagcaagacucugucucaaaaaauaaauaaauaaauucaaaauuguagauuaagaugaaauaccuuaaacuaucuuuaauaaauuaagguaauuuaaagcaauuaaaaaaaugaaucucuauggaaacaugaacaaaauauaccacagaaaaucuaaaagguaaaauaaauauauacuaaugcccccaaaccuaauaaaauaaccaaucuagguaauaaucaaagaacuauacuuuaaaacaaugaaaaauuauuaacuauuucaauuguauagagaaucacagauuacaauaaacaacuacuguauacucaugacccaguuuugauagaucuuacugcauucccacacuugucucauauuccaccuacagccucccucaacuuuugagaaaauaaaauauuacagguuauaagugaagcacuauauucucccucuuucaucccacuccuuccucuuacccuagcaaauagcaccaugauuugguauauaucauuccuauguuuuuauauuuugcuggauaaauguguaucaaauauauuucacauguucuacauuuuguuuuguuuuuuuugagauggaguuucacucuuguugcccagacuggagugcaauggcgugaucucagcucacaaccucuaccuccuggguucaagcgauucuccugccucagccucccgaguagcugugguuacaggcaggcgccaccacgccuggcuaauuuuguauguuuaguagacaugagguuucuccauguaggucaggcuggucucaaacucccaacuucaggcuauccagccuccucggccucccaaacugcugggauuacaggcgugagccaccgcgucuggccauguucuacauuuuuaaauuauacaaacuguaauauguacauuugcucugccauuuguuuuugaugguaucugacauagccgcagcuguaauauacuguguaacgcacauuuacaauacuucaucaacucucuuggugguggaccuugcuaauaguccuuuuggcagauaccuauuuuuuguguauuuacaaagcugcaaagaauaaaacuagcaggucuccuugaguacaaguuucuuggagcacagaaauacuaagugacaaagugacaagagagguuuuuuuuuuuuuuuuuuuugagacagagucucacucugucucccaggcuguagugcagugauguaaucucggcucacugcaaccucugccucccgggaucaagcgauucuccugaguagaugugauuacgggcgccugccaccauuccuggcuaauuuuuguauuuuuaguagagacaggguuucaccauauuggucagguuggucuugaacuccugaccucaggcaauccaccugccucgaccucccaaaguugcuaggauuacagaugugagccaccuugccaggcccuuuuaaacaauuuuuuguagagauggggucuugcuauguugcccuggcugguccaaaauucuugggcucaagcaauccuccuguuuggccucccaaagugguggguuuaacuuuauuaagaguugccaacuuagugcuacaaagcggcuauccagcacccuguagugcaugaguuuucaucgaccacaaccuuggccuugcauucauacugugguuuauuaugguuuuaauauccauuucuagggcauagacaguuuuguuuuguuuuuuuuuuuuuuuaaagagacaggaucucacuauguugcccaggcuggagagcaguggcuauucacagacaugaucauagcaggcuacugccucaaacucuuggucugaagugauccucccaccuuagccuccugugaagcugaaaauacaggcacgggucaccacauuggcuugacuuagcauaauucuuaagggccuuaggauuuucagaaugguaagugaucacucguuucaacaaagucaccagcuacauucaccuccaagagagucagccuguccuuugaagcuuugacacaagcauuaacuucucucuagcuaugaaaauccuagguggcauggaauacuaugcagccauaaaaaaggaugaguucauguucuuuaccacggacauggaugaagcuggaaaccaucauucugagcaaacuaucacaaggacagaaaaccaaacacugcauguucucacucauaggugggaauugaacaaugaagacacuuggacacaggaaggggaacaucacacaccagggccugucguggggcggggggcuagggaagggacagcaucaggagaaauaccuaauguaaaugacgaguuaaugggugcagcaaaccaacaugacacauguauaccuauguaacaaaccugcacauugugcauauguacccuagaacuuaaaguauaauuuaaaaaaaaaaaaaaaaguccuagguggcaucuccuuccaguagaaggauguuuugacuaaauugaguaucuguugcuuacgcagccaccuucaucaaugauccuagauuuucuggcuaacuugcuauucuccaucagcacuugcugcuucaccuugcacuacuguuauaaaagauggcuucuuuucuuuaaucgcaugaaccaaccucugcuagcuucuagcuuuucuucuguagcuuccucacuucucccagccuuuacagaauugcagagaguuagggccuugcucuggauuaggcacuggcuuaagggaaugcugugacugguuugaucuucuauccagaccacuccaacuuucuccuuaccagcaauauggcuguuucgcuuucuuaucauuugugcauucacuggagcagcgcuuuuaauuuccuccaagaacuuuuccuuagcauucacaacuuggcuaacuguuuagcacaagaggccuagcuuuuggccuaucucagcuuucaacaugccuuccucauuuggcuuaaucauugcuaguuuuugaucuaaagugagagaaaugcaacucuucauuuuacuugaacacucugaagccauuguggggguuaucaacuggccucaacucaagauuguugugucucagggaguaggaaggccaaagagagaugggggaauggccagucgguggagcagacacaugcauuuauggauuaaguuugcuguuuuagaugggugcaguguguggcgccucaaagccauucuuuuuaucauugauuuugccagaggcuugucgguuuuuuaaagaacuauuuuggguuuuaauaauuuucauuacuguaucuuuauuucauuucuguaccuuuuuacuuuuuuuuuuuuuuuuuuuugagauggagucucacucuguugcccaggcuggagagcuguggcacaaucuuggcucacugaaccuccgccucccggguucaagugauucuccugccucagccuccugaauaacugagauuacaggcgugcaucaccacgcccagcuaauuuucguauuuuuaguagagacgggguuucuccauguuggucaggcuggucucgaacuccugaccucaggugaucugcccaccucugccucccaaggugcugggauuacaggcgugagccaccacgcccagacuacuucuuuccuuacauaugccuuuucucuacaaauccuuguuuugguuaacucuguaauuuccuuuuuuaaauaagcauuuaaaauacuuauauaaaauguucauacuacauggaaaguauaggaaaaaccuauacuaauacuagaguuucuucuacaugccacuuggcugcaucacaucaaucugauguguauauauuuuccuuaucauucaguuauauuuucucuuuuccacuguucguucuaagaguuaaacaguuuagauuuccaaaauguauuuuaccuucaaaaaaauuuaauuucauuuuaaaauuaaauugcggaaacaugagaauguuaucuuuuugacaguuuauuuaaaaugugaugagacuuguugccaaguauauaauuucugcugggccagaacgggggggccauuauuucacaugugccuaaaaacaaugcccaucucuaacuauuggauacagggacccauuagagcuggucaacucuauuuuucagaucuucuauauuguuucugauuugucugcuuauuaauuaccaagaaauuuuuagugaaaucucccaaaugguuuuaucaauuuaucuuauaauucucuaaaauaucugccauauuuugaggcaguguuaacuaauauacauauuugaaauuauauuccugguaaccuguaccuuuuaugauuaggaaguaaccacguuuauuccuaacaacauugccuuagaaacuuauuguaucugacauuauuauaccuuucgguuggaauuuuccuuaaaugucuuuguuccagcccuuuauuuucaaccuuuguuucugugucuuggugugucuacuguaaaucaccacagcauaauugacuuuuuaaaaaaacugagucuaguauuaucugauagacgaguuugguuuuagguaaacuguuucauacuguuauuuggauuaauuucuacgauccuguuuuguauuuucuauuuuaacucuguuucuauguuuccgguuuuccucccuuuccccuucuacuggaaugguaguuuacuuguucccuuauagcucuuguuuuauuuuggaguuauacauucuugaaaugguuaauuaccuuaaaauaugacaugcccacuuuaccuugcaacaauuuuggaagauucuauuaccucuucaaauauuuccgguccccuuucuauuuucuccuagcucuucuauuacgucuaugugagauauuuucauguuaccuucuauaccuugguugaaagucuucaaugaucuucuaucacuuuaucuuuguucaaacuuucuaauuuuuccugaucugccaucugguuaagugauucucuuuugguugugucaaauuuaguguuuaauuuuaaugacuucauuuuacauuuauagaauuucucuuuuaaaaaccugucuuguuuuccauagugguuuuugcuccuugauucuaaagacaacuuuccccacucuccuuauauccagagcucagcuuaaauccuuuagcaguugccuuccugggagaguaggucgaugauuauuauuuuuuucaguucaccuauacacuuaaggguauuuaggcuucugucuuccagguuuccauggaaacgucagcucucagccccucccagccagguguaaggcuuuguuuccuuuucugugugaccccuaccggccagccuaccuugcucaaguccuuaugcugccacacagaggcucacaaugguuagcaccuucauuuucagcucucuucucuucuucagaugccugggaauucccucuuacuuuugugcagagcauuacacuuugcuguauuucacacagcacccaguuuuaggugcuugguuccaggauguuucagguuauuuaguucagccugacugcuguuccuuggcaaucuauggcuucccagcuacuaaauuaacaaagguuuuuaaaaaaacaaacccaaugauagcuaaagugcagcaaaaugggagcuuccauaugcuuaagaguguacacaauuacaccguuucugaaguaaaaucuggaauauucaaaagccuucaacaagugcauuccuuuugauacagcaauuauauucauaagcauuuaucacagggaaaucaucacggaaauguacaaauacuuagcuagcaaacuaucacagcauugcuccuaauggcaaaaaacucguaacaagcuauuugucaaacuuaguuaaacccacucucggguccaccugaagauagaguacgcagcuuuuaacaaugucauggaauagauggugguuaaaaagacugcaauauauuuaucacauuucagcuaagacaucaaucguaacauguaucauuaaguauauuuaagaaaagaaaaugcugccaacuagaaugcauuuucaucagauggaauuuuuacuuuuacuuacuaaagaaucaccuguuuuagacuuaaacagauuuauccuaacauucucguaaguggauaaagaaaagcuaaauagauuggcuaggauauugccaaaaugguuuuacauagaguccauucugaaucauuuugacucuuacuaaggaugucuguguuuuuccacauaacguuguccuccgagccacuaaguauguuagcacuccuuaguaguaguccaaggcuaauucuaggauuuucuccuaaucugcgcccauccauuuucuaagucugauccugagcuuucuugauauccaaagguuuguucuuucagggcagauucuugcaaugguccuuaaauaguuugcugacagaaagaacaaggcugcacgcaagugugcacugaugcaaugaugaugacuaggucaucacugauaccuggccagcuacuguacuaugugcacugacuuugcaaugcacucgaaucaaugaaucaauguagcaguugcuuccagagagcagggcuagggguuuuaaacuuuuggccacagaauccuuucauucucaccaaguguucuuuguggaggaaagcucagugcccagaacacugccccuccccaccauuacuuccucccccaagcccaccccucagagaggaccucacacacacacaggcaaggggccucacaaaacagauugaaaggcacaauugaaacaaaacgaaugcuucuuaaaagcuguuuugaaguuucuacucaguuuaacaucacauucauucccaaaucagcaucacuccucaccauuaucuagucaggaauggaaagcauuagaugauagugguuaggagacuuccugcuuaugacaauuuagguucaacguauaucuaaauugaagagaugaaacaagcaaaacaacugaagaacaagccagaauguuaugaucccacccuccccacccauagugggaaacaucuuuaacuguuucuagaguuaguucuucauuuuuagcuggauauguacaugucuuuaagucauaugcuuguuuuguucuuugaccaaucaacguuugcguaaauuauugauuuccugcgaauagagaacacaucuccuuucuacccccuaccuccaguccaucuucauccuaauagucacuauggagccucugaaacuuucaguuacuuaaaccaugauuccaauuuuaaauguaccgaaguaccuaaccacauuucuggcaaauaacgauaaacucuagaaaaaauauuaaaacaaugaucuugaaggcaccagagaaccaccaaaagaagguguauacugaaaaguggccuaguguuggaagaagggaauggcacagcccaacaugguugauguaaaagaaacaggaaaaugagauccacucucaagacaaaagacaaucaacagagaccagcuguaguugacccaaauguuggaauuaggagacaaagacucuaaagcaacuauuauaguuauaauaaaagauauagaaaaauauguucauaaucaaugaaaauugcagcacaaaaacagaaaccaugaaaaagaacaaaauaaaaauucuagaacugaaauaccaggaaaucuagaauaaauuacucauuggauggucuugacagcaaaauaaagacgagucauggguuugcacagagaccaacagaaacgaucaacucuugagaggaaaaaaaagauuaaaacuucuagaaaaccaaagggggaacaaucuugaaagcggacagggaaaaagaacguaacacagaaaaagaguucacaugaccaguaacuucucaucaaaaacuacaaaggccagaagacagugcaauaacauguuuaaguggugaaagaaaaaaaaaugcugaaagaaaaaaaguaauuguaguucuauagccagugaaaauauccuucaaagaugaaggcaaaauaaugcuauuuucagguaaaauaaaacuaagggaauucauaguagagaccugcauuuuggguggaagcaaacugacacuacaauagaauccugcaucuuuaggaaggaaugaagagcaguagaaacaguaaguaucuggguaaauauacuuuucuuaauucuuuaaaauacaaaggaugguuuaaaacaaaaauuuauaauaucgucuuguggguuuaaaaacauauguagagguaauauaaaggagagcgauacgaguaguaaauggaacuauacaaccacaauuccucuacauuuucuaugaugucauacaaucuuaacucuaaguggaauguuaagaaaaauguguauuauauccuuagagcaaucucuuuauuccuucuucucuuucacacacacacacacacacacacacacacacacacacacacugcagaaacaaccaacaaauauauuaaaaaggaacuauaaaaaaauuucaaauaauccuaaagaaggguggaaagcaagaacaaagaaacuuuuuaaggggagaaaaaaacaaaaugguaggccuaaaauuaaucuauuaauaauuauaacaaauguuaaugggcuaaaacuacaauuaaaagacagagauggucagaaggggcaaagcagcaagaccgcucuauauguugacaugagggacacaauuuaaauauaaaaauacacauaaguugaaagcaaauggauggaaaaagauuaucaugcaaacauuaagcauagaaagagguuaaagaagcuaauaacuaucaggcaacaaauuacuaccagggauaaaaagggacacauuucauaauaaauguacuuaaaagacauauucgcaaauguauuuuugucuaacaacagaguuucaaaauauaugaaaaaaaauuuguuuuuugagauggagucuugcucugucaccuaggcuggagugcaguggugccaucucggcucacugaaaccuccaccucccagguucaagcgauucuccugccucagccuccagaguaacuacaggcgcccaccaccaugaccggcuaauuuuuguauuuuuaguagagacaggguuucaucacguuggccaggcuggucuugaacuccuggcaucaggcgaucugcccgccuuggccuccggcgaucugcccgccuuggccucccaaugugcugggauuacagaugugagccaccacaccuggcuuaaaauauaugaaaauuugacagaauuaaaggguaaaggagacaauuucacaaucauaggauaagauucaacauuccucucagcaacuagaccauaggaaaaauaucaaucacaacuuggaugaucuguaugggcaguuguaacauucuacacccagugguauacugguaaauuggcucucugagcagggagaaaagaaaaaaagaaaagcccugauuuguagccuccauagaugucuauuguauaagguucccaccauggcagaugcaagcuaccaacaggacaauaucacacagggagaugggagagagaugggcacaaucaucucccgcaagcugaucugauccagcuccagcacaucaccaucuacagccaacagcugcagaacccacauucuuuucaagaguacauggcacauucaccaagauaggcuauuuucugggccacugaacacguuucaauacauuuaaaaggacggaaauuauacaguguguucucugaucaaaauggaauuauaauuaggaauuaguaacaauaagcuacccgggaaaauccaauauuucuaaacaauaucuuccuauauaauucaaaggucaaauaaaguguuuugaauuaaaugguaaugaagauacaacauaucaaaauuugcagaauaaggcuaaaaauccuuaaaaggaaauuuauacuuucaaauacuuauaucagaaaagguagaaagaguugggcaugauggcugaugccuguaaucccagcacuuugggaggcugagggagguggaucacuugaggucaggaguuugagacuagccuggccaacauggucaaacacccagucucuacuaaaaauacaaaaauuagcugggcgugguggugcaugucuguaauuccagcuacucaggaggcugaggcaggagaaucgcuugaacccgggaggcagagacugcagugagccaagaacaugcacugcacuccagccugggcaacagagugagugagacuccaacucaaaaaaaaaaaaaaaaaaccagaaaagguagaaagauuuaagaauuauuaauuaaaauggcaauacucccugacaugguuuggcuguguccccacccaaauagcaccuugaacuguaauaauccccaucugucaagggcaaggucagguggagauaaccaaaccaugaaagcaguuuccccgauaguguucucgugguagugaauaagucucauagaaucugaugguuuuauaaaugggaguuucccugcauaagcucucuugccuacugccauguaagacaugacuuugcuucuccuuugccuucuaccaugauugugaggccuccccagccacguggaacucugaguccguuaaaccucuuuccuucauaaauuacccagucucggguauaucuuuauuagcuguaugagaacagacuaauauacuccccaaauugauccaaagauucaauguaaucccuaucagaaucccaguuggcuucauuguaggaaguuaacaagcugauuccaaaauacauauagaauuucaagagacucaaaagagccaaaauaaucuacaaaaagaacaacauuggaggacucaaacaucacaauuucuaaacuuacuacaaaaugacaguaauaaacucaugaaucuguggaccugauuuucaauaagggugaacaucaaaaccacaaugagauacuacuucauucccacuaggauggcuagaaucaaaaagucagaaaauaacaaguguugagccggaugugguggcucaugcccgcaaucccagcacuuuggggggcugaggcaggagaaucacuugaggccaggagcucgagaccagccuggccaacgugaugaaacccugucucuacuacaaacaccaaaauuagcugggcauggugaugcgcaccugcgguuccagcuacucgggaggcugaggcaggagaaucacuugaggccaggagcucgagaccagccuggccaacgugaugaaacccugucucuacuacaaacaccaaaauuagcugggcauggugaugcacaccugcgguuccagcuacucgggaggcugaggcaggagaaucgcuugaaccuaagaggaggagguugcagugagcugagaucucgccacgcacuccauccugaauuacagcaagacucugucucaaaauaaguaaguaaauaacuaaauaaauaaauacaacacaacacaacaaguguuggccagaauguggagaaacuggaacccucauacacugcuggugggaaaguaauauaaugcagccacuuuggaaaauaauuuggcaguucugcaaaugguuaaacacacaguuaccaucugacccagaaauaacacuuguaggcaucuaagaaaaaugaaaacauaugucuacauagaaaccuguacacaaauauuuacagcagcacuauucguaauaguaaaaaguuggaaauaacccaacuguccaucaccugaugaauggauaaacaaaaugugguauauccacagaauggaaucuuauuuuaccauaaaaaugaaguacugacauaugcuacaacauggaugaaguuagaaaacauuauacuaaauggaagaaagccagucacaaaagaccacauguauuagucggcuuaggcugccauaacaaaauaccagacaagacggcuuaaacaacaggaauuuauuuucucacaguucuggagacuagagguccgagcucaagguacugucaggguugguuucuggugagggcucucuuccaggguugcagacggccaccuucucacuguguccucacauggccuuuccucuguguauguggagagagagcucucuggugucucuuccucuucuuauaaggacaccaauccuaucaggguaaggccccacccucacgauuuuauuuaaccuuaauuauucccccaaauagccuuaccuccaaauaccauccaaauauacuggggguuagggcuucaagauaugaauggaggagaggcacaauuaaguccauaacaccacauaucauauaguuacauguauacaaaauguucagaauaggugaauuuauagagacaaaguacauuaguagaagguagggguaagaaggaagugacaacuaaagggcacaggguuucuuuuugagaugaugaaaaucuucuaaaauugaaugugacaguugaacauuaucugugaauauaccagaaacuauugaaacguacacuuuaaaugagugcauuguaugcuaugugaauuagaucucagagccauuaaggcugggcacaauggcucacaccuguaaucccagcucuaugggaggccgagguagguggauuacuggaggucaggaguucaagaccagccuggccaacauggugaaauccugucucuguuaaaaauacaaaaaaauuagcuaggcgugguggcgugcgucuguaaucccagcuacucaggaggcugaggcaggagaaucacuugaaccugcgagguggagauugcaguaagccaagguugcgccauugcacuccggccugggcaaaaacagcaaaacugucucaaaaaaaaaaaaagccauuaaaaaaauucaauaccauuccaaucaaucaacuuuugggguagacauugacaagaaguugacaguccauugaggaaaaguuuuuuucaacaaaugacacuggaauaauuggauauccacacaggggaaauuuaaccuuaagccuuacuguacaccauauacaaaaguuaacuccagguggaucacaggucuaaaaguaaaugcccaaaccauaaagucuuaugaggaaaacacaaaauauauuugagaucuaggcaaagguuucuuaugucacagaggcaauaacugcaaaaauaaaauaaaaccaauaaauuagguuuccccaaaguaaacauuugcucacccaaagacaccauuaagaaaaugauuagcaagccucagacuugaagaaaauauuagcaaaauauaucugacaaaacacugguauccuugacauauaaagaacuaaaacuaacaaaaagcaaaauauccccaaaauggaaaaaacaggaggcgaaagacuuggacacuuuacaaaagaugacauacgaauggucaacgagcauauaaaaaggugcucaacggacacgaaguuuacauggcagcccgagaggugcccccgguuuagggcaccuucgccuaaagaacaggaucaacugugcuuugaauccaggcugagucagcagaggcaggagugaaagcagaucuuauauagcucugaugacacacagucuuagcuucacaguauuuuuaucucagcuuuaaaucaacugaacuauauggagaaauguuaucagaaauggaaugagcaggcucuucaugugaucagaagcugccugagggagaucuguccaggccaccagccccuccucacaccucacugguaugagaccugaggaaaaagcgcuauugggauaauucaaguguauuaucuggaaggggagaauuccccauguucaaggaaggacugugaaacggauguauuccugaauuaugaggugugccauuuuccugaagaaugagcccugaagggcgccugugugaaaggacagggccggagccuccccgcugcucucuaugccugggcuccugcugcucccugaacccaccgccccccacaaugccacacucaccaccuguugccucaacaugcacacaaauuaaguguucauaaaucauuuacuuuagaagaguagaaaaacgaacuaugacuaaucuuuaggagaaaaauggucacaucuaaaguuauucuuaaagggaaaaaaaauuaaaacaguaugaggacaaguuaaauauaggaauuaagaugaaauaagaaaaagcaaaaacaucagagauaaaaaauuaaaagucuacaaggcaauaaaauagaaguuucauucagcagacaauagauuagguauuuuauacuaaggcagccauagacucuaacaaacccauacauuugacuuuuaaaacucugagguucuuugcugaagguccucugaaagcuucuuuggccagaaagcaggugagaacguaagcagguaucuggggccuccuccgcaggcagguggggaaaugguguaaggugguacagggguuuauguccaagagccaagccugguucagccuccaaaauagguccuacaacucuucugucauccuagaaacguugucugccaaggcaugcuucuguacugauggggaggggcaagucacugugaaaggguccuaucagaugcaaagcuucacaucucaccuuucagcaagcagacaccuucugggcaccuguccagugccagguaccaugugugugacuuaggccucaccaacagacugccuuccuggaguucagcaucuacuacuaacguaauauaaagugagcagcaggaugacggagccaguauucucaaaugucucuguuacccacagcaccaugccuuauuucugaagugaacacaccuggggaaucaauucuugacuuuuaguuauugccaaacuccaaccauucucauuagcuaaaagaaaagccaauucaaucaaagaagcaaaacuaaacagaacagaaucacuuccuacuaccacuuguuucccaaaugcgacuuaagaaguggaaauuuaaacaaguaacuucuauuaaaaucacauggaaagacucugcacuaaaaguuuuauuaaaaauacaguacuuccuaggcugggugugguggcucaccccuguaaucccagcacuuugggaggccgaggugaacagauugcuugaggucaggagcucaagaccagccuggcuaacaugaaaccccguaucuacuaaaaauacaaaaauuagcugggcaugguggcacgcaccuguaaucccagccacucgggaggcugagguaugagaauugcuugaacccaggaggcggagguugcaaugagccaagauugcaccacugcacuccagccugggcaacagagugaggcgcccucugaaaauaaauaaauaaauaaauaaauaaauaaauaaauaaauauaaaaauauauauauauacacacacacacauauaucguacuuccuaucuucaaacauuaacaaguuaaccuguaccaaauggcagaacagcaggcucacauacuauccuguauaauccgucuguaguuauaaaagaauaaaguccuguccagucuguggguacgugcauuucugaaaagaaauaucccauacaaagcaaauaaauucacaucuaauagcauacuucaaaaguaaaaacuaauugcaauugauuauaaugaacuaaaaaauguguuacauaauguucaaaguacucugaguauaauuaccgugaaucaaacuuugaaaaauagcugaagaacaugccauauuuauacuaaccgccuaccccaccaaaaaaaaaaaaaaucacuugugacaaguacacaaucucauaauuucuacagggucuuacuuuaagacagauauacaauuucucaauccuaagaaugauuuuaauaguaccaggucaguaguaaaagauagcaagaacuuugcaaacuaggcuuaacauuugcaaaaggcaaacuaauaaacugcacuuuuaaaugcaugcucuauacgaaaaucuagaaggcaaagaagagcaauuuuuaaaaacucauauagaaguccaccaccuuauaagggacaguuccuuuccauaugguguacacaaacuuuuucaaaagcaggagcaugugcugaugguucacaauucacauaccacuucauauccugcuuucccacagcaauauauuaugaacauuauuccaugucaacagucuucauuguguuuuuaauagcaguuuauaguuauccuuaauauugaagauugagguuguuuuccauuguuuccuauuauuaaaauaugcugaagagccuugcacaugcaauuuugaauacaacuauuuccuuaggauaaaguuuaaaaaauaaauugcugggccacaguacauuuuuaugucucuagaaaggccaggcuugugugguucaugccuauaaccccacaacuuugggaggccaaggugggaggacugcuugaagccaggaguucaagaccagccugggcaacauagcaagacuccaugucugcaaaaaauaaaaaauuaggugugguggugugcgccugcagucacagcuacucaggagguugagguggggugggggguggaaucacuugaguccaggaguuggaggcugcacugagcuaugauagugccauugcacuccagccuaggugaaagggcaagacucuaucucaaaacaaaaaaauauaucucuaaauuucccuccagaaagaucacagcaaacuaacauuucugccugcacuguagagcuuggucuccuugccaacacuggcuguaauagucauuucuuaacaauguuugucaaccugauagguaaaaacagggucucacuguguugcccaggcuggagugcaguggugcgaucaugacucacugcagccucgaccucccaggcgcaaguguuucuccugccucagccuccugaguaguugggacuacaggcaugcacuaccacaccuggcuuuuuuuuuuuuuuuuuuuuaaagacaagguuuugcuauguugcccagacuggucucaaacuccugagcucaagugauccaccugcccuggccucccaaauuccgggaauuaaaggcgugagcauggcuggccuaauucuucauuuaacaguuauaagguugaacauuuuuccauaugcuuacuauuugcauuucuucugugaaccaguauguccuuuuacagacuuaugcuaaaaguauggauaaacauauauauacacacacacacacgagaaggauagauuacaucugaaaaauaugaaaacuuucuauguuuagguucauuugauguaagccaugcucauuaggugagcagaaucagauuaauguaagacuccuaaauuaagagugcaagaugaaaaguguccaaacacaucuguugggauggaugguuauucuaaaacagacauggaucaucauuaaucuacuuugaagacaauuuguuauuccuucugugugaucugcuguucuuugaaauuuugguuuucuauaaaggagagaauuuugcagugagcaggcgaagcaggaaggcugccaccugagcacuccccugcagugcagcuccuauggaagggaaggcgauggucagaguguggaccugaaaagagugguggcggcagccaagacgggacugcucaacuggcaggugcagagcugcagcagggaccagcguguccuggcacggugucccugcaaagcacagccgcaggcuccaagggcucagcagauugacucgggugaaaaagugccccgacccccagcaaucacgaaccuuaucacuaaacgucaaaauagacaauuaaaugugaauucugaaugugcuuauguuaugacuuacugagagcaaccaagaccaaucucauucucauucucaaauaugaaugaaugauucucaaaucaaccaaucucauucucaaauaugaaugagauucuuacggugcuagugggggaaaagaagacuggaaaaaacaggcuaaggaacagaacaaacugauucaggccacagcaauguacaggaagacaaauagaaacgucaaaguucaugaacauuuauucagguagagagaaaaaaaagacaucaacaugaaaguuuaaacugauuccaagggaagguaaaauuaugaaucugagguaccugaccuggaaacaagacacagguaggucuggagcccagaacaaugaacagaaaccuccaacaggugaccugacaccugcacgagcuaggccggacucucauacuucacugcauccccuuaaauaccucuccucuagccagcacccauguuuguguuccaaccuaagcacaacaccugaaauauagcggugucaauaaauugaauaagaaaugccaauaccuauuucaaauucaaaaggaaagaaaccugguauuauuuacccaccugcauagaauuuuacucuauguauuuuauugcacaagaaaaacaggccaggugcggugguucauaccugucaccccagcauuuugggaggcccaggugggcggauaacuugagucgaggaguuugagaccagccugggcaacauggugaaacccuguaucuacaaaaaauacaaaaauuagacagaugcaguggugugcaccuguggucccagcuacuuggaggcugaggcggggugaucaccugaccccagcucaaggcuguagagagccaugaacccacaacugcacuccagccuggguugacagagugagacucugucuuacacacacacacaguugcugcaugguaacuauacacauguaagacaucauagaaaacuagaagugaauaguuggaagcgcuuaacagacagacucacagugaagagugauggcuuaaggcuaaaacuuuaggagaaaaaccaagucugagaaauggcugaaaaccaaguuaacuaaaguggaucuuucugucugcagaugcucuggucauuuucuuuucuuuucuuuuuuuuuuuggcuuuuccaaaauucccuucuuucaccauuuugaguugaaaagucaagauaaauauuuaugcuguauaauaacccaccucucugcuacagcaaccacaaaugucacagguuccuaaagccuccaagaauauuuguuuuacagcaagaaguaguugcuuuuucuaaaaaaaacacacaauuuucuccuccaggauagacaauggguaaaaaucuagcuguuaacuacuagccagaguuaugggaaggaaaagaaucccuccuuuuucucucaaccaguuuuccuuucuaacccacuuccuuugccaacugcugaugaggcaugucuaauuuugcagagugauacuagaacagugagaggcacugccagcuccuucuuccccgguccaaagcaccuccuucccugaaacacaaccuuacaacugcaaguauuagaugucacagcgagcaagccuuuaggagauuauuuuaaaaugaccaaauauacaccaguaagagaaaacuucugaaaaacugcucuguuaugcaaccugggcuggaauaaaacagcaauaauggcaacauauacgcaauuccaaagaguacuaugcguaaauggcuuuaagugaagauggcucuacaaaaacaugacagaugacucaaaauucuuucaguucucacaaugaugcugaaaagauaugugaagaguuaggggguaaaauuauauuuuaugauuuucaacaauuaauaaacauaaguauacacucuacuguuucacuucuacccuaauacauugaagaguuaaucaaaauacuucuucacaacuucucaaagaaaauauagaaauguaauacucugagaaaugugauccauucaaauacaguagcugaagacuacauagagugucuaaaggcaauucuagagucagacugcugagaaccuuaagacccgccucaccaccaccacuggcugcuguacaaccagguuccuggagcuuauccacagagaaaggugacuaccaccagcccgcggugagauaaggcuuaaugagguguggaugguuccaagcacaaagccugacagcuguagccauuauuucauuauaaugucuaaagaauuaaagaaagauauuuuagacuugguuuagauucuccaauuuuuuguaaauauauggagcuauuauuucucagacaaaacuggaaaaaaaacuacccaauuugagaggcaguccuaaaaaaaauuaaaguugcagguaccaaaacaacuacaaauuauacgaauuuaauuauuuguagaauacaagaauucaguaacuucugcuagcauacaaagucucaccgccuuaugagcaaaaauaacccaucagaaaaaggaccaaccugauuuaaaaaagaacacauuaagaaauucccaaggcuggacgugguggcucacaccuguaaucccagccuuuggaaggccaagccaggcggaaugcuugagcccagaaguuugagaccagccuggguaacuuggugaaagucucuaggaaaaaaaaaaaaaaauuagccgggcaugauggugcgugccuguggucccauccacuugaaggcugagaugggaggaucguuuaagccugggagacagagguugcagugagccgagaucaugacacugcacuuagccuggguggcagagcgagacucugucaaaaaaaaaaaaaaaaaauggaugacuuacaaggcauauuaauuacaucucaauaagguggauuuuaaaaagaaauucuccagacacagaucaacaaugacaccuccuugagcucuggagcagugcucuccugcuuccuguacaucagaaaucccaccagugucuucccucaccaguggaacuaccaccuucagcuuuccuacaagaauuaagaaaaugccauaccuagcaagccagaacccuguugggggcauaauaucuucucacuuggcaaagacucuaucuucuuuaaaagcaaccuacccaucauagcacccugcaaucccacuccuacauacacacccuggagaccagaagucacagagccacucaaaaacucgcacacaauguuuacagugguauuaguaacagucaaaagguggaaauaacccaaauguccaucauugaucaaugggcaaacaaaauguagacuagcuauacaacugagucacagaaaggaaugacguacacagugauacgcgcuacaaggaugaagccuccaagcaugcucagucaaagaagccacauaggcagcccacagaucauaugacuccauguaugcaaaauguacagaaugggcaaauucauagagacaaaguaaaugaguaguugccagggccucgggggaagagggcaugaggagugacugcuaauggguacaaggugucguuuuggggugauuaaaauguucuaaaauuagaugguggugauaggugcaaaacucuguaaauauacuaaaaaccacugcacuguauacuuuuuaaaagguugaauuuuaugguacauaauuacaucucaauaaagcuauuauuuuaaaaguauucuauauguaaguguauauacauguauaaauaugcaaacacacauuuuaugcuaauucagagauugacauaguuuuauaucuacuuaaauuuuuuuuaggauucuaaaauauuaacaugcaagaacauacuggaauaucacaaaaacuaguuugauagaacugauauagucuaucaaaccugaagacuuuaaaccugaagcuccguugaaucagcaacuuuaaaguccuagaaacaguggcaaucuccucucuccugagugagcuuaacucuaauuucaaugucauauuuguauggaaucaagaaagccuccaaauuagcuggugcaucuccaaccacacgaauagugggagccgcaucuuuuccacccucaucaccuuuguggcacacagcacagucccccaugcacaucguggaccaaaaacuaaaggaauaaaauucuuuuuaaauacuguacuuuaaaaaauagggccacagcccgggcaacauagcaagacucugucucuauaaacaauaaaaaaaaaauuggccaggugugguggcacgugucuguggucccagcuacuugggaggcugagaugggaggauugcuugagugcagguaguugaggcugcggugagcugugaucauaccacugcacuccagccugggugacagagcgagaccuugucucaaaaacacaaaaaaauagggccauaacaggaaaacuuuugcucgauguccuaucccuuuugaucagguaaacaaacuuuuccuguaaaagggcagguaguaaauauuuuaggcuucauggacaaaacuguuucugacacaacuacuuaacucuguucccauaacacaaggcagucauagacaauauauaaacaaauggacguaaaacaaaugaucugcugagaaccucaggaccuugcuuuagaccagcuuugcccaacggaaccuucuacaugacagaaauguuuuauuuauuaaucacacagcuagugugccuaaggaacuuuaaaauauuucaaauguaaacagccacaugugcccaguggugacuguacugcccagugcugcauuugacuaaaaaugaaccaguucuacucuguucaaaaacuuaaggcuaaaaaugaacccugcgauuauuuuacaugaugaacugggaggagaaaacaauauaaaauucuaauaauucauaagucauacuaguaaauaaucaaaacucuaagcaaucaaccugcgcuaggcaggaggauacguguagagcuccauauaucuggacuuggccaugcucugccguguguacaccugcuggaugccggcucugaggucgucccagaucugguccaggccaaucugcuucaggccguggggguucuggcuccggguugacgacauugugagggauguucuaaagucguccagugcagcaauccuuauucaaaguacagcuaguucuccauuagaugaaaauauacaguaccauuccaaauuuauucacagcagcucagaaaggauguccuuuaaauguagagaaugaaaucucauugcaggcaaaccugaggaagaaauaaagagaaucaguggauugucucugggguacuguaauaaggugagacacacugacagaaaaacucagucugcagggcccacucuagagaccauuucucuuucuaugugcaaacacauucauguuaaccauauggucuguguacaaaaauacgcuuagaauuuuaguucaaaaucauuaugauaucagcacucaagagaaaaccuggguaaaaguuugcacaagcacaacuauguugccuuccuuugccuucggaaguuaucaaaaauauauaucacuugaccuagaugacaauuagaaagacaaacucaaagaaaaaagggcaaaggauaugcucaggaaauucccaggaacacaaacagcuaauaaauaggaaaaaucauacaaucucacggguuaccuaugacuuuuaguagcucuucacuuagaacucagcaagaaugcaaauguuggugaggcugaaaauaaaaggaaauaggcacucccuuuuuaaggagggaaucuggcaagaauuaucaagauucaaaauguacucugaauucagagagaccugaguuugaagcucagugccacaucuacuagauagguacaugugcuacugggugaguuucuuaaccucucuaagcucuaauuuccuagucugcaaaauggaggccaauuacuuuccucaaauggauaugcagaguuuaaauaagauaauguauuagaaaauacuuaacacagaguaaaugcuuaacaaugguaguggcuauuauuuccaaguauaugaagauaaugacaaauacaauauauaaugcuucagcaucuuggacacauaaauaaaguaacuuagguauucaauauuguaucaaaccaauacuucucaaugcacaguaucacagacauaauuuaaggacuaccuauguacgucacaucaaaacguaaagguuuuaaauaguuauuucuaguguaaaucaagaaacacugaauuauuugaaugguuucauaaagcaaauguuauugggaaguaaacgagaucuggaacaaugaggcuagguuaucaaagccugcaaaccuaugucccaguuaccuugucaaguaauucagcucauccuauauccucaauggcauuacagagcucuguguaaacuaaggcacauuuagggacccugugaggucaugcuuaaggaguaagucugaaccacugaaaccuauucucuaauauuuauuuauauucugggcuaugggucuuaauauuuuaugaaucuacaacaucauuccugauccugaaaguauuuuaugucuuacauucgaauugguauguucaaauguggaauauaaaaauauuuaacacaaggacucccucaaguuuuaagaaacuaacaacucagcaaccacucuggaaauguuuccuauguguaguuuccaugugcuuuccuuucaucaucuacuuggggaggguuaacagcacaccuauaauaauaaccauguuuuggacugguggugcaucugauagcaucaacuguuuggaccuacccuacuuuccccaucacuuaauuuuucccuaaggggaaauaaucacuuaaauuucccaaacucauaguccaguuaauucugucuuggaugagcuuucucauaccucucuagaugcucuuuuacuccuuuuccuucucuuauaauuucuaucagcaacugaaaaaaaaaaaaguucuacucuggcccccaaaugccuuucuccaucaguguuguccgugucagcgaguggcaaugccacauguauccacaagucagaaaccugggaaugagucugaugccacagcccucaucuuucacauucaacugcuacggacuucauuucaaaugcauuagcucaucuccacuuccuccucuaguaaucauccucgccaucucuuaccugggcgacuauuuuaguugucuaaacuagauuccaauaccuugugucugcuuguaucauucuugacauggccgucagcugucuaaaaucgcugucauccuaagacggugucauccuaauucugaauaggcugucacccuaagagcaacagggagccaaggcagagucugaagaagggaaauccuuaauauggcacuaucagauccuuuucucucuucauuugccucucacaaaaccucaacucucccccucccuccccucagguucagccacacagauguccccccuugccaccucagucuccuuuccccgccacaggaucucugcaucugcuacugcuucugccuagagaguucuagagaguuccuccccuucuucaaguugccuuccagucauacuuucaaaggaggcuuacuaggaagucccagaagacguacagguuugcuuuaaaugggauuuucccuucuuaacacuuacuccaggccauaaaccugcacuuguuucuuuacuguaacucccugacuucaccggggugcaagccccacaggcucaugagaaccucauacagagccuggcaugccgcucaauacauauuuuacauaaauaaaugaaggaauaaaucaaggaauugaaaagcuuuaugucuuaaaaagauuuaggaauaaaauaccaguaucaucaagcaucugaacuugcucaaaaucccucuuuagaaucucuacaaaauucuaucucguuucuucuaaacuuuuuccuuaaaauauuggauucugggcuaaaauuuaugucuugcuguuucauuuagucauguuuuguauuauuuuggucacugcaaauguauacauaccccaacacaguguuuaaacaggcuuacgaaaauuacaggauuuuagugacuacuuaguuuuaacgaauauuuaguaggaugcuaccauaugccaggcacuguccuaggcauuauuuacucuuaaugguaaacagacaucgucuacgcucauaaugcuacagugacggaauaaagcaugcuuauuuauuuauuuauuuuuaaauaggguaucacucuguugcccaggcuggagugcaguggcgugaucacggcucacugcagccucaacccccugggcucaggugauccuuccaccucagccucucaaguaacugggacuacagguuaggacaaccaugccuggcuaauuuaaaaaaaaauuuuuuuuuuuuuuuuugguagagaugggguuucgucauguuacuuuaugugcuaugcauuuguguaccaaaagcauuuguucuuaagagccaaauacaaucacuggcaauuagagguuaaccuuaaugauaguucugacccuuccucuucagaugaagaaacuaauucaaagaagcaaucaaacuuggcaagcuucuaaugcuacaaaguagcaggaccacaaacuaguacacucuagucugaauuuuagguucuuccguuuuuaaagugucaaaacagugaaaccacuguaagucauaggaaaaaaccaccaacaacugccuauuuguuaaaugaggaaaccucaacaucuccaauuaaaagagccgauagcuuuaaagaguuaauaagucaguccuaauuguaucaguauuaaaucuacucagauauuuugaaauuuaagaaagcccuuuuuuuuuuuuaaagcuugacuuuugaaaaaccaagauaaacugugcaacaaucaggacaauuuaaaagauaaagucaagauaccaguuauccucuagcaaaguuaaaauauaccaaauaaaauggucaauguggauuuuucuccauaacaccuccauucuccugucucagcauaagcacaucaaauauguucuuuacauauucucuauucuuuuuauuacauuucugauuccaauuaugaaucuuacucuauuaaaacguacuguuaaucuaugagaucaaauacaacuuuucaugucacacucgucaaguuuacuugcuguacacuuuuuguguccagaucuaugcaugguaacuuuaugccacaucacaccucaguuuauauuccaaauaugcugaaaaauuagcaaaaucuucuauuccugcugcuaugugauuuauucuucucuauccauucccuuuuucuaguuguucccacugaguaucuaaaauucaugcacagaugaucugagguuuucaaaaauucauacuuaagugggcggguuuaaagaggaugaccuaaucuuacauuuuugauauccccuaaagagccucaccuauguacuuaaaacauuaauaacuaauacagcaaagaaaccucaaacaacgucuacaaggaaauguuagaaguaggcacaucaugaaaaugucuaaaaggacagauaggucacacacaugcugggcagcaacagagaccugugaggaggucccaggcagggcucucggagcagaugcugagaccuggcuuggguggaagaugcuucuuagagaugggcacccacgagaugacaaggaggaagcagacggggcagagaaaagaugaacugugauguaggcccuauagagccagcaucacccuggcagggaacucuguaacaagcguugccagagggucucacaugggcugcaggccaggccuuuaacucccgcugggcugagaagggugcagcccgguccaggcagcucugcagcugaggcccgauggcgcuaacacugggagucaaguccuuccuugaaggggcaucugggugugucaccuguguaucuaccagccugcuccaauggauacaagaggcucaggcaaugaaguuuuccaguuuagagggguacgggugugugugugugugugugugugugugagcgcgcgcguguguguguguguacacgcgcgcaugugcgcugcaugcccaugcuuaaucuauugaugcgucacucaagugucuggugaacugaacugauuguaaaacugccugggacaauaaaauagaauacaggugcccacaaaacacuugcuucucuguuaauguugaauuuuacuuuacaaacuauauauccauaucuuauaaucaagccaucaaaaaaugucacucuuaagcagauuucauaagucagagagguucaaaugguuuuuagguaagggguaaaaauauuuuccucauaaaucaugucucauagcuagaaaaccuaggagguccccaaaccuaaagauauuaaaaacaaacaaaaaacaaacaaaaaaacaaaauauacuuaggaaaucagguaguuuucaaaaguacucagguauaggagauccuuggcaucgcaggaguugccaagugugguuaugaauguccacgcguuucgggcguguacccugcagaugugccaccuccugacuuggacacacagguggcuggugagugaagcaggacgacagcaggggcagccacagggccccucacaacuucaguguucucuagacggccaauccccggagagggauuaucauuuucuugacaggaaaccaaggcagaagaugcaauuagucaaggacaagaagcaauggcagagccagcugugcuuccacacacacacuagcugcuggcucccggagcccgcaugaguuuuuaccacagacacacacgcgugcagacacacacacgcgccacaguuauacuucacuuucaucuaacccuuggaaaauaauggaacacaacagucaaaauaaacaggucuaacagaagaaaagcagucauauauuuaagaacuugucucacagaaaagacuguuauuccaaaagaagaugaaagccaacagaaucaauaugaaacaagcucccuaacaauuccaacugugaacuaaucaaacaggcuguuucucaagauuaacggugcauaagauuccuucacugaguagaagugugaacuaaaugaccugcaaaacuccugaaaaauauaucuucuuugauauuaguaauucaguuucauccauacauacuggaagggcuuuugaaaaagagcacuuacaacagucuuccacuaaacacuaauugcaacaucaacugaacugaacaucaagggaugacuagcuuuagugaaguuaaauacuuuguuugcuagaagacuucagaggucuugauaagugaacgugucuuaugaauuuccaucagaaaaacacaguauaaaacaucuucccucaaacuuacuuagccaugaaauauuuuuuccugaacguaucuugagaccaguaguaauucaagaaaacuccaguauuucaaggaacauggcuuuaaaaagaaaaaaaaaaaaagaucugugcugaccccuacugacuucuagcucuuuggggaucaaucgcacacugguucggcaacuuuuuucauuuaaaaaugauauaccucacuucacuuaaugaaauauaccucuuuuuuuuuuuuggugagucauauauucuauuauuuaucaauaacaguaccuaacaaaaagcuuucaaguauuuacuuuuuaacaauuauaauacugcaacaagcagccuuauaaguauuuacuuuuugcuuacuugagugauugauaaacaccuguauguaccuaucugauaaauaugauauugacuaugaugccaucuaccaagacagcaaacaucagagaggaacagcucuacaggagggcaguuguccuuggaugugugaaccugagguccuugugaaucaucccaagcagcuggacacacagggccucagcacagaagagaagguggcccuacacagcugaucucugggguuuaccaccugauccugggaaccacaguuccucaggggaauacggcagacagacggcccaaacugaguccugaguaacauuuaaaaacugacaagaugauggagaacccauagaguuuguaacugcaaagguacagccagacacaaagagaaggaacccaagccuggaagccaagagaagaaaaggcagcaguugcguaaaacugugugaccuuguaaguucuuucaucucucuuaacccaccucauggguuuguggugaggauuaaacaagccaacacuguuucaaaaaugcuaacuauuacuuuaguagaaaucuaacuggaacagguggggagggacagaaaagacagacgaccuugagcaugugggcugugaaggaguaagaaggcugcaaagggcaugauuagggcaugaugccaaccaggcucaugugccucguccucuuccugccucuggcugggaagaggguucucaaucaaggggcacugugggagugccacaguccagcugggaaggcucagcagggccccaccugcaaaugacuagaacaaaacacagcucaaggaaacaaggcugaagccugggguggccugcaaccaucuccaauaauagguuucaggaguggagaggaagguucugggcugugccaaaguguccaauuaauuucugaacucuggugguuagcagaugaccacuguagggauagaaauggcuagugcagagaggaacuccagagucuuucucugggucuacggcugucaacccgcaugaggaggagguggaccccugccugcagccuggaggccugcaggauggcgggggacaggaacagccacaucuggagagggcuuuaaggggucuuggucuuuauggaagagcaaugggguugaagcagugugagaagcggcuauggaggaguuucgcauucauggaugaggacucuagagagguccaagaacugagguggguaaagaagugaggggaguggaguggggagucccaauccgaggauguagcaggcagcugagggcauucguuagugcagaugacagaaagaugaccugauggccuguguuagucggugaccacagggagagccacugaggauucaaaccuccagcuucaggaaggaagagcuucugcuuugcaagguucagccauggucccaagacuggacagggccaagcauuucuucaucaccuaucuaaccaauuacaccuuauguauuuuccuaaucucacuccuuugauaauuccuaaauauacaguagagcagaauauaacuuauuaaaacuuuaagaauuuuaagcuuuuacuugcaguguggcacauaagauaugaaaccgacaguaaaacaauuuagacuuacagaaacucuuguauaugaacgccagaaaauaugcaaacacaugcauuugcugcacuguuuauaauagcaaaacacaaacaaaccuggaaacaacccacauguccaccaacaggagaauucacaacuaagcaguaggacagucacacaacagaccacacaaaaugagccaacuucagcuacacgcuucaacacaagugaauuccuggagucuugagugaaaaaaaaaggugacaaaggaauauauacaguauaucauuuuuauaucuaagauuaauuuuaaaagaguacuucuacgaagggagagguuagcucuccccgacaugaauggaaggcaccacagugaaccacacacacuuaucugcuuaaaacacuggcuacugugguuucauuguacauauguugaaaaauauauauacuagcuagggauacauauuuuugugauugaaaugauaugaugccugggauuuacuuuaaaauuuugcagagaaaaaaaaaagcugagagacagguacacugcaguuucuacuuuccauaauaaaaagcuaacaaaaaccucagcaaaccuauauagcauaaguaaaaauagaaaagcaaaagcauuuagggugaggggcaggcaauuaaaauauugugggguaacgauggguuugggaagaagugcucagggagcuuccacaguacuggaaauacucuauuucuuaguggggaauggguuggcggguguucacugcaguaguaagcuugcuucuuaacauggaacaugcuauguucucuugugaucuauuugcuacauacauaagaaaacaauuuagcacguuaaaggauacucuaagccacucagaacugagacuggaaaguucaagcucagaaauucuugaauuccacaagaaauuauuaaauucccuuuaaguuuuaaaugaauggaaugccugaaaagaaaagaggcuaauacagccaaccugaguuuuaaguguacagccaauauuagguaaaacugccuaggcaagaaaacugaagcuuuaggcuauauauucauguaacaaaaaccucuguugaggauuuuaauaauacauuucuacaguuucaaguuaauaauuucaggaguaagaaaccagcaacaagccaccagaucuguuguggcaccuucuacuuugcucaacccucgacgacaacuccaagcugcuccucacucuagcucuuccuccuccuuccgcuggaucuuccaaaagccacagacucacaaguucaacacagaacuccucucucccugccuuucuuccugacuuaguugucagaagccucagcugcccagcuuggaauccuaggaguuacgaaagcaccacccucucuacuaacugcccaaauaucuaauccuaucuauuuuccucauguugcgugcaaucucacuuuuccuccccauucccucuaccaagacuuucaacugagggucaugcuuagccucuggacuggucucucucccuucaaacucacucccccuucugcauuucccaucagcuuugauuccucucuauucuuaccccugaugaaaaaucaguucuaugaauucuaucuccuucuuauccuacuucucuuuacacucccaacugccggagucuaggcauuauuaacucccaucuggcucacuaacuaaagggucuucacuggccucguccccuccaauccauccuccauauuguugccccacaauuucuaaaacacaaacaggcacucacucuguuaacugaaugaacugcagggaccuucuucuauacgcugcguuuuauuuacccacacccauggcaccuccagaauguccacugaguacaacuguuccaugucagcuuauuaacuauauaaagaaaggaguuaauauuuacuguagcugcuacgcuagacucuguacaacagcuuuaaugcuuucacugauuuacuccucacaguaaguauauucucugcauguacaagcuacguuucacaaaugaggaagcccaggcucagagguguuacccaugcugcuuccuuagaagguaggaguuucucauuccaccuccuuaagaagugugcuaccaagaguuacuccugcauuugacauuacaaccuggcuucaaaaggaagcaugcaaaaagacaggugaaagcuucaugauaugaauacguaaugacacguccaaacugcugccaacgaauaguucagggaagaacuagcgaauucaugagcuugccuuuuauuuauauuuacauguccaaagcuaguuaaagcucuacuuuguuggaucuucgcugguuacuauuugaauguuguauuauucuacaguuuuuaaucaagaaaauucuuuaacuaaagaugccaggacagggaccagcaucuuguaaauauagaccaagaaccugugcauucaguauuuggacaucuaccaagaaggauuaucuaauuagauaagacuucauaaguucguuacugaaauucaaggcuugaaaaauuugcacuuauuuauaagauuuaugcuaucccuuucuauauaaaacuauggaaacucucauucaaacaauuaaaauugacaagcagcauaaaaaaauuucaacuaacacccuaauagauggcuuccuagagacaguagcuaaguuauuuuauuuuuuuuuuuugacgaagucucgcucugucaccaaggcuggagugcaguggcgcaaucuuggcucacugcaagcuccgccucccggguucacgccauucuccugccucagccucccgaguagcugggacuauaggugcccgccaccgcgccuggcuaauuuuuuguauuuuuaguagagacgggguuucaccauguuagccaggauggucucgaucuccugaacucgugauccgcccgccucggccucccaaagugcugggauuacaggugugagccacugcgcccggccaacaguagcuaaguuuucucucuacuuacuuaaagccauucuaaaccuuuaaguccacuggcucuaaagucagagaaauaaaaauaaacacauacucaaauuaagaaaugguuucugcuucucaaauaacgaauuccaagucaaauucucaagacuugaauuuaucacauaugcuugcauugccugguuccuguuguuacccaaagcuaauaauuaaacaucugcggcauuaaaaaccauguucacucaacauaaaucugucacaugccccauuauucuaccagauaucuaccccccaaaaacaaaaaaaaucauacauccacccaaagacuuguacaugaauguucacagcacuuuauaauagccccaaaguggaauaacacaaauguccaccaacaggugaauggauaagcaaaaugugaggcacucacacaauaaugccaaguagucagacuauuuggcaauaaaaaaaaaaucaaguacugaugcagcguggaugaaccucaaaaauauuaacacuaaaugaaugccagaugcaaaacaccacguaucauaugacuccauuuauuacaugaaauguccagaauaggcaaaucuauagagacaaagcagguuaguagcugccugggguuguggggauggugggaauggggagugacggcaaagagacacaaaggaucuuuacagggugauggaaauguucuaaaauugcauuguagugauggccacacaacucuaacuuuacuaaacaucacugaauuauacauuuuaaaugagugacuuuuauagcaugugcauuaaaucucaauaaaguuguuaagaaaaaacaaagaacagacuuaaagcaugcuagcuguaaaucuuaugguucaaauucaguucauucacagaaaggaaugcaucucuccaagacaaccagguucuguguacauaugggucuugguaucagcgcuaaaagcaguauuacugaguauucuaccagaaaguuagcuuuaagaaaugcuauguaagacauuaccaauagagagggguuuauacuccccugcaacaauauauaaacaggugaaaacacgaaugucaaaguuuugccugcagguauuggaagagaugucauauggcauggaugauuugcugccauauuaaacauacagacaaaaauggcaauacaaguuaauaggggaaagaagucguuucaggcuacaagaucaggaagccuuuacagaaugugugcuuugagcguuucucagaggaugagcaggauuugaacagcaguagagguacagggaggcugauguccaagggaagacaagcaugaggcagaaaacugaucacaggagcccggugaaggauuugggcaagucaugagagguggcggcugggucagugggaagaggaugcaaggucuuuauucugugagggugacagaguuauggaagguuucggagaagacaagugacaccgagauaacggcucaacuuagaccaacagcaauggaaagagagaggcccaagacacaggcgacacaaagcaguuaucgugguaacuggucagaccggauggggugacacagguaagaaagaauucaggaugacaaaggcucaaauuuauacuuuugaacuuccaacaauuuauuucuggauuccagaauugucagacacuacuuucaaaauucaaaacaaggccgggcaugguagccuguaauccuagcacuuuggaaggcucaggcaggcagaucaccugaggucaggaguucgcgaccagccuggccaacauggugaaaccccaucucuacuaaaaauauaaaaauuagccgggcgugguggcagguggcuguaaucccagcuacccaggaggcugaggcagaauugcuggaacccuggagguggaggcugcagugagcagagaucaccccacugcacuccagccugggugacagagcgagauuccaucucaaaacaaaacaaaacaaaacaaaacaaaacaaaaaugaaaaacaaaauucaaaacaacauagcuauugcugaagaaauguuccaugguaagaacaggaauuugccagaucuaauaacaugacagaugcauuuacccuuugaccuagcaauccacuucuaggaaucuauucccaaaaugugcagccaaagccacgagaagugguaaauucaaguuuugucacugcaaaagacuugaaaucagccccaaaucuaucaguaggggacaggaagacuaaguuaggacaauagagcacugcgcaaugaugaaaacuguuaagaaaaaaagaaaggaccuccacauacugauaagaaaguaaauucuuagcagacacuuaacugaaaacaggcaccuuuugugugugaugggaguaaauacuaacacguaaguguagauacauuuuucuuuucaagaagaaaaauugggaggcuaaacugaacacuaauaaaauugguuacccauggcggaaggagaaaacagugugggagaaggguggaagugagacuacagugggguccaugggcggauuucagggggcuucucaauguagaugggacaaaaaauuacaucuuuauuuucacuaaccucugauggaaauuugacaguuccuuugauuaugaaugcaggcaacagaugcaguacuuuuagcaaagugucuaacuucgucagcaagaaaucacaaagauuuucauuauuccaugcuagacaugccaguaucauuuaugcucaucaacaccuugaaauuauaguaguuacauauaaagucuauaacuacuagaucuuaaauaggaagaugucugcauguguuagcauguggaauucucaggaauggacauguuugcuacacuuuugacauuuuuuaugauuaaaaaaagcaaaaaguuguacuguaaaaucuagaagaacaucuuggagccauauguggccugcaggaucucaagcaauuauagccucugucuuagguaauuacccggcaacaauauaauuguaaauaaauaugaacucacaaguacgaaauaucauggcaguucuagauuacaggaugaucauccagacauauaaguguauuuauaugaaauucuuuguaucacuaaauuaaacacucaguuuaaaaauucucauacuagcaaaaccccaggaguaaagggaguuagagaggaacaacucuauauaagaaagugaggauuaacagaaauagauaaguuacgagaagaagccugaaacuagaaagaagaugaagagcuuaauuuuagauaaguugaauguguuuuuuuuaaagguuggcaguuuaaaaauuguagcccaaaggaaaucacaccuguagaaauaaauuuaguaacugacaaaaaaguaaaauuguuggcaacagcgcaaacaaaaaucuucaaagugugaagaaagaacuuaauagagaugaggacuaaaauuuugugcuuaaaggacgugggcaaaguagucccuugccucccaccccucccaaaaaggagagagaaugcuugcaagagacagaauauauaagagaaccaggaggacagaaggcaagccaaaggaggcucauccaugaaacuuuuaguucgacaguguuaagguugaagguaaaucaaggaaaaggucuauuaugaaaagucacugacugugguaagugccaggagccacggccuucaagaacauagcucugaacgaguagaaagcaaugaaaccuggcugcagccaaguagaaauggaaacgacucgcucaacacgauggugagaagacaaugguggacucuguugcuagcagaaaucaccagauaccugccucucccaacauugcugucacaagaggauccucaggacugacucagagaacgugaugacuuauuaccccauucaccaugauacaaugauggguaggaaugagaaaugaauuuuccuuuuaaauucuaaagccaguauacaagcauaauuacaacaaacuugcaaaugaacagacaugacaaacaucaugucuuccaaaaccacauaccuuauucaaaaauaagauacaacuugggaggcugaggcaggaggagggcuugggcccaugaguuccaggcugcuguggacugugaucaugugaccacauuccauccugagggacagggcaagacccucucacacacaaaacaaacaaacaaacaaaaaacaaaguacaaccaaugauacuuacuuacagcagaagucucacaacagaacuucugugcaugucucucagcuggagguaugcaacccuggauucaaagucugguauaaagacgaccauguucugcccagguguguucaugcuuuccacugcccucuaaaaugagucccuuuggcaaccucaacaagaugacacccacucagaucaccacgagauggcaaugagaaaauaccacaccuaucacuacagagaagacagacagacuccaaaccagccagcacugcuauucagauucucuuagaagggacauugguucuuucuauaaggccaauucuaauucuguucauucauuuuuaaguuuuccuuaaaaaaucaagcaccaaggagggggauggggagauacuggucaaaggugcgaagucucaguuagauaggaggaauaagcucaggagauccagcacccagcauggugacuccaguuaauaauaauguacuguauuuugaaaacugaaaauugcuuaaaagcaaaacaaaagagaaaaaacugcuuauaguacaucuuaaaaguucuuaccacaaaaaaauguuaaguaugugaggugauggauauaauuaacuugauuuaaucauuucaugaugugcagcguacauauaucaaaucaucagguugcaugcuauuauguuuugucaauuauaccuuaauaaagcugggagugggaauuaaacaccaaaauaccgacuucucagaauugcuauaaagaauaaauuaguagagccucaaaguuuuacuaaauggauauagcaggcuucucguugugaucaaucuuuguccuucuaauuauauaaauauacacacaugcagccaggcgugguggcucacgccuguaaucccagaacuuugggaggccgaggcagguggaucaccugaggucaggaguucaagaccuggccaacauggugaaaccccaucucuacuaaaaauacaaaaauuugccuggugugguggcacacaccuguagucacagcuacuugggaggcugaagcaggagaaucacuugaacccagaagguggagguugcagugagccgagauugcaccacugcacucuagccuaggcgacagaaugagacuccaucucaaaaaauauauauauaauauaaaauacacacacaugcuaauuuaauucauuccuucaaauacacacauuuuguaauuacaagaauucucacauaucauuacccagaaguacagaauuuucuccuauaaacaucuuaggaauuagaaaacaauuuuuuuucucuuagaguugauacuugaauaaguaauagaggaagguccuuuuaaauccuaaaaaauccacacacaagcacuaaaugccuuaaauauugcucaauucagaaaugaaucuuaauuaagucaacaucuauauucuuccuauuuuacuacaugacuuccaaguaagaugccacaagcgucacugguauaaauugcuccggaaaaccugaaaacuuacagaaaaucacaaucacauuauauuuaacagguguuauaaagacugcccaguuuguccaaauaaacuaguuuuaacugcugaggacugaguaucaguucucaguuucagcacaaugcuuuuacucaauuaccuagauuaaaucaugcuuacucaauggucuagauugguacuugcguguauuuuguuuccaaguacuugcauucacuuuagggcaagaaaaaacgguauuacauuugaucaugaucaucuacaccacacaugcuuuucaaacugagggcugcaauucauuauuguguagaucaugaaaccaacuuaguaaaagggaacuggaacuuuuuaaaaaaucaaauaaagaaaaagagcucauagaauguaacaagguuaaguauuacucagugcauuuuuuuuucccaguuaugucugugugggugcuggguuaucccacaaaaaauauuuuacuaaagaaauaauucaagaggcacugauugacaguacacagugacaaauugcaaacagcuaauauggaaaugcgugggaugucugugaacuucacaguucuggcuccacaagucacuggcagugugagcuuggucagauuccuuaacuucugcgccuguauuucaucaucuguacuagagauaauacuguaguaccuguuguauaagguggcuaugaggaauaagugaguuacgaaaauaaaaugcuuagcagaguccuugacacacgguaagcauuugcuacuauucauguuaacacuacuauaaaggguuucuaauaucuaugcaauuccuaagauaguauuuaaauguuaaaccacccaugcuuauuuuugaagucaaaaugaaguaaauuaacguuaccugaaaacuccacaauaccuuugauaacugaugacaccagagguggcacuucucuaaaauucccaccaaaauguaacuuucagcacaggguggaggaauccuuuguaucgggacagaccuggggauccagccuaagcugugacagaguuaaauuuuccuugaaauaucacucuaucuuaaaauucacaugaaucuuucauucuaccaugaaauacauguuuaacagaauacuuuaaaacaccagcuccacaggacuuccuagcucucuugcuagugaaugaaugggaugcuguuguaugaaacccacugacuuuggaaaagccgcuacuggagagcuuucacugcacaucagcauccaaaaaguuucucuucugucuuggcaccacuguauuuucagaacccagcuuaacacaaauacaaagauacaaacagcaagccauucugcccuccuuuuagagggccuguggaaguggugccccagggaaacauccucaggccacuaagcguggaaggccagaugugcaccuccuggcaggucucucccucucccagugaggugugcacgugagguccacuuccguaaaggaugcccuuagucaaccacaaacgcuauuaacucccauuuagaugaacaaucucaauucacaguucccacaauccucuucaacuaauuuccaaauuucccucauguguggugaaccguuugcccugcaguugauuguggggccuugaauaaguaucugcucaauaagcagauuuuggaagcuaguguaucacuaagugaacaugaaucuauucaucaauaagacaccccuuucuauuauuuuucuuucgacuaagauaauuuaacccugagucgaaaacucugaucaguaauuuucccuagcugagcaaacuuucaaauacacuucccguuucacuacaaacugguucaaaaggagaaacggcgcuaccgugcucuuuauuugauuuagggcuuuuauguuuuuuguuuuaaagacaauuuaccacuuuaaccgcucuccugaaggaacugggcacaguuaagcgacaccucuuucugguaagaugcuccugacacaugucccccguggucccugaaccacucaaggcucacagugagugaugucacccaccgcaccugugguuccaccugucagauuugcacccccauucucugcacauauguucaaugcugcauuugcuaaaaagcaucuugcugaaaauuuccuuacuagcuauuacaacaucaaguacuaagaacuuuuuaguauuuuccgaaauuauggacacuggggagagaguaugaggagaaacauauaugcacagaaguguacauuuaaaucagucaagaauaaauaauuuggaaaaacaguuucucaaugauuugaguaugucuucugagcucacaaaaaucuguaacucgaugacaacauucaauaagaagcaggguucuuuugggaaggggacuuuuuaaauuuugcuucccacucugucucaaaacaaucuggccauaccuauaauaaaggagaaaaugugggcugggcacgauggcuccugccuguaaucucaguacuuugggaggccgaggcgggcagaucaccugaggucaggaguucgagaccagccugaccaacauggugaaacccgucccuacuaaaaacacacaaaaaaaauuagccgggcaugguggugggcgccuuuaauccuagcuacuugggaggcugacgcaggagaauugcuugaaaaccaaccagaaggcggggguugcagugagcugagaucgugccauugcacuccagccuaggagacaacagcgaaaccccaaccaaaaaaaaaaaaggagaaaaugugguaaaaccuguagcaucagcuucacuuaugauuccgaaacagcaguaagccucuagacauuuacauuugcucguauuuuuucugagacggagucucgcucuguccgcccaggcuggaauguaguggcgugaucucggcucgccacaaccuccgccucccggguucaagcgauucuccugccucagccuccugaguagcugggauuacaggcaugcaccaccaugccuggcuaauuuuguauuuuuaguagagacgggguuucuacauguuggucaggcuggucucgaacuccugaccucaggugauccgcucgccuuggccucccaaagugcugggauuacaggcguaccgcgcccggcccacugguauuuuuuauaguaaugccccuagucaagaugcaccuuucuuuguaguuacaaaauuuucuagucaauuucccucauggucuguacaauuuguauuuauuugucacccuaagagugguggguuuuggagguuauugcuaaggggcagagacacaaaagcaucaacaauaacuuaaacccauauuuuacuuauuuauuuuugacacaggguuucacucugucacucaggcuggagugaaauggugccaccucggcucacugcaacaucucccucccucuagggcucaagcgauccccccaccucagccucccaaguagcugggaccacaggugugggccaccacaccuggcuaaucuuuucauuuuuuguacagaugggguuucacuacguugcccaggcuggucucgaacucguaagcucaagcaauccggccaccucggccuucuaaguauucaaauuacagacgugagccaccacgccuggcaaaacccauaccuuaagcaggcauaaagaauauccugcauguuaagauugcuacugauuucugucaccacccuagcuguggcugggacaauaccauagucuucacugcccagccuaaguuucauguggaaagucucaacaauagucgguccauauuuuuuauuucauacaauuuacauuaacuuguguauuuucucaagcaagcuuuuuaagcuuauacuucaaguagcuuacuuugaaaaacauaaaugcauguucccaguugaaaacauaguuaauauuuuuaacaagguaaagaacuaaugcuaacaucacaaaauccagauuuuuccccauaguuuuguuaucgucaagaacucauauauaauaaacuuacuuuagaggacuugaaucucacaaacuucauucaauuuucuaaaauaaaauguacacaucaaaacugcaaauaaauaaacuucugaaaaauauaaauacaauggaauaaagagaugcacacuuuaggacuauuuuucuuuuugccaaaucacacacacaaagcccagaguauguaugcgcauauacgcaguuuggccuguacucaauugucaguaaaacaaauccuccucugcauuuuuggcggggaaaguacucuuuuuaaugugaaacuguaguuucauucacugccgccaagagaggcgucagaaugcuuuuuagaaucacuuuuccuauaacuauuaagggaaucacuauccuaguuacacauacacgcucaccuauguuuaccauaaaaagcuauguggauacucaucuuccacaauauccauauuuuugaaacaaaacuuuaguguaauauaugguuugcugguuauaaucagugaauuauuuaaucaguuuuccacaaguuagccuuaucaauagaaaaauuccaacauuuauaauuuauuauggcaaaaccucaaaguuaacacaacuuccgcaaauugguugcuuuguugaaauuuugcuaaauguuguuacuagaaaucacauucccaguuugaagagcugagauagagacaaauacccagaaccaacauccagcuacuuucaagugaaaauugcagcagagccaguuuuuuuaaaaagcauguuagcaugauacacacagcuagauuuucaggauuuuuuuaagcuuaugaagaugagauaggaugguuguggcaaagggcugcaaagacaaagagcagagcccacucuaucaaaugcuagcagcccaauaccugcccuggagagccucuguaaucaaggaagccaggcaaguccugaaugaagcagcaaucagcagcgcacugcaucgccaggcgugagggcagaaugaagcuggugacagcggggccaaagaggaagguauaaacacauaguguuaugggggaggaacuaguaagauuugguagaucacugaauauggacaaacaaaagaagucaagucugaaaucugugucucugacacaacgcuagaaauagagaugucggauauggucuagggagcaaaaaagagaucaguuuggggcaagccaaguuggaagaaaggccagguuagucaaaugcaaaagcccugaaggcuauuagcaggacugcaaggcucucagcugaaguugcugagaauugcuuaaccugaaaaaacugagaaaccacaaagcaaaaaagacuagaagagaggaucaaguuaaagcuaucuccugaaugcucaugaagaguuagaaaagauaagaugaacuggaacagcaaguauucugcacagaacccuaaccucaggaggucacccaagaaaaaagaaagguaaccugguccacaagucugggaaaugagcgauguggccccuacucagaaggggacacuggagaacagaccuggugaugcuuccuaaacuccucuaacgcaagacauccugagaacagcguucacccucuggaaaccaugaauuggaaaugcaagagaaccaaucuaaugaaucaaguacaaaucuaagagugccuucaagagaaguauugagaugcuuuuaaaacccaggaaguuuuagauuuuuaaagaaaaaaugugaaacaacuuuguaguuaaaccauuauuuuacagguuuaaaaaguguucuccauggacaccgggaagggcacaacacucacuggggccugucagggaagguguggggaccaacaccagggaaaacagcuaauguaugcagggcuuaauaccuaggugauggguugaucggugcagcaaaccaccauggcacacguuuaccuauguaacgaaccugugguacccugaaacuuaaaaaaaaaauuauuauuuaaaaaaauaaaaagugaucucaacaugacaccaccaauaacauguaaaugacacaggcuuugauuguguugucucccauaugcuuuaaaauuuuuuuaauauaauuccucugauaguauuuaggauuuaaacaaggacuagggugaagcaaaaauuauuucuagacacuaaacuuauaaccauacucauuaggauccuggccucuauggcacuucccacacugugcuacaaagaaccacgaauauuuccaggugcucguuccaagagaaaaaaaugaacacaucaauucacuccauaucaaaucucuacuguaaagaccuaauuuuccacauucgaugauuuuaaaaucaguauguguucuacaaaacauguuaauaugguaggggaguuuucuuccuucaaagguaauuucuuauuaaauuaggaguggaccuuuuaauauauaugaauguagguauguauacauauauacauacccuauaagauauaucucccuguaacagcagcaaaacaaauuaagauuuuaaaggcccuucaauaugccaccuggcauuuccuacguuuauucacagaucuucccuccuauucccauaccuuacauaucacagaacacagacagccaaauauuggccuaaauaaaaauccugaaaaugcaguaaaacaaguagaguaguaaggcagagcuccauuauaaaaauaccagugaccaaaacaaacaaaaucuucauaaugucgagagaacacauacaguacguuucaccuguaaagccccagcuaaacugcagacauuaaacacccaccccgccccccgccgcccccacccccaacacacauacccuguauagggcaaaguccccuauauauagaacauguaacaaaggcacuacugaagagccaauuucaguaugugucuucagcauuccuaacccuucuucccuuuguguguuuugagucccuuguugguaggaccuacucuacacagaugcccaaguagccuuucaucaacacaucaaauaggagacccucucauuucaguagucucuacuuuaugauugauguaauauauucccaugcugugugucaaaguccauccucaaccaggacugcauuagacagccuucugucccauuugagguaucuccaagcagcagaaagcugagggcaagcagcuagggagucacaaagcaagcucggcacagucuuuggcucauaccaagcacugaacacaaauugaguauccuuuaucugaaaugcuuggguccagaagucuuuugaauuucagacuguuucauauuuuggaauauuugagguaucuugcggaugggauccaaaucuaaacggggaauucacauguuucauauagaccuuauacacacagccugaagguaauuuuacuuuccccuuggggacacugaauaaacuguugugcaccugcauguugaccguggcccaucacaugaggucggggugaaaugauccacuugucacaucguguugguaacuaaggaaguuuuagauucuggaggauuuaggauuuucaaauuagggaugcucaaccuagacuaaggguuauuauugcauguaagauaaaauggcaagcaaacguuuuaaagauuuuacguauuuaaaaugagagaagucagaagaaucagucuggaauuuuucuucuccaccaucccccacaccaaagucuccaaguuccuauagauaagcuugaaguuuggggagggggaaauggccuagucuucaugucuauucccugaauuccacuugggaucaaagagucugguuuauugacaucaucuaggauuccaaaccuuuccuuccagucucaccaaagccuccuuccugccuugagaaaaggaggucugagcugucagccuuuuucccccguucugacuuucggaugccuauuaggcacacguaacuauuuuaguuagcauuuaauuaauuucgacauagcaaaggugcccccucccagcauuaggugacacguuucugugcaacgguuuucucauaauuacaacaguauuccucauuuguacuauuuagcauacacuucuuaaauaauugaugguagccucugaauuuuccaagcuacugcagaaacuagaccaaaauacuuuuucuaauuuuuagcaaauucuuaucuuaagcauaaugacauuaaguuuaaagauuaauuuaaaacacaucuacuaucacuaggaguugugaacuaagcaaaaaaaguucacacuauuacuaaaaaaaagaaacuuccacacugaagacaauucauuaguaccuaaucuaguguuacaauaaaccaucaaaacaucaaucaguuucaugagauuaggacaguuucauggagggcauuaaaugaggggacuaaaguaucugaaggauuaagauauggggaaauaaaugagaagaagauuaguccagcaaaggagaaccugaccgcuggaaauacagcccaacggaagucagauauuuaacccugugcaucaacacaccuggaaaggggcugccaguacggcaaacacuaagugauuucagcauuaaacuaagcagaaaugucuuccuugcaaguagcuccccugcuucuccuguuuugggauuucuugauuuuauaaauuaauccacuguacuauaaauauaugugcacuguagaaaguuggaggaaaaaaaaaauaauaaccuacugcuaagagaaacuaaaaauaacuccacugcucagagacaaucaaugcuaacauucugguuuucaucuuuuuaaaaaaugcauauacucacacaccaaaauaaaguuuagcuauuacuuacauauguuguuuuauguugcauuuuaucauuaauacuaacuaaauguucauuaaauacaguauuauggaaguuaaagauugaucuaaaugcugaaauaaucauccuuaacaacagcaaaaaaacgaaaacaaaugcuuaagaggguauuaguuaaauaacagcacacccuggacagaauauuaaucuaguagucauuuuuuuuguauuuucuuagacuaaauucuuagaaauggaauagcuauuucaaagcacauacauauuuuacaagcuuuuguuacguacuuugcucucaaaaaaucauauuaaauuacacucuuucuagcaagguaugagugagcucauuucuccauaccuucaccauaaguaguucauuuuuuaaucuacgccaauuaaaaaaacaacaacaguaucucacugauuugcauuucugggaguacugcuaguaaagcugaaaguuuuuucauguuuccugcuccucuuuuuauaaauuaccaguuugcccauuuuuuuccacgggggugggggggggccgcuuuuguuggugguguucacaugcccucuuuuuacaguaaggaaaguaaauuugcuuguaaguuacaauauuuuucuguuugccagucaccuuuuaauucuguuuauggaauuuuaacacagagaaguuuuauuauucuaaaguacucaaaucuuuuccuuuacaguucccgugcuugguguuauaucuaggucuucuccaucuugagaucgccaugcuguuacuuuuugguucuuaaauuuuuucuugaaaaaauauuuuaaaagcacccaagcuuaccccccuaaaaugacagccauuuuuacuacuuuaaauauccucacggccgggcgcaguggcucacgccuguaaucccagcacuuuggcaggcuaaggcaggugaaucacgaggucaggaguuugagaccagccuggccaacauggugaaaccccgucccuacuaaaaauacaaaaaauuagcuggguguaguggcaggcaccguaaucccagcuacucgggaggcugaggcaggagaagcgcuugaacccaggaggcggagguugcagugagccgagaucacgccacugcacuccagugggggcgacagagugagacucugucucaaaaaaaacaaaaaacaaaaaacaaaaaaaccuucacuaguacauacacacuuuauacauauuuuaaauggcugcacccauuucauacaaucuauuuuccgaaguauuuucuaacacagaccuuuaaaaaaauugcagcuuguuauauuugaacagucuugaaugguuuuauaaauuuuugcaaggccaaugagucauaacaucacacccaauuuaacaauagccccaaaguuccagaacuguucgugucuaugcuaucagugcccaauuacucucccacaauguuacuaaaagaccaggaagaauaagcucauucuugguaguggaucacaguucugcauaaugaauucugccauaaugaucagauaucaguccuuaaagcauuuucauuuuaaucucuucuagucuucuuccaucuucacauaaacuagucaaacacucagggaacaucugguuaaaagccugagcuccggaguuauccugucccguuuaacucgggcuugacuaccuuccuagcccuuaccugcaccacucaaagucucagcuccuucaccuauauucuguaaaguggguuaaaccauaguacccacacuucagagggcacuguaaagauuuccaguggaaggauguaugugaauguugaugcaugcaguaugcuaggcacuggggacagaugcauaucacagugucccugucccaaaggaggucaguuuggugggagaaaccaccaacuacaaucaaaagguuaaauacugugauagugacauaggcaggacaacaugggaacccagagaaggcuccuaacccagaccaggacaucagggccagcuuuccagagauggugaugugugagccgucaggugauagaaaaggcaaagagucagauccagaauggaacugcaauagcgcugaagcauggagucaacacuaggaaaggcagaccagugcuuacuugguccaaguuucccaagggaaaaaauuuaacuaucaaacuuaggcuucacaacccugcuuuuuaaacaugaauacaauacuuaauguucuuuaagaccguuuuuccaaaauccuguuaauguuaaaagcuguggcauucccauggaauccacauacuuucggggccuaaggaaaucaacagugucaauuaaaaaccaucucauuuuaaaaacgaggaaauauaugcccugcaaagguaagcuugaacuagacuccaugucuucucucccaagcaagauguucuauaccuaagcaaaaauaaaugacuucaaucucucucccucacggaauuuuuagaaaugaaacaccuccaugagugaauaaaaaacuuaagucauuaaauguuauaauaauucuguuuauaguguguuuacuaaaucuucauauuauaaacaggaaaccuccuauaaacaggaaauuauguccucaguaguaaacauaaggcuuuuauccaaauaggaucuauuuuucauuuaaugcucauuucuucauuuggaagcaaaacaaacacacugauaaacuaccaaauguuuuuaaaaagcaaggcaaccuuagaauuggcccuuaaaaugguuaacacucuuuucuccagacauaccuaaaagacaaguucaaaaugaagcugacagucccccaaagacauuuuauuccagaaugacucaaggucacuggcuuuaggaccuacggaaggcugaaacagcaaaacaaacaaaaaaccaaguuccuaaguuuuuaaggcccuaauauuuuuaauuugaagaauggcaaguaacaacuccucaauuuaaaguacauucauuuuaauuuuccaugcugaaagacagacaccacuggguauacugggaaugacauucugaugaauggcccucagagaccaagggaugguuccuccuacagcaacuuccuaucccacuccagcagaaccauggggcuugccucaucuacaaggaggagccuuaacuaccaaacugcuucauugcaaaggcaaggcuggauacucaaccuggggggaaaaaccugaucguguuuccaaaaaaacaccaaacacaaaaaguaaaaacauccacaccuuaaaacuaguuuuaagggggaaaaaaguuaaaguuucacaaccuguuuucuuggcacuuucccagacuuccauagguauagaaaaccugggcauuuuucuguuagggcccuguacuagauacugggguguuucagggagaagggaagugaagagggaagggggaauagaaaaggagggaugagagagacgaucaauuuuacucgagaaguguauaauaaagcuugaauucuuaaccggcuuaagcacaacgacuguguuuucuguagccaaaaaucagcgcauguuuucaaacguuaaguuuaaguuagaauuauuccagaaaacucauucauuaaaaaaaagcaacugaggcaccaccacaaccaaguucuguuacucuggggacgcaaaaacaaauaaggaauaucuccugcgcuggaggaauucacaaucggaaauguaugggaaauaaggcugucauguaguuaauuacagcuagaagauaauauucaguaaguggcaagagucuaaugaacuguaauaucuaaggaaaccaugcagaaucagcucaggcaugcgugucugucuucugaugugguacacacauuaggagugggggguggggcuggcuauaaggaccugagcauguggcucucagggagggaggcuuuuauaaauuggugaaaaacccuagcauaucuaaauuugguuuguuuuuugacaaaaucguuuuuaaaagaugaagccaaugagaaaaaaaguuuaacauauuuagaaagcaauucagccaucccucucaagcuuaaggaacacucuccugaaaccuccaaaaaugggcauuaauagaguuaaagcgagccagucuuguguuugcaugcuuuggaauuugaaauguaacgcaacuauuucgacucaccauggaaaacaacaaauagaaccuucaaguaaaacauuuuucaauauccaaaaacaaaccuucuuuaaacaaagaaaaaucucaucuccaaauaucuuuuucaaacagaaugacugguuuuacauuuuaaacaucauuacauauuuuacuacguaauacacucuccaggauuucagaaaaucggguacauuuucgggugcaccaugaaaugaaguguuaaacuuaaaacugcacacacuucugcgaggcguuaagcuaugcuuagguccuagaagcucauggcuugaaguaaaaaaggaaucuaguuccucuucugccgcuucguuaagugcauuccaaaaagugugaucguuuacuccacucagaacuuuugacgauuuuaaugcuacuacaggaaagagcaauuacacagagcaaacaaauauuuaaguagacugcaauucaguauuugcgcacuuaccacuaaccccuacuacgaaccagaagcaaccaagagugacccaaucggaaaagagaauccucuuuuuggcaaagccagccagggagaaaacccuaacuuuggggauucauuucaaggaaugucuacaagcauuccucucuuucuuaucuuaugucugcgcuacacaauacugcacggguggcagaaacgggggucuuucagaucuuaagggaaaaaaaagcgacgacccccgagucuggggaccccaagucccagcggccuggcgggcgcacggcuacccucagggucagggcgcgcgcucccguugggaccgggggcgcgccgaggccgcagcgcagggcccggcccgacuagcgagcgauaggcgggcgccggggggcucuguccgguucggccgccgggcuagcaucccugcgcgcaugccccggcccgcucucccaggagaacggggcaaaagggcgacuguuacccaauaauagcgcccugcacguucgcaacaaugcaggcggggaacccgagagccgcgggcagggaaccggaaagcgagagagcccggcuccgcggcugcuccugcgcuugagcccagagcucacaggggaacacgcgucggccggaaagcagcgccgggaagaagcgugggcgcgagggggcaagggcacgggucccggcgucccgcggaggucgccucaccaggcgaggcgcggacgcccgagccgccccgggccacacgucggcccacccuccgagaacccagcccggucgcggcggggaaaggggccggcgccaccaggccgccgccuccaggcgcgaugaaucgugcuuuuucccagugcguaguccaggccuggccgccccggcccguccggggugacucagggcccggccccgcucgcuccucugccaccuucggcguccuccgcccacgagucccccggcccggccgccauucugcccggccgcguuucggcggcucaggccucgccaggcgccugguuucggccgucgcggcccgagucacugcgacaccgcggcucggggccgggccugcgccgccgccgccgccgccaccuccucucggccccggcggcugccgacacucacccgcaucucuguggugccccaaaggcucccgcgacgccuccgccuggucccugggccugggccccggcgaaagccccgucccgccaaggucuagcugcgucccucagcuaccggggcugccccgccuggagcugcgugcgacacggcgcccgccuccuccuccuccccugcccgcccggcccuccuccu

SEQ ID NO: 193015 - RNA, 43040 nt, Homo sapiens
gcaucguuauaaaaugucacguuuauugcuacagugcuguuauauacaggacaggucucugaauccaccugaaagagggucguuuuaaagucccaaucauccagccagcuguguugacacguauacaauuauuuucuuuaaaaaaauuuuuuugaaaaccaucuugaggcacucagaucacaccccccaccccccauaauugugguucccaggaacugcuguuucuuccuccucgcgcugggugaaucucguuugaauucuaugcagaacgcacaguuccagaggcuauggggccacugcccacccagaccuaggggcagggccaggagcaaaacaagagggagaggcaaguucccuuaagagaucaaacucccagggcguaggggaagccaccgagaagggagaggcagccggacagccccuccccuccgccuggccuggacugggggcagauaccaggcauugagcuggccuugagguuucccuugcaucuaccauggggcccaggcucccaagccagucuggggaggggagucaggcaguccaggaucuccuggggguaacggugggagucucaggaguggcacggggggagacgcccgaccugcagcggggaugaacacagccagcccagggguccacaaggccucaaugcagggaggggcaugaagggcacaugaaggcccccagcuagccaggcccacaccugggugccacagugaccacugcccuaguucguguggaacuggaugggaucccaggguaggagacuugcaguuuuaaacccaagacaguccccagccagcugggaagagcugguuacccucauggcaaaagaccagaaaaggagaccuggagagaggccugggugcugggacaugggacacagaugggcccgaggggacacccugcugguucugcagcagggucggacgcacagcccaaggccuucguggggcucagaccagcacagucccccggcuccagccacucuugcccuuggaccacacagagggagggcagcagguguggccccaggcccagggaugcuccccagcauugggggaggcuggccaggccccuggcauccugucuacgucacgauggcccucugguguaauggggacauggugggguggggugggggguguccugugcuggcuccugagcagcauccucucagccagaguucagagcaugagccugggucccuggggcaaaggagugaaggacaggguguccaggagguccccagcaccgggcuccagggugugguccccaugccaggggucacuggucccaacaaaaugccccauuucagagagcugugcagguuccaagggagagcagcuuaggggggccuggggagggcguuguguaggguagcccugggggccacagcugcuuggcagagucaccugggagggucagagccaccuugcugacgucccuucccccaagcccaggucaguccccuuccugaggggagaggaugcggcagggaagccccaaggugccuucaucagggaacgcccacgcaucacuuuccacaugacaaaaccaagagaacccccaacaucaaaaaaacaaaagacccgccgccuguccccguucugucugugugcaguggcuuccggggggggggggggacgggggggcucagguuuacacggggucuuuuuaauacaacguuuaaucaucugguugaucaagaaaugcaaugcucagucuaggaacagcagcagaaauagcgagagacacgggacuuuuauacaaaaaaauuuguugcuuacaaaacauaugcaaaaaaagcuuaaaaaaaccagagaccaaaggcagcauccuugcuaauuuucaucuacauuaagaaaaaaaaaaucuuguaacuaauguuuuuauuuuccuuaaaaaaaauauuucgcuuaggcacaauuugcugguggcuuuagaagaauaagccagguuuccacagcaucccccuugagugauauguuuccauuucuccgcuuuuuauaguuaaggcauuuuuuucuucucugacaaaguguauguuuuguugcuugcuuucagguuuuguuuacuggaaaaaaaaaaaaugcuccugucagcccaggcaacagggccaagaugcaguuucaggauccaugggacaggucacagagugacacgguggcugagauucggggacagggggagcgaggccagugagugguaggccagggccccagggagcuccuggacccagugucaccuuggccgcccccaucacuccgaaccuugucagguugguguuggcucgaugcugacaacaggugugugagguguggauguggaugaagcccggggucucgaguggccguucuggggccagagcacagggcugaaagcggguggcucgucccacggaggcauaccuuucacaugugcccggcgggguugugggcuucgcucaggccuggguggggagcugaaagcaccaucugggggucuccaaccacaccugacaccuuuuccucuucucgccguuucaaacaggcugcuuugggauucagguuccgcucuggagggaggggggagagcucugugggagacggucccagggaggagaaagaugugaggugggagugggggguaggaugucgggggggggggugggggcagagccccaucacguguggccuccuguauuuccggcucucaccuccuuccuugagaaggcuggggggaugggguggaggcuuguaaagaagagaguggguaucagggggugucuggggaacaucacugggucugaguccagccacaaagacagacauggacagaguccgggggcggcaagcacaggaggaccccagcaucugcaccuggguguggggaagggagagggugcuggggcagcccuggccggggagccuaccucgcaccugcugcuccagccccaggaugaccugcacggccugcugcaggaugagcagcuuggucugcgcuuuguccgacuugaggugcaucuggcacaugcgccccagcucccggaaggccucguuaauaucccgcacgcgcacccgcucccgcgcguuauuggccaugcgccucucccggucccucaggucuuucuccuccagggacagcaccucguccguacugcugggucacagcaccgaggccucuguuagugaugcgccaaggcugggugggagggcagggcuggguuguggagaggguauccagcuacuuguguuugugcuggugugggcagcaguguggguacacggcugguguuggugggcacagcagugugggcagcagugcagguacauggcuuacauuggugggcacagcaguguggguacacggcugguguuggugugggcagcagugcagguacacggcugguguuggugugggcagcagugcggguacacggcuggugugggugugggcagcagugcggguacacggcuuacguugguggacacagcaguguggguacacggcugguguuggugugggcagcagugcaguuacacagcuggugucaggcacugcagugcagguacacggcuggugucgggcacagcaaugcagguacauggcugguguggguguggacagcaguggggguacacggcuggugugggcagcagugcggguacacagcuuacguugcugggcacagcaauguggguacauggcuggugcugcugugggcagcagugcaguuacacagcuggugucaggcacugcaguguagguacacggcuggugucgggcacagcaaugcagguacauggcugguguggguguggacagcaguggggguacacggcugguguuggugugggcagcaguacggguccacaugcugauguguguguugucacaugcgugaaaaugugcuucucugugcacgcggcgaaugugcucccuggaaugcagcagagccccaugguggggcgccuguguguguacgcgacuggcugcccaggugcaagugcccucagacucagcucuaggggaggcuguggauguggucacacccaggaagacccaaggucugacuguucccagacguuucuguggagggagauggggcccugcuuccccgucugggagcccacaggguaacugcuucucccuugacccugcucacucugugggccccagggcagggcugggggcaggggaggcccagugccugcuccucucuuuguucuucccucccaagaugaugacuuucccugcucagagcagccacuugcggggugauggacagcuaggccuggccagacucacuguggacagaggaggccuugaagacacgggcucagcaggcaaauaccugggccacuccaaaaacccgggacuggggaguccaggacucaaaucagggcucacauggagcaaaccagcucccaucccccgagacccccacacccuggggaggagccucagaaaugcacccguccccuacagugaacuccggcugccccaagaugagcccucccugagcuccugccccuggcugggaaggccagcucccuaggccuccaggaaccccauugucacugccaccgugaauggucgcaguaggagcucugagguuccaagagccuguucugugccaggcccaaggcugagcccccucuccagccgagcagcaugcagcuggcgagcgggcacuguugcugcugccgcaggggugcgggucccggcccaggccucugugcugcauggcccugcaugggugaccucgcucuguucccuggcuuccuacuugguagaauggaugccgguccccaucagggcacccacugcucuagguuguggugaagaugaaaugggugaaggucuggcccagugcccagcaugccuggugcccugucuuagucucuagggggcugccucacccacuugccugcccacccugccuuaggggccugaggggaucccuccagguggugggggcggccccuggagcccaggacaagcgcacagaccaaacugacaggaccaggggcugcgugcucccgggucugguuucuucccgcaagcccugacggggggcuuugggggaggaaacgcccugagguugcagcccagccgcucccggugcucgggcagcaagugcgaggugaggaggggcugccacgggaagcagagggacggacgggcgggauggaggggagggcggaaggcagacagcagagaggcgggcuuggggggcgcgaggcgugccacacacggcugcagagacucggaaaccuuagagcugaggggauagcgugugggccgggccggggcucuggcuccggucccagcaacagugcugcaggagagaaaggguuaacggggugcaggcgaggaaaggaaggaguuaaggaagcagccgccagcgccagcggggggaaggagucagcucacaucugcggguggggacagggucugucuguauccuuccucccccuggcccugggaaaugggggugauaggaaguuucccuaucaccuucagauagggaaacugagucagagacaggggaugggcucauguggccuugcguggcaucugccugacgggaaggggccagggugguuugcacaccagcuccugucucugggaucgggggacacuggccucugugagcuggguucugggcuucccaagaaaggaggaccacggcgagugggagccccguggagcugggagauacaguucugagccacagagcccaggccugaaggacuagggguccagaaagaguccaguccucccacuguggaggggaugcugaggcaggcagggagaagggcuggcagucaggaguggacagucauggcaaugcggucagaggggugaagggcacagucacugcaaggaggcaacugcugcagagggagggcuggcuccaggaaggcgggcggggaaggagaacgagggcaggaacacgagggaggguggcgcugcagggacgcugguggcccgcgcccccacugaccucgcacuugcugcuccaaguucaggaugaccgagacagccuggugcaggaugagcaguuuggucuggggcuucucgcuguugaggugcaguuggcacaugcgccccagcuccuuaaaggccucguugaugucacggacccgcagccgcucccgggcguuauuggccacccggcgcuccuucucccgcucggccuucugcucuggggggagaaggucguccucguccucgucugggcuauggggagggcgccgggagggggccagagggagacagugagguugggggaagagcguggggcccgccgacggccucccagugugggugcggugugcguguggccugugcacaugugcguccugauggggugaggguggggagugccgagggguggguuggcaccugguccgggcccggggggccuucagcuccuucuucuccuccuccgaguggucagccgcugacguguucuccucguccuccuucuccucccgcuugaucucgcuggcggccgccguggcaccugcucgcccuagcccugcaacaggccuagggucaggggccugcgucggccuccagggccaacugacauaucucuuugugcuccuguggugagggacuugggcuuuccuggaaaaaccaggucuuggccaaaaauaaaaacaaaaaaccaacaaccagaacuggaucccuaccucacgccauguguagcuaccaaugccagacagauuaaggaccacaagaugaaagggaaacaguuuuaccaccuuuggaacaaaguguguagaaauucugcagcaacucaauggcaggaaucuacuaagaugcuaaaagaacacucuucuuuuuuggugaaaguaaacuguuucaaucauuaacuuaaaaauauggaacacuucggaugggcacaguggcucacaccagcucacaccuguaaugccagcauuuugggaggccgagguggguggaucacgaggucaggagaucaagaccauccuggcuaacauggugaaaccccaucucuacuaaaaauacaaaaaauuagccagcuguggugguggguaccuguaaucccagcuacuugggaggcugaggcaggagaaucacuugaacccaggaggcggagguugcagugagccaagauugcgccacuguacuccagccugggugacaaagcaagacuccgucucaaaaaaaaaaaaaagaauaaaacuuuggaacacuucaggaauguccacgucacccuugugcagaugcuaugcuaaucuuuaucauucucauuuuaguccaagagcuguccaagcaagugcucaaagcgcugcuuuugaaagaacacaggccgggcacaguggcugacucacgccugugaucccagcacuuugggaggcugagguggaagggucacuugaggccagggggucauggcuaccgugagcugugaucaugccccugcacucuggugugacagggugagacccugucucaaaacaaaacaaguaaaaaagaaaaaacaaaaaucaguaagcuggacuauaucagaauugagaguuccugaucagcaaagauaccaggaaaagaaaagcauuugccaaagaauagaagacacccaccacagauguagccaaccaggaggugaucucccacaaucaaugggaaaggacaaaaagaaaguaacucaguagaaaaauaagcaagguauccaaaaaggcaucucacagacaaggaaaccacauggcuagaaacacguggaaguccgcuucagcacaucaagagauuaaggaaaugcaaauuaggguggcuuugcgcuacccuuucauacccagucagcuagcaaaguugagggaccugaacagucaaaaucuugccugugggagggcaacuuggcugcuuuggaaaauaauucaucagccuuuccucugaauugacaacagguguaucacacccuugaucagcagguuggcaggaaagcgugauguuggaaugaccuacagccccacgcccgggccagggccaacggcacacucacaaugggaccccagccgcucacaccacacauguaccccacacacaacauaagccagcaaaccagcguguaaagaacacgcuagugggacgccguguucaugaagcucaagaacaauaauugcaaaacauguggcuuaaggguacacagugccccaaaugaaugcggccacucugcauucagcagggccugggccacccccaaaacccgggcuuggggaguccaggaaucagucagggcucacauggagcaaaccagcugccauccccugagacccccguacccugagggggagccucagaaaugcacccgcuccccacagugaacucugcuccaaucggccaacgccagccaccaggaccagcccaggccucagcacacgaagugaaggacaggaaggaaacagaggggagccuaugggugaaagacuaagcuuggggcugccccuggaaacugcugaccuguggguccggacccuucucugggguggggccguccugggcacugcagggugcugagcagcaucccuggcccccacccacuccaugccaggagcuccccucagcccugacaacuguagauguccccagacaucacccaguguccccugggggcagagccgcugcggugagaugcccuggccuaggagugauagaaucaagguacuuggaaagucugccuggaaagcaggcaggauuccugggcugguggaaggcacagggccaggacagcgcccacaaugaccccaccuucuccugggccucucaugggugucugagacacucaacaauccccaggcccagguccagauuuguccccaaccuuuuccuuuguccccuuccuuacggaguucccagccccagugucacccacagcucgggccagaaaucccagagccacccugccuucucucacccucaaguccuguccaucacaaauccugugggccccgccuucaggagaugcagggcccacccacugcucaccccuccaaggccccuggaccagcccuguggccucugccuuggucucccggugccacucauagucuguccuccaagcagccaccagaggguaucugugagcaccugggucaggucccaucccuccucagcccuccacggcugccaccuuucucauggccaaaucccaaguccuccccgcagcccacaaggccccgcaugaccugcccugccccgcccuccccccuucccucucucccucuccucacucugcuccaaccccacgggucuccuggcuguuccucccaggugcaguccagccccagggccuuugccugggcugcgcccucugccugaaacccuccuccuccagguacuugccuacucuugccuccucccagaugcugcccaaacaccaccuuguggccucaugggccaccaucuucaaagccauacaaaacccccaacccaccgcagccacuucguuccuucucccuggcaccuguacugugcagcgagcuccuggucugucuccccugaggcagaggcauccugcugcaccccucgccccuuccccagugcugagcgcugccaggcacacagcgucugggagcaggcgaaugaagaggcagcccagagcuguccaccucacacgcccagggccaacgccggccccgccggucuuacccacccuccugaaguugcugacuggggcgcccaugucaccaggugcccccacggugacaccugcccugggcucccacccugacccccaccacuagagugccucaguuuccccaacuggaaccaggagucggacagucccaagcucaagggcuuaccacuguaggagucgggaggccgagacaggucagggagggugccuggcuggcuggggagggccgcgugguugugcaugaggcuggugcugccugcgaggccguccucgggguggcugccuccaaccugcaggcguggggagacgggugcaucagggggagccggguccccgcccacugcccagcuccacccucgcccagcgcucaccaggccugcgugccgcccgcccagugacauggggccggugaaaccugaggccagcgccccguggccaggcagcagcgugugcaugucgccggcugugcccacggcguggcugcggagcacguggauggccucguccagguggucuucuaucuuacucugcugcaggguggggggauggguggugaggggcccaagccgagggaccccacaggccuccauucaugucccuuccgcaugcaaguggccgguggucccaucuuccccuuccccaggaagcugcauaugccaggcaucuggcgcccgggagcacacacaaaaugugugugccuuggcggccacgaggccucaauaacagcuuggggcuuauuuacaagaaacuaacaaaaagguuucuccuucucaaggagcgucuguccugcaaauucugucggggaagggugggguggggcggggcaggcacucaccaggccguggagacccccgucguagcugggcgauaaggcaccgggggcuccugcucgaggccacugugacguuccuggaagggaguggggacgugaauggggugcgaggggcggggugugagcauggccugaugcccauggggagggauucaugaaccaccccgccuguccagccuccggugaugcccaagauggccauuccggggcaccccacacugaugcaaagcugcucggccccgccaggcagggaugcugggugcccaguggguacugccauuccuaucucugagccucaguuuccccaucuacaaaauccaacuccccacucagaggauaaaguggcucggcagcacacaguagggggcuccuccccaugcugccccacccuggcugacccacgcugggcuccagcagcaggcaagaaaguggcaagcuccaggugggaccagacaggccgaggugaagugaggguuccuggcgcuucccaugggggcagagaugaggacucacggguguuuuuaaacacccagaccuucuggaaaccuccaguucucacucccccuccuccuguaccugcccccgacccccugcggauaagcaagcacguccucacagggauaggagggucugcccucccaugccggagcaccgcacaggguaaacagucaguaccuaauaaauacccagugggugagcaaauggcaacacgcacacauucuagaguccaggccacagcccuggcgaugcuggccccaucggaccugggagcugcuaggcacgccaauguccccucauguucacgcagugugaacugccagguccugccuccuggcuuugccugugcugugaccuaaccuggacgccaccucccagcccucccucacugccugguuaugugcuauagccuuggagggcuggcuuggaggcugccuccacuaggcagcuuuccuggauugcccaguggaacacaagcccaugggggacucccuuccaccgucgguuccugaccagcgaugccacgggcccuugggggccaucugcucccuccccgcugccugccuaucccagcaaggugcagacaccagaaccagccuccccucccccgcaaagccuucacagaccucagccuccccuccccccaaacccucacagaccucagccuccccuccccccaaaacccucacagaccugccaggcccuggggggagcccacggggguagaagggcuggacgagaaguuauugcuugagugauccggggaguagaucugcgaggaggaccaggagagaugggcggucaggggccggccucucaggucacuugccuggccaccccccaugccccacgccucaccgaggccagugcuuugccgagggcauccccggagcugccagcuguggucccucgggagccugugggugaagagaggugaggcccacgcagcccggccugggugcugccgccgacggcaagcucuccugcguucugccguccugcacagacacugcugcgccagggagagcagccugacucggguccgguuucugucugacccccugaaaccagccucugcagggguugaggcacuggggacaggccacuggcaggggacccugggugggugaguccccuucugggccugggugggugagucccccucugggccuggaugggugagucccucucugggccuggguaacugagucccucucugggccugggugggugagucccucucugggccugggugggugagucccucucugacccugggugggugagucccucucugacccugggugggugagucccucucugagccucuuucccagcuguaaggcgggaaagccgcuccucaaagaucuguuuccagacaucccaagcccaacgcacguggcaggcccugcagacagcggacaaugagaacugacaacaacccgcucucagggccagcagacgcgccugcgccucccguggaguccucgccaccccccacccagacccugccuggagcccaguguccccucggagaggccgcaucccagggaggggccauacccaggaggcugucggccccgcugacaggcggcguguggcuggagacgccgccguacguggcuccgggggcugaggagaaggaggaugcagaugggagcccaccguucaccucugcuccaugcagcugguagcccuggggggucaggcaggaggaggguggguuagaugggcacugccacccuccgcccacccccugcccccugcccuggguccuaccauacgcucgugcuggugcaggccaccaaacgugcugcugcuuccacugcugcccaccgggccgcuaccgggcgggaggggcagcggggaugagcccccacccagcaugggcccgaagcccgccuggcccgggggacuccagagcucggcugaggggugcaggcugccaucuguggaggggagcugguaaggugggggccgaguggggaaccccagcccugcccuaccgucccuggcgagcccccgcccugccauguaccugccacguagaagggggcgggauaggugcugcugggggucuuggcggacggguaggcgguggcaucccugccguaguccucaccugagcuggguggguacaccugcgggcgggugggcgguggggggugcagucaggacggagggaccacgaucagcccaugcaccuugccggccuccuguccccuccugguagcacaucuaccaccccguuucccuucccuguaaagccaccccccuuuagguaaaucccagccccuggccaaguuugagguucuuaugauguccuggucucucucuccuacuccuuuuccagcccccaccucccgccucccugaacuucugaccuuuguacuugaggacuuggaucuggcucugccuacuaaaccuuuuuccuccuuaauccagaaaacuccuaucgacccaucaaaaccccagcuccaacaccccaucccauccuucucccuuguuccccagcuggaaucaaucuuccagugcugagcuucccuuggucccagagcaacauucguccuucacuaaaguaacaggaagaggggucugugaguagcgccagcucugacugguuggcacugccuggacuguggggcuggggccuguugguaacgucugcugcugugcuggagcgggaaguaugcugggugggccugauguuguaauaaacuggggggcgguuucagggcagagaaagugcacccuggggaaggaggggagugagugauacuguugggagcagagccugaccacgccuuuggccugggaagucaaccugacucuaaccccgaacccaggccuguggggagcuggucggcuggaggggugaggagauguaugcccagggcucuuggggccagcacaggcacugggcagagggugguugguggcuacugagccagggaaucggcaaauucccucucccuccagcgagaugagaccgcaggaguguggcacagcagccuggaccaucugcgaggccugguagggaggcagggaugcggggcagccugaagcugugaggauguaacagggagccccaauugcggcaccccccgcuuuuuuuuuuuuuuuuuuugagacagagucucacucuguugcucaggcuggagggcagcggcaugaucuuggcucacugcaaccuccgccuccuggguucaaacgauucuucugccucagccucccaaguagcugggauuacaggcacgcaccaccacgcccggcugauuuuuguauuuuuaguagagaugggguuucaccauguugacuaggcugaucuagaacuccugaccucaggugauccacccaccucggccucccaaagcgcugggaugacaggcaugagccaccacacccagcacaauugugcccuuucuaaaggggccucagccaccaggacugccuuucucucaaaacaagacagacagaggcuggaccuagggaaggacuuccccgccuucccuuggaggcggccucgggucagagcucagaucuuggcucagaaaucacagggggccuguccacucagggcccaccccgccauguguguucccaagcuucgccaggacacagggccuggcacugccacugacgagcuguggggucccuucucccucgugcgacucaccgaggauggaagacccggcgggaccuuccggaccuucuugggcugcgugucuguuagaagcaaaaggggugagaaccggccaccggccaugagaacaaccccugcccuacacccuggaggagagacccucacaauucccguuucauauauuaaaaaccucgggucggcugggugcggugccucaugccuguaauaccaggacuuugggaggccaaggcaggcagaucacgaggucaagagaucaagaccauccuggccaacacagugaaaccccgucucuacugaaaauacaaaaaguagccgggcgugguggcgggugccuauaauuccagcuacucgggaggccgaggcaggagaaucacuugaacccgggaggcagaggcugcagugagccgagaucgugucacugcacuccagccuggggacagagaaagacuccgucucaaaacacaacagcagcagcagcaacaacaacaaaaagccccgggucuauuuauacggcuccaaagaugucgaagaaccacgaugguuuucucccgcgacgcgcaguuuggaaaacgaggaguugguggauucuaagccaaggcucugcugagaagccccuuggccccacccuccuuccaagauggccccgacuaucccacgcagucaggcuucaccacuaggggcugcuguuugcaaacucgccuacaggauaaaauccguaacccggaaaccagcacucaggcgccuuccugaucacucacggacgugcgcacagugggaaaaguucgaguggcccaggcgcaugugcccagccaaggcggaacagaggccuccucccgcaucauggggcuccuguccuuggucuauucagagccacgaucuuuuacguuuuugugcuuuuugugggugauuucacgcuuauuuuuuucaggcagggucuugcgcuguugcucaggcuggaguacaauggugcgaucgcagcucauugcagccucgaacucccagggucaaaccauccuccugccucagccuccugaguagcugggaccacaggugugugccaccauacuuagcuaauuuuuaaaauuuuucgcaaagaugggaucucccuauguugcccagaaugguuugcaacuuuuggccucaagugauccuccugucucggccuccagagaagcugggaccccaggugagugccgccaugccuggcgacugugcugccuggaaugggccccggguaguucaaggcgccguccagugcuccugagcccgaggcugugacgugccucgcgggggaugcccgcgugugcagcagggcucagugcagaggagccacgaugcagccccaugaggcaucugacacagaaagcacauggcagagcccgugcccgucagcugcaggaaccucgggaccagaggcucguaggaaccucucccuggacgugccacgcccgccggccccugccucgaccccccgucaccguccaucccucccacggcccgagcgcccgacguccagccaggaccuggaaggugcggggucugcucccucuggugcccucagcuaacgggaagccuccuaccucccuuugcaggcucccucccagaagcccccgaugccccggccagaccccgcucaccuaggcugccgucugccgcucuccgccgggagcugccggaguaggagggguaguacugggagguccccuucaugcccgaaggggacaggggcccggggcuguugagggccagcucgccugacaggaagccagccugguggggagcggauggucagaaagcgcccagcuggcauccagaccccaggcuguuccauucaagaaaaaacugcaaaggccgaagccacucagacccgcccugcagugggugaugccccuucugccugucacgguguuucucugugacaccugcuguguuuuucugacuugagacugaccgcaucccacacugcuguuuucacgaagaacgaaagacugagaaacagauaccaguguggccaacccaaggggcugcucccccgauucugagacgcaaaguacaaagcugcguggcuaagcgucugugcacccggcugcuuccuaucuuuuugguuuuguuuuguaaagcccucgguuggauucuguacauguuagugugaaacgggcuuucuuccuggggagccagggcugcccugagccgggucccggaacugacuccugcauuucauccguucuaaggccgggcacgguggcucacaccuauuaucccaguacuuugggaggcugaggcgggcggaucaccugaggucgggaguucaagaccagccugaccaacauggagaaacuccgucucuacaaagaauacaaaauuagccggguaugguggcacaugccuguaaucccagcuacucaaaaggcugaggcaggagaaucgcuugaacccaggagacagagguugcggugagccaagauugcgccauugaacuccagccugggccaugagcgaaacuccgucucaaaaaaaaaaaaaagaaucaucuguucuaucaucauccaguggccccacgggguggcccagcgcccaggacagggccuucucccgaggcccggccuguccugagcccgcacccuguguggccaccgcggggcucgaugagucacccgggagcgccagagagcagggcccgagcccuaguucugcuucucggauggggagcccgggcacuugcguauuccugucuguaaaaugggcacguaggccgcggccccucguugcggggacugauagggaaacgcgcaucugccccuggcgcagagccuggcacccggcuggcccccuccaucacuauggcuacuguugcucuggcuugggcacagugagcacacagacggccccaccugugacaaggccgagccccaccgagagcuaggagcugacggcggggacagagaugaaguccuggggugagggaggaacccugggggugcccagcaccggaggcugcaugggaccccuguggcuggucacagcccccaacauccucccccagccucacaaccagggccagcgugggugaggaucucggcugcacaggggccuguuguaugggcuccccaggggguccacaccugcaaagcccugcugcauggccuguuuuccugccugccacucagaggagagggcaaccgagccccuccagcuaagcauggcagcccugcaggccuuggccucccugguccucaccuaccuccccucugcucccgguccacacccacccagcccacccuggcccaagcccagccugguuucgcuaucaggaagcaaacauaaccuagcuaagccaggagagcuucugcagaucagagagggugggugacagauuuguuuaaaaucaaaauacaccccagcccggcccgagccccucaccugagucaggccgcccacgccugcgucucucccgaaggaggcauaggcgccccgcucaccgcucuugccugcaaggggagaaggaagguuagugggaggcgaccccaaggaacauccugagggcccccgagugccugccaugugccuacaauaggcucucaguaagugcacacgacugagagcgccacggcaggaugcuggcagagccugaccccagugugcccaucucggggagcccuggccccaguaugcccaucucccgcagagcccugcccucagugugcccaucuccugcccaaugacaggcuuggggacaagaagggguccccgaugauuucggggccaacucugagcaucugcagcccacagaagcccugcccaggggguggggcggaaaggggacagcagagcucacggggugaggugggaaggggacagcagagcucacagggggugaggcgggaaggggacagcagagcucacagggggugaggcgggaaggggacagcagagcucacagggggugaggcgggaaggggacagcagagcucacagggggugaggcgggaaggggacagcagagcucacaggggaugaggcgggaaggggacagcagagcucacggggugaggcgggaaggggacagcagagcucacagggggugaggcgggaaggggacagcagagcucacagggggugaggcgggaaggggacagcagagcucacgggggugaggcgggaaggggacagcagagcucacaggggaugaggcgggaaggggacagcagaacucacggggugaggcgggaaggggacagcagagcucacggggugaggcgggaaggggacagcagagcucacagggggugaggcgggaaggggacagcagagcucacgggggugaggcgggaaggggacagcagagcucacggggugaggcgggaaggggacagcagagcucacaggggaugaggcgggaaggggacagcagagcucacagggggugaggcgggaaggggacagcagaacucacggggugaggcgggaaggggacagcagagcucacagggggugaggcggaaaggggacagcagagcucacaggggaugaggcgggaaggggacagcagagcucacagggggugaggcgggaaggggacagcagagcucacgggggugaggcgggaaggggacagcagagcucacggggguggggcaggaaggggacagcagagcucacagggggugaggcgggaaggggacagcagaacucacggggugaggcgggaaggggacagcagagcucacagggggugaggcggaaaggggacagcagagcucacaggggaugaggcgggaaggggacagcagagcucacagggggugaggcgggaaggggacagcagagcucacaggggaugaggcgggaaggggacagcagaacucacggggugaggcgggaaggggacagcagagcucacggggugaggcgggaaggggacagcagagcucacggggugaggcgggaaggggacagcagaacucacggggugaggcgggaaggggacagcagagcucacggggugaggcgggaaggggacagcagagcucacagggggugaggcgggaaggggacagcagagcucacgggggugaggcgggaaggggacagcagagcucacggggugaggcgggaaggggacagcagagcucacggggugaggcgggaaggggacagcagagcucacggggugaggcgggaaggggacagcagagcucacaguggcccugcuuccugcuggccaggccccugcccuuccugagccucaguuuccucuguuucaggcguugaggggcugaugcccuggggugcuggggucagaggcauuugucugucccaggggacaggccugggggcccuggcggggagccccggggccugugcacaccgcaucagguucaccgcacaggcucccccaaagugcccagcauucagccuucaggccaggguucauucgcgaaugagcacgugaccugcaccccaccaaugagcacuucccuggggcgcucagugacaaaggacaggugaggccucggggcuacggagggggucagcuggccagggcgagcccccagcauggaaggccugggcuacggaggggaacagcuggccaaggcgagcccccagcauggagggccugggcuacggaggaggacagccugccggggcgagcccccaguguggagggccuggggcugaugcggugacaccuggauccagccuugccugaagcaggcaccccgauuacucaggaccugagccacuuaaauccccuucuggcugacacugggcacggaaugugacuggggcugcugugaggggcugggacgcgcgaucgaguaauguacauuauucucaaagcaggaaaaaaauuucccgauuuuugaauuuuaaaaguucaacgauuucccaacuccuggaacaaaugcugcuguuuuuugccucccguuuccucaucuuggugacccggggggacauggggaagaugacagccacgacccaccccacaggccacacccggccacagcagucacucgcccggcuccucgggugagaaaacugaggccauaggagacugagguuauggcaaaagccccccgugccuccccgggacccccgccugcccucuccaagcugccuggcuauggccugggccccacccguggggguggcaggugggacauggcugggcucugggcauugcuggccgggccgugggaacugcccacgucagcccugcccacccuggggccaucggggguaugaggaagaggcugggaggaaggaacagccagugaggaaccaggcucccaggugcaggggccacccccggcaggggggcggggccaggccucaccuaccccguaaggggaacgggcagaaaucgcccguggcacguggugggcccucagacacacccgccagaccuucacgcuauucgcuuccuacucaggacaccaacugacucuacuguacuccaaguucgaggccgggcaaagcgagacaggaccgucccugccccgcuguggggcccaaacaggcgcugccccucaggguccagggaaaaggcugggucggccaaaguccuccgggccucaguuuccccgcaagccaacaaugccgagggguacacggugagcaccugggccccgcagcagguccagugccccacagcucccggcuucuaagcagcgcacacccccacugcaccacgaaaagccagcagaaacacugccucaaaccgucggguuccagagaagggaaggaucccgcaucccaggaugacugagggaugaaaccacaaauuccacagcugaggcacuggggcaggaggcugaccacgacagcgggaccccugaggcccuuaccagccccccaagcagcgggacccccccaagaccccuaccugagcccccgaacccuggggcacaggacuugacacucccgcaggaggcggagcaugugaagcucggggcauuuccugugucacccgcaggagggaccgcacacgggacacugucccagucgcagccccaggugccuggaggagggcgucccagucagccccacccagccgcagacccccggccagggugcccuucccaagcgucgguucguuccccugcagcacgggugagccugcagcggggcuggaauauacccaagaccaggcaccaacccccaccuggcauugggcagggccugcagagcugggucaguccucaccgccucccuccaagaagguucugggagggucccuuucccacaguggggaaacugaggcucagaagaggauggcgcuugcccagguuccgugguggggugggaccagacaccaggccugagucuucauucuuuuuuuuuuuuuaagauggaaucucgcuccaucacccaggcuggagggcaauggcgugaucucggcucacugcagccuccaccuccuggguucaagcaauucuccugccucagccuccugaguaguuggcacuauaagcauccaacaccaugaccggcuaauuuuuguguuuuugguagaagcgggguuucaccauguuggccaggcuggucucaaacuccugaccucaggugauccacccaccucgcucucccaaagugcugguauuacaggcgugagccaccgagcccaaccugagucacgauucucucgguuaacaggagggccccccagggaaagagggcgggcgggcggucugcggaagggcaugggcucugaccaccgcacacucuggccgcccucccgagucuccagaacuccuacgccuccuucccagcgggcacaggccagcccggcugaccccuccccgggaagcaggaggagcccugcagaaaucccagggaggaaguggggucuggaacggccucccugccucuacgcucaggcggggaagccuaguugcagagugccgugccagggaguccgggccacguccccugcaccuccccgcagcugcucccaggacgggcagaggcuucggcuguccacacccucugggugaacgcuggggacuugccuggcgcugugcgugcacugaccaugccaaggcccacgucugcacaucugugcacagcagagggaccgcaccaggccaggcacucaccuccgagucccggucccaggaauguggaugaagagaggcugcugugcgacucagugaagugggugcccucgcugaaggucuaggggagaugggguggggaugagaggugcuggggcuucacaggcccccccuccaccccgcauuacagcuggagaggcaggacucaaacccaugucccccaguccaaaccccuggaaggcuggccccuucucucagccucaguuuccccacaccccucgcccccaacucuggggacaggaaacucagggucucaggccucacggggacuccuacccggcuggggucaaaggaggagcugcucuggucgccgcugccccaggagccugagcugggccgguccucaagaccugcaggcaggacagagagaguuaugggucacccucacgccugcccagcucuaaaagcuucgguucaucaucucaggggcaaaccucaguggacccggggggcuuguggaacccuuccuaacccagccucacccagcccgacucaugaggacaccagucagcagcuaacacccagacacccugggacucggagcacuuacagguccauaaacuuaaauuaacucuuccgucggcucucugcuggccaacuccuacccacccacuaaagccccagcuuucauacccuccuugggcaaagaccucacucucacgccgagccuccuccccaucagccccaagucccucccucuggcccagcccugacuauguggacuggggucucugugucagaugcagacucuucugacccugugagaaaggcucaugacagcaugaggguguggaagcuaacccaugagcucuggggaggcccagggucucccuguccccaccugccagugugggaaguggggccgcccuuugcugaagcagcagcagaggcucacccaucgggcaggaggcuggcagcccgugaggguggagccgaaucucaucacccaggaacaagcccaguguggagaccagaagccugcguggggcaggaguucccggcgcagcaagggacgggacgaggaccuuggucccggggcggggcgggcggggcccuuaucucucagaacacucacaggcaacgcccaggacuccagaaucuucugcccugggcagggagggccugcuuggauccuucccccuuccaucgggggccacagagcacacccguggagaagcaggagcgggcccugggccuccucagcuuggccacggaguugcugcccugccuugguuucccucucuauaaaugauuuacaaacaggcccuacuuuugcagggcuggggguguccauguccaacucccaaguccagaggcuucccgagagccaggccugggggacccagcccagugcugaugucugugaccggcaccaccucaggcuguucugcaggcucccccgccccgcccccugcccucccugcucauccacaccagaaacuucuuucaaaucgcauccuucuauuucggugccuuuguguuaaucauuccccccggggaguauugguguuuaauugcugucugauuugcauaauuaugcauauuaaucuccaagucuaaugaauauucaugcgccucauuuagauuuuguuuucuaaucaaaaauuuccaaugugauuaugaguggggggcugggaugcugccuuggcuggguugggggccaggcagggggcuccuguggucuccaggaauccacacggcauucgcugccaggucugggccaucugcaccccaagauccugguccugcacgugggcccuggugaacagggcagcugcugaggccagggugggcuggcuguguaggggugggcacagcgccggcacccucugggucucaguuugccucuauaccaccugcauguugucugguccccuccggccauagccaguaccccaggaggugcagagacccccaacugagcaaacgggaggcuccuggcaccccagcccucauccccuggaaggccugguguggugggggaccuccuggggccccaugcccagggaucgcccccgaaguucacuccaacaggccugugccagaggcacugcggccucaaucugcccuuugggggaacccucccucacccagccuuggccuccuccuagaaaugacaaaaauaaggacagcccccacauuaauacaguuauuaaaaucccccccaccgauuaaugaugcauuuuaauaacccaccaugaauauucauaaugcauccauugcuccuguucuaauuaaaauguacuaauagaauaagacacugcugucagagugugguuuucugugauuucuuuggugaagcaccgcagaguuuuacccgggaagggcaccuuccugcccugggccagccuggcugccucgggagaggccugcgaguggacggcgcaggggcgcuggggagagggccccaggagcggcccaccccuugggcuucaguuccaauuccagucacgggguguggaagccgcccaccugccugggcugccgugaggauaacaaugaaagaugcugcuucagagaggccauccguagccaaggaaugcuccaggcuggugguuucccagucccggucccuguuggguccccuccugagagggaccggggacuggucuuugccugguggcucguuggcaaaugggagagggaggcuucaaaaggcgcuuaguaaauaccggguaggacugagauuggucugcagcagggaucugcaaacaguacacaaggaccaagucuggccccuaagcugcuuuuuaaauaaaguuuuauuggcacacacuaugcccguuuguccauguacuaucaacggcugcuuuugcugcaacaguagaguugaaucaauuccaauagagaccaucuguccugcacagccaacaauauucacuccuugguccuuuccggagaaggcuggcugaccuugauacagaaaaagacuguccaagugccuucagcugccucugcacaagaaacccaaucgacagacuucaguaccaggagugggguuaccaugccgggcaggcaaaacuauugguggacacgggcccugaacacagcccuguguaccgccccugccaaacccucaggcacaccaccagguggucuggcuucagaugggccuggggacuucauccuauagccccagcucugcaaugugcccccacucaggugcucaggcuaaaguccugggaguccuccucaccuucccuccucccaaagaacagcagcuugccccauagcuacagcagcggguuaagcccagucccugcagcagcuuccuuccaagucugcugacauccucaggcagccggauggagccuuuagaagcaaaacuuggcucuucucccucccucuacccucucucauggcuccccaccguccucaggauaaagaccaaacucuuuccugaucucaccacucuccucuuccccaacacaggaggugacccccacccacacccccugccugagccccuucccagccugggaccccucuuugucugcagcacugccuggaacacagcugacgcccccaaaacacccacccucaacgucuucauuuuacucauaaauaacugugcuuccaagaacauuuuccuggaggaucaaaauauucuccaccucugcuguccaauacggggaccacacuaccaacugcuggaaacguggccagcauuuuuucaagcacauuaaaaauuacauuuaaaaauguguauauggcuaaugccugcuguacugaacaacccaguccccaaaagcaaaugaaauaacagccaccaccaaauaccacggucacgucuaaaaaccaauuaacaccucgacagcuccucacgcagguuccguuuacucgggaguaggagcgggccacccgauacagggucacuaugaccccccaagcccgugccucgccccgucucuucuuccuccuuauaauuaaaaucgugaaggaccccgauggcagccugucccaccgcccugccugggucuggccccugcagcuugugaugcuucucagacccauucccagccccucugggggucaugacgggugagaucagacagagguuugaauccggggguggccuuuccuuggguggagcaguauuuuaaaaaauuuuuuuuuucuuuugcuuugagacagggucuuguugcccaggcuggagugcaguggugcgaucuuggcucacugcaaccuccgccuccuggguucaagugauuuucccgccucagccucccacguagcugggacuacaggagccugccaccacgcacagcuaauuuuuguauuuuuaguagagacgggguuucauacauguuggccaggcuggucuugaaucccagaccucaagugauccgucugccucagacucccaaagugcugggauuacaggcaugagccacaacgccuggugaauuuaaaaaaauuuuuuuguagagauggggucucacuacauugcccaggcuggucucaaacuccuggacucaggcgcuccucccaccuuguauuucccaaagcccuggggucacaggcgugcacagccuccauuuuaucuaaauucaagcuaugggagaagaugaaagaccaggaugcccucggcccagcucgcgcacugcagccgcccuggguuuaucuuccugucgugucuucuuggucagggcccgcaggcuguguagcacaugcucccagcuucugaggaggaucccgagugggggagaaaaugcuucuggggcaccacagagcccuuccuuguuggggggcugacgagaucccgcaaagccucccacuucgaucugccucuaaugucuggcgauggggggugggacagcagggcccuguggcccgcccgcgagcagacaaaccugaggcugaagagaaugugaguggagaccacacaccacccuaagaguggggguccccacagcaccuaaaguggcaggacgugcccucggguagaggcacagugaggcugugcgggcaacacaggcaaccuccuccgccagaaccggggacgccucgcaaccuccuccaccagcacgggggacaaccuccuccgccagaaccggggacaacuggcaaccuccuccaccagaagcggggacaaccuccuccaccagaaccagggacaagcuccucccccagaaccaggggcgccucgcaaccuccuccaccagaaccgaggacgccuggcaaccuccuccaccagaaccgaggacgccuggcaaccuccuccaccagaaccggggaugccuggcaaccuccucuaccagaaccgaggacaaccuccuccaccagaaccagggacaaccuucucccccagaagcaggggcgccuugcaaccccgcucccccaaggcccugggguuucccuggagggcagagcuggccccgagagugggcaucgagcacagauguuaaguaacaacucagagaaacagggccccgcuuugaauuucagugaccacagagauaaccgagaccccaucccgcucuugcuuccaugucuaugggcaucaccagugacaccugaguguggggaccggagaaccugccccucaaaacaagcucagaaaccaacccggggccgggcacgguggcucacgccuguaaucccagcacuuugggaggccaaggcgggcggaucacgagguccagaaaucaagaccaugcuggccaacagggugaaacccccgucucuacuaaaaauacaaaaauuagcugggcgugguggugggcaccuguaguaccagcuacucgggaggcugaggcaggagaauggcgcgaacccgggaggcagagcuugcagugagccgagaucgugccacugcacuccagccugggcaauagagcgagacuccaccucaaaaaaaaaagaaaaagaaaaagagacacaagagggaacccaacauggaacaaaaaggaugaaguucaagaaguucaaugauuuacccuaaaaaacgagaagacugucuuaagccuguaagccccauggauccucaaagaaauggcagagccuggggguucuauggaaugaaguagacagugagcacauuuaauuacgaaucaagagauuccuagaagccguaacaagacaggcacacaaggaaagcccucugggggcacuuugugaguucucucucauuucacugaauccuugcaguggcuacauuaccccuacccuacagauaaggaaacugacgcaaaagauagaugccauuugcucaagcccucacaguaaguagcaaagucacuauuuaaugauacaaauguuuccuaguaagaugcaaauacacaauuaugaacagauacaauguuuuuuuguuuuuuuuguuuguuuguuugagacugagucuggcucugucgcccaggcuggacuacaggcgcccaccaccgcgcccggcuaauuuuuuuguauuuuuaacagauacggcauuucaccguguuaaccaggauggucucgaucuccugaccucaugauccgcuggccucggacaauguuuuuuaaaaguagcaauuuauugguagcaaauaccagcagggaagagaaauauacaggcucaauuuucaccuucucacagaagggggcagaugcgauuucacuucggacguugagagcgcgagaaacggcguguuuaaacguguucuucacaacgcagaauacuaaccgcuauucaaucacggccuuaaacguguuauucaaaacuagaaaagaaccacuggcagagccgcaaagcgguacagagcuucagaaaacacacaccgggggaagcaauccggaguugggagcacacagauggaaaaacaaaauaagacgauggaaggaaaagcugagaacgaagauggacgggugcuuaacgucuuuaaucugaaaacacggugccgaccaaagacaguuuugaaacaagcgacucaggagauacaaccaggagcacaaagaucugccaagccacaccaacaaaaaggaaggguugcaaccuucauaucgaaguuucaauucaagggagguuucuuuuucugagacagagucucgcugugucgcccaggguggagugcgguggcgcgaucucagcucacugcaaccucugccucccagguucaagugauucuccugccucagccucccgagcagcugggauugcaggcaccugcuaccaugccuggcuaauuuuuuauauuuuaguagagauggaguuucgcccugugggccaggcuggucuugaacuccugaccucagaagauccaccugccuuggccucccaaagugcugggauuacaggcaugagccaccaccaccagccaaggaacggauuuuuuuguuguugacaauggcucgacccacaacgaaaucccacugucucagcccacacaagcccacaauccuggcaucuaaauacgucaacagagaaaccgacaaacagaacagagggggauggcgcugcucucagccugacauuaaacagauuaaaaaucuaaauaugguucaaaggccucgcagcuccacauccaacuaucccucaaguacucacaaagaaggacaaaaauaauccauguuucagccucggcagaggagcucugcguccuccaaacaguagcuaccguuuaagccaaagcugaguuuuggcacuggagaucuagaaaucaagaaaggaccuccaacuuggaacucagaaaccucugaagcaaccugaccugaagaggaaauuaggaaaaaaaaaaaaaaaaaaaaaaaggaacaaaugucaguaauaugagaaaaacaugcauuauggaaaccaaugggaugggguucacgggguggaacccucaacaccacacugauggaacagaagagggcagaagucagcaaaaggggccugugaucugaaagucaccaaaaacuuuagaaagagaagaaaugccgauaaagaggaaaauugaucaauugaucaauaucgauuugccaaugaagcagauucuccagaagaaaaaucaacgagagagagaaaaugcacagggcagccgagucaagaacaaagaaaccaccuaaaaguuggcgcauugaggaccgcggcgcccucagccucccugcgcagguggaaagacaggcgccuccaaacguuaucaaagagccgaacggggccaggcgcagagggucaggccuggaaucccagcacuuuuggcacggguggacagacaggcgccuacaaacauuaucaaacagccaaaugaggccgggcucgguggcucaugccuguaaucccagcacuuugggaggccgaggcgggaggaucaccaggucaggagaccgagacuguccuggcuaacacggugaaacccugccucuacuaaaaauacaaaaaauuagcgcaaugguuacuaaacucucuaaguuucagcuucuuuaccaguaaaauacgguaauaauuacaccuauuucgcuaaccuguuagaacugagaauucccagugaauaagccaagcuuuguguccaaugcacagugcucaagaaacacugauguaagcaguggcucacaccuguaaucccagcacuucgggaggccgaggcgggcggaucacaaggucaggagauggagaccauccuggcuaacaaggugaaaccccgucucuacuaaaaauacaaaaacuuagccggcaccuguagucccagcuacuagggaggcuaggcaggagaauggcgugaaccugggaggcggagcuugcagugagcugagaucacgccacugcaccccagccugggugacagagcaugacuccgucucaaaaaaaaaaaaaaagugauguaaauuguuguauuacugauguuguuaaaaaguuaaugaggcggccaggcgcggugguucacgccuguaaucccagcacuuugggaggccgagguggguggaucacuggaggucaggaguuugagaccagccuggccaacguggcgaaaccaugucucuacuaaaacuacaaaaaauuagccaggcaugguggcaggcaccuauauucccagcuacucaggaggcugaagcaggagaaucguuugaacucaggaggcggaggcggaggcggagguugcagugagcugagaucgugccacugcacuccagccugggcaacaagagcaaaacucggucucaaaaaaaaaaaaaaaguuaaugaggcagcaauaaaaagaaaaaaaaaagauacagccaacagcuuggcuggaucuccagggaauuaugcuaacguaacagaauaaaagcuaaucucagaagguugcaaacuauaggauuccauuuacacaaaauacucaaagugaaaaauugggcugggcacaguggcucacacauguaaucacagcacucugggaggcugagguaagaggaucacuugagcucaugaauacaagaucagccuggagaacacagcaagaccccaucuagacaauauuuuuuuauucuucagacacggucucccucuguccccgaggccagagugcaguggcgcaaucucagcuaacugcaaccuccgccucccagguucaagugcuuuucgugucucagccucccgaguagcugggaugacaggcacgcaccaccacgcccagcuaauuuuuguauuuuuagcagagacgggguuucgccacguugacuaggcuggucuugaacuccuggccucaugugauccacacacccuggcuucccaaaaugcugggauuauaggugugagccaccgcacccagcugaaauuuuucuuuuuuuuuaaacagagacaggguuucuccauguugcccaggcuggucuugaacuccugggcuccggcaauucucccaucucaaccucccaaagugcuggggauuaccagugugagccgcugacccagcccucuacaaaauacauauuuuuuuaauuagguggucgcagcugcucacaaggcugaggugggaggaucaguugagcccagaacuucaaggcuacagucaguuaugaucacaccacugcacuccagucuggacaacagagugagaccuggucccuaaaaaaaaaaaaucguacagaugaagaacagauuggugauuccugggcuuaaagaaggugcaugucucaaaacugcacagaacuacacacacacacacacacacacacacacacacacacgcacgcguacacacacgcacgcagacacagacgcagacacgcacacacgcgcagacgcacagacacgcacgcgcagacgcacacacacgugcgcacacacgcacgcacacgcacagacgcgcacacgcacagacacacacccgcacgcacacacagacacacacacgugcguguaaagccgguggaaucugaucaggaucuguggacggcaccaaugucggcuuccuaggucugacgcagcaccacgggugggcgggacgguaccccuggggguggcuaggugagaggagaacacucugccacuuccugugaaucccgaaagacuucagaauaaaaaguggaucaacuucaaggacgagggcccaagagaguaacagaaaauucaccagagagccauucacagggucaauccccuuccgagaagaccaccgcccucuauuaaacaaguggcaggugaaaggacacgaucuuugucaccuauuaaaugagacaggccgugcugucaccacguuggccaggcuggucucgaacaccuagucccagguacuccucuugccuuggccucccaagugcugggauuacaggccugagccaccgcgcccggucacaagggacgcuuucaaugugaaaaagcauccagggacccagcaauuccacucccagacacgcacccggaggaaaugacccaugcgccagguucucccgggguuuccucuuaaagcagaacgcggaggugccguucuguggauuuucacucugaccgugugucacacuuacaaucgcacggacagagaaagcgacggggaaaugaaaaauaggaaagaacuuuccuuugguccgucaauaagcaauuuccuggugucucccguggccucagagccugucugucuuggcagaagauaggcugucacucagagaccugugccugaggguuuccaaaaaugggaggcggugggugggagaaggcguacgaaaauuauucccguuuuaaaugucuuccgauccagacaaccagaaaaucuugguuuccuauucguuaaucucuaaugccuuuuuuguuucguuucuguuuugagacagggucuggcucugucacccaggcugcagggcaguggcgcaaucucagcucacugcaaccuccgccucccaggcuccagcaauccuccugccucagccucccgaguagcugggaccccaagugugcgccaccacgcccagcuaauuuuuguauuuuuaguagagaugagguuuugcuguguuacccaggcuggucucuaacuccugcgcucaagcgauccuuccgccuuggucccccaaagugcugggauuauaggcaugaaccacugugucuggcccuuuucuguuuguuugaguuggggucucucagucacccaggcuggagcgcaguggcucaaacauagcucacugcagccuugaccuccuggccucaagcgauccuccugccuuggccucccaaagugcugggauuaaaggugugagccaccuugcccaguaccuaacuccucucucgacaccaauuuuuaaauauuuauaaauaucgaagaacaggcagacccuucacaggggaaaacuuauguuuaauuaauuuucagggacaccuuuuauucucaccuggguuucugguucucaaaucuaaaguuuccuuucaaaugaacuuaagaaaagcgaggugacuuaaaagggagcuagaacagggcacaugaagaaggggccaagguggagaaugcggcugggguaccccaucagccaucagcguuggggacuccuggcgaaggguggcguccccgaagccaacuaggccccgccuggaaggaagcugcacccacuguuccaggaagaagccgagguuugggaagggaucccacagcuccggggcuccauccugcugaugagccccaaacuccccucuuccuggguccucggagaggagaagcaggaagcggggaaaugagcuacugcagcuccugggcccugccgggaucccuccgccccucgcacccaucgacucgcugaaccugacgauggaagagagcaggugcccaucuugcgggagcuucgggagggccacaccuggggccagcgccacagccugcaggggccugggggaguggaggcaaugaggagggugccaccaacucaggccuuggagcucugcauccuccaccacccccgggcucaggcgggcguuaacugcauggacugaacggggagggggucaccccucuguguccaggagcuggggggucccaggcuggagcagccacaucacgucccucaagggcaaaaaaugcaacauacugggccucacugggcccuccaaagccuccgcccuaacgugugaggggacaaggcgagacccucccaaccugcagcauuggggcagggccggagcacagggcgagacucugugggaaccacagaaaauacaucugcaaacauuggcagguuccugcugggaccgggcugggcguccagggagaggcaacccagagggagcauucucagguccacacggccuacacaccacagcucugguuacccagggaccaaucucacagugguccgugccagggcugagggggugagaggcgacaggggacgagggaagacaccucccaccccacccuccccaccaggcccugcuguaagcccacccagaggcccaggagaauggggguggacggccuugggaguugcgcuuccuccuccaggaagcccccagggccugacccucugccucacacagggaagcauuagcauguccgguuccuggggcuguuuccggggggcuggcaggguggcguuuggggauuuccacgccucagggagcauauuccggccagcccuguggccacuuccucacguagaggggaaggccagugugaggcagugggggcagcaaagcgaugucucuccaugugggggugcaagugcccaaguacagaacccccuuugcccaccacucaaaaccccgacacuccagccagggcccaccccugggggauucuggagauaacugcaggacggcgcuuuccacccagaucccggaggcaggaaggacacagcuucagaggccccaacccgaggcccccacuccccggaaagaugcugauguccacaaagagacccguggcucugaagcagcaucgggggcacccgccccaaccucccccaccaaauccugucgacagccagccugggccgcccaaaugcacaucagacuagacccucucuccauucacaaccauccagggcuccccgcugccccugcaacgaacacagcgccccuagcccgccccgccggccggucccaccgcagggcguccguacgggcugcucucucugccuggcaaauuccuccccucaugcucccacggccccuuccucucacccucagggcucugccccgacacgcccucugcggagaccuucacuagaggucccgcuuuggggcaaccuggcccucgcugggugugccgugaagcccugcccaugcuccagagugugauuuucaggccacccccaggaccccacgucuccccuaucugucccgcccacugcugugucaucagcgagggugacccgcucauccaggucagccugggauguuucugcuuugagcacucaaagccgcgggucccaggaauugccccucaguccugggcaaaccacaauggccggucacccuggugcugggcccugcauacagcaagcgccuaauaccugcuuaaaugaaagucgucgaggcucacaaggugggugggauccagugagagccgggaucccgcaccacgcccucuccagagccucaguuucccccuuauggauugacuggagaaacggaugcucgagauccccacccacacacaggcccagcuccaacccugcgccuaaaaacaagccccacccagcccccagacccaggcuccaggcgcgggagggacgaggggacgaggggcucaggggcucgggcucccaaggcaggucacacgggcaacggcagcugauuucaggggucuucaggcucgcugcccccgacccggccuguguggcccuuuccccauugucucccuccuuugcugccccagccucccucgcccgcacacugucuucaacagacccuugaucuccucacuccacgagcgcuggcaggaaggcgggguccuaccugaaccuccgaacugcgccccggccagggaggcgggccggcccuucccguuggugacaggcagcgggaacaucugcagggaggggaggggagacgugagcggggcggguggcaaaccaaacccuacagucccggguucaaacccaagcugggagcagagcuggggacacccgggaaccugagacugcgcuccaucuaggcccggcccguccugcuccgccccaucacagaccagaagacucugaggacucgcgugcccucaagugacgcugcacccuggacacccacgcccagagugagaaaacuccagacgaugaccccgcuguaccgccaggcagagucccugccgcugaaaacucgcuguucccccugccuuugcucuggggggagggguaucccauuaggcgaaggauacaacuuaucagcucuugacagugauacaaaguugucuuuacguuucagcucugaaaagugagagguuuacacucaacagguggacauguggagaguccccggaugccugagcccuggcugacuccucguuuccugugugugcacuggccccgcauggcaggcccuggagcagggggucccuggagcgggggguagggcccagugucccccuaccagggcuggguauggguuugcuuggcaaaaggggaagccgaggcucagacaggcagcaggucgaggaagacacgggauggagccccgggcccggcaggaagcuggaggggcuggggagaggcugcaccccacagcugauccagcuccugggugcuaggggugugggacugccacccucccucccgcccggcucacccguacccagaacacuaagucccuaaagauuaacgggcucagcggcauuaaccggaaaagccaacggcaacaaacccuuuugccacagaaaaaaacacaacaagccuccgcccugccccaaggggcugcguuuuaaggcucccaucggggcuuaagugaucaaaguggcuggaaucagagccaggggcuuucugaggagcagccaagauccccaacaccuuccccagccagccaggaggcgaaggcacagcgccuguggccacgauccacagguccaaaggggacccaggaagcgggguugucccccacucccugguccugcagaaggggaaacggaggccgcauucucaccuggcccuggagaggaagaacggucuugcggguagggguggcacccgcgcugaaggcaguguucgcccuggaccacacccccucccgcaggcuccggugcacccagccuccccuggacccagaccuccaagggccaaccucucauuugggaaacaaaggccugcugugggggacagccaacugcauuucuaucugcuuuguccccuaggacaccagggcugcaccaacgugccacaggucacauggguaccgggcuguguccugugggcucugcaggccucaugagcagcccagaacagcccccgcaccccuuggagcaucaguuuccucuucugagaaauggaccgagggcucuggcugugugggacguggugaaacccaaaagcccaugggagucucgcacgcggcagggccuggggagcucgcuuccaacagccucgguccuagggacucgcucccccuucauuccugaagccccugacucaggcccagggacugccugggacccaggcagggcaugucagcccaggccagugcuggcggguccuucguucccgaccaaagcuagccugggucagggcaggacaaaggcgcgcugggaacagccuggguuagcguucucccucguauuuauuuggaguucccuguucucucacuuuauacgcaucugguccagggaaguaagugcuuccccuaggacccagccucggcaggggcagaaggcaggcaugcaggaacagaguggggaugcgggcagucacaggggcugccucugccuccccguccuggccagggagguggaacuccaccucuggguaaagcccgaggggggacgcccggagaggacgggcaccucgccgcucccagccuguuuccucaucugggaacggcuccgacccgggauggggagacgugcugaguggcuugaggugaggagucagguccuggggcugaaccugugcccccuccccccaaacgcuggucuguuccagcccagcggucugugacuugucaguuuaacaaaaaacaacccaacugcaccucggguuacucagccagggaagcaaaaauaaaacggggcuuaaaaauaccagcauggcccuuccggagccuuggccccuccggcccuugggcuguuuuuuuccgcaggguggccgguguuguuucaguuuggggacuuuuguuuuugacagaccucaguggccugugccucauaggcgggaggguuaaauucagacugaaagugcccucccccaaccuguuucaaccccaaacgcugccacugggcauggggggggggggggagcagaauuuaaggacaucuguagacaggccagaagaaacaaaccaaggucccugggcuucuccaggaacccauaacacauggccccacuguaccagcaggcaaaccgaggccccgggccuuuacagcacccgucagcggccgguaccccagggggcuccggcauuccagccucacugcaccugccugaacugugugacuucugaggaccagcacccucugagccuccguucacccagguggagaaugggccguacagggacagauccaaccaccuaagacucugaagaagccgccccgcccuccccaccgggccugccugcuccgcagugauaaccguggcagucacaaugguggcgcugcugucugcucgguggcccaugaauucccacucaaucccaauccagccuccuccuggcccaagcucggcuucuggcagcuuaacuucagcacccacgugugacuaauuaaccacacagucaguuucaugcccgcauccucugcccaccaggggagucccguauggggcagguugugucugcccuguucacggagggugguccgcucagcacugggcacccccuccuuuacuucuuugaggaaggaucuuacucuaucgcccaggaaggagugcaguggcgcaaucacagcucacugcagccucaaccuccagggcucaagugauucuccuugccucagccucccaaguagcugggaccacaggcaucuaccaccacuccuagcuaauuuuuugaguuuuguuuugucuuuuugagaaauggggccucacuauguuuccugggcuggacuuggaacuccuggccucaagcgauccucccgccucagccucccaaagugcuggaaugacaggugggaaccacugugcccagccccccucccauuuacugaaacagggucuccagggucucacugucaaccagacuggagugcagugaucuuuuacuuacuuuuaauuuuuguaucuacaaugagguaagcgacccugaucaggcccauuuuacagaucagaagaucaaggccgcauuuugcuuacccagccaagcugggggcccaggaccaugccccugaggacucaguuuccccaucuguaaagcaguaggcuguagaaugcugcguccgggcaaaagccccauagcacacgugcugccgugcgcugucagccuccugccagagagcggcccacucccccagccccaccggggccucccauccaaacagcugaggcuccaucgcugaaguauucagcaaacacucuccccugaaaaccuucccgugaacuguggaggcaaaggggugucgggggcugggcggggguccuggcucaccaugcugaaguccaggaggucacugagcuccuugucugugcccacaggcgccauccucugcggcugguucauucuccuggggccagggcgggcaccucaggccuggaaacccugcuugguggauguggggacagauggacagggagaaacagggaggggagaagaguugugaguggucaaagcacagagugcuaaaagccaccuaaaaaacccucaaccgcccuggggucugaguuccagcagagcccugggggcacggggagcccugggagcaggcgcagggaagcuggaauuccagagucuaggucccugcagaguccuccccagagaccacagggagucugaaaaauggggggagggugugcaaauauaaacucccuaacucccccagggaacaccagggcaucaaguugccaaguuuaaacugcacgcagggcagccagaaccucuccuuucuccaacucucucauuuccaaccaaccccgggcuuccucugaggcccccuacccccgggaaagggaggaacagcccgauccuaccccgccccgagggaaauuuggugauuccccccucccccagcagauggcacagcccguugaagaccaggucgcccccaaauucaacaugaaggaaauccacaagucagaaaaccacgaaacucuuuuacaagcuucaagacuuaaagugccgggggugggggggacgcgcauccuaugcagggaccagcaaagcuuuccuccacccucaaucucccuccccccaagaaaaccccaacaguauucaggaaagaaaaaaaaaacagcccuagauugcuuuacugucgcgauguauccgggaauuauuuuuaagcaaaacuuugacaacaucccuugccugcccuccaugagcggggagagcgucucaagaccagggugcucccgcguggucccagggggcuccauucuaagaugggggaugggggauccaccugccaagacccauuccacccccagaaaaagguacagagaaaaauuuccauuccaaagaaaugcacuccaggccccuccagucucgacuuuccccagggguccccagguggggacgggggcagcccgggagacaccuccgaggcuggggguggggaggagccuccgaggucgagggagacccaacuucagaagcagagaaauccccucuuugucugccaacuggaggccgggugugaagcgggcgccccagcgcagccccucccccgcucaguuuuuuucuuuuuuggagggcgugugaaacugacuuuuuuugaggacuacgaaaccgcacuuuuuugugggguagcugaaaccgauuuuaagacagacuuaguuggggggguggcgagcuaaaacgggcauucuacgggagcuggaagacuucuggggcgucccaaggacuuugagagacuuggagaauguuugaagccacuuugcacggcgccgaaggcggggggcgcgcuggaacgccuuuuucccggggggaggcggcccgggaagccggaccccccuccccccgcagccggugcaggcggugcggcccgggagccuuugaagcucgcagcgcggccgccgccucgccccgcauuaacgcggagcagauguuacccgcgcgcccccccccggcccgcccggccccgaccagcgccugcagcgcgcggcaccuuccccgcgcagacaaaaggacgucccucccgcgcgcuccccaccccaaacuccggcgcccgggccgggccccccucuacccgagaaagggggcgccccgggguccccgugcgcccgggcugggggggacgguccucgcgccuaaguugcacagcccguccggcgccccccgcgcccccgcccggggcugcuuaaaguuucccgaagugcccggcccgacgggggcgacgcgggccuggcgagcuccgggcuccuccacgucgccgcccccccggcgccgcgcgaaguuggagaacaaugacucccgggccgcggggcgccccccgacaccgcccccgccccaacuuccuccgcgcccccccccaacaagcgcgcgcggggcgggccgggguucccugggcacaaagcacggggguaccgggcgcgccccccgccccccgccgggcucaccugcugggcgcggccgggcacgcggcgcgu

SEQ ID NO: 193016 - RNA, 43040 nt, Homo sapiens
acgcgccgcgugcccggccgcgcccagcaggugagcccggcggggggcggggggcgcgcccgguacccccgugcuuugugcccagggaaccccggcccgccccgcgcgcgcuuguugggggggggcgcggaggaaguuggggcgggggcggugucggggggcgccccgcggcccgggagucauuguucuccaacuucgcgcggcgccgggggggcggcgacguggaggagcccggagcucgccaggcccgcgucgcccccgucgggccgggcacuucgggaaacuuuaagcagccccgggcgggggcgcggggggcgccggacgggcugugcaacuuaggcgcgaggaccgucccccccagcccgggcgcacggggaccccggggcgcccccuuucucggguagaggggggcccggcccgggcgccggaguuugggguggggagcgcgcgggagggacguccuuuugucugcgcggggaaggugccgcgcgcugcaggcgcuggucggggccgggcgggccgggggggggcgcgcggguaacaucugcuccgcguuaaugcggggcgaggcggcggccgcgcugcgagcuucaaaggcucccgggccgcaccgccugcaccggcugcggggggagggggguccggcuucccgggccgccuccccccgggaaaaaggcguuccagcgcgccccccgccuucggcgccgugcaaaguggcuucaaacauucuccaagucucucaaaguccuugggacgccccagaagucuuccagcucccguagaaugcccguuuuagcucgccacccccccaacuaagucugucuuaaaaucgguuucagcuaccccacaaaaaagugcgguuucguaguccucaaaaaaagucaguuucacacgcccuccaaaaaagaaaaaaacugagcgggggaggggcugcgcuggggcgcccgcuucacacccggccuccaguuggcagacaaagaggggauuucucugcuucugaaguugggucucccucgaccucggaggcuccuccccacccccagccucggaggugucucccgggcugcccccguccccaccuggggaccccuggggaaagucgagacuggaggggccuggagugcauuucuuuggaauggaaauuuuucucuguaccuuuuucuggggguggaaugggucuuggcagguggaucccccaucccccaucuuagaauggagcccccugggaccacgcgggagcacccuggucuugagacgcucuccccgcucauggagggcaggcaagggauguugucaaaguuuugcuuaaaaauaauucccggauacaucgcgacaguaaagcaaucuagggcuguuuuuuuuuucuuuccugaauacuguugggguuuucuuggggggagggagauugaggguggaggaaagcuuugcuggucccugcauaggaugcgcgucccccccacccccggcacuuuaagucuugaagcuuguaaaagaguuucgugguuuucugacuuguggauuuccuucauguugaauuugggggcgaccuggucuucaacgggcugugccaucugcugggggaggggggaaucaccaaauuucccucggggcgggguaggaucgggcuguuccucccuuucccggggguagggggccucagaggaagcccgggguugguuggaaaugagagaguuggagaaaggagagguucuggcugcccugcgugcaguuuaaacuuggcaacuugaugcccugguguucccugggggaguuagggaguuuauauuugcacacccuccccccauuuuucagacucccuguggucucuggggaggacucugcagggaccuagacucuggaauuccagcuucccugcgccugcucccagggcuccccgugcccccagggcucugcuggaacucagaccccagggcgguugaggguuuuuuagguggcuuuuagcacucugugcuuugaccacucacaacucuucuccccucccuguuucucccuguccaucuguccccacauccaccaagcaggguuuccaggccugaggugcccgcccuggccccaggagaaugaaccagccgcagaggauggcgccugugggcacagacaaggagcucagugaccuccuggacuucagcauggugagccaggacccccgcccagcccccgacaccccuuugccuccacaguucacgggaagguuuucaggggagaguguuugcugaauacuucagcgauggagccucagcuguuuggaugggaggccccgguggggcugggggagugggccgcucucuggcaggaggcugacagcgcacggcagcacgugugcuauggggcuuuugcccggacgcagcauucuacagccuacugcuuuacagauggggaaacugaguccucaggggcaugguccugggcccccagcuuggcuggguaagcaaaaugcggccuugaucuucugaucuguaaaaugggccugaucagggucgcuuaccucauuguagauacaaaaauuaaaaguaaguaaaagaucacugcacuccagucugguugacagugagacccuggagacccuguuucaguaaaugggaggggggcugggcacagugguucccaccugucauuccagcacuuugggaggcugaggcgggaggaucgcuugaggccaggaguuccaaguccagcccaggaaacauagugaggccccauuucucaaaaagacaaaacaaaacucaaaaaauuagcuaggaguggugguagaugccuguggucccagcuacuugggaggcugaggcaaggagaaucacuugagcccuggagguugaggcugcagugagcugugauugcgccacugcacuccuuccugggcgauagaguaagauccuuccucaaagaaguaaaggagggggugcccagugcugagcggaccacccuccgugaacagggcagacacaaccugccccauacgggacuccccuggugggcagaggaugcgggcaugaaacugacugugugguuaauuagucacacgugggugcugaaguuaagcugccagaagccgagcuugggccaggaggaggcuggauugggauugagugggaauucaugggccaccgagcagacagcagcgccaccauugugacugccacgguuaucacugcggagcaggcaggcccgguggggagggcggggcggcuucuucagagucuuaggugguuggaucugucccuguacggcccauucuccaccugggugaacggaggcucagagggugcugguccucagaagucacacaguucaggcaggugcagugaggcuggaaugccggagcccccugggguaccggccgcugacgggugcuguaaaggcccggggccucgguuugccugcugguacaguggggccauguguuauggguuccuggagaagcccagggaccuugguuuguuucuucuggccugucuacagauguccuuaaauucugcuccccccccccccccaugcccaguggcagcguuugggguugaaacagguugggggagggcacuuucagucugaauuuaacccucccgccuaugaggcacaggccacugaggucugucaaaaacaaaaguccccaaacugaaacaacaccggccacccugcggaaaaaaacagcccaagggccggaggggccaaggcuccggaagggccaugcugguauuuuuaagccccguuuuauuuuugcuucccuggcugaguaacccgaggugcaguuggguuguuuuuuguuaaacugacaagucacagaccgcugggcuggaacagaccagcguuuggggggagggggcacagguucagccccaggaccugacuccucaccucaagccacucagcacgucuccccaucccgggucggagccguucccagaugaggaaacaggcugggagcggcgaggugcccguccucuccgggcguccccccucgggcuuuacccagagguggaguuccaccucccuggccaggacggggaggcagaggcagccccugugacugcccgcauccccacucuguuccugcaugccugccuucugccccugccgaggcuggguccuaggggaagcacuuacuucccuggaccagaugcguauaaagugagagaacagggaacuccaaauaaauacgagggagaacgcuaacccaggcuguucccagcgcgccuuuguccugcccugacccaggcuagcuuuggucgggaacgaaggacccgccagcacuggccugggcugacaugcccugccugggucccaggcagucccugggccugagucaggggcuucaggaaugaagggggagcgagucccuaggaccgaggcuguuggaagcgagcuccccaggcccugccgcgugcgagacucccaugggcuuuuggguuucaccacgucccacacagccagagcccucgguccauuucucagaagaggaaacugaugcuccaaggggugcgggggcuguucugggcugcucaugaggccugcagagcccacaggacacagcccgguacccaugugaccuguggcacguuggugcagcccugguguccuaggggacaaagcagauagaaaugcaguuggcugucccccacagcaggccuuuguuucccaaaugagagguuggcccuuggaggucuggguccaggggaggcugggugcaccggagccugcgggagggggugugguccagggcgaacacugccuucagcgcgggugccaccccuacccgcaagaccguucuuccucuccagggccaggugagaaugcggccuccguuuccccuucugcaggaccagggagugggggacaaccccgcuuccuggguccccuuuggaccuguggaucguggccacaggcgcugugccuucgccuccuggcuggcuggggaagguguuggggaucuuggcugcuccucagaaagccccuggcucugauuccagccacuuugaucacuuaagccccgaugggagccuuaaaacgcagccccuuggggcagggcggaggcuuguuguguuuuuuucuguggcaaaaggguuuguugccguuggcuuuuccgguuaaugccgcugagcccguuaaucuuuagggacuuaguguucuggguacgggugagccgggcgggagggaggguggcagucccacaccccuagcacccaggagcuggaucagcuguggggugcagccucuccccagccccuccagcuuccugccgggcccggggcuccaucccgugucuuccucgaccugcugccugucugagccucggcuuccccuuuugccaagcaaacccauacccagcccugguagggggacacugggcccuaccccccgcuccagggacccccugcuccagggccugccaugcggggccagugcacacacaggaaacgaggagucagccagggcucaggcauccggggacucuccacauguccaccuguugaguguaaaccucucacuuuucagagcugaaacguaaagacaacuuuguaucacugucaagagcugauaaguuguauccuucgccuaaugggauaccccuccccccagagcaaaggcagggggaacagcgaguuuucagcggcagggacucugccuggcgguacagcggggucaucgucuggaguuuucucacucugggcguggguguccagggugcagcgucacuugagggcacgcgaguccucagagucuucuggucugugauggggcggagcaggacgggccgggccuagauggagcgcagucucagguucccggguguccccagcucugcucccagcuuggguuugaacccgggacuguaggguuugguuugccacccgccccgcucacgucuccccuccccucccugcagauguucccgcugccugucaccaacgggaagggccggcccgccucccuggccggggcgcaguucggagguucagguaggaccccgccuuccugccagcgcucguggagugaggagaucaagggucuguugaagacagugugcgggcgagggaggcuggggcagcaaaggagggagacaauggggaaagggccacacaggccgggucgggggcagcgagccugaagaccccugaaaucagcugccguugcccgugugaccugccuugggagcccgagccccugagccccucguccccucgucccucccgcgccuggagccugggucugggggcuggguggggcuuguuuuuaggcgcaggguuggagcugggccuguguguggguggggaucucgagcauccguuucuccagucaauccauaagggggaaacugaggcucuggagagggcguggugcgggaucccggcucucacuggaucccacccaccuugugagccucgacgacuuucauuuaagcagguauuaggcgcuugcuguaugcagggcccagcaccagggugaccggccauugugguuugcccaggacugaggggcaauuccugggacccgcggcuuugagugcucaaagcagaaacaucccaggcugaccuggaugagcgggucacccucgcugaugacacagcagugggcgggacagauaggggagacgugggguccuggggguggccugaaaaucacacucuggagcaugggcagggcuucacggcacacccagcgagggccagguugccccaaagcgggaccucuagugaaggucuccgcagagggcgugucggggcagagcccugagggugagaggaaggggccgugggagcaugaggggaggaauuugccaggcagagagagcagcccguacggacgcccugcggugggaccggccggcggggcgggcuaggggcgcuguguucguugcaggggcagcggggagcccuggaugguugugaauggagagagggucuagucugaugugcauuugggcggcccaggcuggcugucgacaggauuuggugggggagguuggggcgggugcccccgaugcugcuucagagccacgggucucuuuguggacaucagcaucuuuccggggagugggggccucggguuggggccucugaagcuguguccuuccugccuccgggaucuggguggaaagcgccguccugcaguuaucuccagaaucccccaggggugggcccuggcuggagugucgggguuuugaguggugggcaaaggggguucuguacuugggcacuugcacccccacauggagagacaucgcuuugcugcccccacugccucacacuggccuuccccucuacgugaggaaguggccacagggcuggccggaauaugcucccugaggcguggaaauccccaaacgccacccugccagccccccggaaacagccccaggaaccggacaugcuaaugcuucccugugugaggcagagggucaggcccugggggcuuccuggaggaggaagcgcaacucccaaggccguccacccccauucuccugggccucugggugggcuuacagcagggccugguggggaggguggggugggaggugucuucccucguccccugucgccucucacccccucagcccuggcacggaccacugugagauuggucccuggguaaccagagcugugguguguaggccguguggaccugagaaugcucccucuggguugccucucccuggacgcccagcccggucccagcaggaaccugccaauguuugcagauguauuuucugugguucccacagagucucgcccugugcuccggcccugccccaaugcugcagguugggagggucucgccuuguccccucacacguuagggcggaggcuuuggagggcccagugaggcccaguauguugcauuuuuugcccuugagggacgugauguggcugcuccagccugggaccccccagcuccuggacacagaggggugacccccuccccguucaguccaugcaguuaacgcccgccugagcccgggggugguggaggaugcagagcuccaaggccugaguugguggcacccuccucauugccuccacucccccaggccccugcaggcuguggcgcuggccccagguguggcccucccgaagcucccgcaagaugggcaccugcucucuuccaucgucagguucagcgagucgaugggugcgaggggcggagggaucccggcagggcccaggagcugcaguagcucauuuccccgcuuccugcuucuccucuccgaggacccaggaagaggggaguuuggggcucaucagcaggauggagccccggagcugugggaucccuucccaaaccucggcuucuuccuggaacagugggugcagcuuccuuccaggcggggccuaguuggcuucggggacgccacccuucgccaggaguccccaacgcugauggcugaugggguaccccagccgcauucuccaccuuggccccuucuucaugugcccuguucuagcucccuuuuaagucaccucgcuuuucuuaaguucauuugaaaggaaacuuuagauuugagaaccagaaacccaggugagaauaaaaggugucccugaaaauuaauuaaacauaaguuuuccccugugaagggucugccuguucuucgauauuuauaaauauuuaaaaauuggugucgagagaggaguuagguacugggcaagguggcucacaccuuuaaucccagcacuuugggaggccaaggcaggaggaucgcuugaggccaggaggucaaggcugcagugagcuauguuugagccacugcgcuccagccugggugacugagagaccccaacucaaacaaacagaaaagggccagacacagugguucaugccuauaaucccagcacuuugggggaccaaggcggaaggaucgcuugagcgcaggaguuagagaccagccuggguaacacagcaaaaccucaucucuacuaaaaauacaaaaauuagcugggcgugguggcgcacacuuggggucccagcuacucgggaggcugaggcaggaggauugcuggagccugggaggcggagguugcagugagcugagauugcgccacugcccugcagccugggugacagagccagacccugucucaaaacagaaacgaaacaaaaaaggcauuagagauuaacgaauaggaaaccaagauuuucugguugucuggaucggaagacauuuaaaacgggaauaauuuucguacgccuucucccacccaccgccucccauuuuuggaaacccucaggcacaggucucugagugacagccuaucuucugccaagacagacaggcucugaggccacgggagacaccaggaaauugcuuauugacggaccaaaggaaaguucuuuccuauuuuucauuuccccgucgcuuucucuguccgugcgauuguaagugugacacacggucagagugaaaauccacagaacggcaccuccgcguucugcuuuaagaggaaaccccgggagaaccuggcgcaugggucauuuccuccgggugcgugucugggaguggaauugcugggucccuggaugcuuuuucacauugaaagcgucccuugugaccgggcgcgguggcucaggccuguaaucccagcacuugggaggccaaggcaagaggaguaccugggacuagguguucgagaccagccuggccaacguggugacagcacggccugucucauuuaauaggugacaaagaucguguccuuucaccugccacuuguuuaauagagggcgguggucuucucggaaggggauugacccugugaauggcucucuggugaauuuucuguuacucucuugggcccucguccuugaaguugauccacuuuuuauucugaagucuuucgggauucacaggaaguggcagaguguucuccucucaccuagccacccccagggguaccgucccgcccacccguggugcugcgucagaccuaggaagccgacauuggugccguccacagauccugaucagauuccaccggcuuuacacgcacgugugugugucugugugugcgugcgggugugugucugugcgugugcgcgucugugcgugugcgugcgugugugcgcacgugugugugcgucugcgcgugcgugucugugcgucugcgcgugugugcgugucugcgucugugucugcgugcguguguguacgcgugcguguguguguguguguguguguguguguguguguguaguucugugcaguuuugagacaugcaccuucuuuaagcccaggaaucaccaaucuguucuucaucuguacgauuuuuuuuuuuuagggaccaggucucacucuguuguccagacuggagugcaguggugugaucauaacugacuguagccuugaaguucugggcucaacugauccucccaccucagccuugugagcagcugcgaccaccuaauuaaaaaaauauguauuuuguagagggcugggucagcggcucacacugguaauccccagcacuuugggagguugagaugggagaauugccggagcccaggaguucaagaccagccugggcaacauggagaaacccugucucuguuuaaaaaaaaagaaaaauuucagcugggugcgguggcucacaccuauaaucccagcauuuugggaagccaggguguguggaucacaugaggccaggaguucaagaccagccuagucaacguggcgaaaccccgucucugcuaaaaauacaaaaauuagcugggcgugguggugcgugccugucaucccagcuacucgggaggcugagacacgaaaagcacuugaaccugggaggcggagguugcaguuagcugagauugcgccacugcacucuggccucggggacagagggagaccgugucugaagaauaaaaaaauauugucuagauggggucuugcuguguucuccaggcugaucuuguauucaugagcucaagugauccucuuaccucagccucccagagugcugugauuacaugugugagccacugugcccagcccaauuuuucacuuugaguauuuuguguaaauggaauccuauaguuugcaaccuucugagauuagcuuuuauucuguuacguuagcauaauucccuggagauccagccaagcuguuggcuguaucuuuuuuuuuucuuuuuauugcugccucauuaacuuuuuuuuuuuuuuugagaccgaguuuugcucuuguugcccaggcuggagugcaguggcacgaucucagcucacugcaaccuccgccuccgccuccgccuccugaguucaaacgauucuccugcuucagccuccugaguagcugggaauauaggugccugccaccaugccuggcuaauuuuuuguaguuuuaguagagacaugguuucgccacguuggccaggcuggucucaaacuccugaccuccagugauccacccaccucggccucccaaagugcugggauuacaggcgugaaccaccgcgccuggccgccucauuaacuuuuuaacaacaucaguaauacaacaauuuacaucacuuuuuuuuuuuuuuugagacggagucaugcucugucacccaggcuggggugcaguggcgugaucucagcucacugcaagcuccgccucccagguucacgccauucuccugccuagccucccuaguagcugggacuacaggugccggcuaaguuuuuguauuuuuaguagagacgggguuucaccuuguuagccaggauggucuccaucuccugaccuugugauccgcccgccucggccucccgaagugcugggauuacaggugugagccacugcuuacaucaguguuucuugagcacugugcauuggacacaaagcuuggcuuauucacugggaauucucaguucuaacagguuagcgaaauagguguaauuauuaccguauuuuacugguaaagaagcugaaacuuagagaguuuaguaaccauugcgcuaauuuuuuguauuuuuaguagaggcaggguuucaccguguuagccaggacagucucggucuccugaccuggugauccucccgccucggccucccaaagugcugggauuacaggcaugagccaccgagcccggccucauuuggcuguuugauaauguuuguaggcgccugucuguccacccgugccaaaagugcugggauuccaggccugacccucugcgccuggccccguucggcucuuugauaacguuuggaggcgccugucuuuccaccugcgcagggaggcugagggcgccgcgguccucaaugcgccaacuuuuaggugguuucuuuguucuugacucggcugcccugugcauuuucucucucucguugauuuuucuucuggagaaucugcuucauuggcaaaucgauauugaucaauugaucaauuuuccucuuuaucggcauuucuucucuuucuaaaguuuuuggugacuuucagaucacaggccccuuuugcugacuucugcccucuucuguuccaucagugugguguugaggguuccaccccgugaaccccaucccauugguuuccauaaugcauguuuuucucauauuacugacauuuguuccuuuuuuuuuuuuuuuuuuuuuuuccuaauuuccucuucaggucagguugcuucagagguuucugaguuccaaguuggagguccuuucuugauuucuagaucuccagugccaaaacucagcuuuggcuuaaacgguagcuacuguuuggaggacgcagagcuccucugccgaggcugaaacauggauuauuuuuguccuucuuugugaguacuugagggauaguuggauguggagcugcgaggccuuugaaccauauuuagauuuuuaaucuguuuaaugucaggcugagagcagcgccaucccccucuguucuguuugucgguuucucuguugacguauuuagaugccaggauugugggcuugugugggcugagacagugggauuucguugugggucgagccauugucaacaacaaaaaaauccguuccuuggcugguggugguggcucaugccuguaaucccagcacuuugggaggccaaggcagguggaucuucugaggucaggaguucaagaccagccuggcccacagggcgaaacuccaucucuacuaaaauauaaaaaauuagccaggcaugguagcaggugccugcaaucccagcugcucgggaggcugaggcaggagaaucacuugaaccugggaggcagagguugcagugagcugagaucgcgccaccgcacuccacccugggcgacacagcgagacucugucucagaaaaagaaaccucccuugaauugaaacuucgauaugaagguugcaacccuuccuuuuuguugguguggcuuggcagaucuuugugcuccugguuguaucuccugagucgcuuguuucaaaacugucuuuggucggcaccguguuuucagauuaaagacguuaagcacccguccaucuucguucucagcuuuuccuuccaucgucuuauuuuguuuuuccaucugugugcucccaacuccggauugcuucccccgguguguguuuucugaagcucuguaccgcuuugcggcucugccagugguucuuuucuaguuuugaauaacacguuuaaggccgugauugaauagcgguuaguauucugcguugugaagaacacguuuaaacacgccguuucucgcgcucucaacguccgaagugaaaucgcaucugcccccuucugugagaaggugaaaauugagccuguauauuucucuucccugcugguauuugcuaccaauaaauugcuacuuuuaaaaaacauuguccgaggccagcggaucaugaggucaggagaucgagaccauccugguuaacacggugaaaugccguaucuguuaaaaauacaaaaaaauuagccgggcgcgguggugggcgccuguaguccagccugggcgacagagccagacucagucucaaacaaacaaacaaaaaaaacaaaaaaacauuguaucuguucauaauuguguauuugcaucuuacuaggaaacauuuguaucauuaaauagugacuuugcuacuuacugugagggcuugagcaaauggcaucuaucuuuugcgucaguuuccuuaucuguaggguagggguaauguagccacugcaaggauucagugaaaugagagagaacucacaaagugcccccagagggcuuuccuugugugccugucuuguuacggcuucuaggaaucucuugauucguaauuaaaugugcucacugucuacuucauuccauagaacccccaggcucugccauuucuuugaggauccauggggcuuacaggcuuaagacagucuucucguuuuuuaggguaaaucauugaacuucuugaacuucauccuuuuuguuccauguuggguucccucuugugucucuuuuucuuuuucuuuuuuuuuugagguggagucucgcucuauugcccaggcuggagugcaguggcacgaucucggcucacugcaagcucugccucccggguucgcgccauucuccugccucagccucccgaguagcugguacuacaggugcccaccaccacgcccagcuaauuuuuguauuuuuaguagagacggggguuucacccuguuggccagcauggucuugauuucuggaccucgugauccgcccgccuuggccucccaaagugcugggauuacaggcgugagccaccgugcccggccccggguugguuucugagcuuguuuugaggggcagguucuccgguccccacacucaggugucacuggugaugcccauagacauggaagcaagagcgggauggggucucgguuaucucuguggucacugaaauucaaagcggggcccuguuucucugaguuguuacuuaacaucugugcucgaugcccacucucggggccagcucugcccuccagggaaaccccagggccuugggggagcgggguugcaaggcgccccugcuucugggggagaagguugucccugguucugguggaggagguuguccucgguucugguagaggagguugccaggcauccccgguucugguggaggagguugccaggcguccucgguucugguggaggagguugccaggcguccucgguucugguggaggagguugcgaggcgccccugguucugggggaggagcuugucccugguucugguggaggagguuguccccgcuucugguggaggagguugccaguuguccccgguucuggcggaggagguugucccccgugcugguggaggagguugcgaggcguccccgguucuggcggaggagguugccuguguugcccgcacagccucacugugccucuacccgagggcacguccugccacuuuaggugcuguggggacccccacucuuagggugguguguggucuccacucacauucucuucagccucagguuugucugcucgcgggcgggccacagggcccugcugucccaccccccaucgccagacauuagaggcagaucgaagugggaggcuuugcgggaucucgucagccccccaacaaggaagggcucuguggugccccagaagcauuuucucccccacucgggauccuccucagaagcugggagcaugugcuacacagccugcgggcccugaccaagaagacacgacaggaagauaaacccagggcggcugcagugcgcgagcugggccgagggcauccuggucuuucaucuucucccauagcuugaauuuagauaaaauggaggcugugcacgccugugaccccagggcuuugggaaauacaaggugggaggagcgccugaguccaggaguuugagaccagccugggcaauguagugagaccccaucucuacaaaaaaauuuuuuuaaauucaccaggcguuguggcucaugccuguaaucccagcacuuugggagucugaggcagacggaucacuugaggucugggauucaagaccagccuggccaacauguaugaaaccccgucucuacuaaaaauacaaaaauuagcugugcgugguggcaggcuccuguagucccagcuacgugggaggcugaggcgggaaaaucacuugaacccaggaggcggagguugcagugagccaagaucgcaccacugcacuccagccugggcaacaagacccugucucaaagcaaaagaaaaaaaaaauuuuuuaaaauacugcuccacccaaggaaaggccacccccggauucaaaccucugucugaucucacccgucaugacccccagaggggcugggaaugggucugagaagcaucacaagcugcaggggccagacccaggcagggcggugggacaggcugccaucgggguccuucacgauuuuaauuauaaggaggaagaagagacggggcgaggcacgggcuuggggggucauagugacccuguaucggguggcccgcuccuacucccgaguaaacggaaccugcgugaggagcugucgagguguuaauugguuuuuagacgugaccgugguauuuggugguggcuguuauuucauuugcuuuuggggacuggguuguucaguacagcaggcauuagccauauacacauuuuuaaauguaauuuuuaaugugcuugaaaaaaugcuggccacguuuccagcaguugguagugugguccccguauuggacagcagagguggagaauauuuugauccuccaggaaaauguucuuggaagcacaguuauuuaugaguaaaaugaagacguugaggguggguguuuugggggcgucagcuguguuccaggcagugcugcagacaaagaggggucccaggcugggaaggggcucaggcagggggugugggugggggucaccuccuguguuggggaagaggagaguggugagaucaggaaagaguuuggucuuuauccugaggacgguggggagccaugagagaggguagagggagggagaagagccaaguuuugcuucuaaaggcuccauccggcugccugaggaugucagcagacuuggaaggaagcugcugcagggacugggcuuaacccgcugcuguagcuauggggcaagcugcuguucuuugggaggagggaaggugaggaggacucccaggacuuuagccugagcaccugagugggggcacauugcagagcuggggcuauaggaugaaguccccaggcccaucugaagccagaccaccugguggugugccugaggguuuggcaggggcgguacacagggcuguguucagggcccguguccaccaauaguuuugccugcccggcaugguaaccccacuccugguacugaagucugucgauuggguuucuugugcagaggcagcugaaggcacuuggacagucuuuuucuguaucaaggucagccagccuucuccggaaaggaccaaggagugaauauuguuggcugugcaggacagauggucucuauuggaauugauucaacucuacuguugcagcaaaagcagccguugauaguacauggacaaacgggcauagugugugccaauaaaacuuuauuuaaaaagcagcuuaggggccagacuugguccuuguguacuguuugcagaucccugcugcagaccaaucucaguccuacccgguauuuacuaagcgccuuuugaagccucccucucccauuugccaacgagccaccaggcaaagaccaguccccggucccucucaggaggggacccaacagggaccgggacugggaaaccaccagccuggagcauuccuuggcuacggauggccucucugaagcagcaucuuucauuguuauccucacggcagcccaggcaggugggcggcuuccacaccccgugacuggaauuggaacugaagcccaaggggugggccgcuccuggggcccucuccccagcgccccugcgccguccacucgcaggccucucccgaggcagccaggcuggcccagggcaggaaggugcccuucccggguaaaacucugcggugcuucaccaaagaaaucacagaaaaccacacucugacagcagugucuuauucuauuaguacauuuuaauuagaacaggagcaauggaugcauuaugaauauucaugguggguuauuaaaaugcaucauuaaucggugggggggauuuuaauaacuguauuaaugugggggcuguccuuauuuuugucauuucuaggaggaggccaaggcugggugagggaggguucccccaaagggcagauugaggccgcagugccucuggcacaggccuguuggagugaacuucgggggcgaucccugggcauggggccccaggaggucccccaccacaccaggccuuccaggggaugagggcuggggugccaggagccucccguuugcucaguugggggucucugcaccuccugggguacuggcuauggccggaggggaccagacaacaugcaggugguauagaggcaaacugagacccagagggugccggcgcugugcccaccccuacacagccagcccacccuggccucagcagcugcccuguucaccagggcccacgugcaggaccaggaucuuggggugcagauggcccagaccuggcagcgaaugccguguggauuccuggagaccacaggagcccccugccuggcccccaacccagccaaggcagcaucccagccccccacucauaaucacauuggaaauuuuugauuagaaaacaaaaucuaaaugaggcgcaugaauauucauuagacuuggagauuaauaugcauaauuaugcaaaucagacagcaauuaaacaccaauacuccccggggggaaugauuaacacaaaggcaccgaaauagaaggaugcgauuugaaagaaguuucugguguggaugagcagggagggcagggggcggggcgggggagccugcagaacagccugagguggugccggucacagacaucagcacugggcugggucccccaggccuggcucucgggaagccucuggacuugggaguuggacauggacacccccagcccugcaaaaguagggccuguuuguaaaucauuuauagagagggaaaccaaggcagggcagcaacuccguggccaagcugaggaggcccagggcccgcuccugcuucuccacgggugugcucuguggcccccgauggaagggggaaggauccaagcaggcccucccugcccagggcagaagauucuggaguccugggcguugccugugaguguucugagagauaagggccccgcccgccccgccccgggaccaagguccucgucccgucccuugcugcgccgggaacuccugccccacgcaggcuucuggucuccacacugggcuuguuccugggugaugagauucggcuccacccucacgggcugccagccuccugcccgaugggugagccucugcugcugcuucagcaaagggcggccccacuucccacacuggcagguggggacagggagacccugggccuccccagagcucauggguuagcuuccacacccucaugcugucaugagccuuucucacagggucagaagagucugcaucugacacagagaccccaguccacauagucagggcugggccagagggagggacuuggggcugauggggaggaggcucggcgugagagugaggucuuugcccaaggaggguaugaaagcuggggcuuuaguggguggguaggaguuggccagcagagagccgacggaagaguuaauuuaaguuuauggaccuguaagugcuccgagucccagggugucuggguguuagcugcugacugguguccucaugagucgggcugggugaggcuggguuaggaaggguuccacaagccccccggguccacugagguuugccccugagaugaugaaccgaagcuuuuagagcugggcaggcgugagggugacccauaacucucucuguccugccugcaggucuugaggaccggcccagcucaggcuccuggggcagcggcgaccagagcagcuccuccuuugaccccagccggguaggaguccccgugaggccugagacccugaguuuccuguccccagaguugggggcgagggguguggggaaacugaggcugagagaaggggccagccuuccagggguuuggacugggggacauggguuugaguccugccucuccagcuguaaugcgggguggagggggggccugugaagccccagcaccucucauccccaccccaucuccccuagaccuucagcgagggcacccacuucacugagucgcacagcagccucucuucauccacauuccugggaccgggacucggaggugagugccuggccuggugcggucccucugcugugcacagaugugcagacgugggccuuggcauggucagugcacgcacagcgccaggcaaguccccagcguucacccagaggguguggacagccgaagccucugcccguccugggagcagcugcggggaggugcaggggacguggcccggacucccuggcacggcacucugcaacuaggcuuccccgccugagcguagaggcagggaggccguuccagaccccacuuccucccugggauuucugcagggcuccuccugcuucccggggaggggucagccgggcuggccugugcccgcugggaaggaggcguaggaguucuggagacucgggagggcggccagagugugcgguggucagagcccaugcccuuccgcagaccgcccgcccgcccucuuucccuggggggcccuccuguuaaccgagagaaucgugacucagguugggcucgguggcucacgccuguaauaccagcacuuugggagagcgagguggguggaucaccugaggucaggaguuugagaccagccuggccaacauggugaaaccccgcuucuaccaaaaacacaaaaauuagccggucaugguguuggaugcuuauagugccaacuacucaggaggcugaggcaggagaauugcuugaacccaggagguggaggcugcagugagccgagaucacgccauugcccuccagccugggugauggagcgagauuccaucuuaaaaaaaaaaaaagaaugaagacucaggccuggugucuggucccaccccaccacggaaccugggcaagcgccauccucuucugagccucaguuuccccacugugggaaagggacccucccagaaccuucuuggagggaggcggugaggacugacccagcucugcaggcccugcccaaugccagguggggguuggugccuggucuuggguauauuccagccccgcugcaggcucacccgugcugcaggggaacgaaccgacgcuugggaagggcacccuggccgggggucugcggcuggguggggcugacugggacgcccuccuccaggcaccuggggcugcgacugggacagugucccgugugcggucccuccugcgggugacacaggaaaugccccgagcuucacaugcuccgccuccugcgggagugucaaguccugugccccaggguucgggggcucagguaggggucuugggggggucccgcugcuuggggggcugguaagggccucaggggucccgcugucguggucagccuccugccccagugccucagcuguggaauuugugguuucaucccucagucauccugggaugcgggauccuucccuucucuggaacccgacgguuugaggcaguguuucugcuggcuuuucguggugcagugggggugugcgcugcuuagaagccgggagcuguggggcacuggaccugcugcggggcccaggugcucaccguguaccccucggcauuguuggcuugcggggaaacugaggcccggaggacuuuggccgacccagccuuuucccuggacccugaggggcagcgccuguuugggccccacagcggggcagggacgguccugucucgcuuugcccggccucgaacuuggaguacaguagagucaguugguguccugaguaggaagcgaauagcgugaaggucuggcgggugugucugagggcccaccacgugccacgggcgauuucugcccguuccccuuacgggguaggugaggccuggccccgccccccugccggggguggccccugcaccugggagccugguuccucacuggcuguuccuuccucccagccucuuccucauacccccgauggccccagggugggcagggcugacgugggcaguucccacggcccggccagcaaugcccagagcccagccaugucccaccugccacccccacggguggggcccaggccauagccaggcagcuuggagagggcaggcgggggucccggggaggcacggggggcuuuugccauaaccucagucuccuauggccucaguuuucucacccgaggagccgggcgagugacugcuguggccggguguggccuguggggugggucguggcugucaucuuccccauguccccccgggucaccaagaugaggaaacgggaggcaaaaaacagcagcauuuguuccaggaguugggaaaucguugaacuuuuaaaauucaaaaaucgggaaauuuuuuuccugcuuugagaauaauguacauuacucgaucgcgcgucccagccccucacagcagccccagucacauuccgugcccagugucagccagaaggggauuuaaguggcucagguccugaguaaucggggugccugcuucaggcaaggcuggauccaggugucaccgcaucagccccaggcccuccacacugggggcucgccccggcaggcuguccuccuccguagcccaggcccuccaugcugggggcucgccuuggccagcuguuccccuccguagcccaggccuuccaugcugggggcucgcccuggccagcugacccccuccguagccccgaggccucaccuguccuuugucacugagcgccccagggaagugcucauugguggggugcaggucacgugcucauucgcgaaugaacccuggccugaaggcugaaugcugggcacuuugggggagccugugcggugaaccugaugcggugugcacaggccccggggcuccccgccagggcccccaggccuguccccugggacagacaaaugccucugaccccagcaccccagggcaucagccccucaacgccugaaacagaggaaacugaggcucaggaagggcaggggccuggccagcaggaagcagggccacugugagcucugcuguccccuucccgccucaccccgugagcucugcuguccccuucccgccucaccccgugagcucugcuguccccuucccgccucaccccgugagcucugcuguccccuucccgccucacccccgugagcucugcuguccccuucccgccucacccccugugagcucugcuguccccuucccgccucaccccgugagcucugcuguccccuucccgccucaccccgugaguucugcuguccccuucccgccucaccccgugagcucugcuguccccuucccgccucaccccgugagcucugcuguccccuucccgccucaccccgugaguucugcuguccccuucccgccucauccccugugagcucugcuguccccuucccgccucacccccugugagcucugcuguccccuucccgccucauccccugugagcucugcuguccccuuuccgccucacccccugugagcucugcuguccccuucccgccucaccccgugaguucugcuguccccuucccgccucacccccugugagcucugcuguccccuuccugccccacccccgugagcucugcuguccccuucccgccucacccccgugagcucugcuguccccuucccgccucacccccugugagcucugcuguccccuucccgccucauccccugugagcucugcuguccccuuuccgccucacccccugugagcucugcuguccccuucccgccucaccccgugaguucugcuguccccuucccgccucacccccugugagcucugcuguccccuucccgccucauccccugugagcucugcuguccccuucccgccucaccccgugagcucugcuguccccuucccgccucacccccgugagcucugcuguccccuucccgccucacccccugugagcucugcuguccccuucccgccucaccccgugagcucugcuguccccuucccgccucaccccgugaguucugcuguccccuucccgccucauccccugugagcucugcuguccccuucccgccucacccccgugagcucugcuguccccuucccgccucacccccugugagcucugcuguccccuucccgccucacccccugugagcucugcuguccccuucccgccucaccccgugagcucugcuguccccuucccgccucauccccugugagcucugcuguccccuucccgccucacccccugugagcucugcuguccccuucccgccucacccccugugagcucugcuguccccuucccgccucacccccugugagcucugcuguccccuucccgccucacccccugugagcucugcuguccccuucccaccucaccccgugagcucugcuguccccuuuccgccccacccccugggcagggcuucugugggcugcagaugcucagaguuggccccgaaaucaucggggaccccuucuuguccccaagccugucauugggcaggagaugggcacacugagggcagggcucugcgggagaugggcauacuggggccagggcuccccgagaugggcacacuggggucaggcucugccagcauccugccguggcgcucucagucgugugcacuuacugagagccuauuguaggcacauggcaggcacucgggggcccucaggauguuccuuggggucgccucccacuaaccuuccuucuccccuugcaggcaagagcggugagcggggcgccuaugccuccuucgggagagacgcaggcgugggcggccugacucaggugaggggcucgggccgggcugggguguauuuugauuuuaaacaaaucugucacccacccucucugaucugcagaagcucuccuggcuuagcuagguuauguuugcuuccugauagcgaaaccaggcugggcuugggccagggugggcuggguggguguggaccgggagcagaggggagguaggugaggaccagggaggccaaggccugcagggcugccaugcuuagcuggaggggcucgguugcccucuccucugaguggcaggcaggaaaacaggccaugcagcagggcuuugcagguguggacccccuggggagcccauacaacaggccccugugcagccgagauccucacccacgcuggcccugguugugaggcugggggaggauguugggggcugugaccagccacaggggucccaugcagccuccggugcugggcacccccaggguuccucccucaccccaggacuucaucucuguccccgccgucagcuccuagcucucgguggggcucggccuugucacagguggggccgucugugugcucacugugcccaagccagagcaacaguagccauagugauggagggggccagccgggugccaggcucugcgccaggggcagaugcgcguuucccuaucaguccccgcaacgaggggccgcggccuacgugcccauuuuacagacaggaauacgcaagugcccgggcuccccauccgagaagcagaacuagggcucgggcccugcucucuggcgcucccgggugacucaucgagccccgcgguggccacacagggugcgggcucaggacaggccgggccucgggagaaggcccuguccugggcgcugggccaccccguggggccacuggaugaugauagaacagaugauucuuuuuuuuuuuuuugagacggaguuucgcucauggcccaggcuggaguucaauggcgcaaucuuggcucaccgcaaccucugucuccuggguucaagcgauucuccugccucagccuuuugaguagcugggauuacaggcaugugccaccauacccggcuaauuuuguauucuuuguagagacggaguuucuccauguuggucaggcuggucuugaacucccgaccucaggugauccgcccgccucagccucccaaaguacugggauaauaggugugagccaccgugcccggccuuagaacggaugaaaugcaggagucaguuccgggacccggcucagggcagcccuggcuccccaggaagaaagcccguuucacacuaacauguacagaauccaaccgagggcuuuacaaaacaaaaccaaaaagauaggaagcagccgggugcacagacgcuuagccacgcagcuuuguacuuugcgucucagaaucgggggagcagccccuuggguuggccacacugguaucuguuucucagucuuucguucuucgugaaaacagcagugugggaugcggucagucucaagucagaaaaacacagcaggugucacagagaaacaccgugacaggcagaaggggcaucacccacugcagggcgggucugaguggcuucggccuuugcaguuuuuucuugaauggaacagccuggggucuggaugccagcugggcgcuuucugaccauccgcuccccaccaggcuggcuuccugucaggcgagcuggcccucaacagccccgggccccuguccccuucgggcaugaaggggaccucccaguacuaccccuccuacuccggcagcucccggcggagagcggcagacggcagccuaggugagcggggucuggccggggcaucgggggcuucugggagggagccugcaaagggagguaggaggcuucccguuagcugagggcaccagagggagcagaccccgcaccuuccagguccuggcuggacgucgggcgcucgggccgugggagggauggacggugacggggggucgaggcaggggccggcgggcguggcacguccagggagagguuccuacgagccucuggucccgagguuccugcagcugacgggcacgggcucugccaugugcuuucugugucagaugccucauggggcugcaucguggcuccucugcacugagcccugcugcacacgcgggcaucccccgcgaggcacgucacagccucgggcucaggagcacuggacggcgccuugaacuacccggggcccauuccaggcagcacagucgccaggcauggcggcacucaccuggggucccagcuucucuggaggccgagacaggaggaucacuugaggccaaaaguugcaaaccauucugggcaacauagggagaucccaucuuugcgaaaaauuuuaaaaauuagcuaaguaugguggcacacaccuguggucccagcuacucaggaggcugaggcaggaggaugguuugacccugggaguucgaggcugcaaugagcugcgaucgcaccauuguacuccagccugagcaacagcgcaagacccugccugaaaaaaauaagcgugaaaucacccacaaaaagcacaaaaacguaaaagaucguggcucugaauagaccaaggacaggagccccaugaugcgggaggaggccucuguuccgccuuggcugggcacaugcgccugggccacucgaacuuuucccacugugcgcacguccgugagugaucaggaaggcgccugagugcugguuuccggguuacggauuuuauccuguaggcgaguuugcaaacagcagccccuaguggugaagccugacugcgugggauagucggggccaucuuggaaggaggguggggccaaggggcuucucagcagagccuuggcuuagaauccaccaacuccucguuuuccaaacugcgcgucgcgggagaaaaccaucgugguucuucgacaucuuuggagccguauaaauagacccggggcuuuuuguuguuguugcugcugcugcuguuguguuuugagacggagucuuucucuguccccaggcuggagugcagugacacgaucucggcucacugcagccucugccucccggguucaagugauucuccugccucggccucccgaguagcuggaauuauaggcacccgccaccacgcccggcuacuuuuuguauuuucaguagagacgggguuucacuguguuggccaggauggucuugaucucuugaccucgugaucugccugccuuggccucccaaaguccugguauuacaggcaugaggcaccgcacccagccgacccgagguuuuuaauauaugaaacgggaauugugagggucucuccuccaggguguagggcagggguuguucucauggccgguggccgguucucaccccuuuugcuucuaacagacacgcagcccaagaagguccggaaggucccgccgggucuuccauccucggugagucgcacgagggagaagggaccccacagcucgucaguggcagugccaggcccuguguccuggcgaagcuugggaacacacauggcggggugggcccugaguggacaggcccccugugauuucugagccaagaucugagcucugacccgaggccgccuccaagggaaggcggggaaguccuucccuagguccagccucugucugucuuguuuugagagaaaggcaguccugguggcugaggccccuuuagaaagggcacaauugugcugggugugguggcucaugccugucaucccagcgcuuugggaggccgagguggguggaucaccugaggucaggaguucuagaucagccuagucaacauggugaaaccccaucucuacuaaaaauacaaaaaucagccgggcgugguggugcgugccuguaaucccagcuacuugggaggcugaggcagaagaaucguuugaacccaggaggcggagguugcagugagccaagaucaugccgcugcccuccagccugagcaacagagugagacucugucucaaaaaaaaaaaaaaaaaaagcggggggugccgcaauuggggcucccuguuacauccucacagcuucaggcugccccgcaucccugccucccuaccaggccucgcagaugguccaggcugcugugccacacuccugcggucucaucucgcuggagggagagggaauuugccgauucccuggcucaguagccaccaaccacccucugcccagugccugugcuggccccaagagcccugggcauacaucuccucaccccuccagccgaccagcuccccacaggccuggguucgggguuagagucagguugacuucccaggccaaaggcguggucaggcucugcucccaacaguaucacucacuccccuccuuccccagggugcacuuucucugcccugaaaccgccccccaguuuauuacaacaucaggcccacccagcauacuucccgcuccagcacagcagcagacguuaccaacaggccccagccccacaguccaggcagugccaaccagucagagcuggcgcuacucacagaccccucuuccuguuacuuuagugaaggacgaauguugcucugggaccaagggaagcucagcacuggaagauugauuccagcuggggaacaagggagaaggaugggaugggguguuggagcugggguuuugaugggucgauaggaguuuucuggauuaaggaggaaaaagguuuaguaggcagagccagauccaaguccucaaguacaaaggucagaaguucagggaggcgggaggugggggcuggaaaaggaguaggagagagagaccaggacaucauaagaaccucaaacuuggccaggggcugggauuuaccuaaagggggguggcuuuacagggaagggaaacggggugguagaugugcuaccaggaggggacaggaggccggcaaggugcaugggcugaucguggucccuccguccugacugcaccccccaccgcccacccgcccgcagguguacccacccagcucaggugaggacuacggcagggaugccaccgccuacccguccgccaagacccccagcagcaccuaucccgcccccuucuacguggcagguacauggcagggcgggggcucgccagggacgguagggcagggcugggguuccccacucggcccccaccuuaccagcuccccuccacagauggcagccugcaccccucagccgagcucuggagucccccgggccaggcgggcuucgggcccaugcugggugggggcucauccccgcugccccucccgcccgguagcggcccggugggcagcaguggaagcagcagcacguuugguggccugcaccagcacgagcguaugguaggacccagggcagggggcagggggugggcggaggguggcagugcccaucuaacccacccuccuccugccugaccccccagggcuaccagcugcauggagcagaggugaacggugggcucccaucugcauccuccuucuccucagcccccggagccacguacggcggcgucuccagccacacgccgccugucagcggggccgacagccuccuggguauggccccucccugggaugcggccucuccgaggggacacugggcuccaggcagggucugggugggggguggcgaggacuccacgggaggcgcaggcgcgucugcuggcccugagagcggguuguugucaguucucauuguccgcugucugcagggccugccacgugcguugggcuugggaugucuggaaacagaucuuugaggagcggcuuucccgccuuacagcugggaaagaggcucagagagggacucacccacccagggucagagagggacucacccacccagggucagagagggacucacccacccaggcccagagagggacucacccacccaggcccagagagggacucaguuacccaggcccagagagggacucacccauccaggcccagagggggacucacccacccaggcccagaaggggacucacccacccaggguccccugccaguggccuguccccagugccucaaccccugcagaggcugguuucagggggucagacagaaaccggacccgagucaggcugcucucccuggcgcagcagugucugugcaggacggcagaacgcaggagagcuugccgucggcggcagcacccaggccgggcugcgugggccucaccucucuucacccacaggcucccgagggaccacagcuggcagcuccggggaugcccucggcaaagcacuggccucggugaggcguggggcaugggggguggccaggcaagugaccugagaggccggccccugaccgcccaucucuccugguccuccucgcagaucuacuccccggaucacucaagcaauaacuucucguccagcccuucuacccccgugggcuccccccagggccuggcaggucugugaggguuuuggggggaggggaggcugaggucugugaggguuuggggggaggggaggcugaggucugugaaggcuuugcgggggaggggaggcugguucuggugucugcaccuugcugggauaggcaggcagcggggagggagcagauggcccccaagggcccguggcaucgcuggucaggaaccgacgguggaagggagucccccaugggcuuguguuccacugggcaauccaggaaagcugccuaguggaggcagccuccaagccagcccuccaaggcuauagcacauaaccaggcagugagggagggcugggagguggcguccagguuaggucacagcacaggcaaagccaggaggcaggaccuggcaguucacacugcgugaacaugaggggacauuggcgugccuagcagcucccagguccgauggggccagcaucgccagggcuguggccuggacucuagaaugugugcguguugccauuugcucacccacuggguauuuauuagguacugacuguuuacccugugcggugcuccggcaugggagggcagacccuccuaucccugugaggacgugcuugcuuauccgcagggggucgggggcagguacaggaggagggggagugagaacuggagguuuccagaaggucuggguguuuaaaaacacccgugaguccucaucucugcccccaugggaagcgccaggaacccucacuucaccucggccugucuggucccaccuggagcuugccacuuucuugccugcugcuggagcccagcgugggucagccaggguggggcagcauggggaggagcccccuacugugugcugccgagccacuuuauccucugaguggggaguuggauuuuguagauggggaaacugaggcucagagauaggaauggcaguacccacugggcacccagcaucccugccuggcggggccgagcagcuuugcaucaguguggggugccccggaauggccaucuugggcaucaccggaggcuggacaggcggggugguucaugaaucccuccccaugggcaucaggccaugcucacaccccgccccucgcaccccauucacguccccacucccuuccaggaacgucacaguggccucgagcaggagcccccggugccuuaucgcccagcuacgacgggggucuccacggccuggugagugccugccccgccccaccccacccuuccccgacagaauuugcaggacagacgcuccuugagaaggagaaaccuuuuuguuaguuucuuguaaauaagccccaagcuguuauugaggccucguggccgccaaggcacacacauuuugugugugcucccgggcgccagaugccuggcauaugcagcuuccuggggaaggggaagaugggaccaccggccacuugcaugcggaagggacaugaauggaggccuguggggucccucggcuugggccccucaccacccauccccccacccugcagcagaguaagauagaagaccaccuggacgaggccauccacgugcuccgcagccacgccgugggcacagccggcgacaugcacacgcugcugccuggccacggggcgcuggccucagguuucaccggccccaugucacugggcgggcggcacgcaggccuggugagcgcugggcgaggguggagcugggcagugggcggggacccggcucccccugaugcacccgucuccccacgccugcagguuggaggcagccaccccgaggacggccucgcaggcagcaccagccucaugcacaaccacgcggcccuccccagccagccaggcacccucccugaccugucucggccucccgacuccuacagugguaagcccuugagcuugggacuguccgacuccugguuccaguuggggaaacugaggcacucuaguggugggggucagggugggagcccagggcaggugucaccgugggggcaccuggugacaugggcgccccagucagcaacuucaggaggguggguaagaccggcggggccggcguuggcccugggcgugugagguggacagcucugggcugccucuucauucgccugcucccagacgcugugugccuggcagcgcucagcacuggggaaggggcgaggggugcagcaggaugccucugccucaggggagacagaccaggagcucgcugcacaguacaggugccagggagaaggaacgaaguggcugcgguggguuggggguuuuguauggcuuugaagaugguggcccaugaggccacaaggugguguuugggcagcaucugggaggaggcaagaguaggcaaguaccuggaggaggaggguuucaggcagagggcgcagcccaggcaaaggcccuggggcuggacugcaccugggaggaacagccaggagacccgugggguuggagcagagugaggagagggagagagggaaggggggagggcggggcagggcaggucaugcggggccuugugggcugcggggaggacuugggauuuggccaugagaaagguggcagccguggagggcugaggagggaugggaccugacccaggugcucacagauacccucugguggcugcuuggaggacagacuaugaguggcaccgggagaccaaggcagaggccacagggcugguccaggggccuuggaggggugagcagugggugggcccugcaucuccugaaggcggggcccacaggauuugugauggacaggacuugagggugagagaaggcaggguggcucugggauuucuggcccgagcugugggugacacuggggcugggaacuccguaaggaaggggacaaaggaaaagguuggggacaaaucuggaccugggccuggggauuguugagugucucagacacccaugagaggcccaggagaagguggggucauugugggcgcuguccuggcccugugccuuccaccagcccaggaauccugccugcuuuccaggcagacuuuccaaguaccuugauucuaucacuccuaggccagggcaucucaccgcagcggcucugcccccaggggacacugggugaugucuggggacaucuacaguugucagggcugaggggagcuccuggcauggagugggugggggccagggaugcugcucagcacccugcagugcccaggacggccccaccccagagaaggguccggacccacaggucagcaguuuccaggggcagccccaagcuuagucuuucacccauaggcuccccucuguuuccuuccuguccuucacuucgugugcugaggccugggcugguccugguggcuggcguuggccgauuggagcagaguucacuguggggagcgggugcauuucugaggcucccccucaggguacgggggucucaggggauggcagcugguuugcuccaugugagcccugacugauuccuggacuccccaagcccggguuuuggggguggcccaggcccugcugaaugcagaguggccgcauucauuuggggcacuguguacccuuaagccacauguuuugcaauuauuguucuugagcuucaugaacacggcgucccacuagcguguucuuuacacgcugguuugcuggcuuauguugugugugggguacauguguggugugagcggcuggggucccauugugagugugccguuggcccuggcccgggcguggggcuguaggucauuccaacaucacgcuuuccugccaaccugcugaucaagggugugauacaccuguugucaauucagaggaaaggcugaugaauuauuuuccaaagcagccaaguugcccucccacaggcaagauuuugacuguucaggucccucaacuuugcuagcugacuggguaugaaaggguagcgcaaagccacccuaauuugcauuuccuuaaucucuugaugugcugaagcggacuuccacguguuucuagccaugugguuuccuugucugugagaugccuuuuuggauaccuugcuuauuuuucuacugaguuacuuucuuuuuguccuuucccauugauugugggagaucaccuccugguuggcuacaucuguggugggugucuucuauucuuuggcaaaugcuuuucuuuuccugguaucuuugcugaucaggaacucucaauucugauauaguccagcuuacugauuuuuguuuuuucuuuuuuacuuguuuuguuuugagacagggucucacccugucacaccagagugcaggggcaugaucacagcucacgguagccaugacccccuggccucaagugacccuuccaccucagccucccaaagugcugggaucacaggcgugagucagccacugugcccggccuguguucuuucaaaagcagcgcuuugagcacuugcuuggacagcucuuggacuaaaaugagaaugauaaagauuagcauagcaucugcacaagggugacguggacauuccugaaguguuccaaaguuuuauucuuuuuuuuuuuuuugagacggagucuugcuuugucacccaggcuggaguacaguggcgcaaucuuggcucacugcaaccuccgccuccuggguucaagugauucuccugccucagccucccaaguagcugggauuacagguacccaccaccacagcuggcuaauuuuuuguauuuuuaguagagaugggguuucaccauguuagccaggauggucuugaucuccugaccucgugauccacccaccucggccucccaaaaugcuggcauuacaggugugagcuggugugagccacugugcccauccgaaguguuccauauuuuuaaguuaaugauugaaacaguuuacuuucaccaaaaaagaagaguguucuuuuagcaucuuaguagauuccugccauugaguugcugcagaauuucuacacacuuuguuccaaaggugguaaaacuguuucccuuucaucuugugguccuuaaucugucuggcauugguagcuacacauggcgugagguagggauccaguucugguuguugguuuuuuguuuuuauuuuuggccaagaccugguuuuuccaggaaagcccaagucccucaccacaggagcacaaagagauaugucaguuggcccuggaggccgacgcaggccccugacccuaggccuguugcagggcuagggcgagcaggugccacggcggccgccagcgagaucaagcgggaggagaaggaggacgaggagaacacgucagcggcugaccacucggaggaggagaagaaggagcugaaggccccccgggcccggaccaggugccaacccaccccucggcacuccccacccucaccccaucaggacgcacaugugcacaggccacacgcacaccgcacccacacugggaggccgucggcgggccccacgcucuucccccaaccucacugucucccucuggcccccucccggcgcccuccccauagcccagacgaggacgaggacgaccuucuccccccagagcagaaggccgagcgggagaaggagcgccggguggccaauaacgcccgggagcggcugcggguccgugacaucaacgaggccuuuaaggagcuggggcgcaugugccaacugcaccucaacagcgagaagccccagaccaaacugcucauccugcaccaggcugucucggucauccugaacuuggagcagcaagugcgaggucagugggggcgcgggccaccagcgucccugcagcgccacccucccucguguuccugcccucguucuccuuccccgcccgccuuccuggagccagcccucccucugcagcaguugccuccuugcagugacugugcccuucaccccucugaccgcauugccaugacuguccacuccugacugccagcccuucucccugccugccucagcauccccuccacagugggaggacuggacucuuucuggaccccuaguccuucaggccugggcucuguggcucagaacuguaucucccagcuccacggggcucccacucgccgugguccuccuuucuugggaagcccagaacccagcucacagaggccagugucccccgaucccagagacaggagcuggugugcaaaccacccuggccccuucccgucaggcagaugccacgcaaggccacaugagcccauccccugucucugacucaguuucccuaucugaaggugauagggaaacuuccuaucacccccauuucccagggccagggggaggaaggauacagacagacccuguccccacccgcagaugugagcugacuccuuccccccgcuggcgcuggcggcugcuuccuuaacuccuuccuuuccucgccugcaccccguuaacccuuucucuccugcagcacuguugcugggaccggagccagagccccggcccggcccacacgcuauccccucagcucuaagguuuccgagucucugcagccguguguggcacgccucgcgccccccaagcccgccucucugcugucugccuuccgcccuccccuccaucccgcccguccgucccucugcuucccguggcagccccuccucaccucgcacuugcugcccgagcaccgggagcggcugggcugcaaccucagggcguuuccucccccaaagccccccgucagggcuugcgggaagaaaccagacccgggagcacgcagccccugguccugucaguuuggucugugcgcuuguccugggcuccaggggccgcccccaccaccuggagggauccccucaggccccuaaggcagggugggcaggcaagugggugaggcagcccccuagagacuaagacagggcaccaggcaugcugggcacugggccagaccuucacccauuucaucuucaccacaaccuagagcagugggugcccugauggggaccggcauccauucuaccaaguaggaagccagggaacagagcgaggucacccaugcagggccaugcagcacagaggccugggccgggacccgcaccccugcggcagcagcaacagugcccgcucgccagcugcaugcugcucggcuggagagggggcucagccuugggccuggcacagaacaggcucuuggaaccucagagcuccuacugcgaccauucacgguggcagugacaaugggguuccuggaggccuagggagcuggccuucccagccaggggcaggagcucagggagggcucaucuuggggcagccggaguucacuguaggggacgggugcauuucugaggcuccuccccagggugugggggucucgggggaugggagcugguuugcuccaugugagcccugauuugaguccuggacuccccagucccggguuuuuggaguggcccagguauuugccugcugagcccgugucuucaaggccuccucuguccacagugagucuggccaggccuagcuguccaucaccccgcaaguggcugcucugagcagggaaagucaucaucuugggagggaagaacaaagagaggagcaggcacugggccuccccugcccccagcccugcccuggggcccacagagugagcagggucaagggagaagcaguuacccugugggcucccagacggggaagcagggccccaucucccuccacagaaacgucugggaacagucagaccuugggucuuccugggugugaccacauccacagccuccccuagagcugagucugagggcacuugcaccugggcagccagucgcguacacacacaggcgccccaccauggggcucugcugcauuccagggagcacauucgccgcgugcacagagaagcacauuuucacgcaugugacaacacacacaucagcauguggacccguacugcugcccacaccaacaccagccguguacccccacugcuguccacacccacaccagccauguaccugcauugcugugcccgacaccagccguguaccuacacugcagugccugacaccagcuguguaacugcacugcugcccacagcagcaccagccauguacccacauugcugugcccagcaacguaagcuguguacccgcacugcugcccacaccagccguguacccccacugcuguccacacccacaccagccauguaccugcauugcugugcccgacaccagccguguaccugcacugcagugccugacaccagcuguguaacugcacugcugcccacaccaacaccagccguguacccacacugcuguguccaccaacguaagccguguacccgcacugcugcccacacccacaccagccguguacccgcacugcugcccacaccaacaccagccguguaccugcacugcugcccacaccaacaccagccguguacccacacugcugugcccaccaauguaagccauguaccugcacugcugcccacacugcugugcccaccaacaccagccguguacccacacugcugcccacaccagcacaaacacaaguagcuggauacccucuccacaacccagcccugcccucccacccagccuuggcgcaucacuaacagaggccucggugcugugacccagcaguacggacgaggugcugucccuggaggagaaagaccugagggaccgggagaggcgcauggccaauaacgcgcgggagcgggugcgcgugcgggauauuaacgaggccuuccgggagcuggggcgcaugugccagaugcaccucaagucggacaaagcgcagaccaagcugcucauccugcagcaggccgugcaggucauccuggggcuggagcagcaggugcgagguaggcuccccggccagggcugccccagcacccucucccuuccccacacccaggugcagaugcugggguccuccugugcuugccgcccccggacucuguccaugucugucuuuguggcuggacucagacccagugauguuccccagacacccccugauacccacucucuucuuuacaagccuccaccccauccccccagccuucucaaggaaggaggugagagccggaaauacaggaggccacacgugauggggcucugcccccacccccccccccgacauccuaccccccacucccaccucacaucuuucuccucccugggaccgucucccacagagcucuccccccucccuccagagcggaaccugaaucccaaagcagccuguuugaaacggcgagaagaggaaaaggugucaggugugguuggagacccccagauggugcuuucagcuccccacccaggccugagcgaagcccacaaccccgccgggcacaugugaaagguaugccuccgugggacgagccacccgcuuucagcccugugcucuggccccagaacggccacucgagaccccgggcuucauccacauccacaccucacacaccuguugucagcaucgagccaacaccaaccugacaagguucggagugaugggggcggccaaggugacacuggguccaggagcucccuggggcccuggccuaccacucacuggccucgcucccccuguccccgaaucucagccaccgugucacucugugaccugucccauggauccugaaacugcaucuuggcccuguugccugggcugacaggagcauuuuuuuuuuuuccaguaaacaaaaccugaaagcaagcaacaaaacauacacuuugucagagaagaaaaaaaugccuuaacuauaaaaagcggagaaauggaaacauaucacucaagggggaugcuguggaaaccuggcuuauucuucuaaagccaccagcaaauugugccuaagcgaaauauuuuuuuuaaggaaaauaaaaacauuaguuacaagauuuuuuuuuucuuaauguagaugaaaauuagcaaggaugcugccuuuggucucugguuuuuuuaagcuuuuuuugcauauguuuuguaagcaacaaauuuuuuuguauaaaagucccgugucucucgcuauuucugcugcuguuccuagacugagcauugcauuucuugaucaaccagaugauuaaacguuguauuaaaaagaccccguguaaaccugagcccccccguccccccccccccccggaagccacugcacacagacagaacggggacaggcggcgggucuuuuguuuuuuugauguuggggguucucuugguuuugucauguggaaagugaugcgugggcguucccugaugaaggcaccuuggggcuucccugccgcauccucuccccucaggaaggggacugaccugggcuugggggaagggacgucagcaagguggcucugacccucccaggugacucugccaagcagcuguggcccccagggcuacccuacacaacgcccuccccaggccccccuaagcugcucucccuuggaaccugcacagcucucugaaauggggcauuuuguugggaccagugaccccuggcauggggaccacacccuggagcccggugcuggggaccuccuggacacccuguccuucacuccuuugccccagggacccaggcucaugcucugaacucuggcugagaggaugcugcucaggagccagcacaggacaccccccaccccaccccaccauguccccauuacaccagagggccaucgugacguagacaggaugccaggggccuggccagccucccccaaugcuggggagcaucccugggccuggggccacaccugcugcccucccucugugugguccaagggcaagaguggcuggagccgggggacugugcuggucugagccccacgaaggccuugggcugugcguccgacccugcugcagaaccagcaggguguccccucgggcccaucugugucccaugucccagcacccaggccucucuccaggucuccuuuucuggucuuuugccaugaggguaaccagcucuucccagcuggcuggggacugucuuggguuuaaaacugcaagucuccuacccugggaucccauccaguuccacacgaacuagggcaguggucacuguggcacccaggugugggccuggcuagcugggggccuucaugugcccuucaugccccucccugcauugaggccuuguggaccccugggcuggcuguguucauccccgcugcaggucgggcgucuccccccgugccacuccugagacucccaccguuacccccaggagauccuggacugccugacuccccuccccagacuggcuugggagccugggccccaugguagaugcaagggaaaccucaaggccagcucaaugccugguaucugcccccaguccaggccaggcggaggggaggggcuguccggcugccucucccuucucgguggcuuccccuacgcccugggaguuugaucucuuaagggaacuugccucucccucuuguuuugcuccuggcccugccccuaggucugggugggcaguggccccauagccucuggaacugugcguucugcauagaauucaaacgagauucacccagcgcgaggaggaagaaacagcaguuccugggaaccacaauuaugggggguggggggugugaucugagugccucaagaugguuuucaaaaaaauuuuuuuaaagaaaauaauuguauacgugucaacacagcuggcuggaugauugggacuuuaaaacgacccucuuucagguggauucagagaccuguccuguauauaacagcacuguagcaauaaacgugacauuuuauaacgaugc

SEQ ID NO: 193017 - RNA, 21308 nt, Homo sapiens
ccggauuguuaguuguuuuuguuuuuaauuugucuccaauaagcaaugucuucugcccauccagcaugggaagugggucccacgugaagggggcccaccacccacuuugggagcugaaggcagagacucgggagcccucccggcucagacucccccuacgcuggguguggguuauauucagaggcccacacccacacugggguagguuagguaugguuuacuuagccacaggcccccgggggcaggagacagagugggggcccgaagcucccuguccuggaagaguuaaaaguucugggguagcccuggccccgugggggcaguuagagaugagggagguuacuccuuagcccaggagugguuagagacaguggggcugguagagaugccuguuuaagccuuggccucuaggagguguuagagauuugcugggguugggggccaggguugcugggaccccaguuuuggggagggagcuguaagagauugggggauguucugagcuccccagacaagaacugcugguuaagagggggccaggcccgguuggggcucagcugucccugaggagcucggcaucccgccugggagaugcagcugucacugggguuucucccucucuguuguccuggccucguccuuggcagguggcggggacuucuugggggaagcugaagugcugggguuggggacccccgcccccgacugggcaucuaugcuggcgugcucccuccggacaagguccuccagcuccuucugcaggagcaaaggucacagaagucaaaggucacugugcaucauggggucagaggacccaugggguggggagaggguccagggauggggcucaggacaggcugggguugcucagcuccucaccuuccauccaaggagcucagcaagggccaggcagcccuggucgcauucacccagccaggccacgucccugcggugcagcaggagaucagaguucccaggcgggcucgccccugccugcuccucucaucugccuucgugcccccgcucccaccucacccugucccuuccaggcugccccaacccccggcggggccucaccuguaggccuucuuggagucaaaguccaugccuccuccgaggcccauaaucauccccaggaaaggguccgacugucagggagggggugggucaggggcaggagcagggaagggagagcuaagagcacagacccuggagccagguggccuggguuuguauccuagcucugugacuuuguuuuuuuuuuguuguuguuuuuuugguuuuuuuugagacaaaguuucacucuuguugcccaggcuggagugcaaugaugugaucucggcucacugcaaccuccaccuccuggguucaagugauucucccgccucaaccucccgaguagccuggaugacaggugcccagcaccaugcccggcuaauuuuguauuauuaguagagacgggguuucaccauguuggucaggcuggucucgaacuccugaccucaggugauccacccgccucggccucccaaagugcuggaauuacaggcgugagccauugcgcccagccagcucagugacuuuggucaagugacuuguccucucugugucuuaguuuccuguagaauaggggugaucacaaaaccgcgaugggguuguggcgccagugaguucacgcaggcuaagacuugggacagugucugcccacagcgugcgcugcuugcccggugacccugccuacuuccccugaggggaacaccuaggagggagcaccugcccuagagugaggcugcccaggaaaaacagaccugagagacccagagcguggacccaaccccgccccccgcacugucucuccugaccccugcacccccucccaccuccucagucccuggaagcccggccuuccuaucuggcuucagcugguuugaguuggaauucuaucacuugcucaaaagggcagugaaugucccagaggccuggaacccgaccccucuggauucuagagccccagguucugagcugaggaaugcaaagugcugggguuccacaguggggguucccucugaggaaaagggugagagggaagggggagccugugacgacgggggcuugaagaagggcucuuaccuggccagcuuucuccuuguugaugagcaggcgagggguggagaggggugcccuguggggagggggagcuaaggggucagggucuguccuggcccugggugcccagccguccucccagccacagcccccaaccuacuugcugaugagggaggcaaagggcugcaccugcaaggagguacccaugaccaggaggagguccaccuucaggaaguccugcggggaggggcgugagcuugggagccuccgcccaggcugcgccaccgcucccucccccgcccccagcagcaaaccucccugccgccccccauagcuggggaggugaccuuuccugaggcagggcccaggcugcccccauggggcccagcacagguggaggcggcgguuggggaugcggggaggcuggggggccacuuacugacugcauacaggagaagaaacgcgcugggaggcucucaccaaaaaagacgauaucugagguggagacagauggacggacagagacagugacauggggaggcagagaggacaggugggagcaauggcagacccggaggccacagugggaguugggagcaguggggaccggccaggggcacagaccccauucuccccaggauggaucuggggcacuguucagagagacagagguggccagaugugugcggguguggccuuugggagggggucagggggaggaggggacccccacccaaauccaccugggcaggucccuggccagaggcucaccaggcuucaccaggcucugacagucuucacacuugggcgucaccucagagaagaucuucucuggguauggggaaggggaagaaagagaaggcaguaagaggaucugggccggagucuggaggugcagcacccccaccccucuuccacuguuaacaugaacacaccuccaucacuuggagugugaugggugucuccugagguguccacucugcucagaaaagaccucucuucuuguuguugcauuuuuuuuguuuuuuucuuucuuuuuuuuuuugagauaaggucucacucuguugcccgggcuggaaugcaguggcacgaucauggcuuacuguagccucaaccucccagcuucaagugauccuccugccucagccuccugaguagcugggauuacaggugcaugccagcacgcccggcuaaauuuuguauuuuuuguagagacaggguuucgccauguugcccaggcuggucucaaacuccugggcucaagcaaaucugcccacuuuggcuucucaaagagcugcaauuacaggugugagccacugcgcccggccuuauugguuuguuuguuuuuuugagacagguucucacucuguugcccaggcuggagugugguggugcaaucaugguugagugcaguggugugaucauagcuuacugcaccaccgacuucccaggcucaagugauccuccugccuuagccucccgaguagcugggcucacaggcauccaccaucgcaccuggcuacauuuuauuuuuuuuagagaugggaucucccuauguugcccaggcuguucucaaacuccugggcucaagugauccacccaccucgacguccaaaaguguugggauuacaggcaugagccacugugccuggccuuauuucuuauugauuuaggaagcuugaaagcauuucuggccgggugugguggcucacgccuguaaucccagcacuuugggaggcugaggcgaguggaucguuugaggucaggaguuugagaccagccuggccaacguggugaaaccccgucucuacuaaaaauauaaaaauuagccagggguuguagcacgugccuguaaucccagcuacuugggaggccgaggcagggagaauugcuugaacccgggaggcggagguugcagugagccgagauugcaccacugcacuccagccugggugacagagcaagacuccaucucaaaaaaaaaaaaaagaaagaaagaaagcauuucugucacuugcaacccacugaauucuaagucauuugcucaacuguccauucauucauucagcacacauuuauaaagcauuguuucaaugucaguagucgguaauuuucuuuaaaauauuucugcauggacagcaugacaccgugggugcugccugugacgcugcugucaaugacacauaauggggguaaugugaauuguacacugcccccagcugcuugcaguugggcuauucaggaauccucagcccaggggcacucagcuggcauuuuaucagaacagccacacuccagaggcccuucugcaaaugcugcagcuguccuuaucucacagggacaccagaggcuuuguuaaaucagcauaaagaaugucagaaauggcuuuccaugaguggaauaagugacuucuuguuuuuuuuuuuuuuuuuuuuuugagacagaguuuugcucuuguugcccaagcuggagugcaauggugcgaacucagcucacugcagccuccgccucccagguucaagcgauucuccugccucagccuccugaguagcugggauuacaggcgcaugccaccacaccaggcuaauuuuuuuuuuuuuguauuucuaguagaaacgggguuucaccauguuagccaggcuggucuugaacuccugaccucaggugaucugcccgccuuggccucccaaagugcuaggauuacaggugugagccacugcuccuggccuacuaucauauauuaaaaacagccaaagacaggaaaucaggcaguugggcugcagugagccaugaucacccacugaacuccccgcgugggcgacagagugagacucugucucaaaaacaaacaaacaaaacaaaaaaaccccaaagaauugagcaggacagaaugggugcccacugcauggagacacugcuccuggugcugagaggaggccugcccucaggaugcccuccagccucaccuuucauccagcuuagcggguauucgugccggcagcuggcgcugacgcagugugauguguagaaggugccgugcgccuccaccaaguccuccuguuccagcccggcuauucgcuccaggguaucuauguucuagagggagagauggagggaagaggggugaggagugagccaccccuuguaggccagaaggcacaguagggaguugagggccacgaggagcagugaggugguggggacagguggagaagggagggaggagaagcaaguggcaggguuuaucugaagacucuucuguucaucccaauggugccacuuaaagggugacagucaaggcugcuuaaaggcaggggccaggcugggcauggcggcucacgccuauaaucccagcacuuugggaggcugaggugggaggaucacuugaggccaggaguucaagaccugccugagcaacauaucaagacgcuugucucuacaaaaaauuaaaaaaaaaaaaaaaaaaaaaggggcccaaaccuaaauaucuaugaggccaggcccacagccacuccacagccuguguggcuuuuauucugcaaauucaggccauuugcuuucauuuuucagaaaaaaaauguuguuuuauuagagccagaugcuuuauuuccaccugucauuaauugcugaaauuaacauacauuuacaaugucucuguuauuaauggagcccccucagauguggcauccuugugcagugcgcacccugcacagcugcauguggcagcucuaggcaagcauuaacauaaaugaaucaggagggcuuacuaggugugguuuguuuguuuguuuguuuguuuguuuuuugagauggagucuugcucugucacccaggcuggagugcaguggcacaaucucggcucacugcaaccucugacucccagguucaagagauuuuccugccucagucucccaaguagcugggauuacaggcacgcaccaccaugacuggcuaauuuuuguauuuuuaguagagaugggguuucaccauguuggcuaggcuggucucgaacucuggaccucgugauuugcuugccucggccucccaaagugcugggauuauagacaugagccacugugccuagccauguuuuuuuauguauuugagacaaggucucacucugucgcccaggcuauagugcagugguacaaucauagcucacugcagccuccaacuccugggcucaagcaauccucccaccucagccuccacaucuggcugauuuuuaaaauuuucuguagagauggggucucacuauguugcccaggcuggucagcgagccuucugccucagccucccaaugugcugggauuacagugugagucaucaugccuggcccuuccuuggcuuuaaucacuaucuuccccuuuaguagccaggguccuuucuuacuauggccuguuucauagauggcauauucaccuguguucuuuucuuuuuuuggaggcagggucuugcucugucacucaggcuggaguguaguggucugaucacagcucacuguagccuucaccuccugggcucaagccauccucccaccucagcccacugaguagcugggacuacaggcaaaugccaccaugcccggcuaauuuuuuaucuuuuuaauuauuuuuguagagauggggggugggguggucucccuauuugcccgggcuggucuugaacuccugggcucaagugauccucccacuucagccucccaaagcguugggauuacaggcgugagacaccaugcccagccacuguuuucuuuucuuuucuuuucuuuuuuuuuuuuuucagauggaguuucacucuuguugcccaggcuggaguacaauggcgcuaucucggcucacugcaaccacugccuccugaguucaagcaauucucccugccuccgccucucaaguagcugagauuacaggcacccgccaccaugcguggcuauuuuuuuuuuuuuuuuugagacggagucuugcucuguugccaggcuggagugcaguggcgcaaucuuggcucacugcaagcuccgccucccagguucaagugauucuccugccucagccuuccagguagcugggaacacaggcacgcgccaccaugccuagcuaauuuuuguauuuuuaguagagacgggguuucaccauguuggucaggauggucucgaucuccugaccucgugaucugcccaccucagccucccaaagugcugggauuacaggugugagccacugcgcccggccacuguuuucuuuuaagacagugagacuuuccauauuaaacaggugggaauguucuuuucugcacagacauuugugcgcgcucauuuuucuuaaaacaaccacccccuuuggagcagcuguuguuugccugugaggaaugccgcuaaaacaggugcugacagaggacacuggcagagguuacgcagagauggcucgcauguguggcccagggccaaacugacagcguuucccagggacuccagaaacaacgggaaggguuuguuucccuucaagggcagaaagaaugcucuaacugccuucugggcucccuaccagcaaccaccuuaucuccaaagccuacagacaagagucacugucacuguucccacacgcccuguaacuuuccucccuugcccacuauucuaaaucuugguuuugccuuugguacuugacucagucuacccacugacucccucacaugugagugagcaauuugcaaauaacugaacaguaagcaaauaacugaacagcguggaaaagaaccaccgaaauaccucugcguucuguuauucuuugacaacaugguuuuuuuuuuuuuuucuuuugacaggauuuugcucuacugguccaggcuggaguacaguagcuugaucauagcucacuguagccuugaaauccugggcucaagcaauccuccucucucaagcucccaaguagcugggacuacaggugugcacuaccaugccuggcuaauuuuuuuuuuuuuuuuuuugagauggagucuugcucuguugcccagguuggagugcaauggcggaaucuuggcucacugcaaccucugccucccagguuuaagugauucuccugccucagcauccugaguagcugggauuacaggcacgcaccaccacacccagcuaauuuuuguauuuuuaguagagacaggguuucaccauguuggccaggcuggucuuaaacuccugacguugacuuuggccucccaaagugcugggauuacagacgugagccaccgcgccuggccuuuauauaauaguuuguaugugaugugucauuuuuuuucuuuuuuugagacggagucucucucugucacccaggcuggagugcaguggggcaaucucagcucagggcaaccuccaccucccagguucaagcaacucucaugccucagccuccugaguaacuaggacuacaggcaugugccaccacgccuggcuaauuuuuguauuuuucguagagaugggguuuacaacagcacccccuuucccgaacacauacaccguuucugacuccccuuccagcuuaacuguguuccagggacccaugaccaucuuauaugcucaguauauggugucuccaucuuguccaucaucucccucccugcuguagggaaucaacucagugaacauuuacuuugacagaagcugacaaacaagggccagcggggucuuggggugagugucaugacaucaaccacaaaaagcacuuggcuucaagcaagcuguuaucauaucugagccacguccuggaauaauggugacucucugggcagaagguuuauucugagcccggagucucccuauguugcccaggcuggucuugaacucaugggcucaagcgaucucccacuuuggccucccaaaguguggggaucacaggacuccuccucuuggaagaaggaggccuccgcugcccucugccuccuaccagccccaggugggaacaccucgcccaccugagaaaucugaacuuaaagccaguuguuccucccccuggcgguagcuuuuggggcugcaggugccaaacugcagguacagggagaaaacacuagaacacuuauuuauuuucaauguuaccacucuuuuuuguuuguuuguuuguuuuuuuaaauugagauggagucuugcucugucacccaggcuggagugcaguggcacaaucuugacucacuacaaccucugccucccagguucaagcgauucuccugccucagccucccgaguagcugggguuacaggcaccaccacaccuggcuaauuuuuguauuuuuaguagagaccagauuucaugauguuggacaggcuggucuugaacuccugaccucgugaucugcccaccucggugucccaaagugcugggauuacaggcgugagccaccgcgcccggccaccuguuuuauaauucgggguucugaggugugaucuagagcuugaauuaauacuguuguagugcaucaugucauuucuauacauauucauaaaacagguagaggcagcaacauuuuguuguuguuuugauuuguuuuuuguuucuuugaaaccaggucucccaggcuacaguacaguggcaccaucauagcucacugcagucuugacuuccugaacucaagcaaucccccuaccucagccuccugaguagcuggggcuacaggcacacgccacccugcccagcuaauuuuuguauuucuuguagagacagggucucccuauguugcccaggcgggucccaaacgccugggcucgagcuaucucucgcuuuggccucccaaagugcugggauuacaggugugagccacugugcccagcccaucaagauuuuuuuacuguuaggggugugagacucuccaaaccagaagccaacaaugugagccauccuugcuugaaugccccagggagaggcccuuggcuaagcaccugacguguacgagacauguuuauaauugggcaaagcacaaaaaacuauaaaaaggugccccuuccuuaaggcacaacaucuacuuguuggacacgugucauaguguauggauuuuguuagaugaagucacuuuggaaacucgcucauaaccaaugugaaaucuggggugccuauagugcacacagagucccuucagccauaggcuccuuccacaucacacaugggauggcccugagaggaggucacugccaccgcacugcagaccugagagggcagaccugagagggcaaaccuuuucuggccccuguuugacggaaggggaaacugaggcagagaagacgugacucacggcaggucaugcagcaaggaggcaguaggccaagcccuggccccgcauugcuggaguccccgccugagcucuugggcacgcagcucugcuccucugcugaggacaccaugcccguuccacccgcccauccuccucccaggaugcucgcauccgccuaccugcguguagcagcgcaggaguagccccuuguccuucagcaggcgcaugaaguagugacagaugguuggcugcagggaagagcgacagcacugcugacgacugcagggaacagccacaggccacugccgcaugccaggaacuguucuaggcacugugacuguuuuacccccagggaaccgucacagcagccgcgucggggagagaccacugcuauccccagaucacagaugaggaaacugaaggacagggaaggggauuguguugccaaagucacacgguggguaagcugcagagcugagauucacacccaggcagcccggcugcagggucccgggcucucaacggcaucauuagucagcuaagccucgcagcagcccucuucagacaguaccauuagcuucacuucacaggaggcaaaucggaggcucaaggucguaagaugaagacacgaggaaccaggacuugaaccgaggcagucugggcccagcacccauguacuuaauggcuacauaauauuugucugcagggccuuggcggggcuucucaugcgugcccucccccaacccuuccuguuucgcccccugcaaaacaaagaucucaccuugaacugcccaggauagaguuccuuggcgagggcgaagaaggguuccggauguuucuguaggagagacagccagagggccagaugccccagguagcgugaggguuggagccaggugaccccauccccaccccucacagacgccccuuccugggggagcacaaaccuugaaauagcugaucucaaagauggccucuggguagggaagaugguacuucucuagguugucauagaggccgguggauggagagcgaaagucggggaugccugcggcuaggaaaggggggucagggagcaguuggucuauaccauacuaacccucccaggacagggcucagauagggcuccuccccagcccuugggagggacuccccaguuccuggggguagcugcugggggagaaggguuacuuacauguggagauuccagcucccaccaaacagaugacucugcgaccuggaggagaggaacuuaugcaccauaugacaccguuugcucagucccuacgauagcaccacccaucacagccccugacaucguuuacuccaugccaggcccuggggcaagcaucucagaugcaugacgggccuuccaaucaucuagacggggaugguguuaacauccccauuuuauaaaugagaaaacuggggcucagauaggggaagaagucacacaaucaacugcggaagagccagccagcggauaaagaauccaguguugggcugggugcaguggcucaugccuguaaucccagaacuuugggaggcugaggcaggcgggucaucugaggucaagaguuugagcccagccuggccaacauggcaaaaccucaucucuacugaaaauacaaaauuagccaggcgugguggcacgugccuguaaucucagcuacuugggaggcugaggcaggagaaucacuugaacccgggaggcggagguugcagugagccgagaucaugccauugcacucuagccugggugacagagcgagacuccaucucaaaaaaaggaaaaaaaaaaaaaaaagagaauccacuguuggaaaucacaccaacuuggacuugagaaaaggccacuuuaggauaagaacccugggcugagcagaaauagcuagcugguggcuggugaguagccaccaggccauaguacccuggcaucugcccaucagcugauagacaggcacaagugugauaugcuguggaucagaugccucugggaugcccuguccaagggaggacagcaaaggugaacagagcacaaagccugccacagcuucagcccugagcuucagcucugagaugccaucaggccaggccugguugaauccagugguggcuacauguggucuggauucaggggaccuggggucaaauccuggcucugccacuuggcaacuguuugacccuacacugagucgugaccuuuuugugccuccuuuuccuccucuguucagaucacuuccauaaugaucuuacagguauaaugugaauaucaaauaauagggcacuuguaaagugcugagcccagugccuggcaaauagugaagccucaauuaagugguuaaaaagaaauuuuuagggccgggcccgguggcucacuccuguaaucccagcacuuugggaggccgaggggggcagaucaccugaggucaggaguucaagaccagccuggcuaacauggugaaaccccgucucuacuaaaaguacaaaaauuagccgggcgugguggcacgcgccuguaaucccagcuacucgggaggcugaagcaggagaaucgcuugaacccgggaggcagagguugcagugagccaugauagcgccacugcacuccagccuggguaacagagugagacucugucucaaaauaauaauaauaauaaauuuuuagagcagugaggugaggguuggagccucaccuuuaaauuuuugcagagagggggucucgcuuauugcccaggcuagucuugaccuacuggccucaagcgauccuccugcuuucagccucccaaaauggugggauuauaggccugaaccaccacucccggccucaacuaauuguuauuuuucauuacuaucuccuccugggcacccucaugagccaauuaccccagaauccaggugcaggaggacacaaggaacaaaugcuuuguagccacugccuguguugucuuuggggccugcccaggcuaaaagauggcugcagacagcugcucgccugccgcaggagagggaggcucagggcagcaggccuggcugccugaggagggagacaguggcagcuggaggacagggacacaggagaagauguccucaacaaaaggcugcucaggaaccacaaagggucgauuguucuaguugaggacugccaagggccugguuucucagacuuuggugaccucaacuuguggcaagaaauauaaauuucaggccgggacgggugguucaugccucuaauccuagcacuuugggaggccgaggaggguggauugccugagcucagguguucaagaccagccugggcaacauggugaaacccugucucuacuaaaauacaaaaaauuagccagucgugguggugugcgucuguaaucccagccacucgggaggcugaggcaggagaauugcuggaacccgggagguggagguugcagugagcugagauugugccacugcacuccagccugggcaacagagcaagacuccaucucaaaaaaaaaaaaagaaaaagaaauauaaauuucaugcugacucaguaaguggacaccuauccaccacaucugaaauaagccuccuguaguaauaaccacggcacacccugccacagcucucgcuauguuccaggcccugcucuaagcauuugcauuuuuauuuaucuuuuaaauuuuauuacuuuauuuuuuuuuagagucagagucucacuguguugcccaggcugcagugcaguggugccaucauagcucacugcagccuccaauuccugggcucaaacaauccucccuucucagccuccugaguaacugagacuacaggcaacgcccccauaucugacuauuuuuuuuuuucuuguagagauggcgggggggucucacuauguugcccaggcuggucuugaacgccuggcguugagugauccucccacgauggccucccaaagugcugagauuacauacaugagccacugccccugguccuauauuaauuuauuuagccccgccaauaaccuuaugaguuagauacuauaaucauuauccucauuuuaugaaacaggccuggucaaucagagugcaguaauucacucagcaauggagaagcgacccaggucuggccaaucagaggcaugggggcaggcauuugacucaaccgggaccaaugggagccaaucucugcuguuugguuugaacuacugggaaaaggugcucucucgguggcagcuccuaggcuaguggaaccugcauuugcagcugccaggaguuaccuuuaccccaaaacaagaaaagcagcaucagagagaguuaugauuuuuaacaaaguggaagcaccuggacccagccgugcuucaagcuggauuagagccaacacacuccuuuuuggcuuaagccaguuccagcuggguuucuugcuacuuauaaagaaaagguuucaauaaaugguucaaguggcuggggaugggaggucacuuggggccaggagccaggcaaaguggcccaauccugacaggggacucacagcguucgcucugcauguaccgggccaccccuuccaaggucagcucguccagcagacgcuccuucuggcugcccaggcugagcgucugggagaauaaguuccgcaggaaguccacugaccggaaagaagagagacagcggcaggacgggcauucagccaggggcauggaugucuccggcacccuggccccagcccugggguucccggccuccccacaucuaaaggcacaaggcccggcccagccagcggccuccaggagccugcucuggcacugguacccaacccacugcuacauacuuuggaugucacuccugauggaguugaggagguaucacccacaccccugcccugaaauccccccgccccccagaacccugcucccugucccuccaggaagauacucacugucugcuucuccaccagcggcuccucccucagagucugaaucugaguccuggaaggggugggguggaguggccaggcccgagaggugggauuagggagggaggagagggggugauaccagguuuggggaaaaggcuguggcaggaagguggccugaggaagugcggggugguggagagacugcacuggggcuagcuccagggcucugggacaggcugccgggguuggaguccuggccaugcccguccccaggagcaagaccucaugugaguggcuuugcuuugcuuuucuuuuuugagacagugucucgcucuguugcccaggcuggagugcacuggugcagucacagcuugcugcagccucaaccucccaagcucaagggauccucccaccucagccucccaaguagcugggaccacaggcacgugccaccaugccaggcucauuuuuuguuuguuuguuuguuugcuuuguagagacgaggucuuccucuguugcccaggguggucuugaacuccugggcucaagcaagucuccugccucggccucccaaagugcugggauuacaggcgugagccacugugccuggucgugacuuugauuuucuaagucuuggugucccucaccuuggaaagggagcuugggugcugggcgcagcaccaggggcgggggaagugcuugguaagcgcuggcuguugcuguuauuaucacagccuggggucuucccuucguucccggguccccuggagcgugggccugcugucccuucccagcagcccugggggccucugaauaaugucccaagucacucugggaaugauuccaaugcaaagccuuggcccucacuucaaggaccuaugugcccccugcucgaggccucagacacucugcccaccucuccagcaaccucugucuccuuccucgaagccuccccucagcccagcuccagacuggcaggucucugggacucuguccagggccucucugcuuucucuuuccacuuuccugggguuaccugucucauccaugccaaugaccucugccucgucacucaugauaccaucucucugcccucagauccgggguucccuggcuuccuggacaccuugcccuaggugccccccagccucucacuccuacuaugucccaaauggacccuggcaucuccuccaagcccauccuccucccaggccucaucucaaugcgaucguacugucccccccaucagccagauguuuccugcccccgccucccuccucgcccuccugccacagcccuucagcuccagagcauguacgcugagccuccuaagggucuguccaccaacccccuuucccuccccggcgcuccaccugguccagccuguccucuccuccggggguccugccccagccuccucccccagccucccagccucagucuccaccucccauccacccugcugcccugcaugugaggcugucugggucagcucgccccucuccacuucaaaggcccuucucucuggcuucugcagucuucccagacaucuauggaauugccaggauguccacaagggcagggacuuugucugggugcccagcacugagaacagggucuggcuccuggcaggagcuccaggagcuccucuaccuuggaaugaaugccugcuucaggcuggaccacggcugggcccugcaauggauuucaccaaaaugcaguucugaccaagccaccaccucagacaacucccuuccccggauacucacugcucugcguccaagucuuuuugaauaagacccucccuuccgaacauacgacaauuuaaaaaauugcuuuuuaagacugugcaacuccggcugggcgugguggcucaugccuguaaucccaccacuuugggaggcugaggcaggaagguugcuugaugccaggaguucaagaccagccugggcaacacagugagacucugucucuauuuaaaaagagagagaaaggcugagcacgguggcucacgccuguaaucccaacacuuugggaggcugagguggguggaucacgaggucaggagaucgagaccauccuggccaacaugaugaaaccccgugucuaauaaaaauacaaaaaauuagccaggcaugguggcacgugucuguagucccagcuauucaggaggcugaggcaggagaaucgcuugaaccugggagguggagguugcagucagcgagaucaccccacugcacuccagccugggugacagagcgagacuccgucucaaaaaaaaagagagagagaaagagagagugagaaugagagagagagagagacagagagaaagagagauuggacaaccucugcaaaaaccuugauuauacucauguauacuucaacaacauauaacuugcggcacucaccuuguaauugcccaagcccacccuuauaaagauaaccacuguuagcuaagcuuaauggaaauuacuccaguuuucucugcauaaaacuaauauuuuuuacagaaauaggucauaguacaauacaacaucuugaguuuucggcagaacaauaugcuacagacccaccuaauuuaaaaaauaauuuuuuaaaaaagagacggcaucuugcuauguugcccaggcuggucucaaaacuccugggcucaagugaucccccugccucccaaagugcugggauuacaggugugagccaccgugcccggccucaccucguuuuucagagcagcuacauaguauuggauuguauggaugaaccauaguucauuuaacccauccacugacagccauuuggacuguuuccaguuuugcccugugacggacaaugcugcauuuuacauccucgccucucucucuuugggacugaggauccuuuuuaacauucaaccuuuuucucugacaguggucgugcuuugggagccaggcgagugaguugccacagccuaacaggaggcucuuauauccuuagcaaagcuccacugugcauuugugagguauucugaugcccgcuucugcaccaccccacgucugaaaggcaaucucaggggugugggugggcuggcacucuuucaggcuguacacagugaggcuguguggaaggccugugcccagcaugugucugcagcuuggccuaagggagagccggaggugcugacgggggccuucaagcuccuaugagacugccuguccaccucuccuggcagccucugacagguggcgugcccagugcugggggacucaaacccuucccugcuccuguagccgagggacgggggauaagugacuuaacaacucugccucagauucugcaucuguaaaauggccgugauaggcguuucucuucacagggaugccaggaagaugaaauugagaugaggcacguuuggcacuaaacagugggcccagcuuuaguaagccgucaguaaaugcuaaccacgacuauaacaagcugaccaccaccagccacccaauuauggaacacaucacaccccuucaugccccccaggucuuugcacaagcgauaccuguuguguggaucaccauuucucaccuugucuaagaaaauucuaagucacucuucacuuaugcugugucuguaucuuggucugacagcuagaccagccuguggauuccuccagggaauggccuggcuagaaucuucuuugacccagaaaauuuucucugugcucccacaguacccugaguuucuuuacuuuucuuccuuuuuuuuuuuuugagaccguguuuugcucugucgccccgguuggggugcaguggcacagucaaggcacacuacggccuuaaccuccugggcuuaagcaauccucccccaacucagccuccugaguagcuggcaaugcaggcaugcaccacuacacauggcuaauuuuuaaauauuuuguagaggugggggccucccuauguugccaagacuggucuggaacuccugggcucaagcgauccuccuaccucagccucccaaaguacugggauuacaagcaugagccacugugucuggcccugaguuacuuucuuucuuuuuuacuuuuuagagaaagggucuugcucuuucaccccggcuggagugcagugaugcaaucauagcucacugcagccucaaacuccugggcucaagcgauccucgcgccucagucuccugaguuauuggaauuacaggcauaagccacugcaucuggcccccugaguuacuuucgucaucacgcugugagaucauuuuuucccaucacuuguccacgagaucugugcguuccaagaccaaaugggauaccugucucuuccagucccaggacaaaugugguucagaagggauggcaggcaguggcaaggaagaaggaaaguuugggaggacaggccuggacuugaggcuggaaacucuucucugacaauccccagaaucugccuuuccccagaaagcugcacuggguggugugagggauuggggcaaugagccgagggcccuggggugacuguuuccccuuugccaccuccccccagugugggauguggaacaaguccgucucucuccuccccuccacccuuucccccaucucaccugagccuccugcaccuucccugccugggucuccagagggugagaggcugggggaggggagcagaggugguuacaguggggagaacgauuaaggggggaauaaagggguucaaauggucagugagggggcaagaacacccaccaaccuaguuacacugggaugggauggugguaaaaauggagcagagggagggaggggacggagaaaagaucuuaucuacaugcaaagugaugccgggagaggugauuagugaggggcagagaggcuggagaggaagauuuagggggacagggagaaaguaggggcuuuugcccaggcuggucuugaacuccugggcucaagcgauccaaccaccuuggccucccaaaguacugggauuacaagcaugagccauuguuucuggcccugacuuacuuucuuucuuuuuuacuuuuuagagaaagggucucgcucaugucacccagguuggagugcaauagugcgaucauagcucacugcagccucaaauuccugggcucaagcgauccuccuccuccuaccuaggggauucagggcaugaaggaacacucaggaggaguuaggaaggacacgacagugugugagugugugugcggggaggguuagauuuacaaggcagagggaaguuuagaaaggaaaagagaagggaagagacgcuuuggcugggaggcagguuuaggagggaggugcaguggugcaguggaggcgguagguuuaggagaggcgcggaacaaggggaagccauaggaggggucagcaggggucccucagcauccucugguugccucuaacaaucagguacccauagcaagcgggaccggggcaacuuauguucuuugcagcgagggaccuuagcaaccaaggugcgagaaacacgcgaucauuggcaacuuggcaaguggaugugguaaacgaacccugaacacacugcgacccagaaacccaccagccuagcgauacagaucgcuaagcaacagcccucagaaucccacuccccgaagcgcucccuacuucccgccccaccgcggccacccuugggccccggggccugcagcauucagccaggccccggcgcggcccgacccuccuacccggauccccgacucacggucuggcucugccaugggcgcggugcugaagcccuugaggcugucaccgaccgcucugucccgucaccaaccacugugucccgucaccgacugcucuguccugucaccgacugcucugucccgugacggcaccagaaaugggaguggccgugauagggcacagaacuacaacucucagcagacauugcggccgcagacgcgcuuucguacaacacccagagcgccccaguuagguaagaaagcgcgcgaggaccggacuacgagucccagaaggcguggcgucagcagccauguugguaaagggcgcccggaaaaugugggaacggcuagagaguuguaguccucccgaauacucu

SEQ ID NO: 193018 - RNA, 11043 nt, Homo sapiens
ggcggacaaagcccgauuguuccugggcccuuuccccaucgcgccugggccugcuccccagcccggggcaggggcgggggccaguguggugacacacgcuguagcugucuccccggcuggcuggcucgcucucuccuggggacacagaggucggcaggcagcacacagagggaccuacgggcaggugugugagucaccccaaccgcacugaaccugggcaggcugcuucccagugccggagggcucuagagcccggagugagggccugcaggucccuggguggcacagagagugcugggggugcagggaggccuggggcaccaucugcuugccccagaggccggaauuugucuucagacacuuucuuucuccaaaacccggaggucuaaggacugagccgacuagaacuuccucugccucagauucaggccccagccccuccucccucagacccaggaguuuagguccuagccccuccucccucagacccaggaguccaaguucccaccuccucccucagacucaggaguccaggcccccagccccuccucccucagacccaggaguccaaguucucaccuccucccucagacccaggaguccaggccccaagccccuccucccucagacgcaaggguccaggcccccagccccuccucccucagacucaggaguccaggcccccaagccccuccucccucagacccaggaguccaggcccucacugcacucagggaccagugcucccuucccuggaggccuggucaggggucaccaagagcagagcgugggggcgggaggaaugugugugggaggccuggguaaggaggaaaaggguguagccagucuccuggcucagggaccugagagacagggguuaaaaggacguuccagaagcaucuggggacagaaccagccucuuccagggaggccugggagcugggggugugugucuggcagucccugcagcccugggcucugcggccccugcguccuccgcuuggcucugccacugcaucugagugucuucucuccucacggcuccccgcauuucuaacucuuucugccuccucgucucaaagcuguuccuucccccgacucaagaauccccggagcccggaggccugcagcaggugagaucacagacaucacagaaccugccgggugggcgggguggguggccauugcgcacagagccaggcuccgaggaaaacucccauacagaggaagaacgcuagggcccccuaggguaacccucuccugucgacaggaaggcaaaucagugcccaagaaaguagaaagaucuaaucagaaucucaccauggguuacuggaccaguggacguaguucugaauucucuuuggcacuguuuucgugggauccucugauggaagaugugggcugaggaagaauaaaucaggaggcuagaugggaaggacagaggucaaggcaggagaccauagcaggccaggaaggaaggagaggaugcagagggagcagacagagggauggggggagggucgaggcagugacuaauggaccauguggcuuccccucucaggagcggccaugaagaagcugaugguggugcugagucugauugcugcagguggggaaagggcauuuggaugggggaggcuugcagacaggguugggcuuguugauggagaagaggcugguauuggggauggggauaugcacaggguuggggugggggagcuuugaaaugaggaagacguuggggauuaggcuaaggguggggaauacagauagggaggguggugggagguggguuugaagauaugaggguuuggggugggguuggcuuuagggauggggaucuaaacauagaagagguaggagguagguuggaaaguuggagagagcccgggaauaggggauacaguuggguuuguaaugggaaugggguaaguuugggaguggaaauacagagaagcuuuuuuuuuuugagacagggucucacucugucacccaggcuggaguguaguggcaugauccauaguucacugcagacuugaacucuugggucucaagugacccucccaccucagccucccaaguagcugggacuacaggcguaugccaccauacccugcuaauuuguguguguguguguguguguguguguguguguguguguggagaugaggucucacuguguuaccgaggcuggucucaaacuccugggcucaagcgauccuccugccucagcugggauuacaggcauaagccacugcaccugaccaaucuugacuggaguucauguugagggggaugcgcuugguuucuccagaacuccucucugacucagaucuucucucccucagccugggcagaggagcagaauaaguuggugcauggcggacccugcgacaagacaucucaccccuaccaagcugcccucuacaccucgggccacuugcucuguggugggguccuuauccauccacuguggguccucacagcugcccacugcaaaaaaccgugagucuacacuguaaaugaacagcagaugcgacugaacccugagggugucuuauagaugucaggcaggaggugacauaggcaucccccccaucccagcacgaggccaucugauagccaggugcauucggcuguugcuuaauugaguacuuaaugugugccaggcccugcgggcauagcaguggaaaagaaaauaaaaaaaagaaaacaaaaaaaaacaagcaaaauugcuguuuuccugaacuuacuuucuaaugggggaauuggaucauuuggggaccugcagggcgugaugggcauuuggauuuaauucugagcacaguaggaagccacugggcaguuuuguuuuuguuguuuguuuguuuuuugagacacagucucgcucugucacccaggcuggaguguaguggcaugaucucagcucacugcaaccucugccucccagguuccagcgauucuccugccucagcaccccaaguagcugagauuacaggugugcaccaccuugccuggcuaauuuuuguauguuugguagagacgggguuucaccauguuggccaggcuggucucgaacuccugaccucaggugauccgcccgccucgcccucccaaagagcugggauuacaggcaugagccaccaccacacccagccugauuuacauuuuuacaagcacccuggcuaccacguggaacguggucugggcaagagagagggagggaggcccacgugggggcuguugcuuucauccggcgacauaggaggguggcuugaacccaggcggucgcaguggggauggagggauguugaauaucuugggauguggaauucugagacugagccagcagaaucuggcaacgaggaacaggagggagaggaagaagcacggcuggcuuccguguauuuguccugaacaacuggguguuuugccacgucuuucucugaguugugggagagggaaagagaaacaggccggguguaggcaggggagcaucugacauuuugcuuuagccacgaugaguuggagaugccggggagaugucccagcagggaggccagggaggacucuggagcucagaggagaggucagggcuggagguuaaaaugaaggcaucgucagcaaacagguguauuuaaagccaugggacuagaugagaucauccaaaaagcuggcauaguuggaggagcuggagggcccaggacaaaaacccugggcgcugauccucacuagucagauucacgacagcugccacuuguuugaugcuaacuaccaaucaggugcugagugaaaccauguacacaccuuuccuggaaugcccaccacaagggacucuuggcaccauuuugcaaaugaggaaacugaggugcagggaaauagcaagugacaaucccuggggugguuccccugaccccaaggagaccuuggaugacucucaccaccaucauucauuccuuugauguacauugacuaagagcaccugcuaagugccacauucgaguugggcaguggagauucagcaauggaugggacacacacgucaucccugcccucgggagcacaaggacagaaaggugcagacaagcaaagugagggcugggcaugguggcucacgccuguaaucccagcacuuugggaggccgagguggguggauuaccugaguucgagaccagcuuggccaacauggcucaacccugucucuacugaaaauacaaaaaauuagccaggcgugguggugggcuucuguaauuccagcaacuugggaggcuaaggcaggagaauugcuugaacgugggaggcggagguugcagugagccgagaucgcgccacugcacuccagccugaaccacagagcgagacucugucuaaaaaaaaaaaaaggaaagaaagaagcagcaaauugggcuggccgugguggcucaugccuguaaucccagcacuuugggaggccgaggcggguggaucacucgagcccaggaguacaaagcugcagugagcugugaucuacagaacaccacugcagauccagccugggugacagagcgagacccugucucaaaaaaacaaacaaacaaaagaagcaaacccuucaaaaccccauauaauuacaaauuaugaaggaaaagaauacggguaccuacuuuagauggaggagggucaggaaggacuuucuaaugagauaaaauccaagcggaggcaugaagaugggaaaaggaauguucagggcagaggaaaggcugugauaacaccccugaggugagaaccgucuugaguauucucagaaaauaaaauuucccguucacuggggggcagaaggugcugggagauaagguuggaaagugacuacagccagaucacacaggggcuccagugccaaguggaggagcccaggcuuuauucuuaggacaauggggagccaugggugaugucugagcaagggagugacucucuguuucaggaauauguaucaaacaccuauccugugccaggugcugaucaacgcacuggagauacuauaucugaauagaacaaaaauccccaucuugacauccuagagcugcacugucuaauaugguagccaucagccacauauagcaaauuacauugaaauuaaugaaauggaaaauccacaagccacauuucaaguacucagcagccaccuguagcuugugguucccccagccaccucuggacagugcagaucgagaucauggcaucguagcauuuaguggacagcauugcucugcaaggaggagaaauaacacaaugaguaaauauuuaacaauaaauauauagcaggucggaugauugugauagguucucugguggaacagaaagcaggggagggagauaggaauugccuacuaacagguauuuguauuuuaauugggcaacuaaggaaggcuucccugagaggcgacauuuaaaggaagugagggagugagcuaugcagauacuuggaggacagacuugcuggcagagggaacagcagugcaaaggcccugaggugggaagaucacuauuguguucaaggcaagacagggaagccagcguuuggcuggagcagagggagagaaggggagagugggaggagaagaugucugugagaugauggggcagugcuugcaaggccuggugugccacguugagaacuuuggcuuugauucugagugagaugggagucauaggaggggcugagcagaggaggcacaggaccaacuuacauuguuaaaauaucucugguugcuuuguggaggauggacugugggggaccagagacagagcagggagcccagugaggaggcuacugcucuaguucagguaggaagugaaaaggcagcucaaaccaagaugguagccgugggaaaggugagauguggccagauucuggauaugcuucagagaggcaaaaggaauucuggacagcuuggauguagggcaugaaauaaagagagugaagaauagcccccaagauuauucugaaaggauggaauugccauuuacccagcuggggaagacugugggaggagcaggccagcgauucaugacuucccagcccucucugaagccucaacugcagcccaagggcuccaggugagacccagcccucuuccuucccaggaaucuucaggucuuccuggggaagcauaaccuucggcaaagggagaguucccaggagcagaguucuguuguccgggcugugauccacccugacuaugaugccgccagccaugaccaggacaucaugcuguugcgccuggcacgcccagccaaacucucugaacucauccagccccuuccccuggagagggacugcucagccaacaccaccagcugccacauccugggcuggggcaagacagcagauggucaguagugggaggcugguggggagcaggcuacuggcuacuuggggaagugugccaaaggauggggagugggaaaauuggugaggggccaugggaagaugggcuaauggugaggaccaaugggacaggguuucaaugggagaaaggucaagggggagggagagugaauuugggagcugggccagugagugaacagccaauggaaaauguagaccaaugggugaauagcaugggagagauggaacauaagaugaagguucaauaaagagggaaggucaguggggagaugcuaaucaggaaggaugucaaaggucaaaggggacugaucaggauucauugaacagcaggaaggaauaauggagaaggaacugauggaagaagagaaaccaauaaagcacaaaagccaacugaaggaugugaauugagacagugaauggggguauagcugauggaagagggacuaaggggaaaggaucaaugguccagaggagucacuagaggaaaaaacagguccaauagaucagcaggauccaugaaggugggccugugugugaagggccaauaagaaaggugaaccauuggaugaagggccagugggaaggcagagacaaugggggaggaugcggcaaguuagaaaaggaccaaugagggagguggaccauuggaugaagggcuaauaggaagggagagccagugggggauggugaggccaguuagaaaaggaccaaggagggaagcagaccaauaggaagagagagccaaugagggagggcagggccaguuaggaaaggaccaaugaggaagguagaccauuggaggaagggccaauagaaagggaggauccaugagggaggguggggacaguuagaaaaggaccaaugauggagguggaccauuggaugaagaaccaauagaaaggaagaaccaaugggagagggcauggccaguuaggaaaagaccaauggucacagagugaccaaucaagaugaaucaaugggcaggaaguguccaaugaagaauggacuacugaucaggagggguacaguagaggagggcguaacagaggaagaguccuccaggucaacugaaacuacugaagaaggugggaccaguggaagagagaaaaguggaggagggaccuaagagaaaaggaaaaccaauaggaaaugaggacuccuggagaagagacuauuaaugaggaagacagccaaugggggggaagaaugauagaaagagggaccaauuaggaggcagggacgaugguaaugagauguaagaaugagagacaaacaggaagaggggugccaauagaaaagagggaccaauagaggauggaggacuuauagggguuggggggugacuggggaggaugaggggagugcaaggccugggcugagucuggcccaucucuccccuaacaggugauuucccugacaccauccagugugcauacauccaccuggugucccgugaggagugugagcaugccuacccuggccagaucacccagaacauguugugugcuggggaugagaaguacgggaaggauuccugccaggugaggugacccggaucugccacuuacacagccagggacaggacgaagucacaaaaacauggccagacacaggaagagagagacacaggccaaaagagagcuuuacagagacagauagagacaggcugagggagaacccaagccuugaaaagaagagacuuaguucaacacacagagacacagucagggauaugcagagauauaaagacacagccagcagagacaggaagugcagagacaaggauggaggccgcgggaucaagaaccagagaggccaggagcagcggcucaugccuguaaucccggcacuuugggaggccgaagcaggaggaucaccuagggucaggaguucgagaccagccugaucaacauggugaaacccuaucucuacuaaaaauacaaaaauuaggaugggcacaguggcucaugccuguaaucccagcaccuugggaggccgaagcaggaggaucaccuggggucaggaguucgagaccagccugaucaacauggugaaacccuaucucuacuaaaaauacaaaaauuaggaugggcacaguggcucaugccuguaaucccagcaccuugggaggccgaagcaggaggaucaccuggggucaggaguucgagaccagccugaucaacauggugaaacccuaucucuacuaaaaauacaaaaauuaggaugggcacaguggcucaugccuguaaucccagcaccuugggaggccgaggugggugaauaaccaggucaagagauugagaccagccuggccgauauggggaaaccucaucucuacuaaaaauacaaaaauuagcugggcgugguggcaggcgccuguagucccagcuacucaggaggcuguggcaggagaaucacuugaaccuggaggcggagguuguugcagugagucgagaucaugcuacugcacuccagccuggcaacagagcaagauuccgucucaaaaaaaaaccaaaaaacaaaaauuacgcaagcauggugggacacaccuguagucccagcuacucgggaggcugaggcuggagaauugcuuaaacccaggaggcagaggcugcagugagcugagaucacgccacugcacuccagccuggggacagagccagacucugucuaaaaacaaaaagaaccaaagagaaguaguaaggaagcagauggugugaggggacuguccuuccucaaacagagcccccacgaguccugcucagaaacgaccaggcucuggaggagggagacacuagcuggggaaaggggacucccucccgaauacuuuaacuuggguuuccuccauugucauccauccaggcucuccucuuuaugccagaaugacuaaugcacugagggaugugcagagaccaaccaagggggagacacaggcagaaacggagacacaggcagaaacagggacagagacagggaaagcgauacauagcaaguuggacgcaaagaaagggcaggugggcgagacuguccucaagacacgagguggagaggugucccuggacagaauagugccaggcauaucucucccugggcccucccuaccucucccaccugggucuuaucgucuccuccucccccuccucccccuccccauccuccucccccucuccauccuccucccccuccccauccuccucccccuccuccucccccuccuccuccccccuccucucccuccuccuccucgucuucccccuccuccuccuccuucuccucuuccuucuccucuuccuccuccucguucuccucuuccuccuccuccucuuccuccucccccuuuuccuccuccuccuuuuccuccucuucuccuccucuuccuucuccuccuccucuuccuccuccuccucuuccuccuccuccucuuccuccuccucuucuuccuccuucuucuccucuuccuccuccucuuccuccuccuccuucuccucuuccuccuccucuuccuccuccuccuccuucuccucuuccuccuccucuuccuccuccuccucuuccuccuccucuuccuccucuccuucuccucuuccuccuccuucuccucuuccuccuccucucucuccaucggucucuacaccucugccucucuccacaccucucagucuccauucuuaaauuguuucucuuucuugcucucuauguuccucugcaucuuggcauuccuaucucugugucuuugagucuccuuuauucucucucuaccauucucucucugugccuuugugugucuuacugucucucucucugucucucugucccugagucuuucucuccaucuuucaguaaguaccucugucccuuucuaccucucucucugucacacacacacacacacacacacacacacacacacacacacacacagucucuggguuucuaucuguaucugacuuucucccucuuuccugcagggugauucuggggguccgcugguauguggagaccaccuccgaggccuugugucaugggguaacauccccuguggaucaaaggagaagccaggagucuacaccaacgucugcagauacacgaacuggauccaaaaaaccauucaggccaagugacccugacaugugacaucuaccucccgaccuaccaccccacuggcugguuccagaacgucucucaccuagaccuugccuccccuccucuccugcccagcucugacccugaugcuuaauaaacgcagcgacgugaggguccugauucucccugguuuuaccccagcuccauccuugcaucacuggggaggacgugaugagugaggacuuggguccucggucuuacccccaccacuaagagaauacaggaaaaucccuucuaggcaucuccucuccccaacccuuccacacguuugauuucuuccugcagaggcccagccacgugucuggaaucccagcuccgcugcuuacugucgguguccccuugggauguaccuuucuucacugcagauuucucaccuguaagaugaagauaaggaugauacagucuccauaaggcaguggcuguuggaaagauuuaagguuucacaccuaugacauacauggaauagcaccugggccaccaugcacucaauaaagaaugaauuuuauuauga

SEQ ID NO: 193019 - RNA, 14232 nt, Homo sapiens
aagauuuauuuuuuuuuccauuuccaguuuuuuaaaguagacacagauuugcuuagaauaaagcugauuuuaaaagcacacaaaaguugaacacaaaggagaggauuaaauucaccaaugcagagugauaaagaggaaaagauacugaguaggugccuucagcagaaaacugaucauccagggugaucaccuaauaaucggagacuuaauuccuuauaaugcaaaagcaagaagaguuuaguguacgaacuguacagcugaguuuguagcucuaucuugguuucuguugauuaugaacaauuagcauaguuauauauaaucuuucuuuaguagacaaccugcauccauuuaaauuaaauaauacuuucuacaauagugugauauauaaggccacaauauuuauuuuggacaaaccccuuaaaguagcgauuuuauuaucaauguuauucauucuuuugaaauauaaaguacuucagcugaauuaagguugcagauaauuuuuaaaauacaacacacaucaugacuaguauauuaaaauuauuuauauucagauauuuauaucuaauaucaaaugaaaauuuacuaccaaauuuucacaguagacauuaaucagucugacaugcuuauugaucccauagguguaauuauagaucaacaugauuuuagugucuauucuuuuauuuuacuaaauuaggaacgcagcauuuacagaacaaauaaacacaagugacguggccaccccaggaucuaacagcucuucagugagcuauguugcaagcucagaaguaauccacuaacgaaccaagucagacuccaguucuucaucaaaaggugcugguggagguugucagacgccuuccaauauagauccuucacagaaaaauuaucaguaguuaauguaucuugugauucacaggagacuguguuacagcugaaacaggguagcucacugugguuagagcuuaugcaaggggacuggugauuuuauacccauuauaaaaauuuuguaaugaaucuaucugugaucuuuuaucuaguguuuuaucaauauguauuuuguauuaauuaacuuagaaaacaucagaucguauucuuacauagaaggaucaccaaaccgaaugcuguuuccacacagaaagcuucugcuuuguuccaacucagugcugggggaagucaccuaccagggcaagaugguguugcuaguucaucaccaccagccucaccaaagccaacugcuuaaaaaugaagccccugcccucaugugguuuaaguuugguagugggagagaugucccaaacuaaagaugcaggagugucagaaaaggcuuuucggcaauagagaggcucgcuccagcugaccagcgggcaucacucccggagggaggaggaugggucuccaggaaagggcagaaucggaagccuggcuggccuggccugugggcggugguguggugggcacugugagcgcagacagugcugcagcagcuuucggggcagauuuuaucgugugguucugaaaagcagcugagggggugugggucgccaguggcagcaucaggcucugaaaacccgggcaggacgaaggacaguagcugggaaguaguggcugcagaaauccauccugaaacgaagggcuuaaaccuuguauuuaaaaugaggaucccgaggccuugcccccagagucugcuugacaguucuggaaaaggcuccagaaagcaaacugccuggugaugcugaugcagucuguaggucugacucccaaaagcaccagcagaaaugaaggugacggguuaugggggggacgugagaaugugcccaagagcuaggagaaagccacgcacacgggagggcgagguggagacacgggcagcgcucaggucccggcccaggaaacucaguggcuuuuaucccguuuccuucaaccccagaugugagcccucuggccaaccuaccuaacccaccugcccccaguggcauuccggucuuuccagucuguccaacacacggcagccacagaacacugucugcacgccaggacuagagcccuccuccccgcugagaggcugggaccagcccgaggaggagccguuuuggcuucccgcucuggcucuucaccaccgcugcggcgaacgcucuucagaacccacagcggcgccugccuggucucuguguuuucugcagggugagugaguauaagcagccaggaaaggccaggcgcgguggcucacgccuguaaucccagcacuuuggaggccgaggugagccaucccuugaguucgagaucagccugggcaacguggcgaagccccgucucuauuaaaaauacaaaaauuagccaggccugguggugggcaccuguaaucccagcuacccaggaggcugaggcaggagagucgcuugaacccaggaggcagaggcugcagugagccgagaucacgccccugcacucagccugggcaacaagagcgaaacucaagccaguaaagucggagacugcauugguuccuucauugcugagaguuacuagaacaacaguccugucuggaggaaguacagcagguaacugagacccuccaccuacagcagagcugggugcauucccgccacaguacuacacagaaaugagacugcuuucaccuacacacaggacaaagaggucagaccuaagaagcccugcuuugacuccguuuauauucagugagcaacaggcagacucgucaggccagacagcagcaccacagggcgccugugcuggggccuuugggggcugcaggcuggugguuucuggaccugaacagugacuacguggguguuugugaaaaugcaccaagcuguaacugaugaucuggacuucaggaaacagguuacgaauaaaucacugcaacccagaaucgccccacgacaugccaugacaggagucacacagucacaucaccuaccccaauccgauggccagcaaaugagagagcagcagagauggaaggaaaacuuucagaaauucugcagagaauaugcccccuuucuucaugacgcucguguuccucaugcugaggguggccgugcgcuucggguguuuaaagaggaacucccugaggcgggaagaaacgugucagcugauguguccucugucaaggggugcccccgugacacugagaacacacucacuuggggggaauauuuuccggccgacuugaccaaucccauauccaaucugaguuuuucuucaagaugcuuucaacuucuuuccuucuuucaauaucaucuuccucagacuaagauaaagucaauguuaaaggcagaucaguguaccacacgugacacgggaaagcacccagcucccacccgagcuucagauccgcaggcucaauucaagagcccagaggcacaugucagugccucggaccgugguccaaggggaguccuggggcugggggccuuccccgggccgcgccgcacucccggcucacagcacgcucgccgccuccagggacagaucaccucugggggagccccacucagggcguaaauacauuugguucacugugagauucuggggguacugacagcggcaaacacuguccuagggaagucacgugacaugagggcaaagauggugacggcagcacugguuauaagaaaagaaaaugaaaacagccgaaaacggcucaaaacagggacaugacgaaggaagggacacuguauagugagcagguuuacaagaugcuuccgggauaagcaggagggaaaaggcagaaauguccacauaaccacagcugcggccaaauccucagaauuauauaacagcacgaaacauuaaagaggauuuuaaaucugagagucuaaguguuuuucucuacuuuuuugcauuuucaaaauucuguaccugaacaucuaauuccuuuuaaaacuaggggaaguuuuguguaaaacagugaaaacggcaagacccugucucaaaaaaaaagaaauaaaauugaaaauacucaagaauauagcuccccaaacccaccaaacaucuggguacacccaagcuggguacagccccaagugcccaggagcaggccgcacgcccuggaugcacccacacacccacagccagggcuccuggggcucccgaaaucaugcugccccucggaguggggccaggggaugucccugagaaagccuggguaacagggacuccuuguuuccuuggugaagaaagccuugagggaagcgcuagcacggaagggucagcuacuaacccugccuggaaggccaugcuuccucacagagcuuccaaaauacagaacacaguccgucgucaaaguucucaccagcaacgaacacccaagaaaacacaucgcgcaucucaucugcagcaagguaaggcacugccagauauaacugagcaagacaguacugaucacugccucgaacccuaucugugccggaguaggaagggagaacgauaguacaccaaggcaauaaccccagguacacuuuuuccucuaagacucacuccgcuuucacaacaaugcugaaggccgcucuguaaagcccauucaauagcuguuaacagaaaagucaucuuaggcuggacacaguaucucacaccuauagucccaguauuuugggaggaucacuugagcccuggaguucaagaccacccugggcaacacagggagaccccgucucuacaaaaaaaacuuuuuuaaaaaagaagaaaaagugaucuuacacuaaauuaucaggcugaucagccgcuaaugcuacacugcuccggcaccaguuagcucaggacuaaugcuaggaaaggcacaggguguaauuuccggcagguagugagugucuaaugaggaagacaccucagagucacagccacaguggccacauggccuuagauggccccguggguaacuccugagucccacacagcaugcaaauauuaaaacccacucacuguccaaccagcaaccacgaggaaagaccagccaguagcuggcucacugccaccccuuccaauggucccucccuccucucuaggcugcagccaccagggagcccuuccuccuuuccgguguaucccugauggcaggcagggagggacaggaggcccccgcugccugucccacucggcgccucccccgcucagcugaguguccagcccaugugcuuguggauguucccacccacaguuucuugguuuuuuuguuucgcuuuuuuguuuuuuuuaaagcaggaaacacccuuaaagcccgacuuuucucugaggugcucaauuacauuuaaaaccguuuccuguacaaacagaucacaaauacuuuuacaacugcacauucuccuuccagcuuaccugugagcuguuuuucucuccaaugcuauggguaucuguuucagaagcucuguugguaucuuguggugucugcgagcgaggugggcuuggcgaugugaauagaaugggaaaaacagaacaucaugugaacauucuaucauuagaagcucaaaccccaaaggcagugaaccgccuccgugaugaggggcucuagccagucagcguacgcgucuucccuuccacccagcaccugccagagccaaacucuuccucagcccuuuuggcugagcacgacaggagugagcuagccagucuuccagagaagacgcaggggcaacuggcaagcagcuggcuuugucaccugccgccuucacggucugggucuguugcacagcucucaagggcacgcgaccuuugaccacugucggccacucuaccuuggagucacucagaaguacugcuaaccagggaccgcuccuccugcgaccacagccccgcugaggcgcgugagugcguuucucagagugggguuuguggcuguuccgcugccuacugaugacuugaacauggcuccccacagacuaagucccaggucacugcauccccaaagagggcgaggcuccuauauaaggacggacugcagcaggagccaguccagaacgcggcccgaggcgaacagcagcccacuguccuagaggugacacgggcacuuccagcugugacugucacccacugaagacaucggcacuguaacacauacacuuguugaugcgcgccuaccugucacagugagagcucuuggagcuacuccguccagacucaugcugugcguccagcaguauuuuuuccaugucuccauuauaaauagaaaccgaggcuggaacgcugcccccguucccauuauugcugaagugcaguucuacccaggagccugauggggacaaaaaaaggggcgcagauggaauucucuacccacucuggaaucugcucuugauaucuaaccagccugcccuuccauuuccaagagguagcaauggugccacaccaggaaccaucccucaaccccgacuugaagacaucccucugcccacucucauggcagugacuguccacgcacacacucccuggguacaggaaggaagcccccuggggcugagaccauguaucuguccagcucuugcagucccuuuauaccaagccaauguccaauaacucugcugagucaacagaauccaauuagaauacuuccuugcagugagcuuuuauaagaaaaaggcuauuauuuggaaaaagaggucuuuaaaaaaaacaacaacaacacuaaugucaacauaagcuuaagggauuugaaguuuucuuuaaaagguuuaagcucuauuuuuuguuucuuuucgagacggagucucgcuuugucacccaggcuggggugcaguggcacgaugaaggcucacuauaaucucaaacuccuggguucaggccauccucuagcugacaccuccggaauaacuggaacuacaggcaugcaccacuacuccuggcuauuuuuuuuaggagauggggucucgcuauauugcccaggcuagucucgaacuucugggcccaagcaguccucucaccucagcuucccagugugcugggauuacaggcgugagccaccaugcccagccucuaugacuugcaucguguggcuuacuuugcauuuauauaauuucuaacgagguugaagacgguuuuacaaguuugcuagccaucuggauagcaucuuuuuugaacugguucuucgaaucucuuauucuuuucuauuaucugucuuucucuuauuugugggcauccagcaguauuuuuuccaugucaccauuauaaauagaaacugaggcuggaacgcugcucccguucccuuacugcuaaaagugcaauucugggauaauucuguauucuagauauauguuuuucugcauuuaaauauguugcaaguaacuuucccucgguagcuuguucuuuucacuucugaugucuucugauguacagaaguucuugauuuuaauucagucaaaugcagcaaucccuuccugagcugagauauucuauucuauuauuuucacacagcucuacuguuaugacagucacauuuagauccaaaaucuacauggauuaauuuucccauugaugugagacggaugccccauuuacugcagacagcucccgccucacucugcgcuggcugcuuccugugucagaaaucaagcgugcauauaggcacacgucuauuucugggccccagauaaucucucuacuuugugucauagguuuauuuauuuaaagcaaaucugguaggagcuuccucugguagcguauggaggauggagugcagugggaggaaagugcaggccacaaaagacagggaaacuuauggacgagaacaauggaauuaucucauuuuugcagucacuauaauuuuaguaagcagaauaaucacccugagcugcugacuguccuuaaaccaacacagcacuaauaacaccaugcaauuagggggaaaggagcagccucuucauccgucauguucgcuggaagcaaaggcaggugcacagcuuuccacacacacgaggcaucucuccugaaagagggcuggccuaggcuccauacgccacuuguugcagagucuauuucauauuaaccagaaaaaagcaaaccgaaggcccaggaaggaaaaguggauuugcaacuuaugccaucaacagucucccaguaagcugcuaacgaaaugaucacacaaauuuucaaaugaacgcaugauuguucucuuuggccucucacguugccucauguccuggccuacacgaagcacaucccuaauacaaaggcaagccagggucugucucggagccuggagcucaauggaggagaaaggcccaggccagucugccccacacucuggcagaggcuacauggugccuucugagauguacagaccacaccauuccugaagccgcucaucugaccagacaguauugccaaguacucugauguucacuagcccuccuucccucucugcgguucaagaugccaugcggccggcuagccauggccugccccugagagaacggcaccacagccucuguuuuggccagcugucuuucuccgcugaaucuacaguauucagauucugggccugcuucaauuuacuugacuaaaguguuguucagcuaucugacgauauggaacacaaaugcaacuugaagguguggugucucuucucugaugccacucuuaacaucaaaugugggacaccaagucaccaccaccgggguguccaacgauucaauuccauucuaucuaccuagacuuaguguggagcccacaagacuguucccacagaugcaagcagagaaugggguguccagguuacccguauuucugccagugccucuaccuacucaggggaucccacacaccugccucagguucaguaauuuacuacaauucacagaacucagaaaaacucuuuacuuacauuuaucaguuuaccagaaacaauuccagggcagacaaauggaaaugacauacagcccagauccccaccuaccccacacgucccaacccuaaccccaaccacacucucugcaaccagacucccacuuaccccacaugucccaacccuaaccccaaccaugcuacccgcaccucauggcucccccaucuccaucuccaguccccuccccuccuaggaggggcugcccugggaauuucuaccucaaguaacuauccuggggccacccuugagccacuguauuagcaguguauucugaaggggcuccuuacaacuuacaccaaaaaugguuaaccaaggagcacuuuuggaguacacugcuaauagggugacuuuaugaauaacgcacacacuggucagguuguucugccuauggagucaccaucuuuuuacuguuuuacuuucuuuaauaaacaugcuuaagacacuuauuggcacagcgguucaugccuguaaucccagcacuuugggaggccgaggcgggcagaucaucugaggucaggagucagagaccagccugaccaacauggugaaaccccgucucuacuaaaaauacaaaauuagcugggcguggugggcgccuguaaucccagcuacucgggaagcugaggcagaagaaucccuugaaccugagagggggagguugcagugagccgagaucaugccacugccccccagccugggcaacaauagcgaaacucugugucucaaacaaaaaaaaaagacacugcucaggaagccccagggguuuaggugcucugcaccaggaaguagguagggucaagaccaaacacauacuguaaucuaucacacaaggggcaggcugaagacaacagggagaggaagaugaaggagagacaaguguaucucugucauccucugcgcuacugcaacagaaucccacagacuuagugauuuacgaacagaaacugaucucuguucuggaggcugggaaguccaagauccacgcaccaacaucuggugucggcugagggccuuccugccucaucccuucaaugaggcuacagagggacccaccucccuccauccagccccuuagagcacuaaucccauucacuagagaggagccccuauggccgagccaccucuuaaaggcccaccuuuuacuaccaucccacuggcaacauggaggaacacauucgaaccaaagcagugcuuuuuaaacaucaccccagaaaggaccuaaaaauccaggaaacaaggaaaaaaaacucacuccagauuguccauggcuaaugacuuugggcccaaaagcuguauucccaggaaugauuuacuaagggacaggaguuuuauuauuaacccacagcaaccgcguaggaaaggaaggcacuuccuggagaauggagcgugcuguguaucuacucacguguuacaguucuccacucggaucguucaccuuuucaaagaaagaugggcuuacaguaagguugcuuaauaaccuuagaaaacuugcucauaaucacaagcaguuuacacuucaaaucacuguaguauaauuaggccccagacggaaaggugcugcuguugcugcugcaagaaaagcccuccuuccuaaucucauuucgcgucccucucauguuccucccccuccucacucacuuauaauuuacauugcuaacaagacacacagccaguaaaucuuaccucccuccuauaucaagguagaugagauuuugaaaagccuagacuauaaauauuuauaucacaguacaaaaagaaaacugauaggucugccucagagacaaaauacaguccaacaagaguucuuaauccauuucuuauucucacuuuguguaaaaaaaaaaaaaaaaaaucaucugacauccagcuuuucuaggugcccaaagcaguucucccuccagugacagacuccagggaaucccuucgauucacugcccucuguaugucccagggcaacucccugggucccauuccucaacauggauucaugggccacagccacgagccccacguggaguaaacacagggccaaguucucaaggccacccuaugcccuaaccuggggugacaaccucaacucuggcuaugaagggagaaucaccugugguguuuuuucauuguucuccaaaagccuagccucagcccacucugaaagugacuauuugggaugcugggguggaauccaggcaaauagauugaaaaagcucugggauaaaugucagaacagagggaggcagcaucccagaaaaaaaaccugaagcagaggagcugugaacccccgagggaacuagcaccccaaaaccauacaaagggcuucuuccccaggggaggugggcucuaagaaauugcuguuuuaccuuuaaagcuucucagguuaguggggagagaacaaaagagacccgccugacaaaagauuucaaguaucaagucagcuggguagguaaaucaggucccuggcuuccaacggggcucguuucccuccaccuuccuguugccuccaggaccucuggccuccucuccuccaggacccuccagggccuauugcacgcagccucaggcaucugggcuccagguaucccacugcugccucaugcagagaccuuggcuucuccuuaaguguuguugccagccuuaucuuucacuccaccucuagaaccucauugugaccaucuaugaaaugcaagucuuggacgagaaucucgaugucugcaaccccuucaggucucaaagcacacaaugcuacaacuccacuccaaaauaaguagaaaacaucuuuuccccucauacaacuuugcccauggugaguugccucugacaagagagagaaccaucugccaguugcagacacagcagugggugaagaggugagggcuuggauuauuaaacacggcccuccagaguaaaugggcaugcacuuuacugaacugaugcccuccuggugaagacaguggguccuucaaggaagugaugcccccgccaccgugacacggucucgucacagaauccuaccucuccugcauguuagcagugacaugucuaggagaaaagggccaaguucauggcuacagugagcuauaaugauugugcuacugcacuccagccugggggaguaagacugggcuuguaaaaaaaaggaaaaggacaaauacgagcauccugcgagucaacaacuuuagcuagaaugaucaagagauagaaaggaacagaaucagcccauuuugccauuaacucuuuaggaaaagcaguuggccccagaggguacacucagaggagagagugcuugcugcuuccauccgugggucuggcugcaaggcucccauuguucucuguuccgaggucaacaaggggcagugaaaucggacaggcagaggugagcgcugccugagccaccgcuccgucccggauuugcaggcagcuggagcccgcgggaccggccaaccccgcccacgccgagcccacaguggccccguccugccgcgcggacacucagggcggcccaaggaaucgccuacaugggauccaccccgcggguaacuaucuuuuuauagaauaaacaaaacagaaaaacaaaaaucucguaacuccggcgcuggccgccuugcacugccaaugacucagcagccuguguaaguuacauauuggagagaggaccgagccccccggagcccccuccaccucccagcgcccagaucccagccggacagugaaacgcacaaugucaggaguaacgcggcuucacaaccggaaaaugggugauuuuauggcaaagaguuuauaaaaacaucccuuggacuuuauuuuaugacaaaagauaggaaaacaccucuuaaucuauuucaaaauaguaauuagccaauguuuaaauuucaagaggaaaaauccgaauuacaggauuuuaaagaauaugguuuuaggccaggcgcgccugguggcucaggccuauaaucccagcacuuugggaggccgaggcgggaggaucgcuugagcccaguucagaccagccugggcaacacagugagaccccgucucuuaaaaaaaaaaaaagguaaaaaaaaaaagcuuguaguguucauauguauauauauauauuauucaauauauuacgguaacuaaguccugccuaguaaaaucuuuuuuuuuguaauaaaauuagcaacucacuaaauuuaugugaauauaugguuuuaaaaacucucaaugaagauuaaaaguucacugucagagguuucagcaguccuuucccaagcuuauuuacaugcuaauuuugcuuaguaaacucuggcuucaaagaacacaaaggucagcugccaccaggucccuccuccgaggcuuuggcccuagggacccugggaaggcggcuucagugcccgcuucccugagcaaaggcucgucuggacucugacgcggacccaccggguggggugggucuccacgccacccggcugugcguggggcaaguccugcaccccgggccugcguuucccgcugcgugaacggauggucuugcgaaucuagccaagggcacacagcgagccucuacucgggcauuaggcaggcuguaacgacugagugcugcacgggcagcguccuuuugcuuguguuuucuuaacccguaagucauuuaaagcuuuguuuuggaacgacccucuagugaaauuggaacaugcccauuuaaugccauauuuuaaaaacgcuguaacccccucccaucuccgcguucacccuugaggaaauccuaacagucaccauggauauaaacauuaauaacaaaauuaaagcucauaacaggccacuugccacgccuugguguuuggucauuaaaaccaauacuggucugaacuacagaccgcggagggcaacguggacuuugaggcuguucgguccaacugcgagacgcagauucaccuccagguggaauucuagcucgcgcggagcuggagaaucggggcuuucccgugcgguccgacccggguccaagccaacccccgcccgaguggcgaggccgcgaaccccgggcaguacgcgggguccccacgccccgggcuccgcaugcccgcaggagggguggguacggaaggggaggauggcgcagccucgcccggcccgcgaugcccccuaggccuccccggcaaccuccccuuggcgcccucuuggccuuccccaggcuucccccccgcgcccccucggcucccgcgccgccuccuccgccucacccugcaggcucuccuccugcaucccgggcgcuccguucugcgacauggcgccagagggcaacugcggcgaucggaguccgcgccgggcugcgggaugugcuucagcugcgggcggugggaaagcggaggucggagcgccgcggcccagcugcgcucccggacugagcggag

SEQ ID NO: 193020 - RNA, 14232 nt, Homo sapiens
cuccgcucaguccgggagcgcagcugggccgcggcgcuccgaccuccgcuuucccaccgcccgcagcugaagcacaucccgcagcccggcgcggacuccgaucgccgcaguugcccucuggcgccaugucgcagaacggagcgcccgggaugcaggaggagagccugcagggugaggcggaggaggcggcgcgggagccgagggggcgcgggggggaagccuggggaaggccaagagggcgccaaggggagguugccggggaggccuagggggcaucgcgggccgggcgaggcugcgccauccuccccuuccguacccaccccuccugcgggcaugcggagcccggggcguggggaccccgcguacugcccgggguucgcggccucgccacucgggcggggguuggcuuggacccgggucggaccgcacgggaaagccccgauucuccagcuccgcgcgagcuagaauuccaccuggaggugaaucugcgucucgcaguuggaccgaacagccucaaaguccacguugcccuccgcggucuguaguucagaccaguauugguuuuaaugaccaaacaccaaggcguggcaaguggccuguuaugagcuuuaauuuuguuauuaauguuuauauccauggugacuguuaggauuuccucaagggugaacgcggagaugggaggggguuacagcguuuuuaaaauauggcauuaaaugggcauguuccaauuucacuagagggucguuccaaaacaaagcuuuaaaugacuuacggguuaagaaaacacaagcaaaaggacgcugcccgugcagcacucagucguuacagccugccuaaugcccgaguagaggcucgcugugugcccuuggcuagauucgcaagaccauccguucacgcagcgggaaacgcaggcccggggugcaggacuugccccacgcacagccggguggcguggagacccaccccacccgguggguccgcgucagaguccagacgagccuuugcucagggaagcgggcacugaagccgccuucccagggucccuagggccaaagccucggaggagggaccugguggcagcugaccuuuguguucuuugaagccagaguuuacuaagcaaaauuagcauguaaauaagcuugggaaaggacugcugaaaccucugacagugaacuuuuaaucuucauugagaguuuuuaaaaccauauauucacauaaauuuagugaguugcuaauuuuauuacaaaaaaaaagauuuuacuaggcaggacuuaguuaccguaauauauugaauaauauauauauauacauaugaacacuacaagcuuuuuuuuuuuaccuuuuuuuuuuuuuaagagacggggucucacuguguugcccaggcuggucugaacugggcucaagcgauccucccgccucggccucccaaagugcugggauuauaggccugagccaccaggcgcgccuggccuaaaaccauauucuuuaaaauccuguaauucggauuuuuccucuugaaauuuaaacauuggcuaauuacuauuuugaaauagauuaagagguguuuuccuaucuuuugucauaaaauaaaguccaagggauguuuuuauaaacucuuugccauaaaaucacccauuuuccgguugugaagccgcguuacuccugacauugugcguuucacuguccggcugggaucugggcgcugggagguggagggggcuccggggggcucgguccucucuccaauauguaacuuacacaggcugcugagucauuggcagugcaaggcggccagcgccggaguuacgagauuuuuguuuuucuguuuuguuuauucuauaaaaagauaguuacccgcgggguggaucccauguaggcgauuccuugggccgcccugaguguccgcgcggcaggacggggccacugugggcucggcgugggcgggguuggccggucccgcgggcuccagcugccugcaaauccgggacggagcgguggcucaggcagcgcucaccucugccuguccgauuucacugccccuuguugaccucggaacagagaacaaugggagccuugcagccagacccacggauggaagcagcaagcacucucuccucugaguguacccucuggggccaacugcuuuuccuaaagaguuaauggcaaaaugggcugauucuguuccuuucuaucucuugaucauucuagcuaaaguuguugacucgcaggaugcucguauuuguccuuuuccuuuuuuuuacaagcccagucuuacucccccaggcuggagugcaguagcacaaucauuauagcucacuguagccaugaacuuggcccuuuucuccuagacaugucacugcuaacaugcaggagagguaggauucugugacgagaccgugucacgguggcgggggcaucacuuccuugaaggacccacugucuucaccaggagggcaucaguucaguaaagugcaugcccauuuacucuggagggccguguuuaauaauccaagcccucaccucuucacccacugcugugucugcaacuggcagaugguucucucucuugucagaggcaacucaccaugggcaaaguuguaugaggggaaaagauguuuucuacuuauuuuggaguggaguuguagcauugugugcuuugagaccugaagggguugcagacaucgagauucucguccaagacuugcauuucauagauggucacaaugagguucuagagguggagugaaagauaaggcuggcaacaacacuuaaggagaagccaaggucucugcaugaggcagcagugggauaccuggagcccagaugccugaggcugcgugcaauaggcccuggaggguccuggaggagaggaggccagagguccuggaggcaacaggaagguggagggaaacgagccccguuggaagccagggaccugauuuaccuacccagcugacuugauacuugaaaucuuuugucaggcgggucucuuuuguucucuccccacuaaccugagaagcuuuaaagguaaaacagcaauuucuuagagcccaccuccccuggggaagaagcccuuuguaugguuuuggggugcuaguucccucggggguucacagcuccucugcuucagguuuuuuuucugggaugcugccucccucuguucugacauuuaucccagagcuuuuucaaucuauuugccuggauuccaccccagcaucccaaauagucacuuucagagugggcugaggcuaggcuuuuggagaacaaugaaaaaacaccacaggugauucucccuucauagccagaguugagguugucaccccagguuagggcauaggguggccuugagaacuuggcccuguguuuacuccacguggggcucguggcuguggcccaugaauccauguugaggaaugggacccagggaguugcccugggacauacagagggcagugaaucgaagggauucccuggagucugucacuggagggagaacugcuuugggcaccuagaaaagcuggaugucagaugauuuuuuuuuuuuuuuuuuacacaaagugagaauaagaaauggauuaagaacucuuguuggacuguauuuugucucugaggcagaccuaucaguuuucuuuuuguacugugauauaaauauuuauagucuaggcuuuucaaaaucucaucuaccuugauauaggagggagguaagauuuacuggcugugugucuuguuagcaauguaaauuauaagugagugaggagggggaggaacaugagagggacgcgaaaugagauuaggaaggagggcuuuucuugcagcagcaacagcagcaccuuuccgucuggggccuaauuauacuacagugauuugaaguguaaacugcuugugauuaugagcaaguuuucuaagguuauuaagcaaccuuacuguaagcccaucuuucuuugaaaaggugaacgauccgaguggagaacuguaacacgugaguagauacacagcacgcuccauucuccaggaagugccuuccuuuccuacgcgguugcuguggguuaauaauaaaacuccugucccuuaguaaaucauuccugggaauacagcuuuugggcccaaagucauuagccauggacaaucuggagugaguuuuuuuuccuuguuuccuggauuuuuagguccuuucuggggugauguuuaaaaagcacugcuuugguucgaauguguuccuccauguugccagugggaugguaguaaaaggugggccuuuaagagguggcucggccauaggggcuccucucuagugaaugggauuagugcucuaaggggcuggauggagggaggugggucccucuguagccucauugaagggaugaggcaggaaggcccucagccgacaccagauguuggugcguggaucuuggacuucccagccuccagaacagagaucaguuucuguucguaaaucacuaagucugugggauucuguugcaguagcgcagaggaugacagagauacacuugucucuccuucaucuuccucucccuguugucuucagccugccccuugugugauagauuacaguauguguuuggucuugacccuaccuacuuccuggugcagagcaccuaaaccccuggggcuuccugagcagugucuuuuuuuuuuguuugagacacagaguuucgcuauuguugcccaggcuggggggcaguggcaugaucucggcucacugcaaccucccccucucagguucaagggauucuucugccucagcuucccgaguagcugggauuacaggcgcccaccacgcccagcuaauuuuguauuuuuaguagagacgggguuucaccauguuggucaggcuggucucugacuccugaccucagaugaucugcccgccucggccucccaaagugcugggauuacaggcaugaaccgcugugccaauaagugucuuaagcauguuuauuaaagaaaguaaaacaguaaaaagauggugacuccauaggcagaacaaccugaccagugugugcguuauucauaaagucacccuauuagcaguguacuccaaaagugcuccuugguuaaccauuuuugguguaaguuguaaggagccccuucagaauacacugcuaauacaguggcucaaggguggccccaggauaguuacuugagguagaaauucccagggcagccccuccuaggaggggaggggacuggagauggagaugggggagccaugaggugcggguagcaugguugggguuaggguugggacaugugggguaagugggagucugguugcagagagugugguugggguuaggguugggacgugugggguagguggggaucugggcuguaugucauuuccauuugucugcccuggaauuguuucugguaaacugauaaauguaaguaaagaguuuuucugaguucugugaauuguaguaaauuacugaaccugaggcaggugugugggauccccugaguagguagaggcacuggcagaaauacggguaaccuggacaccccauucucugcuugcaucugugggaacagucuugugggcuccacacuaagucuagguagauagaauggaauugaaucguuggacaccccggugguggugacuuggugucccacauuugauguuaagaguggcaucagagaagagacaccacaccuucaaguugcauuuguguuccauaucgucagauagcugaacaacacuuuagucaaguaaauugaagcaggcccagaaucugaauacuguagauucagcggagaaagacagcuggccaaaacagaggcuguggugccguucucucaggggcaggccauggcuagccggccgcauggcaucuugaaccgcagagagggaaggagggcuagugaacaucagaguacuuggcaauacugucuggucagaugagcggcuucaggaaugguguggucuguacaucucagaaggcaccauguagccucugccagaguguggggcagacuggccugggccuuucuccuccauugagcuccaggcuccgagacagacccuggcuugccuuuguauuagggaugugcuucguguaggccaggacaugaggcaacgugagaggccaaagagaacaaucaugcguucauuugaaaauuugugugaucauuucguuagcagcuuacugggagacuguugauggcauaaguugcaaauccacuuuuccuuccugggccuucgguuugcuuuuuucugguuaauaugaaauagacucugcaacaaguggcguauggagccuaggccagcccucuuucaggagagaugccucguguguguggaaagcugugcaccugccuuugcuuccagcgaacaugacggaugaagaggcugcuccuuucccccuaauugcaugguguuauuagugcuguguugguuuaaggacagucagcagcucagggugauuauucugcuuacuaaaauuauagugacugcaaaaaugagauaauuccauuguucucguccauaaguuucccugucuuuuguggccugcacuuuccucccacugcacuccauccuccauacgcuaccagaggaagcuccuaccagauuugcuuuaaauaaauaaaccuaugacacaaaguagagagauuaucuggggcccagaaauagacgugugccuauaugcacgcuugauuucugacacaggaagcagccagcgcagagugaggcgggagcugucugcaguaaauggggcauccgucucacaucaaugggaaaauuaauccauguagauuuuggaucuaaaugugacugucauaacaguagagcugugugaaaauaauagaauagaauaucucagcucaggaagggauugcugcauuugacugaauuaaaaucaagaacuucuguacaucagaagacaucagaagugaaaagaacaagcuaccgagggaaaguuacuugcaacauauuuaaaugcagaaaaacauauaucuagaauacagaauuaucccagaauugcacuuuuagcaguaagggaacgggagcagcguuccagccucaguuucuauuuauaauggugacauggaaaaaauacugcuggaugcccacaaauaagagaaagacagauaauagaaaagaauaagagauucgaagaaccaguucaaaaaagaugcuauccagauggcuagcaaacuuguaaaaccgucuucaaccucguuagaaauuauauaaaugcaaaguaagccacacgaugcaagucauagaggcugggcaugguggcucacgccuguaaucccagcacacugggaagcugaggugagaggacugcuugggcccagaaguucgagacuagccugggcaauauagcgagaccccaucuccuaaaaaaaauagccaggaguaguggugcaugccuguaguuccaguuauuccggaggugucagcuagaggauggccugaacccaggaguuugagauuauagugagccuucaucgugccacugcaccccagccugggugacaaagcgagacuccgucucgaaaagaaacaaaaaauagagcuuaaaccuuuuaaagaaaacuucaaaucccuuaagcuuauguugacauuaguguuguuguuguuuuuuuuaaagaccucuuuuuccaaauaauagccuuuuucuuauaaaagcucacugcaaggaaguauucuaauuggauucuguugacucagcagaguuauuggacauuggcuugguauaaagggacugcaagagcuggacagauacauggucucagccccagggggcuuccuuccuguacccagggagugugugcguggacagucacugccaugagagugggcagagggaugucuucaagucgggguugagggaugguuccugguguggcaccauugcuaccucuuggaaauggaagggcaggcugguuagauaucaagagcagauuccagaguggguagagaauuccaucugcgccccuuuuuuuguccccaucaggcuccuggguagaacugcacuucagcaauaaugggaacgggggcagcguuccagccucgguuucuauuuauaauggagacauggaaaaaauacugcuggacgcacagcaugagucuggacggaguagcuccaagagcucucacugugacagguaggcgcgcaucaacaaguguauguguuacagugccgaugucuucagugggugacagucacagcuggaagugcccgugucaccucuaggacagugggcugcuguucgccucgggccgcguucuggacuggcuccugcugcaguccguccuuauauaggagccucgcccucuuuggggaugcagugaccugggacuuagucuguggggagccauguucaagucaucaguaggcagcggaacagccacaaaccccacucugagaaacgcacucacgcgccucagcggggcuguggucgcaggaggagcggucccugguuagcaguacuucugagugacuccaagguagaguggccgacaguggucaaaggucgcgugcccuugagagcugugcaacagacccagaccgugaaggcggcaggugacaaagccagcugcuugccaguugccccugcgucuucucuggaagacuggcuagcucacuccugucgugcucagccaaaagggcugaggaagaguuuggcucuggcaggugcuggguggaagggaagacgcguacgcugacuggcuagagccccucaucacggaggcgguucacugccuuugggguuugagcuucuaaugauagaauguucacaugauguucuguuuuucccauucuauucacaucgccaagcccaccucgcucgcagacaccacaagauaccaacagagcuucugaaacagauacccauagcauuggagagaaaaacagcucacagguaagcuggaaggagaaugugcaguuguaaaaguauuugugaucuguuuguacaggaaacgguuuuaaauguaauugagcaccucagagaaaagucgggcuuuaaggguguuuccugcuuuaaaaaaaacaaaaaagcgaaacaaaaaaaccaagaaacugugggugggaacauccacaagcacaugggcuggacacucagcugagcgggggaggcgccgagugggacaggcagcgggggccuccugucccucccugccugccaucagggauacaccggaaaggaggaagggcucccugguggcugcagccuagagaggagggagggaccauuggaagggguggcagugagccagcuacuggcuggucuuuccucgugguugcugguuggacagugaguggguuuuaauauuugcaugcugugugggacucaggaguuacccacggggccaucuaaggccauguggccacuguggcugugacucugaggugucuuccucauuagacacucacuaccugccggaaauuacacccugugccuuuccuagcauuaguccugagcuaacuggugccggagcaguguagcauuagcggcugaucagccugauaauuuaguguaagaucacuuuuucuucuuuuuuaaaaaaguuuuuuuuguagagacggggucucccuguguugcccaggguggucuugaacuccagggcucaagugauccucccaaaauacugggacuauaggugugagauacuguguccagccuaagaugacuuuucuguuaacagcuauugaaugggcuuuacagagcggccuucagcauuguugugaaagcggagugagucuuagaggaaaaaguguaccugggguuauugccuugguguacuaucguucucccuuccuacuccggcacagauaggguucgaggcagugaucaguacugucuugcucaguuauaucuggcagugccuuaccuugcugcagaugagaugcgcgauguguuuucuuggguguucguugcuggugagaacuuugacgacggacuguguucuguauuuuggaagcucugugaggaagcauggccuuccaggcaggguuaguagcugacccuuccgugcuagcgcuucccucaaggcuuucuucaccaaggaaacaaggagucccuguuacccaggcuuucucagggacauccccuggccccacuccgaggggcagcaugauuucgggagccccaggagcccuggcugugggugugugggugcauccagggcgugcggccugcuccugggcacuuggggcuguacccagcuuggguguacccagauguuugguggguuuggggagcuauauucuugaguauuuucaauuuuauuucuuuuuuuuugagacagggucuugccguuuucacuguuuuacacaaaacuuccccuaguuuuaaaaggaauuagauguucagguacagaauuuugaaaaugcaaaaaaguagagaaaaacacuuagacucucagauuuaaaauccucuuuaauguuucgugcuguuauauaauucugaggauuuggccgcagcugugguuauguggacauuucugccuuuucccuccugcuuaucccggaagcaucuuguaaaccugcucacuauacagugucccuuccuucgucaugucccuguuuugagccguuuucggcuguuuucauuuucuuuucuuauaaccagugcugccgucaccaucuuugcccucaugucacgugacuucccuaggacaguguuugccgcugucaguacccccagaaucucacagugaaccaaauguauuuacgcccugaguggggcucccccagaggugaucugucccuggaggcggcgagcgugcugugagccgggagugcggcgcggcccggggaaggcccccagccccaggacuccccuuggaccacgguccgaggcacugacaugugccucugggcucuugaauugagccugcggaucugaagcucgggugggagcugggugcuuucccgugucacgugugguacacugaucugccuuuaacauugacuuuaucuuagucugaggaagaugauauugaaagaaggaaagaaguugaaagcaucuugaagaaaaacucagauuggauaugggauuggucaagucggccggaaaauauuccccccaagugaguguguucucagugucacgggggcaccccuugacagaggacacaucagcugacacguuucuucccgccucagggaguuccucuuuaaacacccgaagcgcacggccacccucagcaugaggaacacgagcgucaugaagaaagggggcauauucucugcagaauuucugaaaguuuuccuuccaucucugcugcucucucauuugcuggccaucggauugggguaggugaugugacugugugacuccugucauggcaugucguggggcgauucuggguugcagugauuuauucguaaccuguuuccugaaguccagaucaucaguuacagcuuggugcauuuucacaaacacccacguagucacuguucagguccagaaaccaccagccugcagcccccaaaggccccagcacaggcgcccuguggugcugcugucuggccugacgagucugccuguugcucacugaauauaaacggagucaaagcagggcuucuuaggucugaccucuuuguccuguguguaggugaaagcagucucauuucuguguaguacuguggcgggaaugcacccagcucugcuguagguggagggucucaguuaccugcuguacuuccuccagacaggacuguuguucuaguaacucucagcaaugaaggaaccaaugcagucuccgacuuuacuggcuugaguuucgcucuuguugcccaggcugagugcaggggcgugaucucggcucacugcagccucugccuccuggguucaagcgacucuccugccucagccuccuggguagcugggauuacaggugcccaccaccaggccuggcuaauuuuuguauuuuuaauagagacggggcuucgccacguugcccaggcugaucucgaacucaagggauggcucaccucggccuccaaagugcugggauuacaggcgugagccaccgcgccuggccuuuccuggcugcuuauacucacucacccugcagaaaacacagagaccaggcaggcgccgcuguggguucugaagagcguucgccgcagcgguggugaagagccagagcgggaagccaaaacggcuccuccucgggcuggucccagccucucagcggggaggagggcucuaguccuggcgugcagacaguguucuguggcugccguguguuggacagacuggaaagaccggaaugccacugggggcagguggguuagguagguuggccagagggcucacaucugggguugaaggaaacgggauaaaagccacugaguuuccugggccgggaccugagcgcugcccgugucuccaccucgcccucccgugugcguggcuuucuccuagcucuugggcacauucucacgucccccccauaacccgucaccuucauuucugcuggugcuuuugggagucagaccuacagacugcaucagcaucaccaggcaguuugcuuucuggagccuuuuccagaacugucaagcagacucugggggcaaggccucgggauccucauuuuaaauacaagguuuaagcccuucguuucaggauggauuucugcagccacuacuucccagcuacuguccuucguccugcccggguuuucagagccugaugcugccacuggcgacccacacccccucagcugcuuuucagaaccacacgauaaaaucugccccgaaagcugcugcagcacugucugcgcucacagugcccaccacaccaccgcccacaggccaggccagccaggcuuccgauucugcccuuuccuggagacccauccuccucccuccgggagugaugcccgcuggucagcuggagcgagccucucuauugccgaaaagccuuuucugacacuccugcaucuuuaguuugggacaucucucccacuaccaaacuuaaaccacaugagggcaggggcuucauuuuuaagcaguuggcuuuggugaggcugguggugaugaacuagcaacaccaucuugcccugguaggugacuucccccagcacugaguuggaacaaagcagaagcuuucuguguggaaacagcauucgguuuggugauccuucuauguaagaauacgaucugauguuuucuaaguuaauuaauacaaaauacauauugauaaaacacuagauaaaagaucacagauagauucauuacaaaauuuuuauaauggguauaaaaucaccaguccccuugcauaagcucuaaccacagugagcuacccuguuucagcuguaacacagucuccugugaaucacaagauacauuaacuacugauaauuuuucugugaaggaucuauauuggaaggcgucugacaaccuccaccagcaccuuuugaugaagaacuggagucugacuugguucguuaguggauuacuucugagcuugcaacauagcucacugaagagcuguuagauccugggguggccacgucacuuguguuuauuuguucuguaaaugcugcguuccuaauuuaguaaaauaaaagaauagacacuaaaaucauguugaucuauaauuacaccuaugggaucaauaagcaugucagacugauuaaugucuacugugaaaauuugguaguaaauuuucauuugauauuagauauaaauaucugaauauaaauaauuuuaauauacuagucaugauguguguuguauuuuaaaaauuaucugcaaccuuaauucagcugaaguacuuuauauuucaaaagaaugaauaacauugauaauaaaaucgcuacuuuaagggguuuguccaaaauaaauauuguggccuuauauaucacacuauuguagaaaguauuauuuaauuuaaauggaugcagguugucuacuaaagaaagauuauauauaacuaugcuaauuguucauaaucaacagaaaccaagauagagcuacaaacucagcuguacaguucguacacuaaacucuucuugcuuuugcauuauaaggaauuaagucuccgauuauuaggugaucacccuggaugaucaguuuucugcugaaggcaccuacucaguaucuuuuccucuuuaucacucugcauuggugaauuuaauccucuccuuuguguucaacuuuugugugcuuuuaaaaucagcuuuauucuaagcaaaucugugucuacuuuaaaaaacuggaaauggaaaaaaaaauaaaucuu

SEQ ID NO: 193021 - RNA, 21333 nt, Homo sapiens
ugaccauagauugagauuuauaccacauaccacacauagccacagaaacaucaucuugaaauaaagaagaguuuuggacaaaaauguauguguaaauuaucaaauaaaggggccaggcacaguggcucaugccuguaaucccagcacuuugggaggccgagguggguggaucacuugaagccaggaguucgagaccagccuggccaacauagcaaaaccuugucucuauuacaaauaugcccaugugcuagguguggugggacacaccuguaaucccagcuacccaggagaaucgcuuaaacccgggaggcggaaguugcagugagcugagaucauaacaccgcacuccacccugagugacagggcaagacucaaaaaauaaaaaaggaacauuaacuaggguuagaaacuaacuucauucuuuuuagaauucaacaguuuuccuaggucaccaauuccaccuuuuguucuuauuaaggcgcaaagucacaggacccccuuccugggagucacugucauuaaaucuauugccgucagcucagcccaggguaggcaagguucaagaaugggaagugcuuuugucuggggaaacacgcagguaaugugaugcuaggaaggaggaugugcaggugggugagagcccaggagggagcagcuggugccugacagggugagccaucagggcugggccuggguacagccccaggagaaggagccugugcagaaguagcaguucaguggauuccaccuccuaugucacaauccagcagguggccaggacucagccuggguuuuaagugaguaaugccuucccugucucagagauuagcucuaacagugucacuagaggaagcccuggcgagggugggggggcguaguguggggacaaggaggccagauagaaagugcuggaauguucuggaacagaucuguuucuggaggagaggcugaguauggagagucaacagaaugugaccaccuucagagggaggagcugggccgucuccaauaaauccagggacaaaugccuucaguccucagacuguuccaauagaggggacgccacguaucccaggguucccuuuccaacucaugucaacaccugcagucccuuugaggagacuaaauguauuucaugcuggaaagaacagauuuucucucauuaaaaauagccccacuaaaggagaccaacaugcuagaagugcggcaccagggccucaagacuacacuucggaacaugaagagggcuggggaccgcucggcccaagucuggaucuuguaaccaacagaugccgagcuugccguucaacuaggcacagaaagcagacucggucugggauuccaguuggucugauucaguucaagagggucacagucagaagaaagcuuuuuccauuaggagcuucagcagagugaagaguucaacacagcaaacaggcaggcagcuccuuuguauaugugacgggguggcccugacuguaaacacagcccuaccagucacugcagcucauggccugagaagacauuccaguggcagccucggguguccacucaguucacauauucugguuucaccugcccaagcugucuucaggcaugaggucuugucagaauugggauguggaugucuccuauguuaccauuuauugugugggggcagccaucauccuauuugucugguccaucaagcuggaauacagaagacagaggguaucagcuaucuguuuacacacccaggcaggccagcagaucucuguucaaacagcucuagcugcagacaugcaaaauauuucacaaaacaagcugcuuucugcaaauacugcugcugcugugcugggcuaagaggaucccagcaggccugggcagaacaggguggcuaaauggagagccucauucuaugggucuuaaaguacccaaaucaauauguacugaugcucaugugcuuaaaagcauucacuauuuggaaaaguaaccccuuggauaguaaugcuguaaaaaacagaaaaugaaaucauaacccauuuuacauacauuucucugaaacuagauuauacaguucaaauccuauuaagccacuuccaaaacuccacaggagcuaccagaguuacaaucugcuuuucuaugaaaacaggaaguugggccgggccugcuggcucaugccuauaaucccagcacuuugggaggcugaggcagguggaucacccgaggucaggaguuugagaccagccugacuaacaugaugaaaucccaucucuaauaaaaguacagaaauuagccaggcaugguggcacaugccuguaaucccagcugcucaggaggcugaggcaggagaaucacuugaacccaggaggcagggcugcagugagccaaaaucgugccauugcacuccagcuugggcaacaagagugaaacuccauuacaaaaaaaagaaaauaugaaguuggagcaggaaaaggaucccucaaaaaagccugcugggcugaucuaagaucuccgcugccuugugagcuggccaggaggcacucgccucucagcguuuaagccucauuguuagcuggguucccugccuccauaaugaagugaccaugauugguaaaaaaucagccugcaaccagagguuggaggucuuggacugguggaggugaggagagugcugaccccauggcccugagccaugaggcagccacagcuguggacaaggaaaaaggaucaggauuuccuaagacaucugccuuggaaggcaagaggagcaucaacugugauauauuguaguugauaugguuuggcuguguccccacccaaaucucaccuugaauuguaaucauccccaugugucaaggguggggccaaguggaaguaacugaaucaugggggcgggucuuucccacacucuucuucugauagugaauaagucucacaagaucugauaguuuuauaaagggcaguucccccgcacacguccucuugccugccaccuuguaagacaguacuuugcuccugcuuugccuuccacuaugauugugaggcccccacagccauauggaacugugaguccauuaaaccucuuuccuuuauaaauuacccagucucagguaugccuuuaugagcagccagagaacagacuaauacacuggugaaauccccuuuggacaguguuacaccugccuguaaucaugacacuggacuuuaaaugcuuaaugcuaccaccucccauugaaaacccuuaauaucaaggcuacacaugcuacaugauucuuaugggaaacugcauuuucuguaacuucacuuguuuauaggcgguuugaaaucucuuagaaagcaucaaggcucuuuggcuuuccucagcggauuauaauugaucaauggcucucauaccaauuacuuccgaaaagcaucacucauguagccuucaucccacauagaugcagagaacuuuagcuucucaaaguucuuuaacccguaucaucuuagaaucacauaccaggccuuagagggacacuguuggcugcuuuauuuuagggagugaagguaacgccuauagucuguuaagaauacagacucaucagcccugagugucuggaccgugucccugcuuggccuguuagcaucuguuuccucaucucuaaauggagguauugaaaguaacacccagucagguccagguagugccuggugcaggauucacagcaucaucagcuauuacuguuacuguguuaaccaacggggcuccauaucagguggaccauacccuagagcagugagaagggcagccccuuggaugguccuccucagcagucuguaccuucccaguuucccgcugcacaaggucccgcaucucuucuguccagcccagaagcuccacuaggcuuuccacgccgugaaccacgucccccagcugggccacgucccugcugcgaggaugccaagccaagggccccaccaagucccgguugaugagcagucggggaacugagcuccgcacggccucggucaagcuggcaaaaggcuccaccugaaaaaugggccaaacgugaggggcacaguguccacuuuacaagcuccucaggauguuucaugccacagccaccgaggccuuggaggagcagcagauuggcagucagagccugcgauauagggaaaacccaccaccaaucucauuucuucagcugagcuccugccgcuuggccuccgugacgguuuucuccccuccgccucucucucucucucccacuucuugcuguuuccacacauccuugcuuuuccccaccuccguuccaaggcucaucagggauccaaccuuccugccuccucuuugugagcacguucuguucucccuguccuccccaccucgcugucucccagcaugacgcagagggacaacagcacagacucguccaucuccucuggcuagcccugcuugcucugacagccaccaccagcaucgggcacccagacgagcuggugcccccgagcaggaguuacuguuacgucucuccauggucuuccccacccagccucuagagaggccuagcucggugccaucaggcuucuucauacagcucucaaagcuucuuuuaagaggaacaagguaaaaaaauggauacauuaauaaauggcauuaaaacuggcucauuaucugggaggaaaauacuccauuccuaccucccacugaaaaaaauucaaauggauuaaagguuucaauguaaacaaaacaguucuugaagaaaacuaaggauuuacaaguaaggauagggaagaacguucuaggcguaaaaacugaagucagauaaggcaaaggaaaaugacagaucugacuauguaaauacuauuaucucgguaucuacauaaaacuacuauguagaaaauuuaaaauuuuuaaaaaccucucaucaucauaaacugcaaaaauauuuacaacauaugacaauaguuuauauugcuaauugauaaacucauuuauaaacauauaauuuaugaacuaauuuauaaugcuaauuuauaaugaaauuuauauuaacagcugggcauggugguucacaccuauaaucccagcacuuugggaggccgaggcgggcagaucagcugaggucaggaguucaagaccagccuggccaacauagugaaaccacgucucuacuaaaaauacaaaacuuagcugggcgugguggcacgcaccuauaauccgagcuacucgggagguugaggcaggagaauggcuugagccugggagguggagguugcagugagccgagaucgcgccacugaaccuccagccugggagacagagcaagacucugucucaaaaaaaaaaaaaaaaaaaagaaagaaguuuauauuaacauuaaaauguaauuauauuauuuaauuuauacuaaaauuaaaacuaauuuauauugcuaauuuauaaugacccaaugaaaaauggucaagagguacaaauauacaauccaaagagaagaaacacaacuggcaauaaacaugaaaagaugaacuucauucuuuacuacagaaaggcaaaauccgcaccccccuccacacacacacaugcauuuuuuaaccaauuugauuugugugauuuugguuuuggugaggaugugauaaaauggcuacauaaaaacacaguuuguggcaguguaauuguuacaucuuucuggaaggcaaguucucaauauuuaucagcauuuacccuucaggaguucuugcauggguagauaaggaugauacacagggauauucaccacagcauuuacccuucaggaguacuugcauggguagauaaggaugacacacagggauauucaccggaaggcaaguucucaguauuuaucagcauuuacccuuccagaguacuugcauggguagauaaggaugauacacagggauauucacuacagcauuuacccuucaggaguacuugcauggguagauaaggaugacacacagggauauucaccggaaggcaaguucucaguauuuaucagcauuuacccuuccagaguacuugcauggguagauaaggaugauacacagggauauucacuacagcauuuacccuucaggaguacuugcaugaguagauaaggaugauacacagggauauucacuacagcacgggaucucauucuguuacccaggcuggaaugcaguggcaugaucauaguucacuauaaccucaaauuccugggcucaagcaauccuccuuccucagccucucaaauagcugcaacuacacagaccaugccuggcuaucuuuuuauuuuuuguagagacgaggucugacuauacugcccaggcuggucucaaaugccuagcuucaggcaaucuuccugccuuggccucccagagugcugggauaacaggugugagccacggugccuggcccagcauuacuuuuaauguaaaaauuauauacuauuuauuaucauuguccaucaguaagaaauugcuuacauaaauuuuguauuaaauccacaaaaucuauguuaaagcucuuguggcugaauauguuucagaauuuuugagauuuuagaaaagaucauaugguuuacaucccacguuaugucacaccuaaaggggaucuggagugguacuccacagucaaacacauuaacauuucguccacaaagcacaugagauagagucugugcgugacaccagcucauucaguucaugauggcaccagccuuacagacauggguuucucaguugggaccucauauccguguaagggaaacuguuggcauuaacaacgcagcacaucuccauggacucacauuguuacgugaaaacagcaggcugcagaauagaauguacagugcuguccaacuuuuaguuuaaaauuaccaucuguacguaugcauuuguacaaaaaaaagaaagcugagaggacacagaauaaaaugcuaacaguuggugggauuaaaaaguugauccuuugcuuuauaucuuuauauaauguacgaaucuuuucaaagacacacaugauacacuuauaaucaggaaaaaggccauuuucauuucacuucaacaauaaagauggcugguggcccaaguguccacaccugguggccagcacggucagcuggucucagcccacacugugcugaccaccauggccccucugacugcuccuccugugucugucccuccauccuaggccuagcauggcauucucaugucuguccacacccugggcucuccugucugcucacuccagcaccccagcuccugccucugggccuuccuggacuccagacucauguccaccugcucaacaccuccaguccgcagcacauccucaaauccguggaaacaaggcugaguuccugagcucccccaaacccaccuaccaggcuucuccaucucaggaagcggcggcuccgucuuuccagcugcuccagccacagcccugggguccuugggaauccacggccucccaugcacugugccagcguacccacucugcguucacacacacccagacuccagcaccccucagccucugcuggcuuuaccuggcccccagccagugccagccggugauuaccuacaagggcccugcugggucugcugcucccagucuugcccccauggugggcucacagcccagcacccaacggaguccucucaacuucagacucuggccuggaacccaagcugaacccauucaccuucugagguggcgccagccucccaugagaugacacuugugccccaccuucuucucugcuccagccccguggccaucaaugcugacuucgccccacccuccuugcugcuugucaccugugcaguguccccugccagacccuccucaccucgguaaacucuuagauccaacuccaccugccugacuugacacugcagcugguucccaacccuucuagccuuucuauccuacuuguuaucuuucucauaacaucaaucaucuccuaacaaacuauauaacuucuuacacugacaucugaccguguauguccaaagcacuggagcagggcccagcacacaaugaaugccugaacaaacacaugcucugggccccuguggcugcccugggccccucugagcacaggucuuucuggcccuucuguccucggugccuacauccagucacgcacacacugacuucauggucucauuucuugcucucaucacagcuuuuaggaauuuccugagcugcagacgcagacgcagaacagcugcuugaacacauccagggcauguuucccgacaccucagacacacacagaaccgagcugggcauccucccucccaaaucacgccucaccagcaagugcccugaccuuacagaccaagccagacgccuccuucucacguccccaaaacaucacagacugcgaguccagucccccuccucgccaucccucaggcgaccacagcuccaccuucuccaggaccagccuccuggcacugcuugcuccacucuccacuccccaaaggccucccugaccccaagggugcagcuacguccccgggccagucccuguggauuuaucacuccucccacugcagcaucaguauuccugaucugaccugggaggcccugccccuccaccucgcccccacacccccauccuucucccuucuccucacacguggugccccacccacaccuauaccaccuccaaagcccagcagcuucccaccuuccugucuccugcacaggcugcugcucccucagccuggaaccccagcugaauccauucaccuucccaaaguggcaccagcccuggaagggcccaugagaugacuccuguaccccucccuuccccugcccuccagccuccucccugcacaggccugccgacagcccaugagaugacuccuguaccccucccuuccccugcccuccagccuccucccugcacaggccugccgacagcccaugaggugacuccuguaccccucccuuccccugcccuccagacuccucccugcacaggccugccgacagcccaugagaugacuccuguaccccucccuuccccugcccuccagccuccucccugcacaggccugcugacaaaccuccagggaggucccaaggaugagcagcagaucugccauggggaaaucaaccacaugcagcaagaaccucuggggcagcggcuccccaaagaacacaaugucgggcuucacaacgccggugcagaccgggcagcggggaacccugucugccaucacgucagccuggaaaacagagaaaacaggccugaggaagaugccugcaacacccuguaaaaggaaaaggcaacaaguucuuauuaaagucucaaacauucucccccaaaaaaggugagagagggaucaugaacccccauguacccagcuucaggaauuaccaguuuucauagcuaauuguuucacagcccuccggaaucugggaggagguauuggagccuuuaaaagcaaaucuuggacaucauauguuucacccauaauuacuucggcaggcaucuagcguaucuaacaccaugcucuaucccugggauggcagccagagacauccaggcgcuaaggaaacaccugguagaccacaccaguccucaaacaguagucugcaggcauuuggccuacaccgaacacuauucagucagaaaggugaaacugucucugguuugagcuucggugaucaugccauugccucagcccugggaggcauucaggucagcuucacucacuggcuggcauuauuaggaguaacaacaucugccaaacacugcuuccuuacuggccaaggugaaguggacacaacuucccuuugcgucaagauuaauauaaauaaaugccuuggagcagauggaaaagggagagaguuacagaggaagacaccugacuuucuaagguaaaccuuuacagcuaacggggcuuguuuuaagcaggcucagcccagcaaaaagcaacagauacaaaagacaaaagaaagagacccacgaaagauuucagauauucuuggauacacaguaaaacuguauuauauuuaaauuaaaaagaaaaaacuguuaucuuggaggcaugggguauagcaaaaaaaaaaauuaaggaagcaaaaaaaaaagaugaacuugaaauaucuaucaaaggccaggcgcaguggcucagcucuguaaucccaggacuucgggaggccgaggugggcagaucacgaggucaggagaucgagacugucuuggccaacauggugaaacccugucucuacuaaaacacaaaaaauuagccaggcguggugaugcgugccuguaaucccagcuacuugggaggcugaggcaggggaaucacuugaaccugggaggcggagguugcugugagcugagauugcaccacugcacuccagccugggcaacaaagcgagacucugucucaaaaaacaaaacaaaacaaaacaaaacaaaaaacuaucuauuaaagauauaaaauuauuaaaaaauuauguaauaauguagcagacuugaaaaauaaccaaauagaacuucuagaaauaaaaaguacaggaaccaaaauuaaaacucaaugucuguuuugaguugcuguuugggaaaaaagaaagaaagaaacacucaauggaaggaccuuauaacagaauacaauauuaguaaacuggaaaaaagaccagaagaaauuacccagaaugcagcacaagaagcagcaauuacaggacagaagagugaucaggaacagcaggagagagaaggucuaauguauguucaaucagaggucccuaaagagaggggccagauagugggcuaggggcaacucauauccgaagagauaacggcagaguaugauccagcaaccaugaaagacgccaacccgcagauucaggaucucaagcaagugagggcuacugagccagccugagggugcccacaggaaaaacaugagucacggcacaucugugcuuguuucugucccaagagguucucaggagguuuaguaauuacaugugguccuucaaagagggaggguggcugugaggugagugguuacguacuugugagacuucaguaagugcccaguaaauguacauuuuaccuaagauagaaggaaacagaggaagagaacuaagcagaccucucagggaagggugaaggaaccauuaaucucaucuugucuuuaaucuguaucugggaagauaaaccaguaauccacauuagcaguguagagucuuugaaaagggcugguuucuguuuagcccuuagugaagaagccuaaugguggcuggggagggagggguacagugaggcgcgucugaccuccucuccugcuacggccaggaacucaagcuuccaagguuucucugggguucccuugaccaaggggagggcuccauucaguugguugcagggcuuagaauuuuauuuuauauuuuauuuuuuugagauggcaucucgcucugucacccaggcuggagugcaguggcaugaucucgguucacuacaacuucugccuccuggguuccagcaauucuccugccucagccucccgaguagcugggauuacagaugggugccaccacaaauggcucaucuuuguauuuuuaguagagacgggguuucaccauguuggccaggcuggucucaaacuccuaacucaggugauccacccgccucagcuucccaaaguacugggauuacaggcaggagccaccgcgcccagccuagaauuuuauuuuauuuuucuuaaggaaggccuacaauuauuauuauuauuuuuuuuuuuuugagauggaguuucgcucuuguuucccaggcuggagugcaauggccuaaucucagcucaccgcaaccuccgccucccugguucaagcaauucgccugccucagccucccgaguaucugagauuauaggcaugcaccaucacgcccggcuaauuuuguauuuuuaguagauaugggguuucuccauguuggucaggcuggucucaaacuccugaccucaggcgauccacccacccggccucccaaaguacugggauuacgggcgugagccaccaugaccaacuggccuacaaauuuuaagcagaagaaauaaaagaaaauucauauggaaaaccacaguggagaaaccgcaaaacuccaaagacaaaagucuuaaaaaacaggcagagaggccagacacgguggcucaugccugucaucccagcacuuugggaggccgaggcggguggaucaugaggucaggaguucgacaccagccucaccaacauagugaaaccccaucucuacuaaaaauacaaaaauuagcugggcaugguggcgcaugccugcaaucccagcuacucaggaggaugaggcaagagaaucgcuugaaccugagagggggagguugcaaugagcugagaucauaccacugcacuccagccugggcaacagagcaagacucuaucucaaaaaaacaaaaaauccaaacaacaacaacaaaaauaaaacaggcagagaacagauagcaacaguuucagaaauuuauaugaaaagccaaaagauucagaccagccaacacaguacugaaggagaagaacaaagguggggaauuaacaucaaccuguugcccaaauuaucuauuuuauucucuuauuuauuuauuuauuuuguuuugagauggagucucacucugucacccaggcuggagugcaguggugcgaucucagcucacagcaaccuccccucccagguucaagcaauucuucugccucagccuccugaguagcugggauuacaggugcaccaccacaccuggcuaauuuuuguauuuuuaguagagaugggauuucaccauuuuggcaggcugcucucaagcuucccaccucaggugacccgccugucuaggccucccaaagugcuggaauuacaggcgugagccacugugcccagucccaaauaaucucuuuuaaaugcaaaucccuucacaucauuuuccugccuaaaaauccuccaaugccucccaugaucgucaggauacaguucaaacccuaacagagcaagcaggccucccacacuccaggucucugcugccagaaacagacucuuacauccagacggccucaucucaaaggugcuucccagccuacucuguuccuacagcugagucaguguaguguccaguacauauuuauaguaaaauucguauggcacccaguuguaacuguuggaugacuccaccuuauuuuaauuucuauucacauccacagaacccagcaaagggccuggcacugaggagacuaaacuauuuguugaauaaauuggucauucaaugaaugaguugaccaaaacaauaauacguauauaucaaguuucuacuaugugcuggacucacacuuccuaauuucaaaacuuacuacaaagcuacaguaaccaaaacauuauagugcaggcacaaggauauacagauaacaauggaauagaauugagacucuagaaauaacccauacaccuauggccaacugauuuucaacaacaaugccaagaccacaguuuuuuuaaacaaauggugcuggaacaauuacauauccacauaaaagaaaaugaagcuggaucccuaccuuacagcgcacacaaaaauuaacucaaaauggaucaaagaacuaaauguaaaagcuuuaaacuauaaaacucuuauaagaaaacaggaguaaaacaauaccauuucucagauaugauuccaaaagagugagaaaauaaauagacaaacuagauuucaucaaaaucaaaacuucuaugcaucaaaagacaucaacaaaguaaaaaagacaaccuacagaaugacagaaaauauuugcaaaucaugucucugauaaggaucuagcuuccagaauauauaaaggacucucuuaacaauaaaaaagacaacacaauuaaacaaugcgcaaaggacuucaaucuccaaagauauacaaauggccaaaaagcacauggaaagauguuugauaucaugaaucauuaggaaaaugccaaucagugcuacaguggguuaccaccucccacccacugggauagcuguaauuaaaaaauggaaaguaaguguugggauguggaaaagaugaaacccuugcccacuguugguggaauguaaaaugguccagcuucugcagauaacaguauauucguuccucaaaaaguuaaaacgggccgggcgcaguggcucucgccuguaaucccacacuuugggagaaagaggcaggcggaucacgaggucaagagaucgagacauccuggccaacauggugaaacuacucuacuaaauacaaaaauuagccgggcgugguggugugugccuguagucccagcuacucaggaagcugaggcaggagaaucgcuugaacccaggaggcggaugguacagugagccgagauugcgccacugcacuccagccuggugauaagagcuagacuccgucucaaaacaaacaaacaaaaaaguuaaacaugggcagggcaugguggcucacgccuguaaucuuagcacuuugggaggccgaggcgggugaaccaccugaggucaggaaugcaagagcagccuggccaacauggugaaaccccaucucuacuagaaauacaaaaaacauuagcugggcaugguggcaggcaccuguaaucccagcuucucaggaggcugaggcaggagaaucgcuugaacccgggaggcagagguuguauugagccgaaaucgcgccauugcacuccagccugggugacaguguaagacugugucucaaaaaauaaauaaauaaauauagcuaaacguggaguuacccagcaauacuuguagguaucauacucaaaagaauaaaaaacaaggacucucaaacgaauacuugcauaugcuccacagcagaacuauacacaagagcagaaaggugggacaacccaaacacccauccauguacaaacaaaccaacuguggugcauacaucaguggaacauuuagccaugaaacaggaugaaauacuaacacaagcuacaaggcgaaggagcgagaaacauuuucaggaaauaagcucggcacaaaaggccaucugauugccgggcgugguggcucacgccuguaaucccagcuacuuaggaggcugaggcagaagaauuccuugaauccgggagacggagguugcagugagccgagaucgcccacugcacuccagccugggcgacagagugagacucaaucucaaaaaaaaaaaaaaaaagugggcagcuggaauuggcugaagggagauucauuuucccuacauauuucuauauugucuuaaauuuuuuuacaagcauguauugauuuucuaauuuacaaauaaaauguuucacacuauuauuguucaacuguccuuucgagacaaugcuuauaaaauaccacuuuuccagaucaccccaacagcaaacugcagaaggacaaccaacagcaggauaacucacccgaauguccuccccugggaagggucuuuggcagacugugcagguggcagaggcaaagguuccaugagcuucaaccagcuuugaggcagggaugcccgacacugaaauucaagccaaagcgaaguguugcugccgccuccgagaugagcacgcaaggccaagagcacaacuucugggcuuggcaggacuccuggaaggaggcacagccccuugggguugugauguccucaagccugguuuucaugcccguaucaccuacaugcgccaucaaccagaauaaggcaggggagcaaaggggcaccuagcuggagccaaaucacgguuaaaacaaagccugucaaaacucaguacgaaaaaccauuugauaaaagcucaaauaaaauuauauccagccgggcacaguggcccacaccuguaaucccagcacuuugggaggccgaggugggcagaucauuugaggcuaggaguucaagaccggccuggccaucauggugaaaccguaccucuacuaaaaauacaaaaauuagccagaugugguggcaggcaccuguagugccagcuacucggggaggcugagacaggagaaucgcuugaacccgggagguggaaguugcagugagcugaggucgugccaccgcacuccaguuuggguaagagagcgagauucugucucaaaaaaaaaaaaaaaaauuacaccuaauaccaggcugggugcaguggcucaugccuguaaucccagugcuuuggaaggccaaggcaggaggaucacuugaggccaggaguuugagaccagccucagcaacauagugagacuugucuuaaaaaauuuuuuuaauuagccaggcaugguagugcaugcccguagucccagcuauuccagaggcugaggcaaaaggaucacuucggcccaagaguucaggcuauagugagcuaugaucaugccacugcacucuagccugggcaacagagccaagacccugucucaaaaauuuauaucuaauauccaggaacauaucuucuauucuacagauaccaaguuaaaaugaggauauaaauaucauaaauuccaaaagaauugcuugguagaaacagacaaaaagugacuucuuaugaaaguuguguuaguauuaacugguucugaaaggcugcgguggcacagccagggucccagcugcaggaggcuucccaagucccugucgcugcccuaacucagcagugcugaaucucacagccaggagcucccaccuucccacaaggccugcccugcugcaccucugggagaagagcccaccaacauggggcauccgcugcugccucugugguuccaagucaggggauccuucuggcaaggaaacacauuccuggagccaaggugccaccucuuuuuaacugacaacacaucagcagucucuccgggagccuggcucccggagagcugacugucccagcaccugucugcaucacugcacguaaggaaaaggccccaccaagugcuuccguuaggugcacggccagaaguuggcacaaccugugaaucgcugguuugggcaccauauggauacggucaagaaaucaccacagacuaagugugaccauauuaaggaauuacuagugauucuucagugugaaucacuaucagaguuguuuuuauuuuuuaauuauuuuuauuuuuauuuauuuuuuugagacagaaucucccucugucgcccaggcuggagugaaguggcacgaucucggcucacugcaaccuccgccugcuggguucaagagauucuccugucucagccucccgaguaccugggauuacaggcacacaccaccacgccuggcuaauuuuuuguauuuuuaguagagacgggguuuugccacguuggccaggcuggucucgaacucccgaccucaggugaucuaccugccucggccucccaaaaugcugggauuacaggugugaucccacaccuguaauccggcacccggccggaguuguuuuuaaaguauucucuagagcuauccauucauguguuuauagauuauuucuagauuaaauucaugaugugagagauuugcuucaaaauaaucuggggauuuggaagaagguggugaggacgcaggaagaacuggcugugugcuggugaugaggacaggacgguucguuacauugcucucuuugugugugcucaaaaaaauuccauaauacacuucuuaaaagagagaagaaaaaaagagaucaucacaccagauuggcaaaacaaugucaacuucugcccaaaauacacagcucugcagguaugcaggagaacaagcaguggccuuuaaacacccagaggacauuuuccuugggaacaaagcccuaacuaguuggcucaaaaaaagucccaaggaagaagcauaagcgauagguuuuggccguccccagaaacaggcacccgagcauccccugugagaaacaggcacccgagccucccugggagaaacaggcacccgagccuccgugggagaaaaagaaugugugcgacucacagagggcucaccucucucaagcccaucgauguucugcguguagagccgcagaagcagccccuugucaugaagcagccggagaaaguagugagugacguugggcuuguaguuuccaggguacagcuccuuggccaaagugaaaaagggcuugggguugugaaagaagaaugggaguucaaaaauggccucgggguacgggagaucguacugcuggagguugcuguacaggccacuccccggcgaucugcagggagagaagaaaggcucugaggccuuuggaagaggacagggaaguggaauaaacugggcaguggggagggcaggagucaggggaggggagcgcagaaggcaggugggacugugggcaguaccugaagucuggaaugccacugggugugcugaugccggcccccaccaugaccaccacccucuggcaggcucuggcccgaaucagcucagcuacauccugcagggaaagcuuccccuugucacugcugccuccacuuccaacaacacuugaagcacccacagaaaaagauauggaccuucuuccaccuuuaauacugacagaaaaaaacacagcagcaaaggaaacagauagcaaccaaucucaggauagcaagaacgagcauggcucugcccucugcaccaccgccacccucgagaaugagcaugugugucuccccaggccucucaaaauaaucaccuuucuuagacgacuauugggguacaacaaaaagcagucauaaaucagaaaucaagacuuacuugggagcaaaaaauucagguuaaugggaacugugcucauuucauaauucaguacacucaguaggcacucaacucugacugacugcaaaccuccaaaggggucuccuaaugaaaacugguuaaggagucaagaagcaaagagggaaaacccugguucuaaaaccaucucaccaccuauuaagcgccccacuucacacagcauuucagacaucuauucacuuaaggucguuccccaaacagcuacugugcuccuacuaaacacgaacuguuaagagaagcacaaaaggaaugaaaguuauuauugcuguugagugccugcugagggcaagguaucacgaagggugccugaguacauuccucauuuacguaaauaaaauguuugugagucacugaaaaacacauaaacggcguuuuaccaaaugucuggaacauacguaagauguauggcuuaaaguacaugcugcauggugugaaauucacugggagugggggacccugaggggcaggcaugggugcaaccugggagggacacugugcaaaggacacaaacaacaaauucagagagcucaaaaauccaaagccaaacuggaggaagcccaugcaauggacuacuccucacacgcagcccuaugccuccugcuuuagggccagugguagcaaggauuuuuguuuuguuuuguuuuguuuuguuuugagacggagucucgcucuguugcccaggcuggagugcagugucgcgaucucggcucacugcaagcuccgccucccagguucacgccauucuccugccucagccucccgaguagcugggacuacaggcacccgccaccacgccuggcuaauuuccuuguauuuuuaguaaagacgggguuucacuguguuagccaggauggucucgaucuccugaccucgugauccgcccgucucggccuuccaaagugcuggaauuacaggcgugagccaccgcgcccggccgcaaggauuuguuuuaacaguuuugcagaguaucacagauauuagaaugcgcuccacguguuuguagguccuggucccugcuccauccauagcaccuagaacagagucuggcacagaauaagagcucagucagggcuucuuggaugaacgacugacucuucgggaucuuuguuuuuuuuugagacggaguuuuugcucuuucgcccgggcuggagugcaauggugccaucucggcucacugcaaccucugccuuccggguucaagugauucuccugccuccgccuccugaguagcuaggauuacaggcgcccgccaccacgcccggcuaauuuuuguaauuucaguagaaaugggguuucaccauguuggcccagcuggucucgaacuccugaccucguuauccacccgucucauccucccaaagugcugggauuacaggcgugagcuaccgcgcccggccaacucuucaggaucuauuaaacuuuuuucuuuuuuuuuucccacagguagauaagagucuugcucugucacccaggcuggagugcaguggcucaaucauagcucacugcagccuugaacuccuggacucaagggauccucuugccuuagucucaggaguaacugggacaacaggcuugcgccaccaugcccggcuaauuuuuaaauuuuugguagagaugggggucucguuauguugcccaggcugcucuugaacuccuggccucgagcgauccccgucucagccuccgaaagugcugguauuacaagugugagcuaccacuucgagacucacuuuucaccaacauuuucagcaguugugucagacagcaagucaaugugccauuauuuacuuaaauauucauccauuauagggcaucugauaccuaacaaccauggaccuuaagauuuuuuccuauguagccucaguucuuagaugcaauuacuauggagacggguacgaucacaugccagugggaguauuaaccgcacaacauuuaugagggaucauuaaagcguuaaaugcauauacuuuuggaccuagcaaucccaguacuaggaauuuaugcaaacagugaggugccaacaagguuauucaccacagcaugaugcacaauaacuaaagguuagaacguauuucaaugagggaauggugaaauaaacgacaaaacccccauaagugacguccacagaucagcauaaagacggaggccccgguguuggaacgcacguaaacucccagacaugccgcaaaggaaacacggcaaggugagaaagagugggcgaggugucgacaacgaacacgcaagaagugcuuguccuugcccaaaauaccucgaaaagaagaaacugggagcugcugcccucggcugccuccggaaugcccugggcaccucgggucugggaggccucugcaaggggcgcgccggguccaagggcucaccgcgggccccauggcugccucucagccccgcacucacaucgucccugccgccaagcaccagccgacagccgcaggccugaaacggccccacgccucccccggccucgacccguucaacuacccggccccacagccggagggcugccgcggcgcgccaaccccagaacgccauguuccgcgcaguccaaggaguccuccggacucgc

SEQ ID NO: 193022 - RNA, 237028 nt, Homo sapiens
gcaugcccagugcccgcgcgcgccgccaggcucgcaagcaccgcguaggccagcuggccggaucccgccgucugucauggcggcccccauccugaaaggugagguacuuccugcugccugcuccagcagcgggaguuugaggaccggcaccccucgucgcgggcgcacucgggggaucccgugggaggagccccgcucgccccucccucgcugccugucucccccagacccccugccgccuccuuccucccccgcugccugucccaccaaaacccccugcuccugcucucucccccgcugccuguccccccaaaacccccggcugccugcuucgucucccgugcucccuguccccccaaacccccgacugccugcuuccucccccguacugcuugugccccaacccccgugcugcuaguuccccucaaucccccgcugccugcucccucccccaugcugccugucccccaaaucccgccuuucccccuaccugcuuucaccccugcugccuuagucccuggaucuggggcucacuggcaggcagaguccugcccuccggaaguugguguggggcccuccugggucugguccuguucgacccccucugaggcccaccuggaggagcggcaguugaguuucuaugcuaauuguuccaauaauaggagccgccuuuuacugcggagucuuugugugccaggcgcugugcuuaggcuaguaugguauugucugauuuuuuuaaccgcucuaucaacucucuuauaucauuuuacaggcagaaacuaaggcaucggacguuuaggugacucucccuguguguggcuagucagugcugacagggccuuagaccggagcugcuguccuaaccaguauaugauaccgcacgcagucccacccucugugcaccuggaagagcccaggagaggggaauagcggacacgugucuuguagaguuugaccgugagaaaaaaggggccuguauuguggggccuggagucauaaaaccucauagccaaaaguaaagacuagaggcuuuauacaaagucuguaaucagauguggcuauuuuucuaauguuaguauuuuguuaaauuaaccugguuuucuuuuagcguuacccccaaucauugaccaacggcacaccuggaaaaugcuuuuaaacaucagguuuugagaagaggauauccacuagaacagggguccacucacuaugccccccaggccauaucuagccugcugccuguuuuuguaagggucuacgagcuaagaaugucuuuuacauuuuuaagugauuuuaaaaaaaggucaaaugaaaaauuauaucacauucacauuuccuucuccauaaauaaaguuuuauuggaacacaggccggcccguuaauauauuaccuaugguuauguuugugccacaaccgugaaguugaguaguuguggcaaauacuguauuggccacaaagccugaaauauuuaccaucugucucuuuacagaaaauagguuucugcacuggaaaaauuaagcguaagaauuuggggaaagcaacuaauuuuacaaauguaaacucucauguauuguauggguacaguuguucuuugcuuaaaauuuuaauaaauuccacugaagcuauuuugaaaaggcuuucaguagaaauuuauuuaugagacagagucuuacucucuugcccaggcuggagcgcagugaugugaucacauaauagcucaagcaauucugcuucagccuccugaguaacuugggacuacaggcacuaccacgcccgguuauuuuuauuuuuauuuuuuaauuuauuauuuuuuuguagagccagggucucacuauguugccuaggcuggucuugaauuccuagccucaagcaauccucccgccuccaccuugcaaaaugcugggauuacaggcaugagcuacuuuguucagccaguagaagaaacuucauuuacuuuucuuauuuuugaggcaaggucuuucucugcugcccaggcuggagugcaauggugcgaucauaacucagcuucuaccuccugggcucuagggauucucccaccucagcuucuccacccuacccacccccauuucccacccaguagcugggacuacagccacucgccaccauuccuggcuaauuaaaaacaaaauuuuuuuuagagacaggguuucacuauguugcccaggcuggucucaaacuucugugcccaagugaucccacugccuuggccuuccagagugcugcaauuacagcaugagccaccacaccuggccaguagaguaaauuuuuguuuuacuuuuuucuuuuuuuuuuuuugaaacgggucucgcccugucacccaggcuggagugcaauggcgcaaucucggcucacugcaaccucugccucccggguucaagugauucuccugccucagccucccaguagcugggauuacaggugcccgccaccaugcucggcuaauuuuuuguaucuuuuaguagagaugguuuuucaccauguuggcccggcuggucucaaaccccugacuucguggauccacccacuuccgccucccacagugcugggauuacaggcgugagccacugugccggccucgguuuacucuuaaauguaaauagaacaaaaucuauugggcaggggaugcuggaauuucaaauguauguuucauguucauaucuuguuuucagauguaguggccuauguugaaguguggucauccaauggaacagaaaauuauucaaagacauuuacaacacagcuuguggauaugggggcaaagguaagacacuuauuuugcuguugauucauaugacagucuucugauugguaaaaaguuacauuugcauuuucuuauuuugggaguuuuuacuuagaaucuggacgaagcaauggguaagcggugggagaaaaaagagccaaagugugaagaauuuagaacaguaggacuuucagaacucaaugccugugggcauugagugaggaggaggaaccuaggaugaaaugcuggauucuuacacugguuacuugaaugcauagugcuauuaagcaaagugaggaauacaggaaaaggaacagguuucuaagggaaaaauuguaaauuugggcauacugaaaaauaucuguuagauauuuggauauacaagucuggagcuuggaguguucaaggcuagagaugaugaucuagggggucaggaccauaggggucaugugaagucacagguguggacaucgucccaugucaggcaugguuaggaugaagaguggugacagaggagcguuguucaguauucaaggacaggcgaugggagcagggacccagugacagagggagagaagaaugccaggagaaggagaaaggaaguguggaagucaaaguagggaguaauuuuuuuuuuuugagacggagucucgcucugucgcuaggcuggagugcagugacgcgaucucagcucacugcaaucucugccuucuggguucaagcgauuguccugccucagccuuccaaguaucugggacuacaggcacaugccaccaugccuagcuaauuuuuuuuuuuguauuuuuaguaaagacgggguuucaccauguuggccaggauggucucaaucuccugaucucgugauccgcccaccucggccucccaaagugcugggauuacaggcaugagccaccgagcccggccaggaguaauuuuuuaauugccuuucagaacuagaauggaguaauuuuaaagauagaauuuuuaaaaacuacagaaaguucaagaaaaauaggaugggcaaauguacuuuggauuugaacacuguaaggucauugcugaacuuagugcaguuuucagugaaaugggcaggaaucauugagcuaugaggaaauggagauagcaaacaauuugccuuauucaagguuucuuaguauagccaucucuguuaucagauuuacuaucacguacugcuuguguucagguagccucuauuugacuuaauaauguccuugauaccaaauagguaucuuuugcccacgcacacuaaaccgaucacuuugaugacggguuuuacaaaagggaaaagauucauucacggggaagcccagcuaggaggcagaagaguacucacaucuucauucccaaagauaaggcuuagggauauuuaucaguuagggaaguagggugaucuaagcuguggggaaaaaugaaguacaugaucugcacaagcauaguugggauucauggaaugcauguuuagaaaacaggcauuauuaggaggccaaggcaggcggaucaccugaggucaggaguucgagaccagccuggccaacauagugaaaccccaucucuacuaaaaauacaaaaaaaagccaggugugguggcacacaccuguagucucagugauucgggaggcugaggcaggagaaucguuugaaccugggaggcggagguugcauugagccgagauugcaccacugcacuccagccugggcgacggaguaagauucugucuccaaaaaccaaaaaaauaggcacuaguaggauccgauggugaagauuuuggccugaugucaaaaggucauuucuugggcauuuacacaggccugguugaagaguuggugguugcagccuguuugaacuguacgggugcugccccaaguuccugaaaaguaacuuaagcaacuguuaccguggugacauauccaccagaaguuuuuaucuuauaaggaagccagugaagguuauagcauuuaguaguaugacuugcagcuauauagaaauaaauaaauaaauaacaaaaagcaagugaccaaaagcaagcaaggcagguuaaauuuggcagaacuaauuuucagccguaaagugcaagagugaugaugcuggcaauucagauaugccagagaagccuuaaggugcuuuaagugaaaaggugaaaguucuccacuuuaaggaaaggaagaaaauuguguguugaaguugcuaagaucgacagugagaacaaaucuucuaaucuugaaauugugaagaacuaugcuacuguugcagucacaccaaacugcaacaguuacagccacagugcgugauuuuuauuauaauacauugcuacaauuacccuauuuuguuaucauuauuguuaaucugugccuaauuuguaaauaaaacuucauuguauauguauguauaggaaaaaacaguauauaaccuguucaguacuagcucaggauucaggcauccacugggagggguugggggcgggacgcgggcaugucuuagaacuuaacccccguggauaagggggaacuaaugugcucuuauagggaguuuaguuaugaacaaauccuguuuauguccuugucuggcauuugggaggggcugacugauaggcugagugaaagagaaccauuaaaaaugggagaaaagauaaucgaaggcagggcuagguuaggguggagcaagagagcugcuguggguauaaaacuuaagaggcgcucaccaccaggcaaagagugggugcuacugaauacccuaagagccuuguuugaccucccuaaugccugucuugaguaagaggucaguggagaggaauccgaauauaggagcagggccugcacugcaggaggggagacaugcccacuguaauacacuggaauguaggaacccgagggagucugcauguugcacaugccuaacauuuacuugggaugaggaggaacuacugugaauaagaaaaaagccguuagacaagugaguugacaaggugguuugaggguagcauuaagaucuuagaucuuuuagaacuuuuugguuucaccuuuuauuucaaaaauuggcaaacaguucaaagaauagugaauacagaucaauagucguuaacaucguaagauuuggauauuuguaguacucguaauccgggauuaucuuaagccaauuucaggauuugagaugauuuaaaaccagacuacaggccugugagggucauuauaacuucugauucacccuuaaucuagaugcagcucuuugggucucagcgcaagguguagggguuuuaccagacccccuugucucuuugaggcuucucaauuuucguccuguuuaguguguacuaaauuugauaaaagccuugugggaagauggucucaaaugcuagacucaucucucuaggugucagucuuaaucuagaaucucagcccgguaauucuuaauugccuugauagcucccauggacuugauggggguguggaaauugagagagagagagaguuauaaaaguaauacauauuuauuguuuaaaaagacuaacgggcagugccaugaaauucacaaugaaaagaaagagaaaccagcaacgcuuugcaguacauuuccuuuuccauuuuucaaagacagcuacuuucaaaucaucuguuucuuuugguauuuaccuucauauuuccaagcauuguacauauauuacuucaguauaauugaaugcuauaaaaauuaugcagaugaguucugcuucuggaaaggauacauaaaagguaaaauuuuugacaccaugagugucugagcaugccuuuauuauacuguuaccuuugacuaauauuuuagcugaguguaaaaugcuagcacaaauauuauuuuuccuugaagguauuucccauuguuuucucaauuccagacugcuguugauaagacugauucaguugucacuuauuguuugcaugugaugugucucuauccucuucaccuugauuacccacucuuuuaauauuuuucccuuucgccaaccaugcuggaauucugugauaagcuugguguagugcuguuuucguucuugugcugggccuuugugggggauucuuuugaucuagaaugcauauccuuuaguuugagaaacuuuucuuugauuauuucuuuaauaauauuuucuccauuuuguguauuccuguauucuuuaacuucuguugauuggcuguuggaucuccuggucugagcuucugauguucuugccuuuugucuccuguuguccgucuucugguucuucucuucuacuaccagugagcuuuacucaacuucauugucugauauuucuguagaaaauuuuuuuacuuaugucaucuuuucuuaauuuccaagagcucuuuaggauccuauuaaaaaauaaucuucugaucauguugcgugaauacaguaucuuuuuuuuuuuuuuuuuuggagauggagucuugcuguguuacccaggcuggagugcaauggcacaaucuuggcucacuguaaccgccaccucccggguugaagugauucuccugccucagccucccgaguugcugagacuacaggcacgaaccuccacgcuuggcuaauuuuuguauuuuuaguagagacaggguuuuuccauguuggccaggcuagucuuaaauuucugaccucaugauccaccugccucggccucccaaaguucugggauuacaggugugaaccaccacacccaguuuccuuugguuuuaauuagcugaauuuuuccaacuuuuugaaugauugcacuuauuuucaaccuucuuacuuuguauuuaugcauuuaagauuacaggcguccgccaccuugcacccggauaauuuuuguauuuuuaguagagacaagguuucaccagguuggcuaggcuggucucaaacugcugaccucaggugauccaccugccucggccucccaaagugcugggauuacaggcaugagccaccaugcccagccauggauacaguaucuuaagauaugagguauuuuuaauuuugguuaaauauguguucuguuuucucuguugccucugaauuucauuugguuuuauuuuuuugauguagaaagcuuuucugaaauguccauuauuaucugacucuuuccaucuuuaaaaauguggugccuucucauggccacauuuucucuucuguccucuuuauccuugcagggcuccaacucuauucuuucaguaacacuucagaggguuuuuagagggaguagaugugaacuuguguguaugauucaccguuguaacuggaacagauauguuuuaagcagcguuaugcauuccuuugaguguuucucugucagauguugagaaacagaauugcugggguagagguuuuuugaucaguuguaguuaaguugugaaugaacaguaauguacauuuuguuuucugcauuuugucuacagguuucaaaaacuuuuaacaaacaaguaacucacguuaucuucaaagauggcuaccagagcacuugggacaaagcucagaagagaggcguaaagcucguuucggugcucuggguggaaaaguaagcaguuucucucuuacuuuuuuuccuuaaguaucuaguauugaaaauguguggagauauuuuucacagaucgcagaaccagauaaaguuugauuuucaucuuuucucugccucuuaccucaccuaguaauuugaaauccuccagccucaauuucugugguucaaaaauggucaugcuauaauaccuaacucugccuagggggaaaaggagccugcagguccugaagcuggguaugcaagguggacuuaggaagcaagagggaaugugaugaagcagauuguguuagucagcaagcgcugcuguaacaaaggaccacagaaugggucgcuugagcaacagaaaaggacuuucucacaacucuggaggcaggaaguccaguaucaaguugucaacaggguugguaucuucuuuuuuuuuugagacaaagucuugcucugucauccaagcuagagugcaguagcuggaucuugggucacugcagccucagccuccuaggcucaagugauucuuaugccucagccucccaaguagcugggauucaucucaaccuuugccuccugggcucaagugauucuccugcuucugccucccgaguagcugggauuacaggcacgcaccaccaugccuggcuaauuuuugcauuuuugguagagacgggguuuuaucauguuggccaggcugguuucaaacuucugaccucaggugauccaccugccucggccucccaaagugcuaggauuacaggugugagccaccgugcgcggcccacacaguuuugauuacaguaaauuuguaguaaguuuugaaauugggaaguacgaguccuguaacuuguuuuucauuuucaagauuguuuggcuauuuugauuugaguuccuugcuaagauuguuuggcugucuugauuggguuccuugcauuucuauaugaauuuuaugaucagugugucaauuuauucaaaaacaaaaaaggcagcugggauuugguaggauuguauugaaucucuaauuagggaaguguucauaauauuuaaucuuucaguccaugaaaaugggauguguuucuuuuucaggucucaaauuuccuucagugacacuuucuaguuuucaguguacaaguuuuuuacccccuagguuaaauuuauuccuaacuuuuuuguucauuuucaugugaaugaaauuguuuucuuaauuuuuuuaaguuguuagcuguuaguguauagaaaugcaggugauuguuguauguugaucuuauacccugcaaauuugcuuaacuuguuuauuaguucuaaauauauuuguggguuccuuagcauuuucuauaugcaauguuguguaauuuuguaaauagagauagauuuacuucuucauuucuagucuggccgcauguuaugucaugucaugucaugucaugucaugucaugucauguuauuuguucuggccagaaccuccagcacacuguugaauagaaguggugagaauggacguccuuguguuguugcucaucuuuggagaaaagcuuucaguauuucauuauuucguaugaugguaacugugguuuguguaaauguccuuuuuuaggcugaggacguucccauucccuucuguugcagguuguuuguuuguuucugauuauuaaaggaaguuagauaugguugucagauguuuuucugcaugacugaucaucaugugauuuuuguccuucauuauauuaaugugguguaauugagggguuuuguguguugaagcaaccuugcaguccuaggauaaauccuacuuggucauguuguauacguugucaucuugccuuuuuaauuguuggaacaggccggaugcgguggcucacaccuguaauuccagcacuuugggaggccgagggggguggaucaccugagauuaggaguuugagaccagccugaucaauaugguaaaacccuaucucuauuaaaaauacaaaaauuagccagucauguuggcgugugccuauagucccagcuacucgggagauugagacaggagaaucacuugaaccugggagacggagguugcagugaaccaagaccacgccauugcacuuuagccugggcgacaagagcggggaaaaaaaaaaaagaguaagggguccuucucuggcuuuugucaagauuuucucauuaucuuucacuuucagaaauuuaagugucucgauaugguuuuuuaaaauuuauuuuguuuagauuuuacagaacuuguugaauguguaguugccuguguuucuacauaugauucguuuuuggccauuauuucuucaucuaucuuuucugccccguuuccuccucauuuuuucugauuagcuguauaucuuuuucuaauuagcuguauaccagggauugguaaaguuuucuguaaagggacagauagucaauauuuuaggcuuugcgggccauauggucucugcucaacagcucagcucucuuguggugugaaaggcguaauagaaaauaaguaaacaaaugcuugugucuguguggcagcaaacuuuacuuauaagucuggcaggaagccagguaguuucccaauccuuucuguguaauacaccuuuuaaacguuugcauuuguccauagugcucuccuucuucuucauuauuguucagucuuuuuuuuucuccucagauugaucuuuuuucaaguucauugacuuuuuucuccaucaaauccauucugcuacuuaguaccuuuauuugagauauuuuugauuucuaacauuucuaguugguuuuuguauacauucuuuuuauuucgguuucaugugagauuucucaccuuugguuuuccugucuucgguuaugaguguauuuucuauuaccucgaugaguguaguuauaaauaguugucuuaaugaccuugucugauaauuuugagguugguaucuguuuuguuuuuguuuuucuuugauagugugucacauuuuucuggcucuucauauggcaaauaauuugagguuguauuuugcacguuguaaauacuauguagacucuggauucuuuucuauugucgcaaagagcaugagguuuuuguuuuagcaagcaguuaacuugucguuaaaaugaaacgcacacugucauuaugugggcaguugcuuagaugcgcccuuuaagccucaggugcaggcugauuuguuugccucaaacacauguuguucaggggucagccagagacuugaacuucuauacucagaauuugggguuucuccuaugguucucuuacuuccugaguccuuaccucauuucucuaguagcccuagcugcccagucuccuuccccuggucucuucagcgagaaaggaggccggagcuucugcuugagugcuugcugcgccacaccagcucccucagagacuguggcugccuuuaggggacagacagaaaaaguggugaugcccagauucuuuugcuuccuuuuaaaauuugccuguucuuucuuuuucuuuuauuucccuccagcuuucaaagcucucacauaguugguuuauuuuauuuuauuuuuccuguauuuccaggacguauagcuuauaguucaccuauauuuguauauugguuuguuaggcauaaacagaaauggaacuuaguauguuauuuuugaagcaucugaugccagucuaauucuucuucccuucaacauuauuugaucuuuuuggagacuccuuagggauauuuuuuauuuuaucauuuuuuuuuugagacggagucucgcucugucgccaggcuggagugcaguggcgcgaucugugcucacugcaaccuccuacucccugguucagcgauucuccugccucagccucccgaguagcugggaucacaggcacgugccaccacgcccagcuaauuuuuguauuuuuaguggacacgggguuucaccauguuggccaggaugauccugaucuucugaccucgugaucugccugccucagccucccaaaguacugggauuguaggcgugagccacagcgcccggccaggauuuuuuuuuuaagacucauggcuuuacuguaauauguuuugaauugaucauuccaguucuggcuuggccuuuucaacagauucaggucuauauuucugcaaaaguuucugggauuauaguuuuaaauauucugcuucguuguuuugcuuuucuucugggacuccaauuauguuuacguugggccugcuuagcuaucuuuuauuucagucaacuugacuucaacccuuuuauauuuauauacacauacacacacacacacacacacacagacacacacacacacacacacacacacacacacacacgcauuuuuaccccaaauacuuauuugacaguauuuguuuuuguuuuuugaagacagggucuugcucuguugccgaggcuggaaugcaaugacucaguugcagcuuacugcagccuugaccucuaaggcucaaucaguccucucaccccagcccucccuaguggcugggacuguaggcaugugccaccaugcccagccauuaaaaaauuuuuuuuuucuuuuuucuuuuugagauggagucuugcucuguggccuagugcaguggcgcaaucucggcucacuguaagcucugccucccagguucaugccauucuccugccucagccucccgaguagcugggacuacaggcgcccaccaccacaccuggcuaauuuuuuuuuuuuuuuuguauuuuuaguagagaugggauuuuaccguguuagccaggauggucuugaucuccugaccuugugauccaccugccuuggccucccaaagugcaacccggcauuaaagaauuuuuuuuauagagaugggaucuuacuauguaggccaggcugggcucaagugauccacucacuccagccucucaaagugcugggauuacuggugugagccacugcacccagcugauaauauuugauucaaguucaaggguuuuguuauauucuucaguuuuguguuugcuuuuauuuuagggagugugauggguuuuccucagcugaaaugauuugcuuuuucuuuguuuuuuuaaaauagauuuuuaaaauggauguagucuauucuauuuccauucauugcauaggccaggcuuguggccagagcguccucuucugucaguucugcugucuugcauaguuucuuuuauaggugaugcuggugagggagggaggagggaggggcucguguaucucguuugcguuuuguuucuauaggauccuuaaauguuuuucucuuaguuucuucuuuuuuucacugccauugguucaagggcugccacuccccccagaacugauguuuuucagagccugccuguccuagucuugcucccauucagaccccuucccuggagugggugcugugagcuguguggguucucuguuguggcaguugugcuggguguccucuuucugagacuucuuuuaccugugcuucauguaaguucuccaggcuguacuacuuuuuauggagucuuaagcguauucuccccgacuuucugcauccauagacuugcagcuguguuggaauuugauuauuuuucuacuuauaggucaucugaauuugcgcuguuaucuccgugucagugagaauguaggucauaugugucuuuuauuuaaguuucuuuuuuauuuucugcuuuuuuuucggggagggaaugggguaagacucaguaucagccagccaucauuguuuucucuaccucaucuucuuauggaguccauugaaauggcuuauugauuuuuaucucaaaaucgaucucucauagaucuuuaucucugcuguuacagucgagacaaguaucaugucuugcuucaguuacuguagcagccucaugccugucuguuucauuuuguuucuuauacauaagcaaauguaaccccuuuuguuaccaguggaagguauccaaguuaccggcagcaaacacguauggguuugcagcaacuucaguucuugcuuccucaaaagaaagaauuccacggaggagcauaaggcaaaagaagagacugacgcaagggucagagcaggagcagaaguuuauuuaaaaggcgucagaacagaaagaaaggaaaguacacugggaagagucccaggcgggcauggaggucuaauuugauguuuaaccuugauccugggauuuguaggcucgcccuuuuccgcaguucuucccuuagggugggcugcccgcaugcacagugcgggaauugagcacaggcagcuuguuuaggaaguugugugggugcccaucugaagcuuucuucccguuucuccgccauuuugucucuuaaugugcaugcccgggaaauggccucucccuggcgucugcauucaguuaacacuuuagcacaacagguguggacugucaggaaauggccucucccuggcucuggcugccaauuuaucacuuuuagagaggcaaugugauaauuguugagcuaucacccaacauuccuagugggugguagaggccucuccugccgggcuuaugccuaacuaccuguaauacuucaacacauggaucagcuuuauccuucugacaaaauggcuuagaguucaguggucuauagcagagaauggccaacuaucaucccccagccaaauccacccugccauacuguuuauuuuuuuuuaauggcccaugagguaagaaugguuaagagaaaaaaaaaauucaaauguuuacuauuucaugauauuuacauuauaugaaauucaauuuuaguauccauaaauaccguuuuauuggaacacaggcauguucaucugacgauguagucaguggcugccucuguacuacagcuguagauuuggauccuguggcagagaccuuacggcccacgaagccuaaggcauucacuacuuuccccuuuacagaaguuugcugacccagguccagugugcugcaugaugguccccuucccuuccauugucagcugcuccccucucccuuguuugcgucuuccaaaugcucugggcuuccacguccccaaggcuacacucuuucugccuuuaguucuuggccugugcugagaacucugccccgucuuccugauucuaaacccaguuuuguagucagcuccuuuauacauguugcauugcaaggucgcuuuaucagaagagcuuccucuguccccaguucacaguucaagcccuauuuguuauucucugucucagcuccuuuuuuccuguguguacuauuaaaacuuauuuuguucauuugacugcuuuaucugucuguguaucuaaucaugcauuuugucuuucuauuguaauguggauuccaagagcagcuaccugucugucuuauuuaugguuguguuucuaguaagucuaacauucaucuggcucauaguagaugcucaguaaauauuuguucuaacaaauuaugaacaaaggaaaauuuaguuaaguggcguagagauacuagagaaaauaucaugggggaaaaugauuugaaaaaaaacuacauuuuaaaagucguauagaaauguggaggggagagugcagaaacagagaccuuuacuagaagcuugaaguaaauggagaugcauggacaaaauuaaaauaguagccauuucuguaccuaauagggccucucagcuaacccuacaauggggauggucacugguaguguguucugcugagaguuagggauucuuacucugcuuugcuggcccagccccugacucauucucuauccccuuucucucucucucuauuucugcccaccacuaaccccagccuuucucaaggggcucaugcagaccccauaauacuuguaacuucguuauccaaaagcaaaguuuucuuuuucuuuucuggagacugagucucacucucuugcccaagcuggagugcaguggugcgaucucggcuuacugcaaccuccgccuccuggguucaugccauucuccugccucagccucccgaguagcugggacuaccggagcccgccaccacgcccggcuaauuuuuugugguuuuaguagagacgggguuucacuguguuagccaggauggucucgaucuccugaccuugugauccgcccuccucggucucccaaagugcuaggauuacaggcgugagccacugugcccggccaauuuuuauauuuuuaggagagacaggguuucaccauguuggccaggcugguuuaacuccugaccucaggugauccgcccaccuuggccucccaaagugcuaggauuacagguaagagccaccgugccuggcaaaagcacacuuuuaagguccucagaagcucaaaagugaacuuaaucuuuuggcauuuuucuuuucuuuucuuuuuuuuuuuuuuuuugaaacugagucucgcucugucgcccaggcuggagugcaguggugcaaucuuggcucacugcauucuccugccucagccuccugaguagcugggacuacaggcgcccgccaccacgccuggcuaauuuuuuuguauuuuuaguagagacgggguuucaccguguuagccaggauggucuccaucuccugaucuugugauccgcccgccucggccucccaaagugcugggauuacuggcaugagccccugcgcccggcccauacacuuuagucaacuuuuuauuacaggucauuuuuuugccuguacaugcagaugcaucccacuuuauauauauaagaauauuuuguaguagcuguccaguaauuuauguaagcaguguccuauuggugauugaaguuuuucauuucuuaguuauuuuuuucaauuagaaauauuacagcauugagcuucuguauguauuaccuuuuugcgggugauaaaucuuuccauagguuuaaauccccaaagugggcuguucauuucugagaguuuacauauuuaaauaugauagaugcugccaaauuaucuucuggaaggaguguacugguuuccauucucacuggaauuaucaaaaaaaugcauguuucccaauaccuuugcuaauguugugaguuaucaguucuucuuucuaauuuguagaagaaaaauaauaguuuuuauuugcauuucucugacuuuuagugagcuugaauuuucuucagcagagcauagagauaagagccaaacugaccugcauuuuuuaugucacgucuguccuuucuuggugaacugccugccuuuccaaugcaguagcucaugguuuccacugaaaaugugaacauuaacuucauaaggucacuaggugucacuagaaucccauucuguuggguuccuucugggaguguucauuuuaagaucagauggcaauugauaaaauucugacauuuccuuuggauguagaaauuuuuaccuugaagaaagaauacauaaaguugaaauaaaggucagcuuggcccccacucuaaguucuguugaagacaauuuaucauuuuuaaacaacugcaaacuaacagcuagguggggaauacgguucacaggcuuuguccuugcuaggcugagaguugguugcugaccgaaggccaucacccccugcauuuaguguuugcuggaaacagggacauauuccugcauaaccacaacacaggccgacauuaggggcuuaccacggcuccuuuccucccggaauccucagacuccauuccuauccuaccagcagccagcuccacuucccgccuccucagccuucucacccugcagccauuccuuagucuuucacuggcuuuugugacuuugacacuguuuaaggucacugaccagugauaggaacgucccucaguuuggaacggucugauguguccuccuaauaucacaucaauguguaacaguggauguguagccauuuaggacugggcaaauuacucaacugcugggcucuagguuccuccaguagcuccugaguuaacuuccuacgguuauuuagugcuagaccacagaaguucgcucucugcuggcagagcacuguugugcagacuucucugagucuccuguguucuuccuugugugucagggacacacgugaaggauagcgugcuucgcggcuggaaucuucaaggagaugccauucacuuuuuuaccucacuaacacagugccguuuacaaaaaagauuaauguacuuuuccugaauugacuuacugacugggccuagagaauaagauacuggugcugggcaguuuggcacaagaguagcauaaagaaugcaggauuggcccaggugaaggcaucguccuaaggguagaaugagagucggugguuccuggccgaccuagcagguguacugugggaagugcuggagugaaucggcucucuggggagaauaagcucaucacagcacggcuucccgaggagaacguugcugcuuugauuucuguuggcucugaggcagcagcaggucaaauaguugguucucuguuuagagacaucucuugaaacacuuuucguuuugaccacuagauggugggauaauguuaucauuuuacauuucugaagaaaaauagaaaucuaacuggaagcuuuuuugucuguucaguagauuuugguuggaccccugguaaacauggguuucaguguagcagcuuuaauguguuaccacgugugcuaaagcauagcuguuggcaugcagaacggcauuaccagcaguaagugccacuuacuucuucauagugagugaugauaguuacacccagguagaugaaauucagggagagcaucucugugcaccuuacaucuuaucacucugaaggauaugugguugggaagcuucucccaaaggaacagaacacaucuuccacaacuguauaaccuaugucaggcacacguuuuccuggguugaaucaagcccuuccuuaaacugcuaacuuaaagaauacuuacugguuuuguaaaguuuggcaaaugaucuucucugcuccucgguuuucuguguugugcaauaggaggcaaugguaguggcuuuuccagcacgguuggugugaggcuucucaugagcugggugaccuuuguccugaugaugguggugauuuuaauacuguguauuugauaacacgauuaucuagggucuccucuacgucuuucguccagaugcaucucagccaccccccuuuugcuguucccuuaggcauaauagugguaaaucggugacauuuugcuugaguaagaagaagcugcuaaaaacuucucaugcuuaaaauugguaauuaaggggacuuuuuaaaaagaagcacaguuaaaaaacauuuccuuccucguucucuuccacccgccucccuuucccaucacuuuuauuagauacagcauucugcucaccccauuauugcaggcucagauaguugguuuguuuuuuuaaaaucagcuuuauaaaaacauuuacauaaaauaaaauggacccauuuuaaguguacauucacggguuuuuuguguauaccugugucaccaccacaaccaaaauacagagcauuuucaucaccccaaaaucuccuucguguccauuugcugucggccucccugcccccuccucccaccccagggcagccacagaucugguuucugucauuaaagauuagugucaccaauucuggggcuucagaucaguggaaucauccagcguguacuauuuugugccugacaucacugaaggugauguuuuugcgaucuguccguguuguuuguagcagugguuucacuuccuuuuauagcugaguaguauucuauuguaggcauguagcuuggugccaccaguugauggagauugggcuaguuugccauuuuagguuauuaugaauaaaguuacaauggacauuuacauuugugucuuuguaugcuuucauuucucuugggucauuacccaaacuuuuccaaggugguuauggcacuguauauucccaccagcaguguuccuuucacuccacgucuucaccaauaguugaaauuuauccaucuuuugaauuuuagccauucaagcagauguguagugguauuucaugguuuuuuuuuucccaacauuguuuuaagaucuaauucauaugcuacacaauuuguccaauuaaaguauacaauucagugguuuuaaauauacagucagguauugcuugacgacagggaugccuucugagaaacgaauaggugauuuuguuguuguggagacaucacaguguguauuaacacacaccugcaugacauagcuacugcacaccuaggcucuguggcacaaccuguugcuccuaggcauaaaccucuacagcaugugcaguugugaaacagugguaaguauuugugucucugaaauacuuaaacauagaaaagguagaguaaaaauaugguauaaaagauaaaauaugguacaccuacauagggcguuuacuaugaauugagcucgcuagacuggaaguugcugugguugagucguugagugaguggugagcgaaugugaaggccuaggacauuacuacuauacaguacuauggacuuuauacacgucauacaguuagguuacacuggauguauauuuuuuggagcaacuguauuaacugauacuauaacguuuuuuuaaagacaaggucuugcuuugucucccaggcuggagugaaguggcacauuuauggcucacuguagccucaaccuccuaggcucaagcaauccuccugccucagcuuccugaggagcugggacuacaggcgugugccacuaugccuggguaauuuauuuuuauuuuuauuuuuguagagacggcauucuugcuacguugcccccacuagucuccaacuccugaccucaaacaguccuccuaccuccgccucccaaaauguugggauuacacaugggaguuauugcacccggcuccucccauaaguaaauaaucuaucucucuguuacuuguggugggaggaaaagaaaaaaaacaccuagguuauguauaauaccuaauacgaguacuucguaaguaguuauuauacuguuuuuuuuuuuuuuugaaacggagugucgcucugucgcccagacuggagugcaguggcgugaucucggcucacugcaaccucugccucccagguucaagcgauucuccugacucagccuccugaguagcuggaauuacaggcacgcaccaccacgcccggcuaauuuuugcauuuuuaguagagacgggguuuccccauguuagccuggauggccuugaaccacugaccucccgccucaaccucccaaagugcugagauuacaggugugagccaccacgccucgccuauacuguauuuuuuuuuuauuuggccuuacuauagcuuuuuuacaugauaaacuuuguaauuuuuuaaauuuuuuuacucuuuuguaaugccuuaaaauacauuguacaacaguauaaaaauaccuuauaucuuuaucagcuuuuucuauguuuuaauuuuaauuuuuacuuuuaaacuuaaaaaaaacuaggacacaaagacacacauuagccugggccuacacaggguuaggaacaucaguaugucgcuaggcgauaggaauuuuucagcuccauuauaaucuuaugugaucacuguuguguauguggucugucauugaccaaaagguuguuaugcggcauauaacuggauucacagaguugugcaaccgucaccacaauuuaaaaacauuuucgucaccucaaaaugaaacuugcaccccuuagcccuauccccuauucucccgccagccaaggcagccucuaguagucuacuuucuuucucuguggauuuuccuuuucuggacauuuccaauaagcggaaucauaugauauacggccuucaugucuggcuucuuucucuuagcauaauguuuucaagguucaguauguugucaucuguauuagaauuucauuucuuuuuaugguggaaucauguuccauuguauggacacgugcgcacgcacacacacacacacacacacacagaagaacuaaauauuacaaggcuuaucaugaaaaacaauggucucuuucuugacccuuuucacccucaauuccuguuccccagaggcagcuccuuucacacuuguggcugcuucugcagauaagcuguucggugaccuccauauuucuaaauacuguggccguauugcuguuucgguuuuucaguuucagguauuaucuagugacuuucugauagggaagugagaauuucguuuuuaauccgccccucugagugcaccucacucccacauacacucaucugcuguuugcauggacacauucaugugcaggcucuuuccacucuugauugcaguguacaugauacauuuugguuaaaucgguaguuuauguuuacaucauuaugaauguggaaguuguguguuaggcugaaucucagagugaaccaugaauauauuuccuuucauggaaaacuuuuuguuuucccugagcuuggccugguguccuuugaguccagagcuucucaggcuccacuuaugugaacauggacccagugcccccauuggacacaggguggcagugagugggcacaggcaaggagagaaggagagucgcucccucuuuucagccuuccacccucugcccucugcacuuugcccccugccccaccccagacugcuguggcuucaccugcgccuccugcccuugagggguucugagcuccagguucugagcuccagauggacuccucccccgccccagcugccaggcuuggguuucccuuuuuuuuuuuauuuguuugauuucauuuccccagacagcucuuaucuacucuuuauuuuuguugguuuaugucuuuuuguuuuccuuuacuaucauuuuauugggguuuugggggucaagagaaaagcaugugcuaaguccaccagauuuaaccagaggucaaaaaccuuccauuuuuauugucuaaauauuauucaguuaaggauucccccuccccaucuuaguccccaacugccuuugcugaaucuuuagcgucuccugccacaguuauugcaguauucccugacuggccuccuccuccuggaccagugaucugcccacgaccccucccucacaccuguccccaugccccagacccacaggacaggguccaagcucauuagcuuagaaaguacaacccuuggaaucacaugaauucuuuuuuuguugcuagucuccuaaguugcauucauucacucagucauacaaaugguguauguuuuccccacaaugucacccuguuugcugcacugugcuugagucuaugcucugcuuccagauggaagaucuguguccucccacaucugccuccuugucagaguugagucuggugaucaucucugaccugaagcuuucucugaaccauacucguuaugcaaccuguugcugcuuuucugccugguuguacuucucuuguuacaauuacugcacuguguucuuuuuuaaauuuguacauuuuugcagauuucucugaugccuggcuuaauagaagacaguugccuucucauaucugccucugcauucaguguauugggguggcacaugucguuuugcuucggaaaauuccacugcauuguauacugaggggauaaugcgagaugagaaaggaaaaucacacguuaguguuguuauaaagauaguauugacuuuacacacccucagaagggggucagggaugccaggaugacauucacuacccuagugucacuuaccacauugcauagaccauacugugccguacagaggcacauauuucugaaacuuccuuuauuccuaauauauuuuguagaaauuucuauaucaauauggauauguguuuuuuauugcaguguacuuuauuuuuucaaauaacuguucguguguuagauguugaacggugauaggccugugagggauaguuggagaggugaguagaggccuuauaaaaacacuuaaacagcagaugagugagaauaugcucuaaacaugggagugacagaagguuuuuaucuagguugggaagaaauuuaagauuaauauuucaggaauguaugagugaauuagaagaggagaaacaaauaguagggcaggagaucauuuagaaaaucauaauuauuuagacuugagugacagaaugcuaagaaggagauaagggucacaggaauccagagauacgaagguggacaggagaaauggcagguguguccacagggcaggaggaggaggcuuggcaaugcggagcauugguugcacaccugggccuuggggcugaugguggugucuggacagaaacacaaaaaggacaacccaauuuuggaggaaagagauguccucugacuucaauuucuuuacgucccuucuaccucugaauuaucuguuuuauggccuguuuacuauuaaaugauccauuuaauagcauuuacccuuagcuuuaugaguaccaugcacuaauaauuuugaaguaugcuacaagucaaaaauuguuguguaaaaauuguacuuccuuuaccugccucuugcuucuguuauacuuaaauaccagauagagaugauuuugggaaguuugauuuauacugacuuuuguauuugcaguuguauuuauuuuuuaaaagucuguuaaaaugaccuagcuauggauuucuuaaauugcuaauacaugugcagauuuagugcugugucaauguauaauagaagcaaauacucauuagacuaccuuaauuuaauuauacagaugcaggacagcuggagcacacauugaugaaucauuguucccugcagcuaauaugaaugaacacuuaucaagccuaauuaaaaaaaaaguaaguacaugauuucaauguagauaauggcaauuaggaauuuauucguuuuuauuuuuuauuucuagaaaauaaaacuucuagaaauauauucaagaguugucuuaaauaugcuauugaugauauuguucuuuucacauagcauuuuuaagugaauuacagagauuauuuuauccuaugacuucuucgauagcauuuguaugaaauggaaaagccugugguuggccaugggaagacuaaaaggugccaagagacaagcaaacauuuaggugcuuugguaauuacuucagaaugaaguuuguuauaucuguagccaaaauaccugcauucuguuuagccagauaaaucucaaaaguccgauggaccuacauccaagugugcaaagucauuuauuaggaaaaucugcuguacaaauacaguuguccuucauuauccacagaggaucaguuccgggacccccacagauaacaaaauccacugaugcucaagucccuuauauaaaaugccauaguauuugcauguaaccuacacaaauccucccguauaccuaagaaagaauuguuuguagagacagggucuuucuauguugcccaagcuagucucaaacuccuggccccaagugauucuccugccucaaccucccaauugggauuacaggcgugagccacugcaccuggcuccucccauguacuuuaaguaaucucuggauuauuuaaaauaccuaauacaaugugaaugcuuuguaaauaguuguuacacuguauuuuuuuuuaauuuguguuaaauuuuuuuucuuuugaauauuuccaaucgcgacugguugaauccauagaucuggaacuugcagauacagagggcaaacuguagaguuaaagacauugcuuucauuugagauagaauucacauuuuaaccacaaccuuuucggcuuucuauuuauguaaaaguucuaauugugauuucuuuaucugaggguacuuuacucugaaacaucacagccagcuuguuuucacaugagauucucuguuagagggaggauuugaugacuuucuccaaacugaacuacauuuccuguagacuagaggagaaauaacugugaauuucacauuuccugaaaauaguaaaugauauuucuucguuacauuucaucucagacaagccauaguuugcccaugcagugauagaugaacuucuucagucuuaccugauuauaggugaacaaguguucagcagucucuggacucccugugacaugcuaaaaucaaguguuuauuguaaaaacacaucaguaguacauacauauuuucuuuguaaaacauuuaguaaacacagacaucucuuugauugcccucccucaauguaagcagcuuucaauuugaugaguauccuagguggcauuucuucaguacauuacacacauguacacacucacacaugcaugcuugacgugaaggggcucugcuaucuuauguguaucauuuggugaguugccuucucuuccccaauuaacaauaugguuuugaccauuucaugucgguagcuuugacucuacucaguuuucuguauugcauuauacauugugacuguuuuuccgguauucauguacuuuuagucacugucaguuuuugcuaaguauauuacuuaagccacauauuugaguuuauuucuccaagucagauaucuagagauaaaauuacuggguaagaauacauacacauuuugauuuuaccagcuccaccaaucauauacaagaugaccuauuucuuggccagauacaguggcucacaccuguaaucccagcacuucagaaggccaaggcgggcaaaucaguugaggccaggaguuugagagcagccuggccaacauggcgaaaccccaucucuacuaaaaauacaaaaauuagcccaaccugguggugcacaccuguaaucccagcuacucaggaggcugaggcaggagaauugcuugaacccaggagguggagguugcagugagcccagaucaugccacugcacuccagccugggcgacagcaaggcucugucucaaaaaaaaaaaaaaaaaaaaaaaaaccuauuucgugauacucugaccaauauuggauguuacuaaucuuuuuaauuuuuccuaaucugaagcauuaaugauugcuuguacacuuuaccacuuuaauuuucaugucuaaaaaccuucccuuuccuucucuuuuccaaauguaauugcaaauuaaacccgacucaaggccuuauucuuuuggguccuugagaugguucugugccucugucuccccccucacccugucugcugccugccugcccagcuugcuguuccucaagcaugccaaucguauuucuauuucagagccauugcguuaucuguucccucugucuggaacauucuucccccaaaauccuuacacaugacccguuuuccagccucccuauggcuuugugcagauguuacuuucucugugagaccuauccugccacccguuuauaccagcaguuccuucccacuugugccaacuaugcaagucucuuuucaucugcagugcugacuggcuccuccuaacacacuguaguaaugugggcaguuugauggaauacaguugcuagagaagauucacaggaccccaaaauaacaauguguccaaccugcaccguaccugagaaccaggaagcgcaagauggagugucuucuuguauacugcugacccugagucuauaugaaccagccccacuggcagagccuccaggcaaauccuucaucucacuacucauaaacaauguugacaggccagcacaaucuguccccaaacuucccggaccuguggcuauaaagcaccacugucuaauuaguacauuuugugucaugcagguacuuuagugaaagcagugcaggccgguuccaagccuguugaaaugaaccucccaagacacauacaauuuacuuauuuauuauguuuauuugcugucauuccuuaccagcauacaagcuccaugaugacaaggaucuuucuagguugcaagaccagcgccugacauaaagucauguuuuuugucaauaaaugagugaauaacuaacagagcaagauccccaguauaggcauuagccuugaguagcuaaaagaaguucuuucuaugagacuggagcaaaagaaguuagcguuuacguggguagcuagcuacccauguaagcaaauuugggcugguagcuucgcgcugaaaacgaaggaaccuagacagaugacuuaaauuucccugggguccuauaagaaagaagucaggcauaaaaguguuauagguaaaaucgaugugaaguucaguauguguauuugugcugauggcugggcuaaagacgggaagucaaugggcaguuccaagaacagaaagugggguggguaaggcugggaacgugagguguguuucaaaggaaacauuuccccugucugaggaugguuaagaguagaguuaacccaagaccuuccuguggauaucagccugggguuucauguguuugugaguguaguuacaguuuuuggguuuuacuggcugauuggaguuacugugauuuaaugacgguagggcaagcauaaucaugguucuuuucuuugguaauuauaaaauagaaauuguuuuauuacuguguuguggucuugcagggaggaugacgugagaauagugcuaccaagcaggcagugggcgugcugccaacccacauagaguccaagaucaugccacuuguuuugagaaaagaaaggcuuuauugcaaguugccuggcaaggagacaggaggaaacucucaaauccgccucccugaggugggggcucaggcaguuucauaggcagagaaaacaaagugugaucugauuggaucuugcaauggggugaugcugggaggugucaucugacuggguugugucacaaggugaugccagggcucaaucugauuggaucauggauuaugccaucagguguuuacuccuuaauuuggcccccguuccuuggucuaagugcuuagguucugcccgugguuacaugcuugguucaccugggcaugcucaagugacguaacuugcaacuucaggggccguggcaauuaaacaguucaccauuuugauacacaaaguugaacuagauugggcugguuuggugguaagaacagcaaaaaaucgaaagagacuggcuaaaaacuuucauggaaacuaagaaugcuaggaucaugaaaaugucucacaaagcauaauacagagccuuuuauacagucuuuuaaauucuguccauuuucuuuauaacugcacaaaaaaauaaauauugccaguucacauacagugcaagaaacaccucuuuuagaauuuuuuauuacugauguuauaaaagguaucagaaauguaugcgaaagggcuuuuucuccugccuuaagcaguugcaguacagcauuaauuuuuguguucuuuuugcacagcguaaauguaugcagcccaaagauuuuaauuuuaaaacaccagaaaaugauaagagauuucagaagaaauuugagaaaauggcuaaagagcuacaaaggcaaaaaacaaaucuagguaagcuaagaaauauaauacaguucuuugcauuuguguccauacaccuuguuuaauuugcaugaugacuagugggguucagcaugagagagcugaugaagacuaugauagcuuuacucuaugaaggagaaaacaaaaugucaggagccugcgggagacuuggcugggagccauaauagagccacgcagcuugagcuaaucgaccacagucuuaaccauucaucaagguggucgaacuuuuuauuuucgggaaugauuucagaagaaaagcaaacuuuggcuaauaagcauuauugaaauaaauaccuauuuauuucuucuuuauauauaacuuuguauuuuuaccuaauuggcauuuuuguuuuguuacccugaauaggcaaaucuuagaugauacauuauuuuagugauuugggaaaauacuuuagaauauuauguucuauaacaagaugucuuagaaaaaaauauauguauucuuauguauauauauuguuaaauaauauuuuuauauauaagaauauuaugggcugggcacaguggcucacgccuguaaucccagcacuuugggaggcagaggcgggcggaucacgaggucaggagauagagaccauccuggcuaacauguugaaacccugucucuacuaaaaauacaaaaaaauuagcugggagugguggcaggcgccuguagucccagcuacuugggaggcugaggcaggagaauggggugaaccugggaggcagagcuugcagugagccgagacugcaccacugcacuccagccugggcaacagagugagacuccaacucaaaaaaaaaagaauauuaugaaacauuaagaugcuuuguacguuuuugguauuucuguuuugccuuuuucacugucgucuaaagucaguauuuccuacuaauucugacacagcauugcuacagauaagcaauuauggucacuagaaauuccuaggaagcauuaauuccucuaguuuuuguuuucuuuguuuuaaucuauguuacuaugucacagauucucuauucuguguuuugaaauuauucaaauagaauugucgagauuuauuuuauuuauuuuuuugagauggagucuuucuccaucaccaggcuggagugcaguggugcgaucuuggcucacuacaaccuccaccucccggguucaagcaauucuccuggcucagccucccgagaagcugggauuauaggggcguaccaccacgcccagcugauuuuuguauuuuuaguagaaacaggguuucaccauguuggccaggaugaucucaaacucuugaccucgugaucugcccgcuucagccucccaaagugcugggauuacaggcgugagccaccgcgcccggccaagauuuauuuuaaaucugugacgauaaugcgacagaacuggguagaacacuuagcccacauagugcugccacauaauuuuccagaaacauggccugcaucauuuguuucaugcucagcccucccgcugccucaccuggugcguguccauccuuccuucacaccagcugucucgucuucgucaaagcucaagccagaaacgugcaaucguccuugacaucuccuucuuccugacacuaacccccaucaagaccauggcccugcuucugaaauaguuguuugacuucuucuguuuucuccuucccuccucucuccccugaugccuggaucaucccuccugcaccacugcagccacuccuuacgcugcccuccacugucuccuuacaguucaucucugugcugcagucacaauggugaaaacuuuaaaccagaaggacauccccucccugguuuaaaauuuccuggugucaucccaaggaaaaauauucaggauaaaauccuguauuuaacauauccuccaauuuacuaggugcuuuaugaucuggccucucuuucuagccucauagcaauauugcacacucuccuauaauucuuuauacuuuugucacuuuggccuucuuugcuaugucagugacaguguauuugaaaauacuuuggcaacaugguaaugauagauacaaaauuuucuucuuagaccaaauauguaucguaauuaaaaacuauauguauaaaguauuaaugauucaacuaauguacauuuguauauugucagaacuacaguaagggugauucaggcuuaagagucccaaaggagaauauauuaaaugauucuugguauuuuuuuguugggggugaguaucaaaguucugaagggcucuuugagcauaugcaagguagcauuccagaaaaaaacacaacucugcacccacacaaaacgagcucauaacuucaugguuccgggaccaugcugaucccacuucaugcagucaaguucaugucugggucugugaguguguuugaggguaggagugaugguucaugggggcaguuucugaaaccugagacaagaaacagaaacuaaauugcauuccagcuuuacaacuuuuaacuucugugucucagucuuugucuucaaguggggauacugauuuggguuuggauuugagguuggaugcacuaaugcauauauuguucuuagcacagugcuuggugagggcaguugcucagcagaugugagccagcagcuguagcagcaacaucacugccuguggaggugguggagguagaauauuagcaggaguagguaaugauguugaaagggaagaaggaaaacggggugugggggguuguucuuuaaaaggaaucacauuccugaaguaugaaggcacuuuuuggucuuaaaguggauuuuuuguuuauuuucagaugaugauguaccuauucucuuauuugaaucuaaugguucauuaauauauacucccacaauugaaauuaauaguaggcaccacagcgcaauggagaagagauuacaagagaugaaggagaaaagggaaaaucuuucccccaccuguaaguaauuaguuuguaaaaugaaaauuaugcaaauagccgauucaauuaugguggaaagcuucuuuuuucuuugccuagauauuuuaauguuuccugguaguaacacauuuugacuuauuucauggcuggcuuuguuuuccagaaaaucuuaugcaucauuaagauuuuugaagcauauguuggguguauaguauucuucaaguuuaaaauccuauuuguuguagcuccuuuguaauuucuauuaucuuuggaauuuuuucuuucuuuuuuuuuaaaaaaaaaugaaucaugucuuuuuuuuuuuuucugagauggaguuuugcauuugucacccaggcuggagugcaguggcgcgaucugggcucacugcaaccucccuaguucaagugauucuacugccucagccucccgaguagcugggauuacaggcgccugucaccacuccuggcuaauuuuuuuuuguuuuuuuguauuuuuaguagagacgggguuucaccauguuggccaugcuggucuuaaacucuuaaccucaggugauacacccgccucggccucccaaacggcugggacuguaauccaggcgugagccaccgcuccuggccgugaaucaugucuuuugaaggaauuugcuuuagauuaauguaucuaaggaaucaguuuguuuuucauuauuucuuuuaucuuuaaaauuuuuaauuacugaaguguaauucacauuuuaauaaaacauuuaucaaaguagcuaauaguaaaaguucaucuugauacccaucuaauuguacucuucuaccuggggguaaccuguauuuuaaguuuaaguguuuuuccagaucuguuucaguguaucagauaucuguguauacaugaaaaagauacggguuugguuucuguguggagguguaauuucuguuuuaccuaaauuagauaaugacauauguauuauuauccgcuuuauuuacuuaagaguauccuggaggguuuguuugcagcuuaguuguuguagaccuauuuuuguuuuaagaugcucaaaguagucuacaguuuugauauugaaaaucuauugguggguauuuuuuucccaguuauuagaaauuguguugcaguuuuuauucuuuuuuuaaccauaugguuugguuguucuuguuuuuuuguuaagccauuuuccuuucucuagacauaagucuuuccagcuucccaccccgacuuuuuacuguuauaaccccugcaugugccuacgugaauccuuguauuucugaguacuucguguauuucaauaauacuaauucauacaugcagaauuugauuuuuuaaagacauagagucucccuguguugcgcaggcaggacaugcacuccugggcucaaguacuucugccucacccucucaaguagcuaggaauacaggugugugccacgaucccuggcuuauugauagauauagucaaauuauccuucaaaaaauuugagucaucuuauugucaccaguuguuuauaagaaugccccuuucuccauacuuggaaaacugaauggcauuagccuguagccuuuuucagucggaagcuugaaaaacuggaucuguucuugaaguuacuuuugauuagaagcagguuuaagugccuuuucauauuacugacugacuuaccgaaugcagcuuuuaaugugaucaacuauuaccucgcuuaauuuuauguccuuuguccauauguaucaguuaagguuaguuucggcugcauauaacaaagacaaaaaccaauguguuacaaucgauagaauugccuuucucugucuugccuaguucagaaguaggcagccagggcugggaugccauuccauggugucuuuaagaaacuagguucccaucuuucuguuguaccugccuggcuuuucuugcaaaaugugugugccucccagcuaagccaucuccuuuugacagccuuaccagacgucuauccaauauuccugucuaauuccauuggcuggaauguggucauauggccaccccuuuugcaagcaagacugaaauguagucuugacugggaugcauugcuguccugauaaaaucaaaguucuguuguuaagaagaagugagaauggacauugagguagauaacuagcugugucccagguggacauccaaauuguuucagugugcaauuauguguauaaacuaauuugccuuaaacuuuacuuuuucuauuacuuggcaguguuaauucugcuacuuuacugcguccaguacaguuuaaaacuuaacugaaaauuuuaugugugcuucccuuccuuaucuugguuuauucucuuuuuuugcugaaguuuucucagaaaaguauccuuuugagucucuaaaaaauaucuuuggauauaagauccaaacauuucuuuuguuucuugacuauuguaugaaccgccuuugaagauaauacuuacgaucuuauuuguuaagucauugacauccuaaguguuuucuaugaaaccucuaggauuucucaacccagcacagcugacauuugggucuggguaauucuuuguugggggcacugcccugugugugguaggaagcucagcagcaucccugccucuccccacuaacacuagcaguguaccuacugcucucccucacuggcgauauccaaaaauguguccagacauuaccaaauaucugcugggaccccaacgucaccucugguugggaagcagugcucuaguuuuagagguaacuaugaugagcauccuugaagaaaaauccaugauuaucaaauaagaagacuagaacagacuggaaauguucacuuaauucuguugagcuucugauuagauucaggcaaguugacuuuaagaucccuucuaacuuugugauuauaggauuuaauagaaucaccuaugauuaauaggaggacuuccugcuggcuucaucugcuaagaaauacugaaacuuuaucuaaugcagugucuugguccuguuuuuagcuucccaaaugauucagcagucucaugauaauccaaguaacucucugugugaagcaccuuugaacauuucacgugauacuuuguguucagguaaaauuuuuauuuuccuuucugugauauguuuaaguuuugagaauaauaugauuuucugauuuagaauuucauguagcaacuucugaugaguaaaauaauuaguuaaaacuagaacuucuaaauuucccccugaaauuagguauuauaauaaaauuaaggcaugaguuaaacuuccuuuuugguuccuauagguuuuuuuuccuaggcauuugcuuucuugcuacagaauccauugcucuauuuaaaaaauuauugugaacguauaugaacuaaucuguaugcaguuuaaacuacauagaacugaggucagagcuaaggaaauguuguuucacacaauguauaauuaacacaaggaaccuguuauugaacggggucagugaaguauguaaagaucgucaauugaggagauaaauagaggauuucuaauuagaagcagaaagaacacugguaggaauuagugcaguuaguuccauguuacgcacauacauguuuguaaugugggagcccuaguuccacuuaggaugguaauuuuucauggucauaucuucuucguaccaaauuucuuacaguuucuucaccuaguccccaguggggcucaaguaaguagcagugaucccugaaaguacuauguucaaaagugcuugagauguuauggaaaauuuaucaugaaagccacagcaaugacaaagcgcaagauggcaucaagauauuagaaguuucaaacaaagccuccuuucagcgcaggguuaauccuuguacucucaccucugugugcuggaauuauuuacccauuucucuuaaacagucuccaucuuuuuauuuuacacuuguuacauuuauuuccuagaaguuggaaacaagugauaauaauagcuaacauugauuucauuuuuguuguuguaggcacuccucuaagugucuuauucacuguuaucucauuuauucucccauuagccuuaagagguagguuccaucaccaucccauuuugccagugaaaaaccaggacacagaggucaaacagcuuguccaaggucaugugguuugugaauggcaaacccaagcuucuaacuuaggcagucugacaucacagauuacacucuuagugacaugucacauugcuuaucggguuuuugaaaagugugauaaaacauaaaacaauuuuaggugcugaauaagauauauugagcaucuaaaauuaaaagugaccuuauuuccaacuacugccuugaagacaccuggggcacaguuggaagggaagcuuuggugguuaccuguguucuuccuuuuuaaaguagaacuucagugauuucagacagagaguucuaacacuuacgugaccuccagauugagugauuucuacaaaacacaggcccuccaccagcaagugcugagccccuauugagggagccagcacgggacuagagacuucuucauauucauuccaguagcuuauagcacagugacgggcagaugcccacguaaccauggggcaguaugaugcaugaugguguguagcagagggggcaaggccagggagagcuggcaagggcagugggagggucccagggauguugacaacccagguggguuuggaaggaugaauuguauuuacccagaauaaaguguggaggaaaggggaaggcccagaggguacagaggaguauagaauauuuaggagguagcagcagcuuagcauuacucucaggaaaugaguaauccauauaagaguugaaacauuaaagccuaccaaauggcucacuuuugaauaucaguguaauacgaggacuuuacuggaagacagggaagguaagggugagcuguguucauugagggaauguuucaugcaagucuagaacuuucccuagaucuuacaacaguaguucuuagguuuuagaauuauugaucuccuggaaaauuuagugacaaacuauggaugcucuuuuggaaaaugugcacaugcauauggaaauuugccuaaaauuuuuagaaguuuguuacaccucuucucuauccccacugcuaucccauacacccaucaaagcccagguucucuaguuaaaaauacuggccuaaaauguacccuuaaguggaaaugagaagaacucaagugugguuaauagucuucuuaacuaauagcuguacuuuaaaaguuguuuuauuggucaacugaaaguugaauauagaauaauuuaaaccacuuuuaaaaguuagcucuccguuaauguuuuccagaugaauacuuugcugguggcuuacacucaucuuuugaugaucuuuguggaaacucaggauguggaaaucaggaaaggaaguuggaaggauccauuaaugacauuaaaagugauguguguauuucuucacuuguauugaaagcaaauaauauucauucaucaccaucuuucacucaccucgauaaaucaaguccucagaaauuucugaguaaucuuucaaaggaagaaauaaacuugcaaagaaauauugcagguaaaguagucaccccugaccaaaagcaggcugcagguaugucucaggagacguuugaagagaaguaucguuugucuccuaccuuaucuucaacaaaaggccaccuuuugauacauucaagacccaggaguuccucaguaaagagaaaaagaguaucacauggcucccauucaccuccgaaggaaaaaugcaagagaaagaggagcaccaggagaucuaucaugccgaggcugcagcugugcaggucggaagacaggcugcagcacguggcgggaccugcccuggaggcucuuagcuguggggagucuucauaugaugacuauuuuucaccugauaaucuuaaggaaagguauucagagaaucuuccuccugaaucucagcugccaucaagcccugcucaguugagcugcagaagucuuucuaagaaggagagaacaagcauauuugaaaugucugauuuuuccugcguuggcaaaaaaaccagaacaguugacauuaccaauuucacagcaaaaaccaucuccaguccucggaaaacuggaaauggugaaggccgugcaacuucgaguugcgugacuucugccccugaagaagcccuaagguguuguagacaggcugggaaagaagacgcaugcccagagggaaauggcuuuucuuacaccauugaggacccugcucuuccaaaaggacaugaugaugauuuaacuccuuuggaaggaagccuugaagaaaugaaagaagcgguuggucugaaaagcacacagaacaaagguaccacuuccaaaauaucaaacuccucugaaggcgaagcccagagugaacaugagccauguuuuauaguugacuguaacauggagacgucuacagaagagaaggaaaacuuacccggaggauacaguggaaguaugugaaucuccuuuuccaagucaccuucgcuaaauaaacauguaacagugcauccauauuuuaaauuuaucacaacuuuuucauaacuuauuuccccauuuacuccucuuuuuacuuaaagaaugugcauuugaucauuccaaugauaaacucuuuaggaauagaugacuugcugucuuguggaacuucuagacuuauugguuaagucuguuaggaaucuauuucuccaagacuuuuccuucuuauaggucaaaaggauaaguaguccauaguaugaauaacugaggggagugaagucuuuuuccuuauuccauuggagucuuggcgcugcagcguguguaaagauguauacgauagagaguuuuuuaaaaccuagguucuuaauagugaggcuauuuaaagaaagaaauuaagguagauuaagccaucgauuguaucauagagaaagugugaaaaacuacuuuuagaaaucuguugucaauauugauuuuugaagaaacuuuggucaguguuaacuaugaagaaacauuuaaacauuuuugaucauuuguaacaagccuuguuuaacuuguacuuauuuugcuugaagcaucacuugaaaagguuuacuccuauucauaauuuaauuguaauuauaauaaaccauaucauuuuauuaaaagucaaaacaauaaaaaauuuugcacuucacaguuauaagcacaaauagguuccagcaaccaaaauugaagaaaucuugaacuuugaccgucuuuaccuaaagauuagguuaaaauuugagugagaacgcauucucucugcaugauuucucugcucuacaaauguuuuaacugccucuuugaagguggagaagucaugguagcguuugaaaucaucacagacauguuacauaccuuuuccuugaguauacgcuccccaaaauuguuucacaaaaagaaugaaaauaauuuuauguuuuuggccugcuauuuauaucuuggcuuucugaacauauauuaaauuugacaagaaacuguauuuuauguuccauuagccuuaguauguguuuucaaaauauuuauuuuaaaauguugacucaaaaguuaauauaaaacaauagauguguaaaauucuuugguaguuaagaauauccuguucugagguuuacauucuccaucuuuccaguuuucaccuuguguauuuuuuaagcuuuugaauaauaaugacauggaaauguaaauuaaguaggaaaaagcugguagcaaacaguguggcauggccuaaaauccccguguugcugggagugugcuaguccucggaagcagguguguuauguucuagaacacugccccccugcgucgacagccuccgggguuggggguaaguagaagggggugaggggccagcacuaguugacucaaggcacccugguggggacggagagguuuuuucgcucaguggugcaggccaucaggcagggguguccaggcagggcccgggugcaagaaaacauucugugugcgcuagugcgagaggaucuucuacagucaccugccuucaugccauuacagacagacgggaagucacuggguucuaggacauaaaaagaccuacauguuggcuagccuaaaucgaacccuuuuauaguaauaaagauucaucaauguuuuaaacuguccacugucagcccccugggacucaggugaaccaacucucuuugggaaucuaucuuagaagaugaaaccauaaagccuucaguuucaaugucagggaugcacacucuauaucuggugaaauuauggaggggugaaaacuucuguacagcaaacuguaccuccaaaucuuuaaugucgaaauaaagggcuuuuugccauuucuguuuucaguucacuuuuacuuguugcuguugucaguaucuaagauacaguguaaaaaaggcuucaaaaacaaguuacaaagagcuucaauacgcugauagaacgggaacugagcgagaaacaauuuugguuuuguuuuguuuuguuuuuuaguuuuuuuugagacauagucucgcacuugacgcccagguuggagugcaguggcacaaucucagcucacugcaaccuccgccucccgaguucaagcaagucucugccucagccucccgaguaacugggauuacaggcacccaucaccaugcccagcuaauuuuguuguauuuuuaguagagaugggguuucacgucuuggccaggcuggucuugaacucgcgaccucaugaucuacccuccucggccucccaaaguguugggauuacaggcgugagcuaccgcgcccggccaacaauuuuguuuucuaaaaucuuuaaaaucauuaauuuuuuucuuuuuuacuuuuuuauucucuuaauuuuauaaacaguacacagauacauucccauuguaacaaagauugcuaagaagacuagaauuuccaucuccucacuugccucuuuucacuaauucacuuccuaacuaaugaaagacaugcacccguugugucucaggugcucuucaaguuuguggggacauagagaaugaagcagcgugcacccucauagaggaagacaaauaguaaauaaguguauaacaaugucagcuagcaagcaguuaaugauaaaaagaaaaacaauacugcauuggauagauaaggugaccaacgaaggcuucccugagaaggugacauccgaucacaggccuggggagggagagggagccugugacucugucaaaauccauguuucagcuggagguaacagcaggaacaaauguccugauggaggaaaaugcuugcaggaacaacggggaggccaguacagcaaggacuuccugagcugcaggaaggagguuggagagggguaagagccagagcuuugggaccuucagucucugacaaggcgggcagcuguuuuguuuugaagugugaugagaagccauuggggcuuuugaacaggggagcaaccaaaucugauuuagguuuuaaauguaaccauggucacugaagaacagacuguggguuggaguguuugucugcacgaagcagccacuguccacaguuuaauauuuccuuccacacauuucuugugugugugucuacaagcauacaacugcaaauagauauuuuaagagaauuuuuugcaugcauagaauuauauugccuuaaaaauugcuuuuuacaaaagcaguaugucauauauuuacauauugguaccaguaaaucuucauuuucuaauagagccuauagguagggucagcacacuuuuucuguaacagaucagauaguaaguuuauuacgcuucaugggcaaagagaccaaaucgagguauguagguacucaugagaugauuacauaaugagaaaaagacauuuuccacaaaauuuuuauugacacuggaauacauuuuuuuuuguaauacaggucuauuaaugagaaaaauaaaauaauuuguggugggggaauaauaacauuucauuuaauuggaguucagacugaguguucccaucaccaacauugauugcaaauguuuauuaaggcugauuuguaauaagauagauuuuacguauuucacuuuugaaaauaucuuuucacacagacagauacugcugauucgaugucaguccacaguuagauaauuugcauugagcaucuucauugcuuagaagacgcugauggaauucucuuagauucuucucucgaugccugccucuuagcguguccuuauauugcagauucaucacuugcaauugaaaaauagguggaagcuccucaauugugcaguuaaauggguuuugaaauaggaaauuccggccaggugugauggcucacgccuguaaucucagcacuuugggaggccgagguagguggaucacuugaggucaggaguucaagaccaaccugaccaacauagugaaaccccauuucuacuaaaauuacaaaauuagccaggcgugguggcacaugccuauaaucucagcuacuugggaggcugaggcaggagaaucacuugaacccaggagacagagguugcggugagccgagaucaugccacugcacuccauccuggacaacgagagugaaacuccgucucaaaaagaaaaaaaaaaaaagaaauaggaaauucccuuugcucuugcacucagucugaaaagugcugcuguaguuugggcucaggaaguauguccacagccaguuugcaugggaauggagaucuucuuguuuuaaccucugacagcacaagagagaaucguugcuuauguguggaaaugugucccaccugacccuuagcacugccaaucacagcucuucaaccaccgaaagucaguuugaauugccaaguaguuaaagccgacuggucauccugaacuagugcacagcuuggcuucuaguugcuuuucacgaaggagacacaguuguccuauaggugccguguguucacuagcaaaagcagaaaaguccuuccuaucuauaccccacuuguccauggguuugauacagauuuucuucuuugcugugugugauggauuuuuacaugucagcaccuuguacauacguguugugagcuuaucugagcaauuuggucauguccaacuaccagggucuuguucaucgauaauagucaccaguuguuggaggucaaugaugguuaacuacucuucuaccuucuaucuaccagaucuuguugaaggcaaguaucagaaagacauuuauuaaacauuuauuggcaagcaauuaggaagugguccacaaauugaccaauaugcugaaggcccaguucucuguccuuuagugcaguguccauacuuuaucugaaagguuugcuggaggcagacaacauucuaugggcaaguuucugcaaacuugcacucagcaccagaccaucguguauccuuugacccugugguuuauuauagggucauuuagggauuaagccuuggauaccaccuccagggauaccagccacaacucauacuagaugguuaugcucuguuauguguggguauuggguuccccugcaauauuuaagccaauucaguguucuugaauccaugaauuuaaccaauaagaaacuguuucucacauccauuaugcugauuaacaagcugaugaugucaccgauaaccacucauuuuugucauccauuuuggcuuuuaacaaagcaucuaauauugggcuggaugauuuacaggaguugggguuuuuuguuguuguuguuuugagauagggucucacucugucacccaaauuggagugcagugacaugaucgcagcucaaugcagccucaacuuacugggcucaagugauccucccaccucagcauccugaguagcugggacuacagacgcaggccaccacacucggcuacguuccccaggcuggucuccaacuucugagcucaugcaaucugcccgccucugccucccaaagugcugggauuacaguugugagccacugugcccagccuaugguauaguacauuuugcaaauucugagcauucaagaggaacugugaauuacuauuguugcaaauaaauagauagacauauauucauuaaguauguuaaauuguugcacuuuugacucuucaaauaauucacaaguguauuaagaacccccuuucccauagccugccagccuaacucacuggggcugcaaaacuaagcaauccuagcaacuugauguggguuagucagucuuaacagaaggcuauugaccacuuaacuguuugguugauucauucauucauuuacauauucauuuuuuaucugucagauguuuacuccguaucuacuauguccaauguauaaacagugagagagguaagguuaauagaaagcucugucccuugcuuuaaagaacuuagcuaaguagggaagguacagucaagauacuuuacacacaaguaucaggaaauucaaaagucagagcaauuacuuucagugggaauuaaaauugauauuggaaugaccucuacaacgauuacaaaggauaaaauuccgcauuaucuauugaagaguguuguuuuuguuuuuuucagaaugaacaaagugaacuugauauuuuaauagaugaauaugaauacagucucguuagcagaguuuuacuuguguagaacccguauaacuugcauauauaccaaagguaucucuggaaaggaauuuuuccuaggugucuuuuaagauucuuuccagucuuaauauuuugcauacuacauuguaaaauaauuucauauucaaauuuuugaagcuuagaagacauuucucauuggauaauguuaaguguauauuuuuacauguuaaaauuauggauuauucagccuucagaagccuuuucaacccuugacucuugcauagugcauuguaagaguaaauacuaauuguuuaaauguguuauuaauauuagcauuguuagucuuaauucuguaucuuggaaguaggaaaguaggauguggaggaaaauaaauguuaaaaauaagaguuauuucuucggccuuagcucuagacaaaauuugacacaagccaaguuucuccuacagucuuuucaucguccacuucuucaucucucccuuuccuaguauuuaaguuacauguguccuuauacugucuugcccuggaucuggcuccaaagugaucauauuagucauuuucuucucuuuucccucaguaucaauacuuuuccuuaaucuugcuuaucucuguugaguagcugaagguugugauuuaacuaauucacacugagaggugagugagugaucauuuacuagcuuucauugauguguuugcauuuugaugguauuauuaauccaaacuaauuuccaaauggugaaauuucagauaacugaaagauaaaaauguggggucugucagauucauuuccguauuugaucauuucgugaaaacgaagucaaugaauuguguguguaaugagguugggaggaaaaugagaggaagauauauggcuuucacagggaaaugcuguggaccaaauuguguccuuugacccccacauuuauuuacugaaggucuaacccucaaugggauaacauuuggauagggugaucuuuggaagauaauuagguuuagaugaggucuugaagaugggggcuucaugaugagauuaggaccauuauaaaaagaccagagaacuggcuuccucucucucugccaugugaagacagcaagaagguagccuccuucaagccaggaagaaagccuucaccggaacccgaccaugggggcaccgugaucucggccuucaggccaccaaaucugugguauuuuguuaugguagccccagccgaagaagacagacauucauccaacugggguguguuggaggaagagcagcuaaagagugcauguucguuggaauuucuuggagacauucaaaauagauguccauuagguaguuggauauagccagccauaccucagcugggaggucuagacaagguacagagaauuaggucucuucaguaauggacgacuuuaugggaagugaugaaaucaccuuggggagugagaagggagcugaugacaacccaugaaaaaaccacacuuaggagcaaacacgaauaaagagucauccaagaagugggagagucaggaagaggaggguagguguuuguuuacagaccuccugccaaaaguggaguccaacuaaucuuuccacaaauguuuucagaaguacuuugcacucucaacugcuuuggguuuaccgaugucaauguuaaaacccacuggcaaauuaguguggcagaguuuaugaaauguuuuaaauaaaaucauuuacuuagaucauuuuuugacuucaggauuugugaaauugugaaaacauguuaacaauaucagucuuuuuuuuuuuuaauaucagucuuucuuaaguuuuaaaagauuguguugcauuucuuagaacuuuauguuuauaaaaugcuuuacagccuguuucguuguucggcaagaacugaggcaaguggcuauuauaaaacuuuuauugaauacacuaggaagcugcaaauuuauucaugacucaauaacagagcacuacgucccaaauuauaucucuaguccacugcuuuuccgauuuugacacacucaugcuucaaguaaauauuuguuauuuaaaaaggaaaauaagugcguaguagauauaauuaauaauucuaauuauuuuuaaucuuaaagacgauaggagauugcauucauguucuaccccgggggauaaagugggccugggagaaaagucagugcaagucaaccauaaaagauaccugaggagguacgggaucagucaggaugugacugguuugagucucgaguggauucaguauuagggauuauggcaaagaguguagguugguagguuugugguuuagaacuggaccuuaaaaucuguccagggcccaggcugcaaauaacaacuagcuugaauucaggaaaguauuaacauuuuuauucuacauccuuuuucacugagauaggacccuguuuuugaaaagagugacaguuuuuaccuuagacucuccaaacuuaguuauagcuggcuuuauagcauuuuaucugcaaagaagucuuucucauguuauaugauuuuuaaucucugagggcacugauguuaauuucacguugcauuauauuuauucaucugcaucuacauugucuauuggguugugagcucccuaagugugggacuauaucuugugcauuuugcaucuccaguggguagaugauuagcuauuuguuaaucauuagguaaucaacagugcaguuuggcuaucaccugccuggcagguucuaguacccccuaggcugcuacauaacuuuugcgucaaaguuugcauuauaccauugagaccauguuaugguccauguuagcuccuccuucaaaaucccauguaagucauaaaguaggcaaacuguuugaaggaggaggaagggugagaguaagaggcacccucugaggcaguagaugagucaaaucaaaguacacauuucacauuucaucguggguuacuuaggucuacagagguuagcaucuaaggaaaccacauuucacuugaaugaguauccuuuugguuugugugucuucauggcaagacgcuggucuaagguggaaacuuggggggaguaaaaucaucauccaucauuuguagguugaagccugaagcucuguacugaagacuauuuucuagaaaaucucaaacugaccccaaaaguuagauuaauuauugccucuaauauggaacugccuacucugaagagcuguucuuugucauuauuuuaaaaucuaagaauuuaaguuugacgagugcguaagguauggguauacauuuucuuacauuaucaaauggacggaguugaugcuguagaacacuguaaccugauuguuaccgaccauugaauuaagugaauugcuugggauauuggaauguaauaaacugaaaguucuagauagaucucaaagagccagauauauacaauuuauuuaaaaggccuauaacuuccuguuuccauuaugcauaaaugugauuuuuguuuugcuuaaguuguauuugguccauguaaaguucuaacuaauuuuuaauccccuuggguuuuagguguuaaaaauagaccaacaaggcaugauguuuuagaugacucaugugacggcuuuaaggaccucaucaaaccucaugaggaauugaagaaaagugggagaggcaaaaaggucaguguguaaaaauauuauuuuaaacuuucaaaugcugauacaucauaauguucuucucugggucaaugaaacauaaaccagucuaucugacuugucuuuuauucuaaaaaauugauuauggguaaaugcuggaaaacucagaauaugaaacugaaagcguuguuugcauuccagacaaagaguuauuauugauagagcaagcuuucucauaucacuuugcuaaugcauuucuuauaaaaaugccuguagcuucucucaagcagagaauguugguugugccaguguuucuugccauuuuauaaucggaauaaauauuuacuagguaggaggugaagaauccaaacauucauucacuuuugaacuaaccaagucuugaccucaagccaucagagugaaagguuuauauacuaacacucagguacacccuucccuuugugguuuuggcuuuaaaaccuugcucuuccucugaaagacuccgcugauccucuuacaugaguaauagaaugaggauuuuaaauguuuuuaucauucaauaucuacuugcauugcuuaaauuuaaaauuagccauauauauuauaccuugugccucauuuuuaugaggccaaaaaaguauaauguagugaaaccugaauucagaaugguagggaaaaaccauaccgauugaaaagcaacagaugaaaagaaugacagaguagaugggucugcauggggcuuccagguccugauacgcaggcuugaacagaugggcggcugcauuugaccugcggaagagaaaccugacuccuuugcuucuuaucuuggcaaugguuaaaagacauuuaaaauuacacagauuucaugaaaguuggcaguaacuuguagaaacuuagauuucuuuacugaugcuuucugguuugucucggaaaaaaaaguggagcaagaaaauggaaaggaacccuauuucagguaaagcaacagauguggagagagagagacugucagggucccauaacauguuuguggcgugggcaacaccaaggcaccugcucuacaauggcguugcgcacugugacuccacugcagccugcgggaccugcucagcgcgcugccucccagggguggggcccuuccuagaacgcucgcaacacuguggcugaguuuguguuuugcgucccaguuucucagucuucuuccuacugcuacauggccgcuugaccuaguucauuuggaaagaaauaaagaaccaguuuccuuugcaucuacuaccguucccgugccucuccugcugaugcgucgcauggcaccacagcucuguucugugcccucccgcuuuacugacccuuuacccucugccagugucugcccagggaagccgugguaccucucaucucuauugguacucuacguuguaccaugucuggcuuuuuuuuuuuuuaagugcucaguaaauauugaguguugaguuacuuguuacucaccauaaaaauacuccguccugucugaucaaaaggcaugagguuugacuuucucauuugcccacaguggaaguuacuguuucagacgagugguauugccucccugugccugggauagcccugaaucugaugggcugggucuguggaagcacuggguuagggacaggcauccugggcgggaguguggccccuucuuccuuaugaggcaucucacuguaaauggcauaugaaugggagauggguaccuguuugaccuucuggcauucuucuguagaucaaauaguaagugcuccauaaauauaaggugguauuacugucuugaguaaugauaaaagaaugaguggucagagagggagacaaaauacacaauuacaaauacacaccuccauaucugccuucaacugcugugcucaggaacaaaaauauuuucauauauuaaacugccuaacuugcucaaauuuaagucuucuuuuaaaaauauuuuaagaguauuaguaaacuuugcccucauaauuuagaaugucauuucugaaacgaauccaccacuucugguucugugugaagaaucacucaaagcagguuuuaaaugcagauuuucugggccagucaugguggcucaugccuauaaucccgguacuuuggggcgggcggaucacuugaggucaggaguucgagaccagccuggccaacauggcaaaacccuggccaacauggcaaaaucccgucucuacaaaaaacacaaaaauuggccaggccugguggugggcaccuguaaucccagcugcucaagagacugaggugggagaaucaccugaacccaggaaggggagguugcagugagucgagaucaugccacugcacuccagccugggcgacagagugagacucugucucaaaaauaaauaaauaaaugcugauuuucuggccccaccugagacccuccuggccagcagcucccgaccccagugcggcaccccguccuuaacguggaggggacgaacaccuagugagggcgaagaauccaccuucuguauugcgucucgccaauagcagaaggagcaagaccuagguuuccccucuuucgcaggauuuucuuccuaauccaguccuuauuaguguucaccgcacagccuuugcuugaaugaaucaaaaacuccuaaugcccuaggguagugcuuccugacugggcugcgcauuggacucaccuggggaucuguaagguuuguggcugccuggccccaagccagacaugcuggugucauuaauauggggugcacccuggccacuaggauuuuuuuaaacuccugaggugauucuaaugcaaagcagaguuuggaaacuacagccuugggacuuuuagaauuuaaacaaguaauuuauccuagaagaaguuucauuucuuuauaaacauuucucauguaaaguuguuucauuuuuagacucuaaaauuaaagaccaaggcuuaaaguccugauuugcgggcugggugcgguggcucacaccuguaaucccagcgcuuugggaggcugaggugggcagaucaugaggucaggagaucaagaccauccuggcuaagacggugaaaccccgucucuacuagaaauacaaaaaauuagcugggcguaguggcgggcgccuguagucccagcuccucggaaggcugaggcaggagaauggcaugaacccgggaggcggagauugcagugagcugagaucgugccacugcauuccagccugggcaacagagugagacuccuucucaaaaaaaaaaaaaaagaaaaaaaaaaauuccugauuuguuugcuuaaagguugagugaguguuuuaggagcgcaaauuugauagcaauauagaugaaggacguguuuuauuauuuuacagguuagaaggaagaaugauauaaauuucuuaaaagguaacauuaaauuuauuuuauuuuauuuuauuuuucugagauggaguaucacucugaugcccaggcuagaguguacugguguuaucucggcucacugcaaccuccgccuccugaauuuaagcgauucuccugccccagccuccuuaguagcuggaaccacaggcacccgccagcacgccuggcuaauuuuuuaaguuuuuuguagagaugggguuucaccauguugaccaggcuggucucgaacuccugaccucaagugaucugccuuccuuggcccucccaaagugcuggaauuacaggcgugagccacagcaccuagccagcaacauuaaauuuuaaguauauaacuucccaguaguuugagaucuuuugauaugagcauggggagagaaguuuauguugauaugugguaaugaguccacagaaacacuaaaauuuaguuuccugguuuuaaaaguauacaguggaauuguggaaggauugaauuggugaauuaaaauuagaagcuucugaguagcagccuacaaauauaauguuaguaucucaaccauucuuuuuuucccauuaaauagguuuuaccugcuuauuuuguuccuuguuagauuucaagauaaacuguguuaaacugaaauuuggaacuuaacacggccuuuuuuguuuguuuguuugagauggagucucgcugugucacccaggcuggagugcaauggcacagucuuggcucacugcaaccucugccucccggguucaagcgauucugcugccucagccucccagguaguugggacuacaggugcacgccacauauuuuuauguauaaggacauauuaagguauuagauucuauuaagcacaaaauuguuucuauuuccuaaagaaaacaaaaucuuguaauugaauauuaauguugaaaaagggagaguuuacaggaaauaucuuucaccagcuaaugacugaagcaaugccucuacuagaauggagaacaguaaggucugggccugacauuuuuauguuuucacuugagagccagccuacaugcuauuucuguagugaggaaaaugauuugaaacucagaugugucccguggcccuaaugacuuuauuuucuuuuuaguuuuaaaucugaaguagcacuugcagguaauguccuaucugggcagcccugcagacaggacugucagucgaugagagcugucagucgugaguucugaguaaugugaaggugccagguagaagguacaaaggcaagaaaggugggaaggccuggagccugugcgaagagcagcacggccuugguguggcccggggauggaugcagaaccgcgagaagagagaggcugacuucagccacggccacgggcucugggguuagacugcucucaucuuugguuuucuguagguucauugugauuguuguaccaggguauuguuuuuguuguuuauuuacuugagagucacaggccguccugucuuugaucuguucuggaaacuucuccacugugauuucuuuugccuguuuucucacgccuccauugcugggaacgcaaucucgugugcuauccuuugcuucuauagcccaugucucaugauuuuccucuauuucuuuccucuuguaucuccuuauuucauucuggaugucuucuauugguuucuuuuccauuucaccuuugacucuuuuuaagucuauucugaugcuaaauccauauacugaguuuuaacauguauuauuuuucagucccugcuauuccauuuauuuuuuuuaauuauuuuuuguagagaugggggucucuccacguuggccaggcuggucucgaacgccuggucucaaacaauccuccuaccucguccucccaggguacugggauuacaggcgggagccuucaugcccucuauuugauuuauaaaaaccauuuccaguucucugucaaaauuauuaauccuaucuuuuauuuauuugaacauauuaugcauauuucuuuugaaauaacucccuuuucuggcuccccucaauuucuguuuuucuuaucuguuguuuucaaucauacguuccauaucuaauaugccugguuaguuugucuuuaucuuccuagcagggacugagaugaucuggagcugggguucugucucugugaggcuagcuguccccugggagugugggcuucugacucugguucaccuccucuuccauggguuucuucuuccaugacucacugacuuaguagcugggcaacgucugcaaauagcuggggcuuguuuguuuguuugcaucuuguccagcuuuucugagggcucacagugaggagccuauuucaaacuacuuaguccaccauuccuggagacgaugggugaauuuuaacggccacuuaacuuuucuaaauagaguuuuggugugaaugcuucucugagaagacagcaguaagaggccaacucaagagaaaugauuuuugagaugaacacguaggucaguuugcaaaagacacacuaaacaccugaauugacauuaauucaguuucucuuaaagagugaaaaaaaccaugauuccaugaagaauuauagaaucucagagcuauaacuuccauuagcuuuuuuuuugguguaaugcccauuuuuaauggcaaaaaucacucuauaaaucagucagaaaaagagucuguuuuuuuuuagacuuauuuuaaauauacuuguuucaaauuuguugagacuuuuuuuuuuuuuuuuuugagauggagucucgcucuguuguccaggcugaagugcaguggcccagucuuggcucacugcaaccuccaccccaccagguucaagugauucuugugucucaaccuccugaguagcugggauuauagguaccugccaccaugcccagcuaauuuuucuauuuuuuuuuuuuuuaauuaguagagacaggguuuugccauguuggccaggcugguuuugaacuccugaccucaagugaugugcccgccucagccucccaaagugcugggauuacaggcgugagccaccacacccggccuggugagacuuuauuuggaggauccaguuaagcaguuuuauuaccucuguaaucuuagcuugcagcauguaggucauugacauugauaguuauacaucuuuucagagggagaaauagaaaauauuaugacgaauuuugaccuguuuucuuuguuacuuguugaauauugucagacacagaacccaaagaagcuauguauagauaccagcacucugguagaaauacacgaauguaauuuuuuuuucuccaaguauuugguuuauucuacuacuucuggauuugguuuuucaaaauauugauuauuauccucaggaacauuuuuaaugugaguuaucaacaggauagcuuuuuguaaguggcucaguuguagaaucucauuuuggagccaucucugccaauccagcuuguugcaugugaaggcaagcugugggucagagcacagaaauguuuacagaggcuuuccuaagccuggaggccuggagagaugugaaggaacaaauagagcauacuuauuuugauagugguuuaaaaaaauuaaagaauuacacaccacauagaaugcuuaaauuccugaaaguuucucaaauagggugcaaaacaaauaauagcuugcauaugcugauaguugcuuguucuuacaucuuugcuagaauaugagcccauaaggacauagucuauauccuguuagucucuuaauacucagcaggauauagcaucacaaacaaaauaagugcucaguaaauauuuucugaguaaauaagagaugcauuaauuucccuuuuacuuuuucagugaacauguuuaaaacauuuuuggugcucuuaaccaucacucaguaaugauggaaucaucaucauguacuucacuuauuuuugaauauucuuccaaaacuugagagacugucuucuuucaguaaaagauggauucucuucuccaaggcugugcauggcagcgcaguguugcuaaagcauugcccccagagccagaugccuggguucagucccaucucuguuacucaccugcucuguggguuccaugguguugaacaaauuacuuaauaucugugccuauacuucuuuguguauaaaacaggaauaauaauaauaguaccagucuccucaaaggguuugugcuaauuaauugaguugaaacaugcaaagaguuuaagauaguaccucauauauagaagugcucaaaaaauguuagcuauuuucuucagcaccagcuugggugagggucaugucugcauauugacugugcuuuguucugcagcuauaacuuggaguaggucucucuuaccugccuccucuuugcccacucccagagaccaccaugugucuuuaaugaaaaugacccucaaaacucugggacaguccacacuguguuucuuguuggacuuacugaccacaggcaugccagagccaaaauagagucuugggcagggggugaguauaggaguauagccuuuucuaaaagcuccuucagugauucugagcugauggucauccucccauugagaaccuuuguuuugggggugagauguaggccauuagcaugaaauugugcucugucaucucccccaggaggcagaagacugaguucugcggucagaaaugcccgcuugggggaucugcuuccucaguuuucgagagaugcuuuccucaucuccaguaucauuagaaccuuccugaaagaacugagaucuuugugagcugcgauaggguacucacagcugucauuuauugagcauugugaccucuuuuuagauugaguuuucuauuucucagucauauggaaagcugaaaagaaaguauauuucagagagcucuaaucaugucuuuauugcggaggcaguagauugggaauuacagcucauuuggguguagcauccccagagaaggagccuugcaguggaaagaagauaaaagggucccaguggugggaauaaaaagaguacuagaugcccagagggugggaaaggccuagcccagaugcaguguggccaggccagcuaggggcaggaggaaagagagcugcagggacacagaugccuuccugagcagagaaaauagaauacuugagccaauuuucauguaaaauggauuauuuuccuggcguuuccuguccuucaaguaaaagguucuggaaugaguacuucacugcuguaauggagacacuaauauuuuaugaaugcaguuuuacaguuugcaguaaugccaggccuuuggcuguuuuccauuagauggugcacuuggcuggaagcauauacucuuguagcuuugauuuuaaauuuaacuuucaaguugaaagagcagugacucauccaaaggacaggugauauuuauuuauuuuuucuugaaaaugcagcacggguauguuguuaucacacguuuaggggaauugccacacuuccucgaggaugacacccuuuguaaauauccauguaaaucauuuccauuguucagacccgcuguacgcagaaagauaggcccuuuagugccgaccagccggccagugagcucuguaagaucgaaggugcccuugguuuccaacacagcuguuucagugaucuguaauugcuuugauaaaucacuuuuggcagaguguacccagagcuggcaguggcggggaugugcucguuguaacaggugugggguccaucagcagauguugcuugaugaagccauuuaaaaaacagcugccucuugauagccuaacaguugcuuucagcccccauuagcacguuguuuuuuucuuguuauguaugagagaaaauauuucuacagaaaacauuaaauaggaucuucaaagaacuccaucuuuuuaaaaauguguuuuauuuguucacuaacugauuuugcaugcauuguaaaugugugguucagaaauugucaaauguguuuuggacuggacgugguagaaaugaggaccagccaggguggaucuccugugccucaguggucgucuuuggccacguaaagguagaggccaccgacggaggacauuucccacugggagacccacaggcgcuaagagaggagcuagccgaagaagucuauuuaagaucugcugcuuuggccaggugugguggcucacgccuauaaucccagcacuuugggaggccaaggcagguggaucaccugaggucaggaguuugagaccagccuggccaacaugggaaaacccugugucuacuaaaaauacaaaaaauuaccuggguguggugguacacaccuguagucccagcuacucgggagacuaaggcaggacaaucacuugaacccaggagguagagguugcagugagccaagaucaugccacggcauucuggccugggcaacagagaagauuccaucucagaaaaaaaaaaaaagaaaaauucugcugguaggcauucuaugcacugagcaaaggagagauguggaggcccaauuuaaauaguuacagcugcuagcuccuaaggucuaucuuacuaucugcaccguuugcggggagucagcuuaaugauaguaaacugugcuaaaugggucuagaaauauccaauuaaucuguuugagauauucggaaacucaauagcuugcugaaguagcaaacuugaauccuuauuuuuauuuuaaaagggaguaaagggacuguagauaaguaaaagaugcucugcacugcgccucucugguaccagucccucucguuuaggcagcggccacuucccgcggagcuguucacgccaagugacccugccacugcgcugcucccaccaccccauguccaccccguccucggacgccuggucucagcacaucaccgguauucucuuccucuuaccaguaauuaguuugagacugugacucacuucuguccaacaagaugugaagggaagucuuccugggagguuucuggaaagcguucucucacuugugauagcccugggaagaaaugcuccccggguccucagagcuuuguuguggcuggacgcaucuucuggaacugcgacagcggaggaggaagccaagagagugaaccaaaacaaggaagggcggagggcgggggaggccugcaaaccuuacggcuuauuuccacugacaucagagacucauguuaauaaguaacaagcggcuuuguuuguuaugcuccucagacacgcgguaagguagacacacagaaaugcacagcuguacguauuugucuugaaggcuagaauuuacuuuaaaugugagugguuuucccaggaaaaauuuaugucuguucucuugaggaauaauuauuuccuacucaauuuuaucuaucgauccauccauccauccauccaugcauccauccauccauccauccauccgauacagagccucgcucugucgcccaggcuggagugcaguggcgcuaucuuggcucacugcaaccucugccuccccaguucaagugauucuugugccucagccucccgaguagcugggacuacaggcccgugccacuacaccuggcuaauuuuuggauuuuuuuuuuuuuuuuuuuuuuuccugagacagagucuugcucuaucgccaggcuggagugcaguugcgcgaucuuugcucauugcaaccuccgcuucccagguucaagugauucuccugccucagccuccugaguagcugguacuagaggcacguuccaucacgccuggcuaauuuuuuuuuuuuuugagauggagucuuggagucucgcucuguugcugaggcuggagugcaguggugccaucucggcucacugcaaccuccaccuccuggguucaagugauucuccugccucaaccuccuggguagcugggaguacaggcgcgugccaccacaccuggcuaaguuuuuguauuuucgguagcaacgagguuucgccguauuagccaggauggucucacucuccugaccucgugauccgcccgccuuggucucccaaagugcugggauuacaggcaugagccaccacgcgcagcccuuuuuuuguguuuuaguagagacaggguuucaccguguuggccaggaugguccgaucuccugaccucgugauucucucaccucggccugucaaagugcugggauuacaggcggcagccaccgcgccuggccuaauuuuuguacuuuuaaguacagacgggguuucaccauguuguccagguuggucucaaacuccugaccucaaguguuccgcccaccuuggccuuccaaagugcugggauuacaggguugagccaacgcgcccugcccucaauuauauuuauuucuuugccuuuccuuacgucuuuaacucuucacacuuuuaaaaaaguuauugccuuccaaauaauauuuaggaauauaaauuauuugauauuaauccaggguaauuucgauuuguuuuuaaaaaaggggaauaaaaacauuauuauucagaagggguuaaauacaaugacaaaaacugcaauucagaauuaaugaggcguuauaauaggguuuguuaaaaaaauuaugagguauuuaaaauagauuuuuggcauauccuuuugugacuuuuggauagacuuaagacuuaguuuauauaucaauagugagucuguauaggaaaagaauauaauauucagugacugucaaaccagugacuggagcagcuugguaugaagcgcuucuuauucuggucucccuaaucagugauuuucaauuuugaaaacuuuuuuuugaaguuguguuguuuuauuuuucugcagaaauaucuucugcuuuucauuuuaaaguauauuugcuauuuauuugcaaucuaguucucaucauuaaaagcaguacuaaaaucuuaucccagaauuuauagguugugucuuuuguccuuuuuuuguuuuuaguauuuuucugucacuuuacuuccucaggugaaguuuuaacaaaaacgagggaccauggauaggaaaguaggaaugaaacaguuuacaggguugaaguugugguauaauucuuuuuuuuuguuuuguuuaaagacagggucuugcucuguugcccaggcuggagugccguggcgagaucauagcucacugcagccuugauugccugggcucaagugaucccuccagccuuggccucaugaguagcugagacuccaggcaggugccaccaugcucagcuaauuuuuuuuguuuguuuuagagaugggauuuggcuguguugaccaggcuggucuugaacucuuggccucaaaccauccacucgccugggucucccaaagugcugggauuauaggcaugaaccaccaugccuggcccauggaguaauucuuguggaguuggaagguagagguguguacgugucuguuucucaaaauaguagcacuagccaggaaauccaugaauuugcauauuuuuccccaaguucagcccauuugcuuuggugaguuugggguuauacuuagaguggguaguauaaggaguuucugcccuacaccuuagcuuaagcaauuugagcacauugcuuuuugaguucaccaccaaggauccagagcucagaggcagucuuuccugugcagauaagagugcacccugccugcaccucacggucuugggcucuguggcuucucuccuccugccacugccccuuauuguggguaggcuggaauucccuaugguccuuuguuuggggaagggggaugcuuggauguucccgggugucaccugugcaugcccccuaugcuguccucccaccugcccuguccuacaagcaugaccugcacccuucucccacacacccagaccgcaggcuuauucuuacucucccuggccagccccucuucuuggagaggagaaaggaugaugugaaaauaagaucuaacauuggggcuccccagcgacuuccacaaggagcaaggagcuaggugcauguguagaccccaugggagcuuuaguguuagauaccgaguuugcuagaugaaacaucuuuuuaauugagguggugcagauguauuguuugaacacuuuagacacuaaugaugaacuacuuggauguacauuuuuuugguuuuuuuuuuuuuuugcuaugaaaauuagaaaaaauauuuauccaagacaguaaguauugaaaacugauacuggugcuguauggaucacuauuauuguauuauuugaaacuguuuggaaaagguauuguaguuuuuagaaaaacaaagcaaccugaauauuaaaagucugugaauuugaguaaaaaacaguccacauaagggaaaaaauauauaaggaaggacaaugaaguuuugaaacuguuacuauaagaaagcuaaaggcugagcacaguggcucaugcuuguaaucccagcaauuugggaggcugaggcaggaggaucgcuugaggccaggaguucaagaccagccugggcaaaggagugagaccucaucucuacuaaaaauaauuuuuuaaaaauauuaguuggacaugaugguggccaccugugguccaagcuacuagggaggcuugagaccaggaauucgaggcugcucugagccgugauuguaccacugcacuccagccugggcaagagugagacccugucucaaaaauaaacaaaaaagaaacuuaaagauuuuagucucaauuuucuacacugaacccaucuuuagaucauagcauguauaaaauuaaaaaugggggaauaucaacauuauuauauuuaaugcuauagcuuauuauuguauuuaauaagcuacuuguuuaaagaucugggaucucuuggguccacagacugagucuuucugaaggugcuuuacacgauguagcugccagggaucuaggucauauaauauccucaggaugggauuugaagacauuuuuccagaauuuaucuuuugucauauuggauuuuauuuuuaaaaauuuccucuauagucaaaauuuauauaaauauaugauucugauaguaccauauauauuuagaugggcuuauacugggcgugaacaagguuaauaaucuuugugaauauguggguuaucuccuuauuuuacuuauucuuaaggaaaauuaauuucacuguuuaccaaagaacugauagcuaaacccaaaagauuucaaagaauguuuuguuuuugaaauguuucuauuuaucacuaauaaaacggguauaucuguuuaacuugaccuaucuuuggucuuacuaaaacaaaaucagcuagaccauuucccaaauaaucaugcauucaauacucuuuuucucucucucucccugcucccucaucucuacuccuuuagaacuuucagaacauucuuuuguguagauacaguguuucaugucuguuauuguuucucacuggucguuggauucuuucaugugaccaccuuuuucacguuugcucugauugccuuuggaugcgccuaacugugugcuuuuccuguuaaggaaaagaauccugcauguuuuuuucucaucgaauaacaauguuaaaaacagaaaaggguuguuuuucuucuuugcaguaggcauucuguaguagauaccuugacauacuuaaauuugugagaugugucuagacgaauggaagaguaauaucucauauuaauauauugcuaauaauaagauaaagguuucagcuuccuggagcuguccauauaauagaauuuguacuuguuuuuucauuucugagauccucauacuuugggguuuuuuuuauuuuuuuauuuuuucgagacaaagucucgcucugucacccaggcuggagugcaguggcgcgaucuccgcucacugcaacuuccgucucccggguucaagcgauucuccuaccucagccuccugaguagcugggauuacagguuuccugccaccacacccagcuaauuuuuguauuuuuaggagagauaggguuucaccauguuggccaggcuagucucgaacuccugaccucaagugauucgcccaccuuggucucccaaagugcugggauuacagaugugagccaccaugccaggcucugagauccucguacuuuuaaauaaaauguuaagauacaugcuuuaugcuuuugcugccucucauguuucaugaauacaaguaaacccaugaguaacucaugaauacacauaaacuucugggccuccaaacgaugcccugccaguggccaugccacaggaaucagaggcuguacuucacuuugugguugcuuuauuauuccaccauuauaagcuuuaguagaaaauguaaagaggguuguuaaacugaaggaguguugucucaaacugaaggagaaaaguaguguugcugcuguaagauguacauaaacuaaggggugucuuuucuaccauccaguuagcaauuaggaaaguccuucuuugcucauaccauuccaaagggagucaucuuauucuuucucuaaauuuccuuacaauggaggcugcuacaguuuaaguaucgaagguccuuuuuuuucagauuucaccugcagugccuauaaauuugggggaaugccuuuuuuggggggugaccaacauacucaguggaucuuggaccuaccaccaagugaccuuccuugcucaccuguaaggcugagaacaccguaagcaaaguaccaggcuucuuuccccaaaagggcuuuguaagcguuggcgccauaaaaucaaccugaggacuuagguggcugguuauuucugaguaagugaauaucacucucaaauacgacauuccagcaaaggccaugguugcauagccacuguuuuuaguuauguccugguaacuaggaagauggauuguuuuuuaaucuaugcaaauaauuauauugcgcugaaaaaaaugauacucaauuacaguuucacaauucuggagggaucaggcagggauaauaagauaccauuuccagauguuuccuuucuguuuauaaaagcacagucgacugaauuguuaggagauacaggcagagggagaagagaaaggguuccuuauguauccagaauauagaguguuaaaauagcaacaauacuguaaacaaaagccgcaguccuccuucaguaguucaucugggccuagucauuaauuuuuguuccacuugaucuuggguuagcagucucaugaauccgucugcuucucaaugaggguuauagaaauccucuuccccugguggggucucagcauuauuuagacaaugccauaagaagccuguacccaaaaguacccagcauaguucuucuccacggggcucuaacacagcccccucuuggucgaagguaagucacucuggccuauagcuaauugcagaugcugaucagggaagugucagagaaaaacagaaaucuguaggugacaaaagauuuuaaauggcuaugguucucguauuacugauaauuuucaaaacuaaauuuauugagaguucauuacaacaguauuggcaacugauaaguaaaguuaguuauggugugcaaaacagagucaacccaaaaaaguucuagauacagcaucuagaaacaccauaauuaaccuuauuuuaaaagaacaguggauguugcaucuaauuuauaaaaauggaagaacauaaucuuuacagaaaaaaucuucagauauaacaaaauagucccaagacauaauauacaaugaauaugccaagcauauaauuagaauagaccaagaauaucacaucaagaggguuauuuuagaggggacauaaacaccuauguauuaauaacauauauuuaaccuagggcuggcuaucuuuuuugaugugacaauuugucccauauaacuuaucaauaguaacacaucaaauggaucuccuaauuauuucaagcaucuguuuuuuauuaaaguaaaagcacaaauacuuuuuauuuuccagguaugucuggggaaucuuagacaguuuuuuguuuuguuuuguuuuuuugagauggagacucacucugucgcccaggcuggagugcauuggcccgaucuuagcucacugcaaccuccgccuccuggguuucaagccauucuccugccccagccucccaaguagcugggauuacaggugccugccaccaugccuggcuaauuuuuguauuuuuuaguagagaugggguuucgccaugguguccaggcuggucucgaacuccugaccucagguaauccacccgccucggcuucccaaagugcuggaauuacagggauaagccaccauguccagccucagacaguuuuaaguacaaaauauaucauuuaggauuugauuugcggaaggcaaaauaucaaaaauuaucaagaaauuuugaauaccugauuccaauaggaucauguaacuuagaaacaauuuuugacuaccuauuuaaucaaagugacuguaaaagguuuuaaaaguaaacagagagguaacaugauuguaaagaaccuuagcucuuuccuaagagacacgauuucuugaauacucaaggguaaaauaaagucaauauaaaccauagaagguuauucucauaaaacacagaaucuuuggaaucuaagccaauuauacagaaaaaagaauaagccuuuauuuuuuaggugaaugugguaaacaguaaaccaaagaaacaggcucaucaauauuggguaaacuuuucuuuguuuuuaaauguuuagucuuuaguuuuaagagaucaucugcauuuuuucuguaauaaacuuaaaagauauccacuuauauuucuucagauuuauuaauucuguagcaauuuaagcauugaaaugacaguuuuucucucaauccuuuuuuuuuuuuuuuuuuuuuuuuuuuugagacggagucgggcucuguugcccaggcuggagugcaguggcacgaucuuggcucacugcaagcuccgucuccccagguucacgccauucuccugccucggccucccaaguagcugggacuauaggugcccaccaccaugcccggcuaauuuuuuguauuuuuaguagagaugagguuucacaguguuagccaggauggucucgaucugcugaacucgugaucugcccaccucagccucccaaagggcugggauuacaggcgugagccaccgcgcccagccugucucaauccuuaacaaugcuauauuuguuguauuucauauguuuagcuuucucauggagaaaaagaaacauaggcauaaaccuuuauacuauccgccugcugguccugcaacaugaguuuaauaaagcguuccugauacuuaaacaauuucuaugaugucagcagagagauaucagcaagagugauuguaaaguagcuagccuuauaagucaagaguuauaaucuuugauccacugcucaauccauuucaagaucugaucuacauuauuuucuagcucuucugguuuauugcugggcagccgaugcacaacuucuuccuuguaggaugccguggcuucuucauaaagaacuuggaaaaucucacacugaauauugucuuuuaguuucuucucauuauaaccccucauuugaaguauuucguacaauauguuggcaucuauucucaacacaaaaacuaugugaaaccagcguucagggaagaaaucacaaccgugguaaucaacaauaacuccacauucucucauuugguuaucuaacucaucagcuacucugucuucaucuaaaaugggacaauuauacucuucaucauagucgucauacaauugcuuuucucaagcuaaaucacccacauuaauguauuucaauccugauuuugauucugauaugugguuuuuccaaccucugguguaccuggcuuucuaugacacguuucuaucaccaagucagaacaaagugacacuuuaggacugaacucagggagucuguggggucaaaacuaauuucauaauacuacuaagacuuuaacaugcaauggguucaccuugcugucuccaaaaaaaaaauugcaccacugcacuccagcuagggcaacagagcaagacccugucucucaaaaguaaauaaauaaauaauuuaaaaaauuauuguuaaaaaaaguuugucagguuaaugauucaauuugauuaagcacaaauuuacauuuuuucauagucuuaaacuuuacgaguaacguucacuuauuugaucaguaaaucuguauagcuuuuguaagaacauguaaaaguagaauagcaauguauaguguggcugggcacaguggcucaugccuauaauccuagaaauuuuuggaguccaagaugggaggauugccgagggcagguauuugagaccagccuuggugacauagcgagagaccccaucuuaaaaaauaagaauaauaauacuuaaugcugacaacucauagaagacaugacuauuuuuauuaaaccccaaauauucaacuagucucauuugccaaauauuuaccuaaaugugugaacuugaauucuuaaaacauuuacguuucuauaggaauacuuuuuuuagugcuguugaaaguauuauuggaaguucaauuuccuuaauuucugggaauuuuaggaagauucaauuuauaggugucucuuuauuucuaagccagucagaacagaacauccuuaagagcuaucacauucucacuugguaagaccaucucaugaugguuaucccaggaugagagacaauagcugcuuugaaaguuccccugccacacugggcuuccaguaccagugcagcuaaugacccugcccuaacagcaaaugcuggggagcagggugcaaguguuuacuugggugcccuucacgggcacuccuuuuacgugguggacagccugaugcuuuguucucuaaaccaguaucaggcauuccucucaugggagaugugcuuauccuggcagacgcccuuguggcucuuuucugaccccucuccaguuuaugacugccugaccaucgcucuggugcucagagccugcccuuguguuccuccccagcaucccggggaaaacccagguagccugggagagccccugguucuucagauggaaugugcaaauucagcacaccaacacgauaggaaauaaguuccaagauuuauuacuuccagauccuagagagggagggcgccaugagucgggagggcaaugcucuauccccaggucaccagaagaaugaaugaagugucaggcauagagcaagagagagugggacccaugggccaccaccuuuacugggggccagggcauuguccaagcagguuuccugcagggaguuuuaguuggugaguuuaaaacaggcagccaugaguuucaggaucacacagcaacugagagguggucccuguggcauacuccacaguccauguggggugugggguuggcagggcagccagguagacugucucuuagagaggccgucaccagaaagaggagguguauaaggcagaucccuggaucaaccccauugaggacuggggguggcagguggaagcugucgagggaaacuaagcccuguuucugguaugagaagguuaaacuuaucaucaaaauagaugccaaggcuauaugaaacugucaguauucacuacaguggcauuuccacaguacaauacagacauacaaacagacauagauaauuuguaagcuguaauucuaaaauuucaggccaggcgcgguggcucaccucuguaaucccagcacuuugggaggccgagguggguggaucaccugaggucaggaguuggagaccagccuggccaacaugguggaacccugucucuacuagaaauacaaaaauuagcucgguaugguagugggcgccugugaucccagcuaguugggaggcugaggcaugagaauugcuugaacccgggagauggagguugcagugagccgagauugcaccauugcacuccagucugggcaacaagagcaaaacuccaucucaaaaaaaaaaaaaaaagaagaagaaaaaaauucagucauagaccaaacuuaaaagcagaaauauaaaauuuuacucagauguguacuuccugauggcaugaaauucuuaauuguuuugaaaccaaaguagaaaagcagacaaacgaaaaauacuagcaaaucagauucuguuaucuuucacccaacagagacaagaucucuauaaaccagcaguccuuccccaaauacguaguauacaaaccgcuucaugucugucauuuucgucaacccugggguccuucaaaugccuuuuguuccuucucauuuacuucaccuugacuuuucaagacauauugguuauacuacacaguugguuacauuugaaguauuucauguaaauuacaaaaguauaugaauaaugugaauucauuuuuguuuauauauguauaugcaugcauacacauacacacacacuccuauagagugaacauuuggcugaauauacugccaaauuguuaaacaauagucauuucuagcugguggaauuacaggaaaauuuguguuucugauuauauauuucuauagcauuuaaauuuuuugcaagucagcgugcauuucuuagauaagcaaaaaaaaaauuaaacauuuuauuuaaauuuuuuucaauuccaguugauagcagaugucaauagaacaaauaaguucccuuauccaugcuucuguaugugggggauucacuugacaggugcaacagaagcacaagcauuauugugcaccugugucugaaaugagaaugaggcugccuagaagucuugagaaaaguggcugacgagucuacaaaaacacccuucuuacccuuucucacuuugaagugcaugaagacguugacacacuuggaggucugcuggcuaacugguggaacagauuccugggggaaauuuuuuuguuuugcucuuguaccucaugucuggauuauuuuggauugcuuuggggacaguaucugaguuucuaucucuuggccuguuuuuuccaggaauauaaagguuuuuuuucuuugacauaugcuuaaauguuuauuuuuaagugauguaacuuuucaaaaaacuuauuacaguuuauuucugugggaaaaauauuuuuuauguuuuugacuguuuuuuguuccuucuuguuugaaaucucuagccaacaagaacauuagucaugacaagcaugccaucugaguaaguacuuguuuugauuucuguucaauguaaaauguuaaccuuuucucucuuauacucuaauucugggugccuuuaggcaacuugucaaucuguccuguaucacuuuuacuuuauaaaauuaauaucugaguuagaagaucacugaaaauuaaacauguaccaaaugugagcgacuuagccuugaaaacucugggguuguuuaggcagcauuaagaggugugugcucguuuugguguucuuuugcuugcuugauaccaaauagcuucaugaauguucaagaaguggaacaucauugaccaaaacauuucccuuaaaggucuuaaagcaauacugcagcagaaagcuuuccacagcaguguuaaaguugcuauguaugcauuuuguggaaggguuaauagcuuguuggcaugcucuuaucaucucccuuaaacauuuaacacaacaaagaacauccaacaaaaauacagugcuauauucuuugcaacagauuuuugaauuccuguuuaaaggggaaaaccauguuuuugauaucaaucauagguuuuaagguuuuaagacauccaucaaaacauuggaacauuucagugaaaaauaugcugcagagagggcaccuuuagaacauuuucaguagugggauccuuuuccugccuggggcuuagaaauaaaagcacugaucaucaaacaccauacauuauauagugaaaaagggggucacucaaaauuuuuguaaauauauuaugaaauauauugaacauucuaaauagucuaauacagaagcgaauauugaauauauguguaauauuuuuuaaagucuuuguauuuuuccaaaauaaaagaaaaauuacuaguuaacugcuuauuuucucauucaagauuuaaaaauaaaacuuuucauuuaggccgucuucuugucuuacucuuuuuuucuccacauggacuucuugugauacuuaagaauaagaccuggacauucugauuuuauguggauuagcugagccuugcagagacacuuguuacuuacuggcacauccagcaagcagcugccagccucaggauggaguucuagggaguguguaguuuagagcuuuuuacuuuuuguuuuuguuuuuguuuucuuuuaucauuuuugccuuuauuucuuuccaaguuuaauuauuuuucuugacucaagcacacauucucggguugaaguagugaugaggcccagaucuugacucacacaucuuuucuacccuaaggaucucuuaagaauuuaaaagcaugauauaauucagcccuuucauuuuacagauaaagaaacagguuuugagauggacauaccuaagaucacuagagauaaaacuaagaaggcuggguguguugguucacggcuauaaucccagcacuuugagggucccagguggacauauuguuugagccuaggaguucaagaccagccugggcaacauagcaaaaccuugugucuacaaaaaaaugcaaaaguuagccagacuugguggugaauugccuauagucccaacuacuugggaggauaaggcaggaggaucacuugagcccuggagaucaaggaugcagugagccaugauuguaccacugcacuccagccugggcaacagagugagacccugucucaaaacaauaaaauaaaacuaaggaacaccaucauuuggaaggaagaguguuagaggcagucuguauaagcauagacaauaaccucuuccccuuuguaauauaauuuuuggagaggagagauguuuauuucuuuuucuauuuauuuauuuauuuauuuauuuauuuauuuauuuauuuauuuauuuugagacagagucucccucugucacccaggcuggagugcaguggcgcaaucuccucccacugcaagcuccaccucccggguucacgccauucuccugcgucagccuccugaguaucugggacuacaggcacccgcgaccacgcccggcuaauuuuuuuguuuuuuuaguagagacagcguuucaccauguuguuguauauaucacaguguggcuuagaaagcccuccauuggggauuuuuuaaauuuucugggagagagagaaaacuaaugucagaacuaauggcauagaaagguuauuauaaaagggaagaaagaacugaggguuguuugguaaggaaguuggacggaaagaauauauuuuuuuaaaggauauuuuaaguauuaagggaaugacagagcaggagauaagccauaauggucaugagcuuugugacaaauaggucccagauuugauuugaugauuuaauaaaaagggucuuuuuuccccucuuaguagaaaaacuauguguugauacucaauaaauauuacauuuucaaaauaaaauaagugagguucuugguucugagcaugcacagauagguucaaauaggccugaaaaacaaaucauugccccagugggaagaguguuggucugaugucaggggccugguuccuuuuuuucuuuuuucuuuuuuucuuuuuuuuuuuuugagacggagucucucccugucgcccaggcuggagugcagugacacgaucgcggcucacugcaaccuccaccucccggauucaagcuauucugucugccucagccuccugaguagcuggaacaacaggcgcgugccaccacgccuggcuaauuuuuguaguuuuuaguagagacgggguuucaccauguuggcuaggcugaucuugaacuccuggugauccacccgccucggccucccaaagugccgggauuacaggugugagccaccgcgcccagccaggggccugguuucugaugcuggcucugucccuacccagcccagccacugugggaagccauugacagccugugggcuugucuucucagccauuaaaauagaauugagaucugaaguuuauuuccccagguuucaaagcauugauuauaagucaguuaagauauacguaccauaaccaaaaucaguuucaaauuuuggcuuucuaguuuuauuaguacuaauauugaguguaacugcuuugaugggcaugugcaacaaagucauucauuuuguuaauuuuucccccgauuugacagaaagcagaaugucgucauccagguuguggauaaauugaaaggcuuuucaauugcaccagacgucugugagaccacgacucacgugcuuuccgggaagccacuucgcacccugaaugugcugcugggaauugcgcguggcugcuggguucucucuuaugauuggguaagcccugugugugaacugcguauuuuaaaacaaggcauuuugauagagugggucacccugaggugccgacaucagcacucaggccggcgugcacccuuguggaucugcacacuuuccugugagcugggaacacccgucuuuccuccuguuggucucccgugggcugcuacccuucaaccagggccaaguucuggggcaacaggaggacggggaggguagagagcaggaagugaguagccucuaagauaaagcagaagcaagauuacaaagaugcugaaagaaacgcaagaugcauguucucacagucaaagagcuuuccucuaugugugaccaagaaacauugugagcuguggugguggugguuugcagagccaaaauaauucagugauuguuuguacagauggauuuacuuaggaugaaggauguucuuuuaaucccauuuggauagguuuuauccuauguauaucuaucuguaacauuauuugcccuuguuucuguagauuaaagauagcuuuuaaaaauacauaauuauuuucguuauucauaaaaacugaaaugaacuguuauugguucuauuauuacuuucauccucaaccuaagguugcuccaaagcauuccuuucuggugacaguagcaucacuuguuacguauguuaccauucugcaucugugguauccgucuucccuccuccucucccaagaauguauucuauucauacucauacuguguucauuuaaaccaguagaauuauaacaugcaaaagcuacacauguauuuucaagaauggccgucgucuuuuuuccguguugugacagagguuaaagagauuagugcuucuaguugugaaguggaaaacguugaaauuccaaaaguaagcacuguucauuugcauugguggcaaugggggaucaccuuaccugauuauauauuaguacugcuuuauguuuauuuggaugaaagacaguagugccccucucauccaggguuuuguuuuguguaguuucagguaccauggucugaaaauauuaaaugggaaaucccagaaaauaacaauuuauaagucuuuaaaugcauucuuuucugacuagcaugaagaaaucucagguuaucuggcuccauucucccugggaugugaaucguccuucaguccagccugugcauggaguaggugcugcuugcccucacuuaguagccaucuugguuaucagauagaaucucgugauuuugcaguguuugucuucaaggaacccuuauuuggccuaauaauguuccccaagcacaagaguauugaugcugacaacuuugauaugccaaagaggagcuccaaggugcuuucuuuaagugaaaaggugaacguuguccacuuaauauggaaagaaaaaugguaugcugacguagcuaaaaucuauggaaaaaaugacucuuugaccugugaaauugugaagaaggagaaaaaacugugcauacuauauauauaggguucagaacuauccacaguuuuaggcaucccccagggggccacggacugugcccccuuuggauaggguggacuacugucucuuuaauaacucuagcaucagugaaugaguucuguguuuuauuucucuccaauucaaaucgucucugugucuucaucugacuacucucccuucccucagguuuuggaggaaaaaauguuauuucuaaggauaugcaucuguacaggauuccuuacccaacuuauucuucugggacuuggagcaguccauagaggucagacgugagaacguacugccuuugcugucgacauggauagagaccugcucccugguugucugcaugucucugcucaguguucugcuaguacuccacagcuaaucauacauagaaacagaacugggugaaauuuuagguuauuguaucucuucugggauuaccugauaugauaaaggugggcauuaaaacacauuauuuaauaaacuucucaccuuuagucuagacuccuugccuggagggaagaaccuggggcacucagacacauaagugaaugaaugagguacaaggcaaucagacaagaaaagauaauaaaaggcauguagguuagaaaggaagaaauagaguuaucucuauuuauaaaccacacaauuuucuauguagacaagucacaagcaaucuacaaaacagcaauuagaggugacagcugaguugagcaagucauccagaugcaagaauuccauugaaacuucaguauaaagcuaauaaaauaagugcaggaucugugugcugaaaacuacaaaauacugauuuuaaagcucaaagaacuaaauauauuaaaagacauacaauguucauggauuagaagacauaguacagugaacaugucacuucuucccaaaaugauguauagauuuaacacauucucauucaaaaucucaguggacucuuucaagauacagacaaacugguucuaaaauuucuauggagauauuaaggagccagaauagccaaaacaauuuagaaaggaaagaacaaggaggaggacuggcacuaccugcuuuuggggcauccuuucaagcugugguccucaaggcagugugguauugguggacacacagaacagacagagaauccagaaauagacccccaaaauacaucccauggguuuucacaaaggcaugaaggcaauucaguggagaaauucagucuuuugaacaaguggugcuggagcaguuggacauacacaaucaagaaaaggaaccuucccaacacuuuggguggaucaccugaggucaggaauuggagaucagccuggccaacauggugaaaccccgucucuaccaaaaauaaaaaaacuagcucggcaugguggcaccugccuguaaucccagcuacucaggaggcugaggcacaagaaucacuuaaaccggugagauggagguugcaaagagccaauaccaugccacugcacugcagccugggugacagagagacacccugucaaagaaaagaaaagaaaaggagaggagaggaggaaggaagggagaaccucauucuauaccuuacacgagccacaaaaauuaccuccaaauggaucauagacaaaauuuaaagguauaaaacuucuauaaguaaacauacaagaaaaaugaucuugguguaggcaaagaguucuuagauacaccaaaagcaugaugaauaacagaaaacauagauaaguuagauuucaucaaaauugaaagcuuuuacucugugaaagauauuaugaagagaucagaagaaaacguuugcaaaucuuauaucugacaaaagauuuaugucuggaauauauaaagaacucuuaauacugaacaauaagaaaacagaacagcucaaacaaaaaauggcaaagaaaagauuugaauagacaguuuacugaggacacacagauggcaaauaagcaucuaaaaagaugcucaucauuauugcucacuucagaaauauagugagauccacuacauauccauuagaauggcuaaaagaaaaaauaacagucgcacucuagcaaggagccagggcagcuggaacggcugcuggugugugugggaagugguccagccgcuuugagaaacaguuugacaguuucacagaaagcuaaauguccacucagcagucccacucccagauauuugccucggagaaaugaaagcuuguguucacacagagucuguacgcgaauauuuguagcagccuuacuuaucaucagcuggaccuggaaacagcacagcugucccuccagugggugaauggaucaaccagcuggaccaaccauacuguggagugucacucaggagucgaaaggaauggugauagguacagcagcuugcaugacucucaggggcaucaugccaaguugaauagcuggucucagaaggucacaugcuguauaaggccauuucuuugucauucuagacaaggccaaacuauagggaaggagaacagaugagugguugccgcgcauuaaggugggaguagcaucugccucugcagaacaauagcagcugucacaucuuuggggcauuggaauugugcuguguuguuaguggcaaugguuacagaauccauguauuaaaacacagagaacuguacacacauaugcacacacgaguaaaucuuauuguuucuaaauuuaaauuaagaagaauaucuaggcggggugcaguggcucaugccuguaaucccagcacuuuuggaggccgaggcguguggaucacgaggucagcaguucaagaccagccuggccaagauggugaaacuccgucucuacuaaaaauagaaaaauuagcugggcacgguggcaggugccuauaaucccagcuacucaggaggcugaggcaggagaaucgcuugaacuuggagggaggagguugcagugagccgagaucacgccacugcacuccagccugggugacagagugagacucugucucaaaaaaaaaaaaguauaucuuacauaucuaacgugcuuuccaaauggagauguuugagcacugguaggaccgggcuagugucuugguuucagaacuagguuuccuucugugugcugaaguuuacaggcuccuguaccuucaacugcugccucuguaccuauacuuccuguuagcacugaagcuucaucccagcuuuucuaucuuaaaaaaaaaaugaaaagaauuuaaaaacauaacuuucucuaaauugcucuuugcccucugugcuaccuuuuuuuccccucauucauggcaaaacgucacaaauguaugucuguauugcccuugccuuacugaugaugucgcuauuuguuaauaguaucaacucuugggagauugcgaaggcucagguggccuauggcuucaggugaaauaucuguuugugugauuacaagguaaccaugauggcagucagguauaucacacauauauaaaugacacaaacagauauaaauauauguuugugugauuacaagguaaacgcaaugguaaccgcaaugguaaccacgaugacucucgcuggcacaacaggaguauugauguucacagguugcuccugacuugcacccucaaaaaguuuagaaacaagccgagucacuuucucuguucaucucagucuucaagaagacaaagaugacugcugcuucuugcauggccccccuccuuuaacuuuuaaauaaauugaauaguacaaacauaagaaauuugagagaggauaguugccaccaccauuuacaaagccauucuacauaauuuuuaaagcuuagcacccacuuuaauauuuaucuaugucuugcauauaacuucagauauaaacuucacaguuccaauuucuuuuagggucaagauuuaaaguauccauaucauauauuauauacauugacuuuguguacaaggaaucucucucucucucucucucucucucucucucuggcacucucgcucucucgcucucucguccuccuccuucuaacccugucuccaauguaguugggggauucuuaaaauauucucuuuggcuagcaguauaaacuggccuccaagaaaaacacugcugagcauguuuuuauuucaggguuugugugguauucucuggaaauuucuuguaaaggagauuuguagcaguucuucagaauuagaugguuguauguggcccagcuagucuuaucagaaacuguggcgauuuuauaacaaaguucaguuugaauuuugacuuaauauuuuugagaaguuuauuggcaauuuuuccauguuuacagcaguucacaccuccaguguuagcgcuacuguuuucaggaaagagaauaauuuauguuuuuccuccuucaugacugaauugucuggcagauacauggaaauagaaaaccaugccaggaguugccgagcuuccuauuuaugggagacaggaaguaacacaacagaaaaauaaagaaauuaauuugaccaaagugucccuuuagacucacauuguuuuguuauguguuguucaagcauagcacaauuugaaccuuuaaauacucuuuaucccacucucacuuaauuugaugauuccugcacuuuccugugacuugucuaaaauucuacuuucccucgaaacccuuuuguggaugcuaacauacaagcagaguguccugugauucagucuucccuuuuuccagcuaccacuccgugucacucuguccagcacagugaggaauaacucagccuguauucagauuuuaauauuuugauucugaacagcuuaugaaaaggaucugauaauagagauuuaaagcuaauucacuuauaaauacaaguguagggcuuaaaagcuaaaucagcuuuacaacaaaaugucaaggccgcuaacuaucaacagauaaucuaguguuuucuuaaucaaaaaugauuucaugaugacuauuuucuugagauaaugugauccacauugaacuuaguaagcagugagucagaugagauauguuuuuaucaguggugagcauagaaucaaugaacuguuagaauaacacacucaguucauuccguucacgccucucauuuuacauuaaagaaaugcugagccgcucuccuaaaauuauaacucaugggagaaccagaacuggaaucucagcuuuucacugguguuaguucaucacccugcauuccuaagucuguucaaaagggaucaucuugaaaaaccauucucuuuuuaacuuucaguuggcagauuaacuucauaacucauguuaggaagaaucuucagggacauuguacuuggugugucacacugacacugaguuucugagggugcccuucaggucucucuggcagacauuuauugcucgcacuugcaagcugacuaggaucucaggccugggucucugaacuuucacggcuugauuucaaaguccuuuuuauccugcuacagauuauaccuugguaaaggacuuuauacuucacagaguguuuucacaugcacugucucacuggauccugacagaacauuuuugcagccgagaaggacgcugcaaauaauuagugaauuuagugauggagacucugggcaaaaauagcuugucugacuugaacguggaucuuagaaacacaucucugucaaggcauuguuuuaaggcagugacuauggucuuacauuuaucuccaggacaccuaauuuauacuuuuuccugauuaaaauaauggauucugguuuugcccagacauagaacccacagaguuugucugcuucuuucacuugaggugguuccugagcagugccagagcucauucucugcggaggcuccugcaggcugcggcagcguggccucuggccgcugggagcaugggaagcaggcgcugcggucuagguccuccaucccccugucugcugcuccuggcaagaccccaaggugcgcauuucccagguuggagccgcugugcuucccaggaccauaaucugcugauugaggacagauaccaaaaagugauucaucuguaaaauugagggcuguggugcugcccucuaggaggacauuuggaaagauguggagaaaccugugagugcuaagaaugacugauguuaaaguuugaaagagucaaagugauuuuuuuagugggagaagacuguggagucacccugagaugcaaccacaggcuugauuagaaauaaaguuugaucaccauuuucaaauuuuuacauuaauauuuuuuaauuuucgaaaggugcuaaacagaaucuacuuaaugcaccuggcacagaaaaggcagugcccggguccuaaggcugcaccuuugcaagaaagagaaauaccugaggcaccgggagugaggaggacagguguuggagaaggcuguagggccccaguauggcuguguaguucaagacgagggaugcagaagccaucggacuauuuuaauuacagaguggcagcuuuugucucuguggccucucagcaaagaauggauugcagggagguaagaacagggugagaagcaggaggcagcuagggucaucgaggugaaaaaugacugcggcugugucuagaggggggguugauagguggagaggagagagcaggucggcgcccuuccuaggaagaucuaguggaaucuguaacgucaggugugugggaauggagaagucaagaagacucccacccaaauuuuuuccuggggcgacuaacuauagauaauggugccauuugcagaguuagggaauucuggggcagaagauugugugcaagguuugggguacaauaaaaaauugauguaggcauauuaggucugagauuccuacuggacauucaaauagagauacuacauaucagauuauauauauguacaaauauucagaggaaagguuaacuauucacuccagccaugguaccuggaagggagugugaaugaagaaaugaagaaaacagugaguuuagguuugaucucugggcugugccccuaugcagaagucagggggaagggggaggcagggggacccgggaacggcuagcuagcaaccugggggagacaccaggggaacauggcaucagucagaagggggacugucucaggaaggaaggaugcucagcugugcugagugcugcuggaaggugaauaagaggagacagaagccacuguuugauuucuucagguggauguugucagagaccuugaaaaaagcaggaugaauccaaugacuaagacaguugaagagucaaugguacauaaagcaguggaagcacuaggguuauguguaauggugcgauuugcugaguuagggauuauuaucagacauauugcugauauguuauuccuagacauaaugcugcugcuacaucagagagauugguuggcagcgaauggggcacugugaagugugacucgagccuucucguguugccaacugcaacacagaucaucguccuagugcuuggcgaugugguugcauuauggugaguugaguguggccuugggaagcaucugaaucuguuggcugaguuaucagggaaaaaaaauuuaaaaaguaaacuaagauuauguauauuaaugaaaaaguugcuguauuuggcaaauacuuuaaauggauaaggcuaaaaaccaacaagucgagaggguacuuguugccacccauccuuuuccaaaucauggccuucaaggaucacacuguuggucuuuccuuuucuuuuaacuuggaucaacugugaaguaacacaggucuucaguguagaucucaguuccccaacauuugccuuaugacugagaccuccaggacgucaacuugguccaugcugaacugcagcacaaauuccaagcuuugaccauaccucaaggugcacuuuaaccuuugcaguguucugccagacaucugaacuuucacuuuuguuucugacaucucaaucacacaguucucacuguaaauauuaaauaauagcacagaauauuuuaacuucagguauucauuggaaaauucaaccaugguuugguuuuaucugucacuucaaaaacugucuucagcuguccaucauuuagaugucauuuagauguuccucagggacuuuggggacauuguuaacaaucuguuauuucaaggcuucuaaacucuauccccaaguuaaaaugauuuccaaggaacaucauacuucucuuacagucuguguguaagcacccucugugaauucgguuuuagggacaauguuagcuuuugaagagagcugauguaagaaauacuagauuuuaggaaacuguuguacuuuuuucaaagcuauauuugacgacauuguacauuuugcuaccugauacuuuugauguaugauccaccuaaugccuuucuccuaaaauuaauuuccaaugaauugaauaggaauuccaaaugaaaugaauuucauaggaaaaucucauacagaaaauuuguuaggcuguccuuaaccagagaaugagaauuauguaaugcgguuuugucagcuagaguaacagcuugccauagguucauaauagagcuguuuuuuaguucuuuuucuuggguucuuguuucugaaagaaaguuucucugccagaauauugaaguugugccuaaguuaauaauuuaacaagcauuguauauauuaauaauauaauaucaauaaugcuauuaaucauuaauaacaauuauuuaauauuaauauuaaauacuuaauauuaaauuuuuagaauauuaaaauuuaaaauuuaaaaaauaaaauuuaucaaaaaaaauuuuuuuuuuacuuuugaagcauugguuuuauuaaacuuucaaaguaguauggcaaaaagguggccacauaccaaauagugucauacauuucuuaaaaucucuccuagcaaauaaacuuaaauugagaucaugagucaguugaaaagacaauuuaauuuuuuugccauacaauuaaaguauuucugagaagucagagugcuuugcaauguuuggugaauaauuuacacaauuccagaauaaugucucacuuauggagaauacaccuaccacuuacuucgauaaacagaaguagagucuaugguuucuuucuuuuuuuuuuuuuuuuuagcugcuaaagauuauuauuaggacagaaggacaauuagcuuuaaaagcauugcucagaacauguauuuuuuuuucuaguauucuuuuuuuuuuauuauacuuuaaguucuaggguacaugugcacaacaugcagguuuguuacauauguaugcaugugccaugcuggugugcugcacucauuaacucgucauuuagcauuagguauaucuccuaaugcuaucccuccccacucccccgaccccacaacaggcccuggugugugauguuccccuuccuguguccaugucuucucauuguucaauucccaccuaugagugagaacaugcgguguuugguuuuuuuguccuugugauaguuugcugagaaugaugguuuccagcuucauccaugucccuacaaaggacaugaacucaucauauuuuauggcugcauaguaguccaugguguauaugugccacauuuucuuaauccagucuaucauuguuggacauuuggguugguuccaagucuuugcuauuguaaauagugccacaguaaacacacgugugcaugugucuuuauagcagcaugauuuauaguccuuuggguauauacccaguaaugggauggcuggaucaaaugguauuucuaguucuagaucccugaggaaucgccacacugacuuccacaaugguugaacuaguuuacagucccacuagcaauguaaaaguguuccuauuucuccacauccucuccagcaccuguuguuuccugacuuuuuaaugaucgccauucuaacuggugugugaugguaucucauugugguuuuaauuugcauuucucugauggccagugaugaugcgcauguuuucaugugucuguuggcugcauaaaugucuucuuuugagaagugucuguucauauccuucgcccacuuguugaugggguuguuuuuuucuuguaaauuuguuagaguucuuuguagauucuggauauuagcccuuugucagaugaguagauugcaaaaauuuucucacauucuguagguugccuguucacucugaugguaguuucuuuugcugugcagaagcucuuuaguuuaauuagaucccauuuaucaauuuuggcuuuuguugccauugcauuugguguuuuagacaugaaguccuuguccaugccuguguccugaauauuauugccaagguuuucuaugcuauagaaauagcauauuucuaugcuauucaucauuaauaacaauuauuuaauaauauuaauauuaaauaguuaauauuaaauuuuuagaauauuaaaauuuaaaauuuuuuuaaaaauaaauauuuuauauuaaauuaucaaauaaauauuaauaauaauuauuuaauauuauaaaauuaauaaucuuucauuauugaauuauugauugaguuaaguaauuaauugauuaacugauaaggauuauuguuaaauuauuguacucuuggguaguacagagacugcauacugcgcuuugccauguaaauacuauugucuacuuccugguacguggcucuagggaggcuauggcagagucaagugcuuuugcccuuaaugugaacaaaaaauagugauugcucuuaguagccauaauauuugguuuauugucuguguugguaauaauuucugcuguguuuucauacagugaagugauguuucugcuguuuauuuuaguugcauuggaauuuguuauauuuauuucuuuguuuuccuuuugauaagagaaguacgcacuuaguuauuuauaaagauguuuggacuucacaugugaguacaguggugacaugcuggguuuuccuggucauugcuuagcuguauuuauaaagugaauauuacugagcaguuaagccuuaacaucgagaaucacccauuuucauuuuugaaaacuggaaaggauuagguagaaugcaaggagaauaaauugaacuuaaauguuuguguucaauugaggugagcuuuuucauaagaauauucaagccuaggucaacaugcagcuuguuuucccucucaccaccuggaauucagucucuaucggucaaugucuucuaaaagggaaauggguucuuaacuauauacuuuuaguacuuuauugcuuaucuucccuuucuugguugaauaggcuguguuagauauuuagcuuccugccccuuucuuuaugagacagcuagagcagugcuuuucaaaaccuuacuaauguguggaucaccugggggaucuuacugaagugcagauccugguucagugggucugggucugcucaggcuugaggugagguccacgcugcuaguccugugacccagcauuagguccccaggauacaaaauaugaccggggaucucugucguauucggggguggagaugagacagcgucccaaugauguuagucacauggaacauuuagagaugcggagcuacuuugucaguguuuuacacaucgucaagcuguuagucaagacaguaauccucuguggaaacuguggcuugaacacuuucaguaaauugcucauggucauagugcuuggaaauaguaaauuuuuuuuuuuuuucuuugagacagaguuucgcucuguugcccaggcuggagugcaguggcacgaucuuggcucacugcaacaucugucucccaggcucaagcaauucuugugccucagccucuugaguagcugggauuacaggugcaugccaccacaccuggcuaauuuuuauuuuuuguagagacagaguuucaccguguuguccaggcuggucucaaacuccugaccucaagugauccgccgaccuuggccucccaaggaacugggauuacagaugugagccacugcauccugccagaaauggugaauuuugaauuugaauucagcucuuccucaauucauagcccacauucuuucuagcaucuacuuccaaagauagccuagagaguauuuuuuaucuucuauagcuguaaaccuugauaugggcauucucugauggccuguguguuuugaaaagauuaauggauaaggcaguggauuucacugcuaaccuugcuacaccguagcuguguaaccuuggguaaggcaguuucuuuaucuguaaaagaauggaaagaucaccuaaauaaaguacucaguaaacacucaauaaauauuaaauaucguuauuauucaacaagcauuuuugacgcugaucacuagccuucauuaaaaguauaacuuggaugaacguugaacacaccgagugaaaggagccagacacaaaaagcacauguuguauaauuccuuucagacaguauauccagaauagguaaauccauagaauagaaaacuaauuagaaguuaccagggauggaggggagagagggauggggagugauuacuuaacagguacaggauguuuuucuggggugaugaaagcauuuugaaacuagaaagaggagcugguugcacagcaucaugauauaaaaugccauugaauugcacacuuuaaaaugguuaauuguauauuaugccaauuucaccucacuuaaaaaaagucauauauggaaaauagcuuuaaggcaccacuacaacuacuaaauagguuuguauuuuuaaaagaacuuuauggaauuauaggaagcauuucuugauguuaugagauguguuggaaauacagaagaauagcuuauuuuggaacagauauuauuggcuugaaauuuugccaguucaagcuggucucuuuggaagacuagaccuuuauuuucuggcuugaaaaugcuuuggacauaaguacccuauuauuuuguuguuaaaaauuauacuauugacauccccaauuuuuucuccugaaguucaguauaaccuagaaauaacuucauugcuacacuauuucauuaacuacaugggugcuuuuuuaguuaauaaugaugcauaaugucuucauguggcagaaacacuaaccugccccuugucauaaaucuguaaaaagauggacauugguuuaaacccaguuguugaauucugugcuuuuaaccaguauguuacacugucuaguuggggaagaaucccaaaucuucuucuuucuuuagaaaaauccaaaacagcauacaaacuagcaaacucucauaaauguuguuugagaaaaucaauugcccuaacuacuaagacaaaggaucuauaaaaucugaugagaacaaucuuuguaauuugauuuuuauaauuuugucagcuuaaauuaguaaaaaguuaauaauuauuacuuuuguuacgcuuauaauaaauaauguguuucuacaccuuccauaaacaccuacaaccacacuuuuuaccacaguugguggagugaaggguggauggaggagauaguggcaaaaacaccccaaucacuuucagugauuaaaguaaagaugugucuaacuuuacuccuaaaguaucauccaguaaagcggaauguaaaacauacuuuugaacuguuugaaaucaacuacauuccuauggcuuacgacugugggacaaguuucuaacuaucagauuugauuuuuaauuaaucagugauauuuuauaccagcagucuccaaccuuuuuggcaccaaggaccaguuuugugaaagacaauuuuuccagggacuuggggguugggagggugagggaggaaugguuuugggaugauucaagcacauuacacuuauuguacacuuuauuucuauuauuauuacauuguaauauauaaugaaguaauuauacaacucacuguaauguaaaaucagugggagcccugagcuuguuuucugcaacuagacagucccaucggggggugacgagagacagugacagaucaucaggcguuagauucucauaaggagcaugcaaccuagaucccucaucugcacaguucacaauaggguucgcaauucuaugagaauguaaugccacugcugaucugacaggagguggagcucaggugguaauuaaagcaaugggaaguggcuguaaauacagaugaggcuuccuucacugguucacccaccacucaccuccugcuguguggccccguuccuaauaggccacagacugguaccaggaccccuguuuuacacgauguggagucuuuuguaugcaaagaauauuguugacuuucgccacacggaagcccccccgccccccuucccccgccuuuuuccuuuccaguuacauucccacagguauucuuaguaccacaacugcaguugaauuucacaguauggugggugguaagcuauggugggcgguaugcuuggauaaggcuggcuauuuagaaauuuggaauaaauguaguguuaugacuaacaguaauguugccuaucaaaaauugugaauguuaauaaauguuuucaacacaaucguuaaugcuuuccagugaguuaaaccagcuucauguuacaguuguauuuuccaucccaguagggagucauuauuaaauggggucauguuuucaagcccaacuuaaaaucccucuuacagauugccuuccccaccccacccccaguuuucucucaucacuuauacauugaaauaauugcuuauuguuuucccucuuuaaauuuuuuuugagaagucaaaaauugaguaccuuguucaguguuuuugcuuaugaaauacuuugugaauaaauuuuguucuuagcugaagaaaauuucuuaggcaguuaagaaaauacuaauaagcuaauuaaugaauaaaaacuaauuucauugguccugauuggaagugcaacauuuaccgauauuuagcuauaauccuuuugaucagucagaaauuuguaauuauucuuugagaaauaaaaaguugagagggcugggugcgguggcucacaccuauaaucccaacacguugagaggccgaagcagguggaucacuugaggucaugaguucgugaccagccugaccaacacugugaaaccccauucucuaccaaaaaaaaacaaaaaaaaagaaaaaagaaaaaaauuaaccaggcauugugaugugcgccuguagucucagcuacacaggaggcugagucaggagaaucacuugaaccugggagacgaugcugcagugagccaagauuacaccacuguacuccagccugggcgacagaggaagacugucuaaaaaaaauagaaaaggaaguugaaaacagcuuagggaagagcugcaaccacugaccagcaccaguacuccaucauaauauaugcuuuucacuuauaaggaacuguaauguaaacuguggacuuugggugauaaugaugugugaacacgggaugacuggguacaacacauguagcacuccagugggagacaucgaaaugcauauguggcggcaggagguguaugggagcucucuguaccuuccucuuaauuuugcuaugaagcuaaaguggcuuuaaaaauacaaauacagaaaaaaacuugugcuuucuauagauuaauuugaacauagacacauuaauauaauagauacauugauuugaacauagguacauuaaguugaacacuuaagguuuuuaugauguccuauaccacaauaaacugaagaagucugccuuacaaguuuguucaaagaacucucaaugcucucacugcuccuucccugccuugaacaggaagugucauccagugcaauaagggggaaaauaaaaugugcauagcaaucagaaaggaagaaauaaagcaguuucuauucacagaugcaguuccuauuuaaauucaucagcaagguuuugguuuuaugaaugauaauauuaaaauguaaaaaacacuauuuucauuauguaaugugucaccuacaagaugcugaauuccuguugcagcggaugcugaauucacucugcccuucuuauaagaaauauguugggccaaccuuuuguuuuuaaguuugcuuacagccuuaccugugcucuuucaaaguagauuuucacuauuuugaacacucuauuaagguaaagauguguucggccaaugaaacuacuagagcaaaauguuuacacuguauuucugauuugauuguuuuaauacaacugaauuaguguuuucuccuaucucuaugcaauauuaauuccugggaugucuguguaaauuaauuaauuuacugaccagaacucuacuuuagcuucuuaugguuuuguuuucuuaacauuuagaaacggcuaaauuuagaggacauaaauuuucuccaugagauuguuuaaauucaguugacuuuuuaauguggauuauauuugaacuugaaugccgcacgcauuuuuaaggcugguucauggcuucugucacugguacguuguauuucucacuguacuauucuuuuacguugccucuugucugaaaugaacuugauuuuaaccuuuuauuuucuggucuaauuauaugagcuuguggggagccucacauauuguuaguauaucuccuuaaauaacaugcauugaggcugaggucagcagaucacuucaggccagaaguucgagaccagccuggccaacacggugaaacccgaucucuacuacaaauacaaaaaaaauuagccaggugugguggugggcgccuguggucccagcuacucaagaggcugaggcaggagaauugcuugaaccugggagguggagguugcagugagcugagauugcaccacugcacuccagccuggaugacagagugagaguuugucucaaaaaauaaauaaauuaaauaaauaaauaaauaaauaaauaaauaaauaaaauaaacaugaauuguauaauccagcuuuguuauuuuagcucuaaacuucugguguauggagacagauuuucagggaguuugguccuggaggagagacggcugcagaaccucaaauauuacugaauuaaaaaggaaaagauuguauugaucauuuuaccguguggggauucaaauacuaagaggauaaugaugaugauaaugaugacgaugaaagcuuguuuaugggacauuuuacucuuccaaagucugggaaggaauuucaaguguauucuggggacuucugaaaauauuagccaauguuagaaacaaagucacaagccaaagggauugcuuuugaauuuaggcuugugauccaucuucuuuuaauucacuguuuuaauuaauaaaagucuggaauauuuacagaggauuguuuauaaaacuucacaaauuagaaacuuggaauuaaaaauauauauauaaaauauuucauauguguaaaaacaggauaauauuuaaauaucugaccucaugagaauaaugacucagauuucuuguuaucgugagacuuuuucucaaucaacuuuuuauuaauauucauaacauuuaugcaacaugaagauucugaagggacuuuguugucugagaacacaucuauuucagaucugcggaguguaucacuuuuugcugugucuucaaagugauucuugguuuauugccugcuaaggcuaauaaauguauaauaaaucugcuuguugugucacuugcaggugcuauggucuuuagaauugggucacuggauuucugaggagccguucgaacugucucaccacuucccugcagcucccguaagucagauguuguuuuacgaugguaaaugcaguuugcuguucucaagaaauuauuauaaacauaaggguggacuuaaguuuuuauccagucaagcacaauuaugcccauaauuaaaaagacauucacagaacuuaacaccuuuuaucaauuuauucgcgagaacaaaugugagaacgugagaccauugugcaaaaaguagugaggaaugcaguccaaagaaaauuugacgauuaacauccucagaacugagaaaaacaaaaaugaaaaaagacugaauucuugggcagguagucuuauaucuugcuuaauguuuuuacuguuaauagaaauagaacugauagguauaaagauuauggcuugcuggugcugugauaacaguauuuauauuuuuauggcuuuccuaaauuccacuucaacuuucaaaugcuucauugaaaaguucuggguucuaauuuuuuuuaagauuaaguaauaauuaaguggauaauuuaaaguuugcuuggauacaggauugugcagaaguugccuuucauguucaaaaauguuaauuuguuugucacaguuuauucauucaaaagauuaauagcugaaagauaaauggugauuuuuaucugccacugguguuguuauuuagcuguuugaguaggccauaugacuaaaacauaacaaggaguugaacugugcucccugaucacuguaguuaucuagguuguuggguuguuuuguuuucauuuuuaagauuacuguuugauuuccuuucagcuuuauaaacauuuucuuaaggagagacaaaagcuccucucagcaaaacuguuuguuugaaauaccguguaaggaauugaaguguaaaguaaaaacacaaauuccccccauucucgcucauaagagauuauauaugaugcacaaugacauaaugagauuuguccuugaauuuuuuaucaccugccuacaaagagaauugauauaaauuguguuguugccaguuuuuccugcauuagcguuucccuaccuaaguauccaucacucuugucauugagauauccuagaaacuuguuguugucuuucgaggcugugaaauuuucuuauuuucaguuguuuuucaacuugauacaaggccaugauaccguuguugaauucauaaaaccuucuuaaauauaaaguagauacaguucuaagauagggagguucuuaacuaguuaaauaguuguuggaaaagugcaccuugguggaaauaaaacagagccuugacuuugccagaguccaucauugacuccaaauauguagcaacaccuguguguucuaaaacuacgucaagugguggggagaaguugggguaaaauaaauuagauuuugaaauggaauaaagaaaaaauaaugguagaacacuguaaggugaagacagacauauaguagaugcuaguuacagacuggacucugaacuuccuugcaaaugauucagaaaagaauauaugagaaauugccuuuaaauuauaaagcuuuacacaaauguucauuaguauuaauuguacuaugaaaauuucaaaaggaguuaaaacuccaggaguuuaugguuuuguagucccgaguauaaagcuguguucucaaauuuucuuuucuuucuuuuuuuuuuuuuuuuuuugagauggagucuugcucuguugccccggcuggagugcaguggugcgaucuuggcucacugcaaccucuaccucccuggugcaagcaauucucccugccucagccucccgaguagcugggauuacaggugcccgccagcacgccuggcuaauuuuuguauuauuuaguagagacaggguuucaccauguuguccaggcuggucuugaacuccugaccucaggugaucugcccaccuugccuaccaauguacugggauuauaggugugagccacugcgcccagcccuguguucucaaauuuuugguaaauauuuaaauauauuaugaacaucagauuuuguuuuugcacuuugaaacccuuuuuuuuuuuucaguuugcugauugacauaaaaaaacuuacuagugucaauuauuuuuuuccuuaaguaaauuuaagggugaaucuugagacauauagcuuuguaaauuucuuaaauagaaggcuuuucucaaccagaaauuaaauuguagucuaguucuauaaaaauauaucuuacuaggaaagaaaacagaccucuguuuuagaauagugagaagauaguaaaguuucuuugucauagaaugaaauguauaauuuuccucaucauuaaaaguaagaaguuuccuuaucacaaggcacaauuaggucuuuuggaaacaaauuauaaaauuguaaauauuaucauaaaaguuaaacauaggcauauccccuaauaaguuauauuuaauuacuaaaaauaccuucauauuuaacaaucaggcagaaaaaaauaguacggucugcauauaaacuaaaauggcacguuucuguugauaauuucagagauucuggaaguuucuaccauauaaauuugaaauacguauuugagcauuaacuuauaacuaagcugucaacauaaauguaaauacgcuguuuuugaaauaaaaauuuaaagcaccuaagagauggaguaaaaaugcacuaacuguuuuuccaaauauuaaacuucuaguaaccccuucucagaauaucccugaauaugucuuuuuauggcuuagagaguuuuuuucuuccuuuuaauugugauagugauggugaauucaggacauauggguauuuacacaguguauaaacagugcucagaagaaugcaguuccaagaugaucuguauuguauaacauaaguguucuguuuuccaguuauuuacugauaaacuugcacauaacauucuugguugugacagcagcgucuguaaacugucagucugauucucagccucggguucaucuuugcauagguguucugucuaaucacaauuauggauguuuagggucuugcuuugguccguuaagugaugcaaguuuaagugauaaaguuuacaggcucuaaucuggagcaugugggucccgucagcaccgagcacacgcccucugugguggaagaggacacagugcgcagccgugacuuucagugcacugggcuuaagucuuugaaaauaguucgagacaguuccucagguggacugggauguuuagaaaucugcuggucggaucaucaugguuguggccuugagcgaauagccugagccuuuccaguaguaccauuuaaugccguugaacuuauuuguguucugccucuguggauaguacauuccguucaaguuggaaggaccacaugcaucaaaccaccagccugugaaaguaaaacacagaaggaauuaggaacuaggugaugccagcucccaccacgaagacagcaauacucagcuaaggcaggaggcacacugcaggcguguggaguaggcacaugcagaugauggugaguauaggaugugcacuggcagagggauuguuuuccagccauacacccaugacaucacaguuccauuacggcaaaugcuuuuacaagccuucuuccaccuuuucccuugugcuguguggagaggccugaauucuccacaguccuauuugguaagcccacaguguguacacacuuacagcaggaguaagcaaacaucugaggcacaguuggaaaacucuccuucaaccaggauuacuuugcagucccagcaacauggugggcuggacucgcucaggcuccccuugcucuauuaaaugauuuuuucgguugaaguuuaaacuaaaauauuaaguacucaguggagcuacauaaaaaggaagucucuauguuucagagacaaaaaggaaauuuaaagugagagugugugcucgcucagcuaaagccagggcaggagagguguccagcacaggggcugugggagugaagccccaucugcaccuuaauuucugggcuuggccaaaaacaggagcaugcugggguuugugagagaaagaaacacaguaguccccccuuaucugcuauuuuugcuuucugcacuuucagauaccugaagucagcugggccaaaaauauuaaauggaaaaaucuagaaauauucuauaagcaggggccgggcgcaguggcucacgccuguaaucccagcacuuugggaggccgagguggguggaucacgagaucaggagaccgagaccauccuggcuaacacggugaaaccccgucucuacuaaaaauacaaaaaauuagccgggcgugguggcggacgccuguagucccagcuacucgggaggcugaggcaggagaauggcgugaacccgggaggcggagcuugcagugagccgagaucgcgccacugcacuccagccugggcgacagagugagacuccagcucaaaaaaaaaaaaaaaaaaaagaauguauaaaccuuaaauugcaugccguucugaguaacgggauaaaaucuccugaugcccacuucaucccucccagaacaugaauaaucuccucuauccaguggauccacgcugucuacauccggucuccugaucacuuaguagcugucuugguuauuagaucgauugucacaguaucgcagugcuuauguucaaguaacgcuuauuugacuuaauaauggccccaaaagugcaagagugaugaugcuggcaauucagauaugucaaagagaagcuguaaagugcuuccuuuaagugaaaaggugaaaguuccugacuuaauaaggagagaaaaaaaucguacacuaaggaugcuaagaucuauagaagaacaaaucuuauauccaugaaauuggaagcaauauguuguauauuauucaguuuuauuauuguuaagucucuugugacuaguuuacaaacuaaacuuuguaaguaugugugaacaggaaaaaauauacacauaggguuugauacugugugugauuucaggcauuugcuggacaucuuggaauguuuccccuaaggauaagggaggacugcuguaaccuugauuuuacauauguuaaacugaauaaaucucaacaacacuguguuggaggaacacauacaguaugauacuccuuauauuaauuuuuaaaauagagaaaauaauuaugauugauaucuccauauguaggaaaauuaauaaauaaagugaauuaaccucgacccaagcgucagguagggaauggcacuggcagguccucuuuagccuuacccguaaugcauuauuucuuaauaaaaacucuaugccaaagaauauauauauauauauucuuauguauauauagaauauauauauauauucuuauguauauauagaauauauauucuuuauauauguuuuauauauauguauacauauauauguuauauacauauauauguauauaacauauauauguuauauacauauagaaagaauauauauauucuuucuauauguauauagaauauauauauucuuucuauauguauauagaauauauauauucuuuauauacauaaagaauauauauauucuuuauauacauauagaauauauauauucuuuacauauauagaauauauauauucuuuauauauguauauauagaauauauauucuuuauauauguauauauagaauauauauacuuuauauauguauauauagaauguauauucuuuuuguauauauggaauauauauauucuuuauauauuuauauaugaauguauauauucuuuauaucuauuuauauauagaauauauauacuuuacauauauagaauauauguauucuuuauuacguauauauauucuauauauauucuauauauauucuuuauauauacguauauauagaauauauauauucuuuauauauguauauauaaaaacaugcauauucuuuauauauguauauauaaaaacaugcauauucuuuauauauguauauauaaaaacauacauauucuuuauauauguauauauaaaaacauacauauucuuuauauauguauauauaaaaacauacauauucuuuauauauguauauauaaaaacauacauauucuuuguauauauaaaaacauauacauauucuuuauauauguauauauauaaaaacauauauauauucuuuauauauauauauguuguguuuauacauugguuuguuauuucauccagguuccuacauuguuucuuggugguaacagcucagugacuucauuugauucaggugaaugcagauuggacggaaguuugcguguucuauucagaauccuucacauauucaggacuuugacagauucauaggucagugccuucuggagcuuguccaacuagagaaguugcuguccaugcaaaauggagcugcucauuaggcugguucauucaugguccagaccacuggcuggaauuugaccucuucacaggcaagaccacuccacuuucucucuugggcuguuuuuccucuccccagucucuuuuccaauuacauucucagucccuaaaucuugauuugccuaaguaaauauauuguuuccuugguuauuaaugcaauucuccuacucuccugagaagcucagcacauacggguggucuaauaagcacacccuucucaaggagagagcuggguccagcauguggggaaaugguagacaggaaacaaaguccuaggugucuguggcuccuccaccugacccuuucccugcuguucagcuuuaaaaaggaugauugugccaggaugaaggaaacaggaagcuuuugcaaaaucaauaggagggcuuugcucauugguguaauaaugguguaacauagggaggaccugugguaccaaauaguagucauauuaucucaggaaccagaggauugcuuuuuuuuuuuuuuuaaugaggccugauucuuucagcauaaaaggcaugaaauuuaaagacaugaaaauuacugaauuucauauuauuuucauuacuaaauccuccuuuugacuguuaaugaugcuuuuuuuuuuugagacggagucucacucuugucguccaggcuggauuguacuggugcgaucucggcucauugcaaacucugucuccccgguucaagagauuuuccugccucagccuccugaguagcugggauuacaggcguaugccaccacgccuggcuaauuuuuguauuuuuaguagagaugggguuuugccauguuggccaggcuggucucaaacuccugaccucaggugauccauccaccuuggccucccaaagugcugggauuacaagcgggggccaccaugcccagcccuauuaaugauuccuauaguguaaaugcaucauaacuugggucauccauuuguuuaauguaguaacuuucauuuauaaaacauguugaccauagcuguuaccuuugguuuuccuggguggguaacauauuaauuuuugcagauaugauuuauguucucuagaaauuaaacccugccaauuuuccuguuauucuuuacauucauuuugcacuauuggcagaguuuuuguugcuacuuuaaaucuuucaguguuuuucaagaacuaacuugacagcauuugucacacuuuuuucuugucucagucacuaaguagcguuuguuccugucagugaauuucuaaacuuuuaacaaaucagaaaaauaacacuuucuuuucuuuuuuuuuuuuuuuuuuuuuuugagugaauucuugcucugucccccaggcuggagugcaguggcacgaucuuggguuacugcaaccucugccucccagguucaagccauucuccugccugagccuccugaguaggaguagcugggauuacaggugccagccaccaugcccagguaauuuuuguauuuuuaguagagaugggguuucaacauguuggccaggcuggucuugaacuccuaacuucaggugauccgcccuccuuggccucccaaagugcuggcauuacaggcgugagccaccgggcccggccagaaaaauaacauuuucuaaaacuuuauuccuauguuugaacucucaaauguuucugaauaccaacccaucuguuuuaagugacuacuacaaugguuuuuggcuuaugagugugguuuucauugucuguuuuauggcaguguaauaccaaaccuacaauacaagaaaggucucaaaguagaagaugacucauuuuaauuugauuuacuaaaaaagguggauuaacucauuuguguuuauagguguugcuauauauuaauggaaucuuuuuuaaaaagacagcuggggccgggugugguggcucacaccuguaaucucaacacuucuggaggcugcggcgggcagaucacuugaggucagcaguucgagaccagccuggcaaacauggugaaacccucccucuacuaaaaauacaaaauuagccgggugcacuggugggcgccuauaaucccagcacuggggaggcugaggcaggagaaucgcuugagccugggaggcagggguugcagugagcugcgaucacacucccuucuggacaacaaaguaagacucugucucaaaauaaauaaauaaacaacuggagacugugucuguaaauaaauaaauaauaaaugacagcuggaaauuccuucuuugaacauuaaauuauuaguuggaaauauuucuauaaucuauauuacuguugugguugcuacuuggaauuuuuaacuuuuuacauaaagcaaaauguaauuaaaccaucucucuaguauccagcaagcacaaacgcaggagagcuugcuaagaaucaaauauccccucuccuugccagggcuagguccugaggagacacaguuggcuugcugacaagucuagcuccauaucauauucucacuuaaaacuuagucuaaaaaaagugaaaaacacauuuaccuauaucaagcuagugugucuacguaugaaauuguggacaucguuacaaaucacaauuuguaguccaaauugccagccuuucccucuaugaaaucauuccuugccaauacaaauaggaagacagaaagucaucccuaccuccuguuagcauuugugaacauuugcaaauacauuugucguugucuccauccuuugugcuaaaaucauuuccugguuggcugaugcugcuuauuuugccggcugucccuguaaguccuuuaaggugaauccuguaagcgugcaaagaaaaaaaacacauuggcuagggucauugauuuaccguaguggcaaauuuuuugugaugaagaauuccauucuacagaagcguguucuguacucguuaauggacuaaugcauacucuggacaaaauauuuugcacugguauaaacaggaaccaacuuaucaucaaauccuucagcaaagagggauguuuucaugaaaccuucaacacauaucacuugcacaacuaucagaagcgacuguagagcccuguaauuuauuuuccugcugcuuucagauaaacagaagagaaagaaaugcagcaccaggcuccuccucccaggucuccagucaucuuccauagagacggaguccugagacaacuggacaaccucaaacauuauuuuccgcagggggccccgggggggauggagaaugcagcagacaaggaauggccacugaguuuggggaagaaaucuacagaacggugcugaaaauaaauccuuguggcuacauuuccucaugucuguauaguaggguaauguaauuaaacuuuuagacauugagaaaggaacaaaugucggaguaaguuagacacuauuuacaauacagacgaucccugacuucccauggggcuauguucugauaagcccauuuucuguugaaaauguuguauauugaaaaugcauggaauacaccugaccuuuggagcaucauagcuuagcucuagccuuccuuaaaugugcucggaacacucacauuagcccacagucagacagagccauuuggcaacacggugcacgcagugucuguuguucacccuggggaucacaggacugacugggaccuguggcucgcugccgcugccuggcaucaugagggagcaucgugccacauaucacuagccagggaaagauccaaauuuaaaucccaaaguguaguuucugcugaaugcguaucaccuucacaccaucguaaagucgaaaaaucuuaaguugaaccauuguaagcugaauugcaaaaauacggcuuacaucggucaucuguguaccagcaaggagcauauaagggaagggagaagacaauauuuuugagguuguuuuuucuuuuuuuuuuuuuauuuuccauaacuaugcucaagaguuucugcugcaaagaagcuucuuggcagaugguucaggacagaucagagcaggcauucacguaaugggguaugccauguuggcacguuggguccucacguccugauggagaaacaggcacacgaagacccaggcgaggagccuacaaagcaaauccugcaaugguggcaggagaaguguacuugaagcaccaagaugaugcccuucuuuguaaaaccugcuaauguuugcaagcugccacauuggaauaauauaauuucuaacaguuuguauuggaagaauacaaagaagagagaaaauguucuuuuaguuuuaccugcuggucgggccaggccaggugcuuacaccugcaugcacacuggaugcuuauaaccaccugcagugguggccgccaucuuuguuuuggcacugaaagucacugagguucagagauauaaacuuguccgaggucagacucuuaagucauggagguaggauuugcaccagaugcagcaaaugccucugccguguuucaacacuggugcacaccuaaacagagauguuuguuuguugaagaaguugugaaaagaugaggguagggccaugugauguggaguucuguaaguguugcuccuaagugacuucaguauuaaggcagcccuagaaacuucauccuaaggcaugaacuggacaugugagucucaguauuuucccacauguuucaaaagugagacuggccguagcucagucucuaaaugccugcugcaaaaugcuaaugucauaaauacucaucucuguugggauuuugaaacacuguacuuucuuuccauugucuucccauuaaucauagacaggauugagaugaaccacuucccuugcuuaucuuuuaacucucucuugucuccuuugaacauguuuaguucucauggaacuuguuaaauuauccccagaggcaagaaaaauaagggagaauacuauuuuuuaugagucucuguuagaaagguuuuguguaauuuuagguccuuuuguggcccacugguuuaaagugcuuucuuuaaaauuugguuauuaagaauggccacguucuugaaguugcuuuacauugguauggguugauuuuuuuuuuucaaucucugcagcuuugccagggaugauuuuauauaacaguggaguaaagagguaacaucaacauuaacaauuaaaccucaguguuauauaaaacugccagaaugugugugaaaagugaugaauuuuuaagauuuaauguacgcauagcuuuuaguuucacuagaaagaaugaaauucuauugaugcauuuaugcauuucuuauaacauguauuuuccaguuuuccaacacuuggggaacauuucuucugggaaaaaaaaaucccuuacaugcugcauacaacuggcgucucaaagcauuugcaguuaugagaaguuucagucccuucacaguucucuuaucaugcuagcaucauguuuuauuaggauaauaauuuucgauguaauaucuauuuuaucuugccaagcaaauuaagcuuuaaaccaauguguguguuuuucuaaauggccuauccaaaaauugauugcauuucuaaaggaaauaucuguuaagaaccaucucaguuuaaaauauuuuuauaaugucagcguacaaggguaaugacccauuuuguaaaaaucuuuuuauacaaacagccuaauccuuaauuuuugugcuucuuuuuuuuuuuuuuuuaauucuucuguuguagauuccuaacuguugccaguugaaaaaauauuuaacuuggagguaaaacacugaccaaccacuugugucucaaaauucauugaaguuuugaucucuuuggagucaaguuggaacugcugugaggcccaaacaccuaucuucucauucaucucgguuguugccucuccaggagagccugaucuuuccauaaugagaauagugaauaugcuucacugauguuuaaagagucacauccauguauaucuguuucucaaacaugcuucugaauuuucauccacuguuuguacagcaggacauacugggcauuguagaguuuucaguugguuguucaggcaacuugacauuuagccgcuucuccgugcugcccaccacaauccuccccugggcagccugcucaaggacuuuaacauugugucuccuuucagacuguucaggucguggagcggagugucugacuugggcauuaaugagaugaagacgagacuguaggucagaugaugacuguuuuugugauguucguguugaccuucauuugcuaauuucugaccucaaaguggguauuucauaaugugugcuccaugaucacgaggcgccaccagucugugcucuuuagacuccuuuaggcuggcguuggugccagugggcacacagucucacuucucugccccucccguugcacacacauuucggagugccucuaugugccuuguguaccagcauuacugugcauguggcuucaccguacuuaucuugcacacuagguugucaagucccauugcuguucucucucucuacucucauggcauuuuagaggcagaaaguaaauucccagucaagguugcccaugcuauuacuuaugauuauugcuaccaaaugggugaggacaagguaaacacccagggaaugcugugaaucugauguauuuccuguagaggagagcagaguugacuaaccaucccaccuaacucugccaucucuaaacuugacaacuaaucuugacuuugagauugaagacaauugaauguguuuaaacuucauaaagacagacuaacuuuugaaaccuuuuggaauaaaacagcacagucacaaguauccaucauuuaugcuauucaugugacauauuaucaugggaacacuuacuauucacugauuuuacaaauaccuaugaaagccaauuaucuaccaggcagaguucuucuaggcuuugaagauacacaguaaacacaauggacaaaauacuguuuguaugaaguuucuuuuauauuguuauaaccaaaguuagaauuuuaaacccagagaaacuuaaagaaguaauaguuuagaucuugguuaaaucauuguguuucucauuuucuggaauagucacccagcaaaccuuuuaauuuuuuuuuucuuuuucuuuuucuuuuuuuuuuuuuuugagacggagucuugcucugucgcccagguugcagugccguggcacgaucucggcucacugcaagcuccgccucccggguucacgccauucuucugccucagccucccgaguagcugggacuacaggcgcccaccaccacaccuggcuaauuuuuuuguacuucuaguagagacaggguuucacuuuguuugccaggauggucucaaucuccugaccucgugaucugcccaccucggccucccaaagugcugggauuacaggcgugagccaccgugcccggccacaaaucuuuuaauuuuuucuuucaauuaccaugaacucacuuaccuauaauugaguucuucacuugagagauagaaauguucauacaaugaguaagccucauucccuucccagucuuuaagguguauuuuaagcacauagcguugcugauuagucaguugcgaaacaaacucauuucccagccaauauucuccugaaggguuaccaaaucccuguaaugcaaguuguuaaauucaauuauuucauguaauuuuuucuuuguauauuugaaguggauaguccgucaacuuaacauagaauaacuaucaaauagcagaaauuccuucuggugcugugacaauuuaggguccuucccaaaggaaaauggauuuuaaauaggucaguuauuagacacuaagcugcugcuggaagaaaacuuguauuaggauaaugagaacuacuuggggagccaccagcagaagccuuggcauaaacagcucaguucaugggaaugugaagcaccauuaaacagucggcuuaccaaaaaaaugcugaguccaccuuuaaaaauaagcuaaguaguggcagccuuguuuauuugagagucuuacucuguugcccaggcuggagugcaguggugugaucuuggcugacugcacccucugccucccagguucaagcgauucuccugccucagccuccugaguagcugggauuacaggugugcaccaccacaccuggcuaauauuuguauuuuuaguagauacagaguuuuguuauguuggccaacuggucucaaacuccugaccucagguaauccaucugccucggccucccaaagugcugggauuacaggcgugagccagcacgucuggcugcagcuuuuguuuugauacaguuuaccuuauauuggccauucuuuaaaggggagacugaagcaccaauuuuaaaaaccaugucaaaagucauugguuaguuugggauuggugguuaagguuccgcagaucuugaaagcuauuuuucacaagggaaauucuuuucugaugccuuaaagaauguccuuaccacuuuauauucuuuccaaguccucugaaaaucaacgcugccauccucacgucgcugaauaauuguccacccgccuccuccagcuuccaugucacaguaggccugcaaacaggaaugcaggguauaagugacagagcccccccacuccccccuuacguagcagaagcaggaggaauguagacccugagugcaggacucagccgagaggguucucugggauauaaggcacggaguagaccaucgggguugucuaagaaacagaugguuucaaauaaauugaaagugauggauuaaaaugauggugaaacauaaacaguaauauaauauaaaguguugaugagaauaugacucacuugucaucaucuguuccaggcuaaagaccccacccugauggcugguccagagauugcuguuuuuuuagagauucauuaugaauggcacauuuuggcagauuggccccgaaccccacaucuccauccuguagaaaaccauugacuuguguucacagccuugaaaccuuucacuaaaugccagccccugccccuccacagagagcuaugugaaggggauacucuuugaucauaggguuuggaggacuccuguuacauucucguacuguggggcuguuuggcuuccuuuaugugcaauacuaaucagauuuuuugguucacaucugagcacaagggccuugaggcuccaguguccuggugcaaggugugugaccugggcuuggcuuagcaccuuggccucaagggcaugacuucacgcuucucuguacauagcucacugcccacaguuuuucucuaagcaacucuuuuuauuucugcucuuaaacuggcucuguggguuuaaacuuuguccagaacacagaauucuuucuuaagcuaagcgcaugcaugcucaauuucaacucagcuggaguuuuauuaugaaauuaaaaaccccugaaaauaagauuacauaaauaguuuuaaauaauaaagauuacaguagaacgaaacauguuuuccagaaaguaagauaaauuuucugccacauacaagguaggaaauauugaaguuaagguucaaaaccaauuguaaauauucuucuuguguugugucccauggucuuuuugagaauaauggaggcgauuuggcaggguaagcuucaacgcacacuguucucuguuuacgaguuagaauccuaaagaggagagcgaaaagagaaccaagagagugcuauuccuguucuuucauuuccuacaugaggaaagaggggugcagaggaagugcaguggcugccugaugccucauugccagugcaaccagagaacugucccuggaacagccuggucugcaggggacuucuccccagcaugguucuggucucucuccaggaaggucacccagcucguauugccuuccccaguggcacucauguuuggaaacauaggugccauuaaugaaaguuacauuuauuaagaagaaaauuauuuccucauuuuaaauuaaucugauguagaaaaucagucugcacaagcuaaccccuuguuaccgcucuguauugcuaugauuuuuauuaucauugcuacacaccacucucauccaaguacucugccagauacuuuguguauauuaucuauaaucucacagcaacucugcuguaguaucauaauucugcauuuuugaaaggagaaaagauuuagcaaaguucgauuuugaucaguuacucaccuucuaagugauauauaggauuugaauaaggucucuuugauuccuguuauguuuuuuuuccacugacaucaugcugccaaaaacagagaaaccugacccuuugguaaauaggccaaaagucccucaacacaguuccaaguuuaaaucaguucaugaauaauacugccucuuauuugccugcagucaacaaaauggucagugcugcucacuucuaucaauauuucuuuuuaaaaaucuauuucauaaaccagcugaauaagcuacuuugguuugaggauucauguacauauauugaaguuaauucuguauccuaaaugguaugcucuuggguugaaagcauugacguggcucuuggugagccuauccuuguuccaagaauguuugauucuucagugucaaaauuacugcuaugaaguuaccaguacuuaaauacauguucuaucuuguucagagaacaaguuuaucuuguuauggaagucagaggcaaaacucuuaaaugucugagagucacugccagcacauaaaugauuugagccauaugaguauucgcuuugauuccauuagugaugaugauaagguuauuagaacauuuucuuaguacuucauccagguuuuuagaaaaaagaacagaggauuuguaaaaacuggaguauuaugguuaauuggacuauaaaacuugcagagaaagauaguguucaaauagaguuaucuacccagccagaagauacugaguaaaagugcugaaauugauuauaucaggaucagcaaagcagaaguccucagauacuucccaagaccuuaccacuccaauuacaacaaaccuaagggcaguuaauaucuuuaaucuguccacuggugcauggugcaggaaccugauaucuuucuauaaagcuugauguuuuucagcaaauaauacuugacuugcuucaacucugaggcaaugauuaagugacggguuaaauagcaaaccauagagacaaccguuaggagucagguguccugugaaauuuagggaaggaaaugaccauacaugcuuuugauaaaugccaucuugcagucucucucucguagaagaaccaaaugaauuuuucaaaacuaaagcugcaguauuuuggccuuucaggaaaagaugugcucaaagaccaauugaacauucuuuucuugaauuagauaaaugagugcagaaucgggucuccugccaggcagagaaguugucugguagucuuugaaggcagugaaaauggugaccacuaccauuuacugucccaaguucuaccccaggggcugucccuguguugucacaacccccaaggcugaggguaucauuguucuguuacagauggggaaacugagcucucagaaagguuaaaugacucgcccagagccacaaauggcagagcuagaauuuacauccaagucugucuaucucucccuggaucagauugugacuuacagagucuuaagucuggaagggaauuuagaaguaacaauugacaccacuuauuuuucaagaugagaaaauugagguuugugaaagcuuauuguucccugcuguguaaaugaguuucuuuuacugcaaauguuuaaagggaauauaaauccuaauguuuccaaccaugaccugaggcucauauaaucccagaguacuauauauuuucaucuuucugcagaauauuucaguuauucugggggccauggggugggacagugcacuggggugggaagcuugcacuuagacugagaaacauagaugaaacaaugugauggggcugcaugguuagcggcugucccucugcaucgguguccauggcauccccauuucacaugcauccucuguccccccucuugacacuccuguccccaggccaagaacacgccaacaucuggugacagacaauggcaugcacagaauugucaugaaaaccagauagcaaaagagauugaaaggcuuagccuagagucuguucguugccuuuucaucugcagcagacuguguuguuuguggguuuguucccuuccuucccuguuguauggcuucuagggcguuagggacauuaacuaauuuucaggguugauuuaacacagcauuaaugaauuagaaagguuucuuuggaaagcauuauguugaauagcacaauauuuaucuuuuccguucauaaucaagauacauguuacuguuucaaguuccaggucuuuaaaacccuaaugcuuguauuuuuaaaguguuuuucuuugauacuguuuuaaauacuuaggauaauacucaauuuaaagagauaauacuuccaagagccucgaaaauuuccacuuugguacaguauccacuguauucucuguaguuauuuguguugguucaauauguagcugcuuuuacauuuauaugcaaacauauuuauagacauuuaauauauacaguuauccaguaguuacauaacacuucaccacacugauucuccuguaauaucauucuucccuaucaaauguuuaagagaagccacauugaaauauucuccggaaggguuuuuuuuuuuccuuaucuaaaguucagugucucccaaagcaccuucaggagucaggcucucugagugaggcugcagaacuaggaaugacugagguaagcuguguuguggcuuugccugcugugaguacugacuguccacucacguuacaugcaguaauuggacauaugccuugaagugaacuccgcugcuggagaagaaaaugaacacugucuuuaugguguguuucgagucuuccagacugcguuagaugagguuagaaucgccuuccccagcgguucucaugguguggaccucagaauccugcgugucccucagaccaugucaccaaguccacagguugaaacuguuuucacgaugcuaagacaccaccggucuguggcacuguguuagcguuugcucagauagagcaaaaaccaugguggguaaaacugccaccauccccgugugaggcagggcagcgguagcuaacuguacaagucacuaugcagucacacacaaaaaagaaaggaacaauaauaucacugaaaaaugacuuugacacagcaguagaaauuauuaauuucaugacaccucuauggcugaugcacuaugguuguucaaccuucaguuuuuggaagauacuuucuuuaaggaaaugagucugacaccucaggaaaaacaacugacaguaugcauuauucaagcaaaaugcaaggagaauguauuucuugccgaagauaagauagacauuucuacaucauucauaugcagcuuuuguauuuucugcacagcagcggcacuuagagcccuuggcaagcacucuaggcgagguagcugcccaguaacuauggcuuuguacugugugaggcuggggaagaucuuuggggagagacuucugcucucugguuccucacucacuaaaguggccugccuagagccagggaguuaguaaggggagacgaauaccucaccuugaucucuucuguagaauuagggaauguuaacguguagaugccauucgugguguguccugauuugaauacuucagcacagucucugaagcugauuuguucuucuuuagcaacagugggguccuuagcugcuuuuaaaaaauaguaaggcauuuaaacggaguucaugaaaagacaaagacuuguuauuucaagagccaaucauuuggugaguuuuauuacuuuggaauucuuaaguaagcaaaaggcuguaccacuuuuuuaaccuuucuagaaaguuuccuuucagccuguuuucuucuuaauucucaaaagauuaauacuuacuuuuuggucauuaauuccauguaauuaaaauacuucaaauaauccaaacuuccuuugcugaugaucaauuacauguaaugaaaguacuucacaaucacauaaauuaaauuauuacuuuugaagaucuuucaucuugagcagaauaggguaaacuuaguauggaagaauuuaaaaagaaugucccuaaacacuguuaucuguaucaugaccccauugccugccccuucaggccauuaucccacugaggacauaguggggugcagugacacaucucagcuuaccgcauccuccuccucccagguuuaagugauucuccuaccucagccucccaagcagcugggauuucaggugcccaccaccaagcccagcuaauuuuuguauuuuuaguagagacaggauuucaccauguuggccacgcuggucuccaacuccuguccucaagugaucugccugccucagccucccaaagugcugcaauuagaggcgugauccaccacaccuggcccuucccuccaauauauaagagacgcugcaaagugaaacaauaauaaggaaggcaaaaugugcuuaagaaccuggcaagauaagggaacuagcaucucuuaagugccauuguauuaucucauuuaaucuuaauggccaucccaugggucugauauuauuuuucccauguaaaaccuaaauaaaugaauaucggcugugguuuaguaauuugcccagucucauccuucuaauuaaugauggaacuaacuaaaaguaggcucuuuacugccaugaaucaaaaguaugcuugggguguuugcuucauaauaauuaguauaacauauauuuccccuucucuucuuccuucauuuuaauugguagauauuucauaugaaauauaugagaaauagcgccuuuucugaaaggugagaauuuuuuagucuuuugaguguuuuacugacuaaagguuauuaacgcugaagaaagcaugauauguaaacuuacaguuugauguggacaucauagucaguaaguuauuaacugucuccaugagaucauguugcugcuucugaagaacugaauuauucaccguggcagucacuauuuuuuuuucuaguucuucaaugauggaauuuugcuuggauacuaacaccuguagcugaucuuucucuucuuuuauugacuguaguuggaugaugugcuugucuuccauagcuagcaccuucuuuucuaggaaacuuguaaggaaaagaauuguuaguuagugaaggcuauucuaaugaaauauuuuauauuuauugaauuucuacuucuccaagguacucuguuaagauauuguagugguuauaaaguaauaugauguuaccagagcccuaaggaaucucugaaacuugcugagaagauuagauauauaaauguguguauauauguaaacguauaagcauauauguauguacaugcagacuuaugcauacacacaagaaaagguaccccaucugguccaggauaggugggauauggguguuuuuuguauuagaugcugcagcgcucagaagaaaggugcugcucuuucaagcuuagugcucaugaagugcuuuuuugagaagggagaguuucaacugggcuggacccuuggguaggauauuagcuuucuccuaaacuauuuauauuuuaauauuaauccuaaugauaauaauagcacuuaaugcuaugugagaaauacuccuucauggggaggugaauacuucucccagacucaaguacuggcuuaccagcccugcgacuuggaacaguuuacuuagucacccuaugcguuaauguccucaccuguuaauuaggauacuaucaccuaggucaugggguuggugugaggaacaaauggguuuuaaaauguaaaugcuggccgggcgcaguggcucacgcuuguaaucccagcacuuugggaggccgaggcgggcggaucacgaggucgggagauugagaguauccuggcuaacacggugaaaccccgucuccacuaaaaauacaaaaaauucuccaggcgugguggcgggcgccuguagucacagcuacucuggaggcugaggcaggagaauggcgugaucucgggaggcggagcuugcagugagcugagaucaugccacugcacuccagccugggcgacagagcgagacuccgucucaaaaaaaaagaaaaaaaaauguaaacgcuuagacuagcgccugucauacauuaacagucaaugaauguuuguuaacguuaauauagacauuauuauucccauuuccaaugaggaaauugaaacuuagggacauugagggccaggcucaguggcucacaccuauaaucccagcacuuuggaaggcugaggcagguguaucacuagaguccaggagcuugagagcaggcuggccaacauggugaaacccucucucuacuaaaaauacaaaaauuagccaagcguggggguacaugaauguaaucccagcuacucaggaggcugaggcaggagaacugcuugaacccgggagguggagguugcagugagcugagauuaugccauugcacuccagccugggcaacagagcgagacaucgucucaaaaaaaaaaaagaaaagaaaagaaauguaggaagaaugaaucacauaccuaaagucacacacagcagguggcaggggcagaauacaaucccagaacuuucugacucugaaaucugcuucucuccuuuuaauguggccccauuccuucucuaaaaaaucuaaccagcgcuauggcauguacuuaauacauaacaguuaauaugugagccaagcccuugaaaaguuuuuuuuuuucuuuuuuugagauggagucucgcucugucacccagacuggagugcaagggugccaucuuggcucacugcaaccuucaccucccagguucaagcuauucuccugccucagucucccgaguagcugggacuacaggcgcaugucaccaugucaggcuaacuuuuuguauuuuuaguagagaugggcuuuuaccguguuagccaggguggucucgaucuccugaccucgugauccgcccgccccugccucccaaagugcugggauuacaggcaugagccaccacgccuggcagaaaagcuuuuuaaaaauuauuuagagagcugguaaaauuaugccauguaaguccuaagauacuuuauuaaugguuauauaguuugccuuccuaauuucaacuuauaaacauacauugcuauaaauauguucaaugaagagcauaccacuuuuaaacuaaaaauaguuccuguccauuaagccagaggaaacaaauccaagagaguagagacuauguauuugagaauguuaacuguuucccaggaacaaacucaaagacaugcacagucaagguauuuggcaggguuuuuuguuuuuuguuuugagauggagucucggagucucgcgcuguggccugggcuguugugcaguggcgcgaucucagcucgcugcaaccuccgccucccggauucaagcaguucuccugccucagccuccugaguaguuaggauuacaggugugccaccacgcccagcuaauuuuuuguauuuuuaguagagacgugguuucauuauguuguccaggcuggucucgaacuccugacuuccugauucguccaccucggccuuccaaagugcuggaauuacaggcaugagccaccgugccuggcuggcauuuuuuuuuuuuuuuaauaagauacaagaggaaaauuggauagccugacacuacauuauucagcaccuaaagaggcuuucugugauaauugcaggaaaagcagcaacuaaagauguuucaauaucuucauuuuguuuguacaaggccaguaaauaaagcuuucaaaauauagacacuuuuaaaaauagaaaaacagugaccagaugucagauuccucucucugacauuuuccuuccaauauaaaguuuaguacacaugaauuugcacauugcagaguuuuguuuuaaaggaaggggaccucauauucccuuuuuugagucccguauaagucagcugucuuauuuaauaaugaaauaugucaaugauggcaucuuuauguuucagaauuauuuucugucuacuaacaaguuaccacagcuucuguuaaugucacauuagaagcuggugaaauauucuauacauuucacuagcuuuucugcgaaggcauaugaagagcagagaaacauuauuuucccaccugcuugauaaagaaaccuugaaccggccauuuaacacugcugugaguuaucugaagccuccugagucacuuugcacuuacuuuccuaggaaccgaaagcaugugaaauugacauacacguuucacugagugauaguuggguucagaucacgucuuaccuuccguuuaacagagauguauugaacaccuaccauguacgagguguuuuuuaggguuuuggagaaaaaucaagaaaugaaagcaucaugaaccauagucuuaagccugcggaaauuuagauguuuugauggucuucacaucaucaagcuaaaaagacaaggcuaugaaugucucccuugaggaaaaacuacccuuguggccauguaaggucuguaaauagaaguuaucacagggaauacauaugaagaucaugguuucacugaagagaaaauggagacccugagaagucaccuuuggugucacgagcaccuucaggugaaaggaaguagccuuaggcugggaaucccaccucugcacauggcuuccugugucacaagggcagacacccugcuguggaccucaggugcaugucugucuaggugaauaucuaucuaaauaaagcucuauguaaaaugaaggcauucgauuucauggccucucgggccccuuuuaguucgaaugaucugguaaauccaccuuuuuuugacaguaacauuuucugacucuuuaacccugcaaacaauauuaaccagccaaggaacuggcuacccauuacauaucucgcccauaagcaauaacaaucaguauuaauaauaauuauuagauauucaauuguagcucuuaaauguauuccagcccccugaucguuguaaauuaguauguaauuuuggagagaugggggucugucuuuguugcccagguugguaucaaacuccuagguucaagcgauccaccugccucagccauccaaauaggagggauuacaggugugugccaccacaucuggcuaauuuuuguauuuuuuguaaaaaugaguucucauuauauugcccuggcuagucucaaacuccuggccucaagaaauccuaucacucuggccucccaaagugcugggauuauaggcaugagccacugugccuggcuugaaucuauucuauaaagaaagcaauugcacuuuuggggaauuauaaaagauuauuuaaaaugugguuuguccaaugugaaacaccauuugcauauuuuuguaaugauauacuugcaaauaaaaucauaggccagucagaauuaagguagaaaacacagcaugcagaacucauacaccuguaaaaucaucaacacuauuuucuuuuuuuauuauuuauagcuguugaugaaaaaaaccuuuuuauuuccuuucauaucugugacaaaaaaauacgauuucuacagcugaugagaaaaagcuuauucuuccuacaggcauaguugaaagccaauaugauuggaaaaauauuugcaaagaugauauuuggggaacauaauugacccaaauugguaguuuuagcauuguagcaugcuaaauuugaaacccaaguggggaaacaguauucaguauuaggguauguucuacaaacuggacauauccuagguuugucacggacaucauuguauaacaggcaagagaaaaguaaucuccagcucccauguguuccaggaaucacugcagcauuuugaagagaacauuacuaaguaagacuauuuuaagaaaacgacgccagguacgguggcucaugccuguaaucccagcacuuuaggaugcugcggugggcagaaggcuuaaauucaggaguuugagaccagccugggcaauauggcaaaaccuugccucuacuaaaaaaaaaaaaaaaaaaaaaaaaaaaaucagcugggugugugacacaugccuguagucccagcuacucaggaggcugacaugggagaaucaccugagcccaggagguugaggaugcaguaagcugagauggcaccacugcacuccagccagggcaaccagagugagacccugucucaaaaaaaaaacacagaaaagaaaaugaaauuagcaggauuguuauaucucaaugauuggucucaaauguucauuuacuguuuguagaggagaaaucugaaacaugaaagaaaaauauuugaauuuuaaaaaucuauuugcuuuucaaaacccuaaaucaauaaugacuuaaacuugguauccaaaggacagaaagaauuauuucagcuuaguucuugauuaacaguaaagaacaauuauugaacaagaaguuuaucauuuuugguuaagaauaaagaauuauuuaaauugugaaauaggauauauuguuauagccauguuccauguuguauauacaugucuucauuaaaaacaaggaaauaggcacaccagguaugugcauaaaauuauccucuuuugucccaaguggaacagacauaugaaaacaguccccaccuauccccuacaauuuuuuuucuauuguugaucuugagauuuuucuauauuuuauuuaaauauuaauauaaucauguuuaauauuuuugguuuuacuuuaucguguguuugaagaggaaacauuggaucauaaaaugugcauuggcuuacaguauaaguguagcuuucauacuauagaccauucugcguugagugaagcuaaguccccaagggcaaaggaucuuggucaaguuaauacugaaauaaaaugccugggccagugguucuuucacuccacagcacuagcuguauuuuuauaauagauuagcauguagaauacugaggcaggguuuggaggauuacucuaagaggaucuuuugggccagugguucuuucacuccacagcacuagcuguauuuuuauaauagauuagcaugcagaauacugaggcaggguuuggaggauuacucuaagaggaucuuuaaggggccagggaaugaaagguaaaauccaggacuguguuaggagagcugugccugugcaggaauuuucuccaagcccucucccuucuccucccucaugagguuucugacccuuacacuagacaugaagaaacucaccauucugauaauucaucauuugagaccgacuuucauaucuggaaagugugcaguccugaauuauaaauguuuuaguacuguuauuaccuguucuuaucuugcaauuuguuuauuucacuggucugguccaaaaucuguuuuuccaauuuguuugucgagagggaguguuccaagagcugaaguucaagucucguggucugauuuaauaccuaaauguaacaaaaugaaguuccuauuaauuauuuuuuaauuaguuuaacuuucuaacuuccuuuucauuaaaguacccaagcuacaggaaaacauaacaaaaacauuauuuauuaacccaaguaucuuauuuuggcauauuuuucauuuucagaaaaggcucaaugucuuagaucacaucugaguguguuaaaccuuuuuacucuuuuccccacgucucuauuuuuuuuuuuuuugagauggaaucucgcuccauugcccgggguggagugcaguggcaugaucucggcucacugcaaccuccgccucccggguucaagcaauucuucugccucauucuccccaguagcugggauuacaggugcguaccaccauacccagcuaauuuuuuauauuuuugguacagaugggguuucaccauguuggccaggcuggucuggaacuccugaccucaagggauucaccugccucggccucccauagugcugggauuuacaggcauuagccacugcacccggccguuaugucucuaucuuggaaagugguuaguaguucuggacaauggggucugugccaaauacuaaauguuauuuuucuagucugccauauuuuauuucauacaaugagacaaguaggaguauaaaauggucauauuucauagguggaaaguauuuucccuuugccgaaaacaaaaugcuauucucauauuuauuugucacuagacagagagauuggaagucacaugcuuccauuauauaaaaauauagauaauuuuuagccugggauuuccucauuugucaccacuuguuuagacuuuuauuucuucuugccauuucuccuuccuguuuuaaaacuuguuugaaccaaucgaagccguauagcgugagugugaagcggagccucagccuugccgugcgggccuuugugagcuacugcguggcaugagcagugcggcucucccgcggauucucuagcgccugguugcccuucagcaggaagaaucgacuacucacuuccuccaugucaugcuuauucaggaugugauaucacaugcaaaugucagucagcauuguugccaaggaaccggagaccuugaaagaaucauuguuugcuggugucuuuaugucauuugcaggagccuuggcugguccacagcguggguuucagggauggucuuauccuuagagcugguuuaguucuuaucacaaaaagucuucugugagaauaaaguccuuggccaacguaagguuuuguuuggguuuuaauauuaacaccuggaauauacauuuggccuacgucuucuuugaguccaaacauucuauguugguuauuucuaaaaggaacuggaaaauuguguccuguuuaauucauaaggguuauaacaugaguaaaauuccguguggaggcagggaaggauggcauauaagucaugauuggcccaguaguaauuguaaccauuuucacaucacuuuucuggagagcaucaaaccgcuggaccagccugaaggcguccaucugcaggggacuguaaauuacccaggccagguauugaucucucauucccuuuaagauaugagaccuccagccacccauuguugcucaauuugaucgucucucauucugacaggcuuggagaaucuugcuucuaaucagaaauuuucagauuugaauuuaagucuguuucacaaaaucaguaacugcucagcaaguaccuucaaacagaguggguacauaauucaguuucuuugcggccuuccuuaagcucagccauuuuucuuuuuuuuuuuuuuuugagacagagucucacucuguugcccaggcugcagugcgguggcaccauaucuguucacuacagacucugccucccaggcuuaagcacuucuuguaaccucacuaagccucccaaguaacugggucuauaagugcacacaagcacgccuggcuaauuuuuuuuuuuuuuuuuuuuugguagagaugggguuucaccauguugcucaagcuggucucggacuccugaucucaagcgauccacccaccucggccucucaaagugcuaggauuauagaucugagcaagcgugcucagcuggcucagccauuuucauguguuuaauugggcuucacauggaaaaacugcuuacuuuccaucuguuuucuuauuuuccuguuauccuggauaacaugauaucuaguuucacaauaggcguuuuuuuuuuaaaucauaugacgcaacacaaguacaucaaaugcuaugaagucucugaccgcuauaggauguagcaagguuugcauugcugcucuguccuaacacuuuuucauuacuauuauuauuuuuuauuuuuuuaaauuuuugccaaguucccaugcuuggaucuaacuauuauuuuaaaauauaagaaauguuguaguuuaaaaaugcuuaugagacauuuuuuggaugagcuauucaauuacccaucaguguuaguaucaaaagguggggcaugugacuuaaucauuacuaauuuauuuuaauagguuggugcaauuuugccauugaaaguaaugguggccagguacgguggcucacgccugugaucccagcaguuugggaggccaaggcagguggaucaccugaggucaggaguucgagaccagccuggccaacguggugaaacccugucucuacuaaaaauacagaaauuuagccaggugugguagccugcaccuguaaucccagcuacgcgggaggcuaaggcacgagaaucgcuugaacccgggagguggagguugcagcaagucgagaucacaccacugcacuccaaccugggcaaugcagugagacucugucucaaaaaaaaaaaaaaaaaaaaaaaguaauggcaaaaucugcaguuacuuuugguccaaccuaauaauucgcuuuagauauauauugauauauugacuuuuaaaucuuuaguuuuuaugacuuccuaagauuuaaauuuuuaguaccuuaugauccguuauguaaaauauuuauguauguuuuucuugaacuguugugauauuguggaaagaccugguagucaaguaauuuguuauucuauucucuuaucuguaagucuuuuguuaaucuaucauuucacuacuguuuucucugaccucauccaaccauuuuuaggaagacaaugaaagaacagcuguguccuucuagaaugagucuuacgagaguggcagggcuuauggcaucuccccucucauguccucuccuggcugacgucuagcauuucuugauccuuuuugcugaaguagcauuuaggaauaauauggaguggggauuguuucacuuaaaucugcucuuuuuuuaaaaguauuccuuauagcccagaguaggaagccacugacuucagaagcauguaaagaagccaggaugaggagucagaaagcgggcuuggccgccgagagucacgaccacggccuugagcuuggagcgucugcauuuguacugcuaauagcagcuuuucccuuucccacccaggccguucgcugggucacauguugugcaucauuuagcaugucucucggugaauuuucuucuuuugaaauuuuccuauuuugcuguuauuuuacuaguuucuuucuuucuuucuuucuuuuuuuuuuuuugaguugaagucucacucuguugcccaggcuggagugcaguggcacgaucucaacucacugcagccucugccuccuggguugaagcaauucuccugccucagccucccaaguagcugggauugcagaugcccgccaccacaccuggcuaauuuguuuguauuuuuuaguagagacggguuuucgccauguuggccaggcuggucucgaacuccugaccucaggugauccacccaucucggccucccaaagugcuggaauuacaggcgugagcuacugcgccuggccacuaguugacuauuucagucuucuuucuguuauuauuaaucacuagcucauagaaucucacaguggaaagagaacuuagcaaucacuugucuggcccaacccuuuauauuauuugaggcccagaaaaggugagugccucauugugaugcauuuauuugguuaguggcggaccuggagccauggcagcgcucagggcucuugcucgggcguagcaccaucuuuucuguggcuagacgcuucucacugucccacuugucuccuucuccauaaacucauuccacaggcuguguuagcuguugagauucagguuuuaucuuaacucaagaguuagauuuaaggccagaguuucuagcucuuugccucagugcuuuucauuucucaaauguucaaagacuuuaggacuuagaaauggaaaaugauucccggaguccagaaagcaccagggagacagaggggguauucaucuugcagugguugggaugcguggcaugaaaaugacucacaugucuucaguagauagaacacaugaaauuuaaccucaguauuaaaaacaaaaacagauuuacugauuuuuaauucauaagcagccauacauccuuaauuucuuaucaauucauuccuuuucuccugugguggugcuuucuuuaguuucucaugccuucauugaggaagcuccugacgcgacugagugcuagucucuagcugcagggacaccgugugcuuuauguggcauuacuuacuugggcuuccacaucaguuaacuuccgcguuugcuccgcuguuugguucaacagguuugucccuauuucuaucaucacagccgucugguucuguacugcauucugcuguaucucuaccauuucuuucuucauguuguccuggauauaauucucaagcuagaaaagaacaguguuagaaggcagucauuagucaaaugaccggaaaccugauuccuaaauguuugucgucuccucccuaucuuuaaaaaaaaaaaaaaaaaaucuaucaaaagacuuguaccuugccuuccuuuuggaaucuuacuauuuuuuuuuaucauuaggaaaauacagugugauuuuauuuuuaugcaaaaucuggcaacuuagucacaucauguaaaggagggagacaagcuacugguugcuucuguguucuucuagaaguccaugucauggcaggccacagaggguggugagggcagccacagggacugcugggugcggccacugugggguugugucuguccuacccagcugcaacucugaccaugcagucaggaaaugauaauuugacacaaagaagcaucacuauuucucucacauucuagacuuuugguuucuccacauagacuugagaagacacucuaagacagcauauaaggagaggagcacccuuuugauuuuccuuuuaaccuacggaaucaccacucaguuccacauucuguggggucuuccccaccuuccuccguauugaguuaauucgaccuauuaaauuuuuccuaacauguaugcauuuuucacaauuuugucauuucauguaucaagcaaacuuuuaaucgcaccuugguccauuuaucaccuaacgugccaugggcugguucuucucucccucaguuacuaaagaugaugaucaugcugacuaauuuuagcauuaacugaaacacaagagaaggaagaagcucauuucacugccauugguauagcuaucccugucuauggcaguaaaauuacaugauuauguauaacugcaagacaacugaguacgugggaagagccuuugggcuuggagccagggaagccugcccucugcuuuauagucuugguucuaggaaaguugcuuaaccuuuugggacccuaguuuccucauauguaaaauaggguuucugguuggucagaggagugucuuaaagagggguuaagcugugcuuuuaaagucauuguguaugcguaacuccagauacuuagcguuuaguuucuuuuuuuuuuuuuuuuuuuuuuuaaauaaucuaaugaugggaaccauucuuccauucccugguccaaaguauaagcucgugagugcacaaaccauguuuucuuccuuuucacauaguguaacaaacauuguuuauuacauugaauaauugaaagaugauuauaaaacugguucuggugcccuccuuuaaaaacuuagaauucuuuauagagaaaccauucguggagucagucaucagacaugauuucccccaaaauguuaaccacuaaauaauucugugcuuucugucuuuaagaguaggaaaauaggaugggaaggguagaguuucucucuuagagcuucuuuguugaugcauuucauagauugugucuugugacugguaucagaugguuuuaggauuaggcuggaacuauaaguuuccuguuuccgaugcccccucgccaucgacucugccccacuucucuaagcucccagcucccugcaugccccucagccuggucacuaaggcugccucccuggcagucguucucccguggauauuggaugggucagaugagcaggaugcaugagaggcacagucagcccuccaucuguggccuccacaucuacggguucaaccacaccaucaauauauuuuaaaaaaaaaauaacaauacaacaauaaaaaacaaaaauuguaaaacaauacaguauagcaacuauuuacauggcauugacauuguguuagguauucuaagcaaccucgagaugauuuagaguauacgagaggauguguauagguuauaugcagaucuacccuguuuuacggaagaggcuugagcaccguggauuuugguauucucgggaaucuuggaaucagucccccacagacaucaagggacaguuguacuagagcuccaagcauguguaaaaucauuuuguugaaauguuacucaagccauccacccgccucagccccccaaagugcugggacuacgagcgugagccagcacaucuggcugaagccuuaguuuuccauaugaaccaaaacagaguagaccacuacuuuaaaaaauuaaaguauuaaaaaauuuuuaaaaauuuaaaaaaauaaaaaaucagucacugauacccggcaggccagcaaccaucucuauuauaggcuucauaaaaugugaagagucugaaaucuuacuaaccguuucucagaguuagcucaggcuuuuuagugugugugaucuuucuuaauucauucuuucuccuuccuccccugccuuuauaaaacuguaacuuuugugauugaaauaaacuauuuaaaagaagccauaaauagcaguucguaauucuccccuccgcucaucgccaugggaguaauggaauuuuugagguugcaguuaaagcugugugucacccagaggcacugucuuaguuacuccucacagcaccccagccaagauaauauuuaaaaaguuucauuccgggaggcuuggaacuauagagauagacuccagcuggaguuuaguuuaagcccauacucagaaauaauaauuuacaaagugguauaaauaaaaagucuuaaccuccuucuugauuucaguacuuaagagcuaaauaaaaauuauuguauuuugucacucuaaaucauacaaccagagagggaaaaugaauccucuaauacugccuucccccauuucuagagcuacugagucagauguguuugcaacucuccagagauaugagaggauuguuuauaauugaaaacuuaaagucaaauuccaauuugaaauuaaacuuaggaacuuugaaagacauacaggcccaauuuuaaaaaauaaaauuucuuaaccugccauauuguuuucuaaacauaaaaacaauagaaugcaagauccuuuuuaaauugcuacuuuuuagcuauucaggaugacuaaguauagguucacagugggugagcuaauguguguccauuuauguuaaucuuacauaaaagcagauuacaaauacacaugauguguguauauacagauagguauauagcauauauguauauagugucuauaaauauauacagcucuugaagcauguaucauuuaaauaaaagaaaauucugugugauacugacugcauugcuaauuaauugaagucuuugggagaagaauggaacagaaccaaaaaugugcaguaguagauauuuuguguugauuuaaaaagauauuugagccagucgugauggcucaugccuguaaucccagcacuuugggaggccgaggcaggaggauugcuugcucucaggaguuugagaccaggcugaguaacauggugaaacccaucucuacaaaaaauacaaaaaaaaaaaaaaauuagcuuggccugguagugcgagccuguagucucagguacuggggaggcugaggugggaggacugcuugagcccaggagagcaaggcugcagugagccaugaucgugccacugcacugcagcuugggcgacagagugagaccuugucucaaaaaaagaaaaaaauuaaaauuaaaaguaaaaauacuuauguucuuacucuugaagucauuaaauuaagguuuuaagagaaauauaugaugugacagucagguacucuuuaaaaacaaggaagaauacuguauauuuagccccagaaacacuagcgacaggaacagccacaguaaugguagguacuguuucuugguugccggcacugccugugcuguaugggaaucgcugugucgggaucccaggcgccucacaucagcacagguggaugcagggcugagcacuggaaugacccucagcaaaauguuagcucaacccagaggccgcuucauacuuuuccagccuuuuaagagccaaagugauauaucucaaaauuggcuugaguaugccuuccaauuccaggcuucacaaugccuuaagaaaacagacagaccacccaccccucaguggagggccauuuuuaccaccagaaaagcccagaauuaaagaugaccaaugccaauucuaucuucugggagcauccugacaaaagaaucuguguuuucuuccaaagauuaguaguaauuuuuagagguacagaaagacuauggauguccaucauauaguauaaaaaugaacauuuccaaauaaagaugucccauuuaauguagccuuuccauaaaucaccacguaucaaggauaaugagaacaaaccuagaaacaaagccaucuggcucauccacuuggauagacagaccuugaaauuucccugucucuugaccuugaugaauuaguuauuuucuaguuuauuguccuagaaugucuuucuguuuagugucucucuuauuuuuacuggcugugacugaaacccagaaauauagaaaccugcccagaaauaugaaauuccauucuaaguauaaggaagucuuaguacaagaaaaaaaaaaaaaaaaaaccaacccaguaaauaagccauccuccacuggcagcaccaaacuccacuugccuuuggagaauguuucccaucccugucaucugcaccgaacugcucucaucaaaacaguuccaagauacuugaaccucccgugggaggggacccggcucuuuccaauuucacaugcauagcaugugaaacauauucauguuucgcaggaauguuugccaucgccuucauaucugaagaggauuauuccaugagcgugaucuguaggcacacgugucugaauagguccugcuguauaugugugcgaggacaguguguguuuauuuuguccucuucuugaugguugacacagucggcaaaguguggggccuugggcuguucuuccuuucucagaacucaagugaguuaugcaaguuuaacauugagggccacagugauccuucuagcugcaugguuugcugcuuaguguuauuugauuugcuaaaagaguugcgccccagacauagucuuuaaaacuuggcagcgcaucgaaacucaagcaaccaggaugaaauauuuuaaugcaacauauauauauauauauguuuacauuaauauauauauauuuuagugcaaaauauguucugaaguuuuuuauuacucccacaacguuuugaaugaucaaauuugacaggaaaaauagguccauuugugaggcaacuauggcagauugauuacacauuuaaaaguuuaucuggcuaucuuccuucucaccaagauugucaucauuauuuuuuauaccaaaagaaaaguaaucuugaaacuggcucaguaaaggaaaacauagauaauauaugaaaacuauccccaacuuggagauucugauguugauuucucaccaacuguagaugcugguugagagauccuuucuauuuaaauaaaauucaagguccuuagaccuuuuuacuaauuaguuuuuguccaucugagugaccuaagguggacaaaaacuaauuaaucagagggucuaaagaccuugaauuuucugguaaauuaacaaauaauuugagauuuccuuggaaacuuuuuacuguugcccauuucaauuucgaaauaggauuuugcaaccaucucucacacacacauacacguuuuucuaucccaaugauccauccaucuucccacccagcccuuccauuuuucuaguaaacccuugaauuuuucuaguaaauucacaaauaauuugagauuuccuuggaaacauuuuacuguugcccacuucuauuuagaaauaagauauugcaaccaucugucuuacacacacacauacacguuuucuaccccccaugaucccaucuucccgcccaggguccacuguccucucugucucuugcuggccacgcaucccccagcugcucuccuuucaucccgcugucagagucaggaauccacaugcaaagcuggugaccgcagcucacuuucuucccuugcagguuugccugaggauaagguccagauuccuucuuuuuaagacacacaccgccuccugacuggcgccccugaucuugugggccucagaccugggcgcgcacuguccuuggcugucccagcugcccagcggccucauaccacggccgccuuuguaucuccuccuugagucuucucuuccuccucaggucccaccaucccccauugcaugcccuaagcaaagauacucguuuuguguuuccuuuugauaucaaaaccauuuuguauuugugucauuucauuuuaaaucuccacagacaauagguuaauguucuugcuugcuuggugaagagugaacagaauccucaaacucugcaaccauucuacauauacacccuaguaacaacaagcaaaacauccacucuuagaauuaguuugaaaacuugaguguaagauuauuaaauccagggauauucuauuugggaggcuuuugaccuaauguucuugguucccugucaugaggaaacucugaaacaucauuugaggucuccagacagaaaaguggcaaaacugggcucuccucccccuccuuuuagaguugggcuuguguguguguguguguguguuuauucuggagauuuugcugccuaagcagcuguguacucagcaguacuucauggcagaggcugagccuaaagagggaagggcugggagaugcggauuuugggcagcacuuuguccuccuaaaccccucgccagagccugggggguaggcacaguacccacagugagaggugauguucacaugcccugugacgugggaagcaaguuuucuccauauauugaugccagauuugaauuucuagaaccuagaaaagcccaugccaaagcuacuugccaucuguugacuguuuuuauagucuuggccuuuucuucacguucaguguaaggcccuagaaguugaggcaaaagcuaaaggccgagggagggaagccuggccucuggugccaauuuccuaguggguauugugacuucucuuagggagcacacuugccuucaccugcccugaccacauggacgccugcccacauagggucuuuuaagcacuuccugaaauggaucuguucugaucuagccuuuuugcuuuuuucuagucauacuuuuuuauugucuuuuuuuugagauggagucucgcucugucucucaggcuggagugcagcggcgugaucuuggcucacugcaaccucugccucccugguucaaacgauucucccgccucagcuucccaaguagcugggguuacaggcgcacaccaccaugccugggaaauuuuuguauuuuuaauagagauggggcuucgccauguuggucaggcuggucugaaacuccugacaucaggccaucugccugccuuggccucccaaagugcuaggauuacaggugugagccacugugccuggccauuuaauaauuuaugagugacuaucugauacuguaucuagauaaccaaccccuuuccuacuuucgcuaguauaagagacugaaaguucacuuuuggccacuauauaacuccaagauguauuaggaaauaaguuugugggccucagcugguggcauucuaacauuaauaguccaugccucuccuccuguggauagguacacccuacaguaauuugaguguaccagaaugucugugcucuggcaaauccuauccgcuuugcucuucuuugagugcagcugcauauucuuugcauuaauuuuuuucacauauauuugaauauauguuuuuccacauauauucauaucauuuuaccucuuuguguguuucccuuaccacuacuccaaaauuugauaaggaaaugugcuuuucccuucaaaauguuccauuuauuuucuacugauaaaguggcuauuucucaucaauagcaggcauuuuaaauauauguaaguuuaaggagacugcuguaguaaccucauguaaauuucuuugggcauuucauaugcaaaaggugucacauuuuacacgagugucuuuuagaggucuuguagggcacauguauauuuaccagaugucugugagcgugcagccucauggcacguuaugcauaccugacacuugcacagauuccuggaagaugaggagcaaauacagugcaacagacguugucaggccacgucugcauauauagauauauacacagcaagaauaguuacagcagcuuacaaugacaaaaugcuucucaguguguauguguguguaccucugucucaccagauucucacacugccuuagcuuggguuuccccaaaagcagagccugagacaaaggcaggcaugcaggaaguuuauuuaggcaguggucccagagcgcagccaugccgaacaggcgcgggaggcaggggcgccgcagggugguucgcacacguggacucaggcggccaccgccgcgcuggcugguaagaagccccacaggaucucccaaggagcccugggacagugucucagaacauccaccuggggcaagaauggggacugcuguccccagggggcagguggagccuagugggcauucaugacccagguuuuggagcugugcuugcgagagugccgaggaggcucucaugggugucccgaggcagcuuggagccaacgucccuaggcauggccuggggguuugugggaaggccugaggcaaggccugucucugagauguccugaagagcaaguugggcccagaggguuaauuccgagcagcacaagagggugaauucugagcagcaccagaggguuucccugacacagcaggggaugcuuugaggccccuuuaaugaaggagaaaaaugaggcuuagagaaagucagugcccaccccaagucucaugggccccaggcugugggcaguggcuaaagacaggcuaguggguaacucggggccacguggaaggggagcuuguauuuauagcccccagucagcagcgcuggagaggagaggagaggaaaagcagugcucugagaaagacaauauuucuaguagauuggggcagggcaggccuggagacaggaaaccaaagccaggguugucaugcaggagugagaugagguugcagcagcagagcgaaugcggagacgcucggcagguccuugguggccucugaguuauucugcagacuucugccauucgucuauuuuuugggauacuuuguuaaauucucagcuuagaagauaguagugauguuuucccuacagagauagaagaaaauauaaaacuauuuucuuuuuaaaacuguacugaauguagggccgggcauaguggcucacuccuguaaucccaauacuuuagggggccaagguaggaggaucacuugaggucagcaguucaagaccagccuaggcaacauggcgagacuccaucucuacagaaaauuuuuuuaaaaauuagcuggacaugguggcucaugccugugguccuagcuacucaggaggcuaaggugggaggauugcuugagcccaggagguugaggcugcagugagccgugaucgugccacugcacuccagccugggugacagaaugagacucaaucucaaaaaaaaaaaaaaaaaaguacugaaugauaaaugauuacaaauagaagcaguuaaaauuuagcucuaggaaugagauugaugcauuuaggcuacaauauaccaggaacuuccuuuuuaaaugaaacuagagcguucuugccuuucugaauuuaaggcacacugaaagaaaaaauaauaauaauguaacaaaaugucucaguguuuuucuaugccaaauagaaucuuauguauaucugucuagagacauauaugcauacauuugucuacacaugugagguagggguguguguguguguguguguaucuguguguguguguauguauguguguguguuucaguucucuaagaaacagacauuccaaaacuuguguguguguguuucaguucucuaagaaauagacauuccaaagcuuggugggcaauggcgggaggcuuuagacccuguaauauugucggagugucacuguaagagggacgcuagcgccugggucacagugcuagcugguagcagaguacuaacuuaaacccuggucucccaacaccccaucccgcacucucaucgcuguacugauaugccuauucuuaucuuaaaaaaaaaaaagugcugucugaggagcauuaacauucuuacuuuuucauuuuugaaaugaaguauaaagauacugauggccuuuuacgucuccucucugcccuguuuuugcugucucuuucuguguuacauggguuugccaaaauacuggguggagcucuguggaggagguagcaugaucaucucugaagugggcaguuuuuuucuuuuuccaauaaacugaauuuacuuggucacaaugacuauccuaaauggcuagaaaagggaaaaggcuagcgaaacuuagaugauuuucuaaauuuagauaauuuucuagaagacauuuuccaggcaaacuaguuuuugcuguccuuuauaaggccggcaggaagcguguguuguuucuguuuuaaaaagggagaggagcggacuugggaaugcugaugggaaugcuugagaaaucucacagcagggcugugcgugcccugccgggucccacugccucuggacagaaacccccgcaacuccacccccagccaagacuuucugcuucuuuaucuccucuuucugcuagcacccaaaaaguugaaagaauuccaauggauagaauuuuugagauaauauuggaagaugcucaaaauacacaggauuaauuuacacgaagacucagcgggaacacaagccaucuucuguacaugaagaugcacuacugacccgccguccgcaaauguguuuguacaguuacuuucucaguaugggugauggcucuccaacgaacugcuccucgucuccugccuggacacccuucucucugugcuuuccuggguuagaguaaauggaugcaaacacacauuuccgugcucugcagcaacuugagacuccugugagcaaaacgcacugacgggcaaugugcgugggucguggggagcauccagcucccaucugcggaauaaacccgcccaaaccauagggaaaagcgcugucguauaaggccaggggauuuucagaaaagaaauguguucuuuccucuuugauuuuuguguucauaaagcuguaggugcagcuuuuuuuaauguaaugauuucauaaccgcugaaguucgugcuuuucugaacuauuuaggaagauaaucuaccccuuguauuggaugagaugaucugucccuucgaccucugguucaguucccauucucccaaguauuuaaagcugcgaguuuuuucauauuuucauauuuauuuacauaauuuaaacccccugugugcauggacuuuaaggagcuguacaucugccugggcuuugcagaagcugaaagggcgcaaucuuuuuauaacucacauuagaaacacagauuauuuaacggggcuauguuuugcaccuuaaucuuuaaaguugcaauauauuuuaagcauuuuaaccuuguuuuagaucugaucagcaguagaauguuuucagauaagaaacaauggagcaaaagcaaaacaauauucaauaccuagaugauguggcaagacagagaauaguauaacuuuuuguuuuccaaacauaacuuuuaucuucaucucuugaucugaaauuugguaggaaguguaacaaguacgaaucaacauauuuaccauuugccauuucaaauguugauagugaagcugggaccucuguuuauuauggaagaccauagaaaaccccauaaacacguucuacuucugucuguggccagcaguccagcaaaaauguucuaaaagcacaugcacuguguuccgugaugauuauaguuugacugugcuggaaagagagacugugaacugcacauggugauuaugacuuugggcaaaucacugaacuuguaauuaugucuuccaagaccuccuaacccaaaauaagagaguauuuuacuacaaaauauauguuacgucaaacuguuuuuuacaaaauaccagcucuagggauguuuccaagucauuuucggagagaguuugucgaaguuuuuuucagggugugucauucauguauuggagggggagaggguugaguaagaaccgacaugcacaacuuggccaugaaaugaagcgcaagcacauauuuuauuucuauaggauuccucauucuaaaguaauuuuuacagaaaauggcacucuaagaaggaauucauuaagauaaagacacagauacagcauuuagaguuacacuuugccauaaaagagccucccuuaccuccugacuugaaucuauaacaucugcugaacugucgacaucaggaagacucgaaauauguuuugaggccaauuaugucauuucagauugaaccugcuaacaucagauucuuuggucaguagucucacuaguuuuguucucacaauggaauuauuauuuugauuuuuaaauguugcuccauggagacugguaugaugagcucaugcucugcaguuccauuuuaacaaauaacauaauagaucgcugucaaaugaaugccaucacagacaucauguugggucacagaagccacacccuaggagugcuuacuagaugauccauuuccaugaagcucaagaauggaccgaacuuacuaaaggugauagaagucagaauaaugucuuccgggugggagggguuugaggcugugaacugagcaguggcacgagggagccuucuggagugcugaaaauguuuccuagaucuugaccucggugcugguuacaugagugaauccauauuuuuaaaaguuaucaagcuguaaauuucagguuaguauacuuuauccauuuccuguguuuuauaucucaaaaauucuuuuaaaaacuaaaagacauuuagaaaugaaauguuugacaaguuuuguugugacacuaugacccuaguuacuaugggugguuuuauuugucucugcaguuuucaucuaggagcaccuaaauaaugccuaaugaaaugaacuuuggaaaaguaauuuuaaaguaacuaucuuagagaacuguggauuaaaccauuccagccaucugaugaggguuaaaauguauauucguaaucugacauuccaaaacacgauucuuuccggaucaagcauaaaaggcauuugcucuuggaagaccaagaaagaauucaugugguucccauuagucuaaaaauaaauaauaaauaaauaaaugucugagucauguauuggauuuuguuggauuucaguggcuucaaguauaggaagaaaaugauuugugcuauuaauaauaguucuacccauugcccauuggaauaaauacaagauuacucugagaaaagugaaaucgauugaauuuaguucugcuuugagcuacugcaaugcaaguguuucugacuuuugagacauaguauaaaaaacugaauaaaauaacuuuguucauauugaauugaguuggggaaguagcgauauuugugacauuggaagccauugucauuacagauucaucauuacaguacagauuugagaaucaaacacacccggugugagucccaguucaguuccuuaggaacuacuggcucaauacuuucuaacaucacauuucugguugguaaaacagguauauaaauaccuacugugcuaugcuagugugaaaauuaaguggaaugaguuagcacaauucccaaacugugugccaaggcacccuggguccuugcagcaaacaaauuggaguaagggagacagucugaauauucaagggcaacccagcaguguucaaugacugucagccacuggaagaauucauagcucaaagcaguucaccguuucaacaguaucagcuuguaccucuguaaagcuagguuuuuggugguugcuguuugugaaaagcaagugcuacaggaaaauuagcauagagcguaaaaugcagguggcaguguccaauuugauuccaaaguuugagaagccaggugugccuaacuggcaaauauauuccauucauacgucacugggguuacuuaagaaagaaaauaaaggaucuuuuuuuaaaacucaauuuauauguauauugguauuuucaaauagcuacuaaauugucagaacauaaauacuuaaauuauuuggagcuaaccgcuuaauacaagcaacuguuggccuagagauaaauagagaaaaaauagugaaucacuaagggucccaugagcugagaaaguuugagaacaacuagccuagaagcuugcacuugguaggauauaaacucaacguacccucuuccuccccuucccccaauccaaguauugccuuuaauuguaaucucuaugauuugauauguuuaucggaaagcgaguaagucaaaaagaacuaauaaauuguguaagaccuucauuaagauguacccuuccguguuuuccuaacuucugaaaucacuaggaaaaacagccauguuccuugcaagcuggcugguuaguccugucuucuuucaggugaacagcauuuauaaccacgguguaccucggaagaagcguucucagagcaacaugcacguguuccguguguaccgugguugccuucgggcuaaugcguuuuuggaaguguagauaggugccaguuuuacaaaacucauguggccuauuucugcuuguaauuuauaguuugccuccucaccauccucacuugcucuaaggugaacuaguuuuauaccauuagauuauacagaaaagucaaauuuacuugcaugccacagcaauucgggaaguaaacuuucagugugauucuccaaaugcuugugguaaaaguacagagacuugaaucauuuucccauaauuaguuucaguucuggagguccgcccccucucuuuaacccucuugccuugcauaugugucucuugcaauggaagcuaguggaaauuuccucuccccuuucacuccacugccauaaguuauaaaaagcaugccauucagaacugacguuuucuucugcaugcuugaauuuuuacucaacaacuggaaggggaagaaguuauuuccagagauguuucucuguuuaucaaaggggcgcagagucacaguagcacuuuggaccaccguagaauggcugacucacuugccucaucaguagaggggcacauguuccuaucaaacagugagugccuuugagugacggugugugacacacagcacagcagcaccauuucucagagcugcagcaacacugguucacacaagucacuagagauucccaucuccacugacucacucggugggaacaaaagcucccaugccggugggaaugcggggccaggggagcaccggaagaagggagccguggcagagguuuuccuauuguuagguuuguuuguuuguuucagugagucaucuuacccccauuuuuuuuuuuuuuuuuaaccaaaacucacugugguuacuucucuaguuuggguuaugacuccuacgagccaguuuaauuuuaucaguggcagugaauucuugaacgcuucccucaguuguagaaauuuaguuucacauuuaagugguccaagugccagcuuaaacuuugugguuuagugucuuuacugaauccccccuagcggaagaaccuacauuggaguuuuggcugcucuuugggauucaaauuaugaguaguugguuccacuggaaucuuggccuucuccuggaguggcuugaggcggcacgcuuugacuuuagaaggccaaaguuagaaccuacgugaaggcuuuguccaaaaugccuuuccugcacccuggcauuuucaggugguguguguagaccugacaggacucuacucgugcgucacuucccagcuguugguccccugccacuuagaugccuuucaugggcaaguccaugcuagccuaggaaauuucccgaaaauggcagugauaacucagaauuaggauuuugauccucaucucaaccauuauccccaguggucgcuagcucuccucugcccagcucgaggaaaaugcuggguuuuucauugcagcuuacuugcauuucaguggucccagcaagcacucaagaggaaagaucagaccagccaaacuugcaaggcaggcugaugagccaagguacagaaaguacaccugauggauuuuuguaaugauggccguaagucauagaaggugaagcuuaaugcaauuuagaaagauuugaaaaaaggaagaaaaguccucgugcucacagaagcaagcucccauuggcaaaauuauuguguauaacaagcaucucucucugaugaugcuggaaaaaaagaaggugcuaucagggagggagggaagauuugaaagaccagagugagcagcagauaggcccuuggguccuuccuuuuauucccacccucuuuuccauuggcuguugauaaaguuucaucacuuuuuagcugccuguuguauuucacuaccuccuuguuaaccucugguuauaaccuggggggaauuauguuuaaccaguacuuaaugaaucaaucuauuccucaaaaguugguucugggcaucacggaauaaacaccaagaccacucagcguauuuucugcagaguggauuucauuagaaggcagguuagucuuggaacucagucaaaacagcuuucagucaguccaacuccacagauuucagagauagcaguacaagaaaaaugauacauggguuuguacaguugaguguugaaguguugacuuccauaaaagaacacaaaugucaaucuacagcaguaccauggguacguaaauuguguuauacagcgaaacacugcacggugauggaaaagaagaaacuuuaacaugcacaacaacauggauccaucacagaaauaauaaaagagaccaaaaaggaguauguacugauuguuccaauuacaugacauucaaaaccuagcaaaauuaacccauggugggugacagagcagagucaggauuggcguugagaagagggggauauugacgaggaggggccugaggaagccacgugcagggugggaagccuucuguaucuugagcugggcagucauuacacaggugcgcacauauauggaugaggaggggcgugagggagccgcgugcagggcgggaagccuucugcaucuugaguugggcggucguuacacaggugcgcacagauacagacaaagaggggcgugagggagcugccugcaggggaagaagccuuccguaucgagcugggcggucauuacacaggugcgcacagauauggaugaggaggggcgugagggagccacgugcagggcagcaaguccucuauaucuugagcuggguggucauugcacaggugcgcacagauacaaaaauuuaccaaguuguacacucaagauuugugaauuuuauucuguguaaguuauaucuaaaaaaagaaaagaaaagaaaaagcuagauucccuaaaacagagacagcagggcucgagucugagcuagcuauagccaugccagcagcuagauccaugaaaagguugggguuggcuuugcccaggugaucauucggggacgggggacgugcugugaauggaagaugugccugcugucagcacugauguugcccacccuuuauuucuacaacgcugucuucaaaagaauuacauuucaauuuuauaccaacuaucgugccuccucaugaaucccuuccccgcacaaccuggaaacccucgccuggcgucggcuccaucuccagauguuacucacuggcuaccgcuagguggcugcgaaggguggcggcgucacugaugcgcagcucaggcagcagccauggggagguugaauccccggggcaucugccucucccuauguguguggguccugggagugaggcaguguggcguggggcuguugcacacacccccgacuguagggcugcacccagacacgugcggugaccccgucucuacagccgcuuguugcccuggcaccaagccaaccacucagcauccagcgcguccucaccuccccuccggggugaagcggaaacaaggguaugugccaaaacuggccugcucaccauuucccagauuuuccacauuuguucccacucggggugaggggugugcuucuggugugacagcugugggcuguguaggguggcgggcguugguggugaagucugucggcccuccugacccacacacgaggggguguggauuuuauauugaaaucuuuuuaaaaucuguuuuauuguaagaggcucugaaaggaagaaauuuuaucagaguuuugcggccuguguacguucugauaccucucagagcuggaguuucuuacccauauaggacaagcuguugugaaauugagugagacgauguaagcacauggcgugcaccugauaaaugccagcugccaccacagugauggucagcagcguggucaccacugucguuucacaauuacagcccaaggagcccaaggggaaggagugccucucucuguuuugaccuucucugacugcuguccuaauaaacaguguccuuucuacaagaacccuguagacuuuugaaaccaacaagugaaggcacuccaaggcccuuguuuugagaagggguaagugugcuagguaagggauuuccuugggugcuuaccuuccacggcuccugggccccugacucgaagcugaccaucugugcugaugcugacuuaggauuuuaaaucacuuaaauuugagcuggauagagaaaggguccuaguuaagcugagagggcugcuuauucgugauuuuuuuuuucuucuuucucaugcagagacuguuuauuuuagugguagcgguauuuaggggugaagaaggggaaaggaagaauagugugccaucaauuaauucuaugcaugucagcugcaacgccuucauggcacgggacaggccaauuauguaacuguaaacaaauuauauguauuaaaaguuguccaauuaaaggaaaaaacaugcauggauuuauguguuuguuauuacccagaagggagccaugcuguacuugaaaauaugcaaaauuucacaucacaaaaucaccaguuguuguuugaggggcugguguucugauuagucuuaauuuuuuuuaacucauaacauuuuugucccagucaucaacacuguuaagaacaugucacuggugcaguuaaguuaaaaaugauucaggucaggaauuccugucauuaacaauuuuuuauauuaaaguuggaaaaguuuaaggaaauuuaagaaccuauuccuuaauaguuaaaaauaguaaggaauuucauauacccccaaauauuaagcauagguaauuagcuugugguugggauuugaugguuuucuguuuuucagcaaaauacaauaacguacuuucucgagcagaauuuuuacaccaacauuucccauuaagaccaguuuguuuagggaauuuuuaagcuacaucuguauguaauaauuuuuugagauuccaaagacuacgcagucuaauaaaacucuaauacuucaacuaucuucagacuaauguuuauaauuacccgguagaugaccaagaauugauaucaucuguugauuccagaaauuauggcagagaaaaugcugucaggaacccaaagaaaaucagaggaaaugguaccucuaagaaauucugaaucuuuucuacuaagauauguggcuugacugcuuaaccccaaaaugccugcuuagaagguaguuuggggcuaucuuguaauacucauuuaguuccugccuucuucugccauagaaacaacaugcagaagcagcauugcuuacgacucacacugaaccugaagggaugaaauuacauaugacgauggaauguggccauauucacgcagucacagcaguguguugcccaaugacaguacuggagcaguuuccacagaggcacucaugcaauaugcagaauacagacauuuuacacacacacuuacgaugguccuuuucauugucgaaaaggaauucauuaucuuucgaguaaacaugugcuuugagguauauaacucugagguauagaaguuagaacauuuaacccgauuagggugacuggaauuauaaccuuuaacuaaugugagauauaguauagaucuugauaagugucuuucugguguuccuauuaaaauucauuauaauuaccguuccugcaauuguguagcaucuuacaguuuccaacacccugugcuagccaucaucuuauuugaaacacauaauaacccuacaaguucacugauguagguaagaaaacugguaccguuucugaagauacacagugauuguuucggccaguuaauuaaggcaagagaucacucaacaauuguucuacaguuauuccugcuuuuuuuuuuuuaacucacucauuaagugaaagaagccaguccgaaaaggcuguauauuuuaugauuccaacuguaugacauucuggaaaagggaaaacugaagauaguaaaaggaucaggguuugccagggguuaaggggaagaagggcugugcagguagagcacagaggauucuuagggcagugaagcugcucugugugaugcuacaaugguggauccauggcuucauacauugguccaaacccacagaauguacagcaccagaugucaacugcgggcucugggugauaaugaugggucaauguagauucaucaguuguaaccagugcaccacucuggugcaggauguugaucguaggggagguggcugugugugugccacggaggggggauaugggaacucucugcacuuuacucucgauguggcugugaaccuaaaacugcucuaaaaaacauagucuuuuaaaaaaucauuuacuacauaugaaaaggaacaaguaaagcaacaacaacaaaauguuauuguguacuuucagauugcaccaguaaaccuagccagcccucacuagggucuucugaugguuacauaguuaaaaguacacuagcacaccgggagaauaacuucagaggcuugcuggucuaaugguaauugcgucggcuucacacgucaacauuuuuuuaaaaauuagauuuucuugaaucugaucauguccaagauaccucuuauuuugguauagaacgccuuuauucaaacaacgggagaacaugaacauaucccuuugccauaguuuggcuaaauuccugaggcuggcuggggccagaaacaaaaucccugaaauggucucaaaauuuuuuuuuuuuuuuuuaccucuccccuuuuccuucugguugguggucuuggggccuacgaggccccucaggcagaggggaaauggcaguuuccccauccccuuuugggacuucuugagcagaaaagcgaaugucagacgguccuuauaaagucccacgugauucagccacugaggauggcacuggcuguggauuuacauguaagacaacuucauggcguauuuucgccuuuugcuguugaauauaacuaccaagauaugguuugggcagacaaaauagaaaucuucuguguguagcauguccaguuggauacuguuagugacauagagagacgagcgcacaacucagguuuaaccuucaucccugaaauuugccggaacagucauaaugaaggugcuaauguauuuccugaaauacugaguacuucagacagggagauaugggugguaucuaguagccuugugauaagacccauauuagacuaauaguagucuuaucaccagauuaaaccaccuggauagcccaccucaagucaucaagaguguuaacaugggaguaagugugacaaaugcccagguggucuggacuaaaugugacaaaauugagaaauagacccuacaagaucuggauuuuaaaaagagagaaaaaaaaaaauggaaaggcuggcugcuugcuuccuuuuaagacuuuguucacguucucgcccccaaaagccaauuaugauuauaauuuaucagcccacaggaaaugauugcuucucuaugagacaucgucaacaugauaaaauaauccauuucccaagauuucuauaucuuaguaucucaucucuuuaaaaagcuccauuguccauaaaaaauuauaaaauuacauauuuuuacaugacagguaauuuuuaauguauauuuuuaauuugguuguugguuuuuaaaauaguaaaauauuaaauaucaacuaugaauauuuuguggugguaaguugucagguuaauguaaagauuccaaaaauaauucacagacauguggaaaguugcucagagggagaaccagucugauuuuggagaaaguaauuaccaucagaggagcccucggagggagcgggagaguccacagguuucaaucagguucuagaugaauugcaaagagaaagguuuuagcugguugcaggaggggcucugguaaaaggauuaaguccaguucucaggaguuuuuuaauagguuucacaucuuuugucaaguggugcaaggaaggauuaggacagaaaagaaaggugauuucauggagaaauaucuaauuaaaauauuaaagauagucggauggcacaccugaccuagaguccaggcagugguaggcagaguuccuuccccuuuuuuuuaaaccacacauaaaacagucauuuuaauuccaacaaaugguucauacugguauucuaaaccacuacccaugauuuuuuuuacucuuuuuauuuacaucaaaucauucaacuucacaucauuuucuuuuuaagcauuaacauaauccaagugccaggccauuuuuggugauccagucuguagaaugugagauggacaauaacaaucaaaccguuuucaaacucuaauagugggaagagaaggccacauggaacuucccugaggcugaauuucgucguccugccuuucaagugguguccugugaaauccagcguuucccccugucaacuuccagaacagggcuguaacuagauguaugguuuguaagaauaucccauguauacuuccucuugguuauaacauaauuuguuuuacggggggugguuugcccuuuuuuuuuuuuuggagacaggaucucacugcguagcccaggcuggaguacuauggugccauccuggcucacugcagccugugccuccuggguucaaaugauccacccaccucauccuccugaguagcugagacuacaggcauguaccaccacgccugggugauuuuuauauuuuuugguagagacgggguuucaucguguuggccaggcugguuuugaacuccugagcucaagcgacccacccgcuucggccuccgaaagugcugcgauuacaggcaugagccacugcacccagccacauaaauuuguuuuuagucuucugaacgauuaaauaguuguaccaauuauaccaauugcaccaauucuauuacaagguggaauuucuuaucguuccuuuacaaacaggauauucccaguugcuuguuuuugcuuguuuuccuagcagcuucagcaccauccucacauagaagggcuggcaucucaccuaucuagaggugagaacaaagcugugcucucagcaaucggaaucugucaagucugcuguggggacuugguaucucaggccugaugcuggccuaggagugcccugcacucgucucaagaucgaugucccagugggcgagaauugcugccaagacuaaccaagggugucaaccagugacuuaacuucucaggcucacuuuuuuuuuuauuuuuaauaaaaacaaauuguuaaagagguaauuuaaaauauguacuauauaauaaguacuacagcauauacaguguuuacauacauauaggcauuaaauauuaagaauguuuauuucagaaucauauaauuauaccugauauuuacuuuuugucauucuuuguauauucuccauuuuuugcaguaucuauauauuacuuggguaauaggaauagcaaccauugagaaauaguucuaauugauuuuccuuuuauaaaaggguuuccguguagugaccaaggacuuaacaucauccccaccccacagucccucacacgccugacucccuuugugcuguguuuaauuucucauuucauucauuuaccccuucugugcagcacauacuagcugcugcuacacuacacguucugaccaaagcauagugucccccuggggcaagacucuugggaauugucuuuuuuuauuuuuuuuucauuuuuuagggucucacuuuguugcccaggcuggagcgcaauggcaccaucauaguucacugcagccuugaccuccugggcucaggcaauccucccaccucagccucccaaguagcugggaccacagcugcgugccauuguagagaugggggucucacucuguugaccaggcuggucuugaacuccuggccucaaagugucuucccaucuuggccucucaaagcucuaggauuacaggugugaggcacugugccuggcuuuaggcauuuucuucccccucugacuucuucuaggcaccuagaaccaacacugccuggacaugugaaggcacucgauaaauauuuuuugaacaaauaaaucaacuugcauggcuccugccccaaacuggaaaccccaccuaggaggggugggcggggucauaugguguucacucacuuacgcuaaugaacugagaaauaacgcacuucugcccaaauucauguucauucacacuccucucagcaguuuucugcagucuucccagccccacggaaaauucugcuuuugucagaggaggggauaugcgugcuuucccguguuugcuuuaccgcugggcaauccauacaaggcuacuaaacugcagaggguacugguguuagcaugccccguguuuauaagggacuuaaaaaaauauacaggcuugcauccaccauaccuaccauacuuguguacuagagauauucucggggcaaaaugaggugagguguggaaagugcuuuaaggugacucagagccacccuguugcgauugcugccuucgugaugacugguguggcugcaaaguucaguggcugucuuuauaucagaauaauucuagaauaauuuaggagaaaauucucauuguuagguuccuucaagccaaaggaggauguagugaaaagagaauagguguuggcugucuagaugggcccuguuuaauuagagucgacuguaucaguugccaaaugaagccaaucuuacagggccauccuauagaacaaauauauauuuuuuauauuuaauaugauauauauguguguguacacacacacacacacacacacacacauacauauauacagggagagauagaaugguuugccugcugacuugccauuaaguaccguaaacauccuggaaauugugaacagcuaauuggaaaacagucuguccguguucaugauucauuguaugcauccucuagaucucaacucaggaaauccacaaagcugaccaggcccugcugucauuuuguggccagauauggaaagauauaaaccaccuccuuucuucccugucaaaacaguugugccacguccucccccucuuccucaucuugacugacucccucacagguggugucucugucucuccugccccugcccccacacgcaccuuuaguuaccucagucuuucaaauuuugcucuuuguuccuaaguacagucuuccuuccaaccucucgucaugucauuuuugggccaggaaagauccugauuaugcuauaaugccacuguacguguuuuaaaaagaaggaacgcuguacauuugauauuaaauuuggcauuuuaaauaaagggcugguaaaaaaaucucugagugcuaaucuccaagaaagggauggaagacuggggaaagagaaucuacuuccuauuuccaccauuuuaauagccugacauauuuuuuuaccuugcccauaucuuacuuucauaacauuuuuguuuuauuuuuuaaauuacucccauggcgguagaguugauuugaacucuuguuuuucaauuuuaaauguacaaaauuucaauuauuuuauggauuaaaauaagcaccccagaccauccugagcaucugaucaccaaugguaagaccauuauccuucucaaguuucaucuacgguaacuggcuuacagauaaacuuguggauuacaaccuguuugacaacuguaaagagccacauugauuaaaaucagaagauuuucagaguucaguauuuagacuauauggauuaucuagugucucaauagaagguaagguuauggaaauccauuuccuaguucuaaacucugcaagcaaacaaucaucuccccauagugugauaucuaaauaguuaauccaguaugucagacaaccccauuuaguaaacaaagacuacuugaccauagaaaacauaugauauauguauaauauauaauccauauagaguaaacauguauuauauuuuauauacuguauaggcacauaucauacuauacauauacauaucgcauaagagauacaguaaacuauauuuguauuuuccaaaauuaaauauguugcaguuccccuaccauagugaaacugucucuucuacauuccuuacugcauuccuuacuauauaguaauacuaacacugagcacaaucauauuucaccacucaggauguagccagcggauacaguaaugguucuuguccuccgcaggaggaccacgggagaccaguggcugugaaugggaugggauuuuuuucuuuccucuaaugaaccaagcccuggguuuuauuguuguuguuuuaauauacagcuauugaguguuuuguagccacacacgacaacacacacacacacacacacacacacacacagagucccuagcaagggcaggguggggcuagcgggcuggguuccccugggagccccucaccauccauuucucccagugacggcagcuauguuugaagagcauaacugcaugguuuccuaugcauucauucgugaguaguagcucucauauauuauuaaaaagauacacuauuauuacuuuuaaagaaagaaaaggauugcaauucacauuuacacuuuccagccuguucuuguguuguuuaaaaaacaaacaaacaaaaaacgauggcagaggaaauguuugccuccguaguaggcaucaacuuuauuuuucaaaucauucuguuuuaacguguucauagacugcaguuguuuauagguaugaggcacucaucagugugaaauaguucuuuccuuuccauauuuccucuuaucagaaaaaaaaauuccuguggucuccuagcaaaauacaauccauuuugcuaaauuauuugugaguuuuuauaaaguguguuuaauaucaccagggcagagguucacacuaguugcaggauuagcaagagagacguagcaugaguaguguuugguccacugcaguguguuuugugugcuagcgaucaugaguuuaucugauccuuguuuaacuacuacacagugaguaagcuguccuguauuguuccauucauauuccucugaguucauucagaagccugacacuuccuuugccggacagauuaaaggggcagcgugggaccuuuugaugaugugaaaccugcuuucuuagucuaagcucccuaggcuaugcugaccacucagagguugaacuacuauuuauuugcccuaaaaugaaccagaaacuuggucuuaguuuccuuccugacacauguuuuaauuuccuaaaaguguacggauuuuguaguggguuguuuuugaaucuuucauuuuuagugcugauccaggagagaaaggagauauggaaacauuuuuuucaaaaaauagcucaaaagaaaauauguaaaaccaugaaaaacccagaauugugcugcugcuuucugugcuaauuaaaucaguggguguuagguuguaaugauaacccuuuaacuguguggcuuaucucucauuccauuuuauauuauuuucuuccucaugagaaaaucaguguuuauuaucacaggugacaaaacacaggagaaaaacaaacagugagguuacauuuaaucacuuuaaguggguuucaucuuugcuuuuuuguuuucauucccaagccagaagccguaaaccgagcgagagugcaaauugccuuucucaggugcacguugcugagauaggcugggagaacagguguggagcccgugaaaagauaaacauuaagucauucuuggggaaacgguauuuagcuagacagcugaagacggacuuuugaaauaccauugugcuacugcuguucaaauauugacuaagugaaccuggaaaggaagaaauuuuggucgccuaacauagaacucguugucuuuuucugucuuuaaauguuaucucaaagacccaagagaagggguaguuuaccuaagaaagaaauaugagcuuugcuuauggaguuucagguauaccuaauguaaguuaauuaagcaaauacaauguagcagccuugcauuuggccuagcauucuuuuauguuuccuggcuguuucuucgaggagaugaccugccugucgggcagauuagaauauuuacugcagugcaucuuucaugccucgcugugacucuguaaccacgguggaugugggaaagccauuaaccaucagcuugacgguuuacaaagaaauaggaaguucaaguuaagcagauauuuaggauauaguuugccuuccacauauuucaaccuguguugcugcauacuuuuuaagcuuagcguaauuauucacacagcuaugaauuuuagaagauguuuaaaagcaaaccacagugaccugggaaaggagggaaacuuacuggagcgcuuagccaggagcuuaaaaagacauugcuagugaguuuuaugucacaugaaaucuacauuugauaggucauuuugguaaguuuuuguuguuuuaaaugacuccucuugacacaguaaccaguggugcugggaacauucauucacauucauucauuuaagcucaugacucaaauaauaacuuagucguuuccucucugaagguaggggagguaaugaggagcaccgauuaggcuccaagauccguucugagauucagauaagguguccuaacaaaagguuuauggugaaaugaaagagugagaaaauaauugugcuuuuucuagggucaugcgucaaaugaggcucaccaacuuuuaaaagacuuuacauagcuuuagauaaucacauucccugccauguaagcauugugauguaauggcaucaucaugcuacuuaacaauuaauuuaugcauuuuguuuaaacuuccuuuagaauauauauaguccauauaaagaaaauuccagguucguuuuggauuuuguauaaauagcucccauguuuacaugugaaaaaaaauuauuuaugaaagaaaaacagagcuuucaauauccuauuuugguuacgucuccauaaaaacucuaggaaacagugggaucaucugugaaacaguggaaucaccccaagaacaaacugucagacagaccguccugucguggcaugacuugaacauaaccgucccacguggggacgcauuccgcaccgguugcuggaacugacgggggcugcagugcugaauaccucugggacgcuugggaacugugccccuguuuacagacggcaagcccuuagugguagggcccugagauucugagaaacauaaggucugcuuuauuuaauuuccucucguuuaccaagagucacaaccuauuuuaguaaauaaauucaggaaauugguaaagcacuuuacuccauccguuaugccucggucaucagcaugguugucacggucucucuggcucacgggcugcugcggcucacagccuucccucacuugccugcaaccagcugagagccucccuggugauggguguuacugagcuuaaacgauguaaacaaacagaacggcacacaaguugugcagggaaguauauuuccucuaccuuguuaauaaagauuucuaacuuuagagauuuucuguauugacucuggcauucuuuccaaauaauuauuuucaccccggggacuacccacacacccugggauagaauaaaagaaauuaucuuucauuugaggguaccagcaacccgcucuccagcucuaauccucuucauccuccuucuuuuuuuuuuuuuuuuuuugguuguuaaaaccugagcugcugccaagcugaucuuaauagcauguucacaaagacagauggauuuuuuuccuaccuucauuagccacugaguguuguuuuccaugauguucuccagcacuugcagccucugcaccgagucaucguauucgagcggcgcgucccucugcacagcauuggacacguaggggcuggaggaagagcggcaguuguccaucucuggcaggaggaaaguguagcugcaggacccaugcuggaccugauauugcuucuuuccuaugcuguccaugcucuuccgaaaguuguuauaggcugcggccaagacaagaucacagcucagaguaaagaaaacaaucugccacauucuuucuucaguaauaaaccagcagcuuagcaaacuugagggcaaacacacguccagagucccgagcugcugccgucuaaaacgcagggcugcuacgcugccauggcuggguccgucaaugaaagucuucucuuuccucuuuuuccaguagcaaaccugguuuuuacugcuguguucucuccaggcaugcaguaaacugucagauugcagugggaagaacaguccugcucacuugggagggcugugucagcuuuuacagagcagcuuucacgguccuuuguuccucucuccccagauccuacagugucaguauccgaaucaaucacuuuccuuuccuuauaugauaaguugauaagagcagccagacauguguagugggcugcuccgcccuccuggcuuagccguuaucuuccuguagggggucacuagccaggcaacaggaaaaaucagagcagaaugccugcccuccaaccaggacccaugcugcagaaacccucugggaaaaaccgaucuguuacaggaccccugggcauuuccuaggcaccaccccaauuaaguauuuccuagagagagcaguugaucucuuuugucugaaacugauuuuugccgugcuaagcuggcaaaauaucugagguaauaacuuuaauguugaaguacaaugaaaguuccuguuuuuuccuuuaggaauaaaaauauuacaaauaggucaggacuucgguuuauuuuuguuauuacaaauaaagaggaagaaguuuggcuccuguaaacgugugccuuuucagagggaaaaauagauucauugauuuuaguugauucuugaaccacuagccaaguuacaaaagauuuucauuuccgaacaguuggauagaaagaucuguuauuaagucacguuagaaacaucaguuucugagcucugaccuuuauucuuuaaaaaaacuccacuuggauauucacucuaaaaauacacuguacugauuaaguucauuacauuacaauagagaaauuagaauuuaagugccuguguagaaagaggaauacaaacuuuuuuuuuuuuuuuuuuuuuuugagacggagucucgcucugucgaccaggcuagagugcaguggggcaauguuggcucacugcaaccuccgccuuccggguucaagugauucucuugccucaggcuccugagcagcugggauuacaggcaaacgccaccacacccggcuaauuuuuguauuuuuaguagagacaggguuucaccauguuaggcuggucucaaacucaugaccuugugaucgacucgccuuuggccucccaaagugcugagauuacaggugugagucaccaugccuggcccacaaacuucuuuauugugucagaauuuguugacaucucagcauuuuguaacacauuaucaauuacauuagucccccuugguauuagacucgggcaagucacuucccuguuuuaauuaagcucuaauguccucaucugugcaauucaaggggugcacucacaagauuuuucaccuucaauccuauggcucuguaaguucugcaagucacuuccuuuaacaacuaaaacuuaauacuucagagauuaauaauauguuaacucagcagcccaaguguacauagggaaaaagcccccugccuuugcugcgguuuaucucucaagguacaagguuuauuauucccagugagcgcugaauagcugguacacugacuuaacagaccacaucuacccauaaaagaucuuuauuuuuuacuaagcucuaaccgaaagacagccuuucccuuaucaaugaauaguuaacgaacaacagugugaauaucugugacuuucucauccucagaaaucagcucuuuuuauuugcugccacaauacucagaacuacauuuuuauuaaacccagcccuagaucuugcuacugaacauuggaauaaaguagcaugugucuucuuuugagaagguguuuauaggcuucaccagacaaccaaaggguucugucacacagaaaagcuggaagacaugcucuggaaggaucucauuaguagaagagguaguaugauuccaccaagguucuggacaugguuuccacuaagggaaccaauuaaagaugcuauacccauccggacagugcaccgucgaagaaagcauauaggucuuaaagaugagaccuguguuagaacccugcuucugugugaccuccagcaaaugcuuccauucuuggagccucagucucccuagucauaagauggagaucauuuuuucucuguaggguuuuuaggauuaagauauaauuguauguuuagaaauauuuguuccuuuucuuuacaggcaugcuccauuaaauggggaucaguucuuccaccaucaaauaguauaacucugcuauucucugaaugcaaagcaguggcaguggcauaggguacaauuuuuuuauuuccuguuugaaaaagcauauuguaagguauuaauaucacauaugugguuuuaccuuuuuucaagauuauuuuuuguagagacggggucucacucuuguugcccaggcuggucuugaacuccuggcauccaaugauccucuugcuuggccucccaaagugcugggaucacaggugugagccacuguaccuggccugcauauaugguuuuaaaagucauucaguugucuuccaggcaaauagaguaguuuaaaaggaacaaauagaaagagggcacaccacaguacuuuuugucuaccagccuugugucagacaccaugcuaugcacuggggauagagauuaaggcaacugggugucugaccuaaagaagcuaauaguguauggagagggagagacccauaaacaaauuggaugugguaagagagagcagucggagcacaaagaaagacagugaugcuuccgggugcacaauaugccaugugcagcuggcauggacuccauccuuuucaaauucccucaaguuccgaacauggaaggaacagcucuuuguagauuccuaaauggaaauuaucggaaccagagagucaggggaagcucuaguagagccggaguuggcaaacucuguccagugucagaugguaauuauuuucggcucugcaggcuauacggccaccaucgccaccacucaaagguaaugcggugcaaagcagcugugggacagcauuaacugagugagcgugcugggcuccaauaaagcuuuauucgugauacugaaauuugaauuucuuguaauuuucacaucaugaaagauucuauuuucugcaaucauuuaaaaguuuaaaaaccauucuuagcucauaggcuguuagaaaccgggccuggacuguagcuugcuggccucugagagccuagguggucuguggggguaggaggugcugggcaaggccguccacagugcacgcgguguggugaccgugugugguuggcaaggcugucagcaguacacacagugcagcaaccaccguguguggucagcaaggccauccacaguccacacagugcaauaaccguguguggcgagcaaggcuauugacacuguacgccgugcagcgaccguguguggucagcaaggccauggagagugcacacaguacagugaccaccuguggucggcauggccauuaacagggcacacagcacggugaccaugugugaucagcaaggccguggauagugcccguggugugguauccaugugugaucggcaaggccauggauagugcauguggugcggugacccugugugauuggcaaggccauggauagugaacguggugcggugaccgugugugaucggcaaggccauggauagugcacguguugcggugaccaugugugauuggcaugaccaucgacagugcuuaugguguggugaccgugugugauccgcaaggccauggauagugagugcacacggugcggugaccaugugugaucagcaaggccauggauaguacacgcggugcggugaccaugugugaucggcaaggccauggauagugcacgcggugcggugaccgugugugaucggcaaggccauggauaguacacgcggugcggugacggugugugaucggcaaggccauagauagugcacgcggugcggugaccaugugugaucggcaaggccauggauagugcacgcgguguggugaccgugugugaucggcaaggccauggauagugcacgcggugcggugaccgugugugaucggcaaggccauggauagugcccguggcgugguguccauguaugaucagcaaggccauggauagugcacguggugcggugaccgugugugaucgguaaggccaugauagagcaugcagugcggugaccgugugugauccgcaaggucauggauaguguacacggugcgaugaccaugugugauccgcaaggucauggauagugcacacggugcggugaccauguuugaucggcaaggccauggauagugcacacggugcagugaccaccgugugaacaggggaggacuggugccucggcucagccuucuguguggcugcuuacaggggcuuacuaacgggauagaauaggugcuuagagaaagugccacacugaagugaauuaaggaugccagguggggagaggggccaggaaguggccugggaugcaagugugcauggaugggcgcucagcuguggccccuagggaaguggagacauggucugccaggccacugaccaggaagccucggggagccaaugggaggcccuugaaggcauuaggugcaaagccuggaguuguggguguccaguaacaccaccaugcagccugggggucugaggccacccaucugggaccccuucacucuaaaugaggcuugacuagggggaucucagaacuccagagaaaaucuuggguguuccucccugcuguacugacgggaccacaagaggcaagugagacugucagaugagaaacauuauuacagguucccaaaauccaccugccuacccacccaauuuuugucuguaauaguucugcugaacagcugugcauagugcaauuuauuuccuuaauacuguuuguuuucucccccauauucugugucggcaacugacauuucagagguucccauguguucucuguggaacugucucaaguucuuauuacccugguugacgacaccagaaaaaccauagcuaccuacucccagaaagaggccaguguuacaaagaaucucguggccagcccuuuuggcucaguuugcccaguuggaggcccuaaggcgcaaacaagaaaagccaaagggccuccugaggaccguggaaguggguggcgcguggacccaucgcuagcugaauguggaauguggacccaucgcuagcugaauguggaauguggacccaucgcuagcugaauguggaaaaggacuuaugacagucagaccaucccagguucccccagagcaauccgugcagcucucauaagcaaccagaaaccaaaaaaggaugcuaagucagcacaaaguggagcagccccccagcuauggguugccaaacagaauuugcuugugggccccgugaccccugcuguuguccaguuuaaugcucagcauuuauccagaucaagggauggaaauggggccaccagccugacccaggcccggggucguuuugcuuuuccaaccuguaccaucccagcaaugcauugccagcgugcaauuugaaaaagcccugccgagcugaaaaacacauggaaagggcucagacacacuuaaaggcacauugcugcccugcauuuauacggcauuuugugcugacaucguuuuccaucaggccugggcagccccuccugagacugucucccgccugccguccucagcacggccugcccggcuacagucugcuuuccucccacugccccugccugcaggccuuggaggcggugacugcugcagacuuauuugggcagccuggccuuaauuuuuggaaagugccuuguugauguaugaggaacuuccacggcugaaacagucuaaaaaaaugaagcugggacacuauguuuugauuugagccauuugcagacagaggggcacacucgggacucuugggcgccuggcacacuaagcugggagggacuuuugagacaucuuggccauccaaaucagucaacauguuuauauauacaauuuaauguucaguauacagggaaaaccauuagaagguuagcugcacauaaaacuguuguuaaaguuauuuuuauuacuuccccccacaaaucguaugcaauaauuaauaagaacuagagaaauagccacaacuggcacaacaccugccccucugccaaaagaaaaaaaucuucuuucugaaggcaggcucccuauauagugauuccuuuauaugccuccuggaagaucuguuucgacuccauuuugauauauguugaaccagauuugaagacccacaaaugcagucuagagccauuuugcaaaaguguugcugcaucaaccauuuccauuccccagugcugcucaucauguuacacuaguguuaaauccugacuuuggaaugcgaggaaggacaguuccagccaugggauuucaaaaaaguaccaaaggaaagccccuucaaguuaccguaaagacagaagaaaaggaagaaaaauauaaacacacacguauaaacauguaagguagcuuuggucccuauaacagacaaggaaaucaaggcuccgugaagagagagacaagaauucccuuagccaagugccugugugugucugucuuuuauguuaaugguuaugaauuuaaggagaauugaaagcaauaauuuugccccucuuuaacauggcaaauacagccugcuuuagagaugaucagcaaucaccauuuaguacuggccgucaccucugugcagcacaaacacacaucccgagugacagaagccauuucacugccagagacucuuagcggccuucaguucucuugagcuggagccacugggucuuguaugaaagcucaccagacaucucauguggaccucgggcaucugagccgggaccauccuauuacaagugcggaaaccagaucauuaaugcagagcugaauucaaauuguuacuugcuagcuuaggaaagaauccuuggaaauccaacauauugucuaaauggaucaguuaaucuuacuaugugcauucuacauacccuuucauuguuugggcuuaaauaacuuuucugcuuugucugguuuaauuucauccaauguggaucgcuggaagaauaugauguauguuuuagaauagaaacaguucugagaugaaguugagcacaauuuccuguucuaguugcaauuaaauauaaauauagcauuugacauaaaauagcuggcccgauauauuuagaguacaaguuaagugucauccccuuagaauugggcauugacuccguagaauuccccuuuguacaaggugagcaaauguauauuuuguuaaaaauaaguaucugacugccaaaacggacagaaagcucuuugccauauguguuuucaggccauuuccuuuccugggaaacagccauuucccccgcauuauaguuguguuuucauuugcggguagauagaguaagcgcaggaguuaaaggacgcgggccuccacagccaaggccuuaucugggacaauuaucuuucuccuugcagcuguguaacuucuguuugacacagaaccacagaaacccuguuagugggaaggaucacaguuaauaggagaaaaaucuucauuguucaugagacuucucaggugcuuggcauucuuauuuagguggcuuaaaaaaguuccaaguacucauucauucuaacuuaucuguguucauugugaaaucgugugugaaugacauuuggagcagauggauuguuguuuuuuuuuuuuuuuuuuuuuuuaacaaacuuaagagauucccgaaucuuucacaguuuguacuaccgcaaaccagccuaacaucugcuaaagaauuucauauuuuaaagcugcacuguacaucauauggaaccuuaaggacuuugaagggaagagcuuuuuauuuacugguagcuugggaaauauccaaguaacuauuuuuuaagaaaaaaaaauuccuugaguuuuuagaaauaguuuauauaacuguuaugcuguuugauuuuuaaauauuuucauucucuaguauuauuauggaauauuuuaucuucccaucaaaaaaaugccagaaggucaagauagaagucacaacauuaaaagggaguggauacaauuguaaaacaauagaugaguacauuugccugauaauauuuuugccaguaauucuguguccuguuuucucccuguagaaugaaaugcuaaacauuuuuuucaauggauugaugucaguguuuacuaacaugaccuguguuaagucaaauaaaguauuuccuuugacaaacaccauauuucauuaguggcuuugaggugggcuuauuuguuauaagucacauuaaauguucccaaauccauuucauaaauguugucgagaucucaaacuccguugcuucuaaaaaaauauguccagucucuuugucauaaccauccuaauaaagaucuaaauuucuuagagugaauuuucauuugaaaguggcuuaaugccagcuagauuaauucuuguuuaaucuaaauuuauaaaauuuuuaucuuaauuauugagaaaccuuuuuaaaaagagauaaaaaugucauaugugcuauuuacauuaagauauauuaucucucuugguuauagguuaagauaaauaaaauugcuuaugucaaagaaguaaaaaaaaguccaugaccuccuuuugguauccccauccaucuggcggacuuaauaugaaaaaaucuuccugugggaaauuaggcuugauuauagaguuacaaguacaaaaaguaguuuuugaagaauuauaauaaauaguuacacauaaaaggaagugauguuugcuugaaguauauaaaaauauuccuugucacucuuguccccucaugaaucuuaguugucugaugaugguucaagucuuuccuaauaauccagaauguaucccuccacuuuuucucuuaaaaacgcuauuucaagcauuuucuuugguaccccauuaauaauaaagcauacuuccccaaaauguuccauuucaaguaaggggucuaaaagucaaagaccgacugauacaaaagagaaaaguaaauuguacaaagacugaagagaggaugcaguauuaaacguaccaaguucuugacaucgguuucccucaagaaaaaaaaaaaaugaguaacguuuuuugaaagccugaaacuauucuaguaaaauauuuacggaaaaaauaauaugcgcucuccucccaaauccugaugcgcauuuaaaucaccuuuuucauuuauagaucaaaaaucuugcuugacuacaauaaaaauuaaaaaaugguaccuauuuaagaaugcaaguaucaaauccacuuguaauacucacuagcucccucugcugaucuccuaucaagcgacaggcaaaucuauccaugauuguuauuacaauuguuaauggaaaugauagguaauuuaggaccuacaucaauugcaacuaaaauacaagcuacaaugcuuucauuuuaauuuuaaugcaaaagcacaucacaccauauacagauguuaaagaccgacgugcacacacacagugaaaaaauauuuuuaggcauucauuuagcauacauagaccuaggagcugucucuguauccucaggugauaagguuacuacuauuacaacagcagaaaaagaggucuguacugucugucuccauaaggagccaauuuagagacccaguccuguucaccccaagcuuacagucuaacgaggugaacagaugucccaucuggaugcacaagcacugcugccuaaggcccuggguagugcaggagggagcccccacacgggaagccucccaaaccacguaagggcuacgugaacagcaagaauaguuucacuguuuauuuagauccacacuguuacuuauuuaagaagaacauacucugcccuuucucccucccugaagaaagaccaaaacugagggaaauuauauuccaggcugagaaaauugccugugcacuuaaaaaauaaauaaauaaaaggcgagaccacggaaguuaaaauaaauuaacaauaauugagccaagagggaggagaugggugagucggagaugcggucuggaacuagcugcugaagagucugcuuaggaauugggguuguacccuggacauaaagcauuuggggcgggggaguguccugaugugacugagaaaggacuguggagugcugugugcagaagggcuuagaggaggugugaguagaggcagagagaccagagcagaagcugcuacaguaauucagguuagauauuauaguggccugugcuagaauauuaacaucaggcucaugauguuaaagaggggugaucaauaggccuucuagauggauggaauacagggaguccaggaaugggauuggucugguacugggacugacucuuacacuuaaaaaugcuaaaauaaaauaacuuggcaauaguuuuuaaagcaucuguaaaaugacaagauaauaaacacauauucugcucaaacuuaugugaaggcaggaauccugugaacuauuaaagagcuuugccaucaagucauuugccaaaccuggccaacuuaagccuacuucaaggccugagugguucagacagaagacaaaggccaggaccuaaagaaaugggagcaucugaugagauaccuccuuccaggaaggcucuaccccagugucagggaagcagaaguaaaccugcccaccccacucuccagagcagacaagaaaacaugccuggauguuaaacagaacuaaaagaggggagcccaucccugagaauuuaacuacaagcucacccuuuuggguuuuacaguacacauaagguggccagaaaaaaccacaaugaauuguucuaagguggucccaggcugaucaucuuauuccccuagguuuguggaagaagcaaaugaaaauccuuucugggagaaugcacuuucaucaugggucucaaaacauucuuacaauuucccaagaauaaugggcaacucacagacaaaaauaaacacacaagaaaacauagugcuauuagcaaaaaucagcagaaagaagaaauaguaaaaacagaccagccaaaaacaucuaucccugcuguauugguuugcuaaggcugcgguacaaugugccacaaaccgggugccuaaaacaaugggaauuuauucucacagcucuggaggcuagaagucuguaauugaggcaucagcagggccaugcucccucugaaaccuauaggggguccuucccugucccauccuagcuucugguguugcuggccucaucgucucaugguauucucccugucuacacggccgucuuuuuauaaagaugcagucacauuggauuaagagcccaccccacuccaggaggaccuccucucaacuaguuaaaccugcagugacgcuacuuccaaauaagcccacaugcugaguugcuguggcuuaggacuuacaucuuucuaucaggaauguaauucuauccauaacacuuacgauguuuaaagaugaaaguaaaauuuugaaaacaccuaaaggggacagaaaacuaaagaagaaaaucuugcagauuuaaaaugaaaacuuauagacaugaaaaauacgaugguuggaauuuauaauucagagucauguuuaacaagauuagacacaccugaagcugaaagauaagugaaaacgagucaucccagguguaggacagagagacgagauaaggaccaggagagaaagugaaggaagaccugcaggauggaggaagagugucugacaaaguccauccaaauuccagaagaagggagagagaacagggcaggcaauauccagggagauagucacugaagcuuuucccaaagugaugaaagauaucaaguuacagauucgaaaaacggcaaaaaaugacaaacaggauaaauaaaaugaugagauaaagcaguaagagggaagucaagaauuacugguucugcaguuucuggccuggcagcugcacagauaggauucucaagggcucggaaggggagagcuagcagagaggcaaugcaugcagcuugcacacauucaguuuaaauuggcuaugagacuuccgguuagaguuuuccuauugcauguuugggucugagcucaagagagccaccuggguuggaagcagcaggaagaccuauuuuccugauuaaucucaaugccagccucauuacacaaucuuaacuaauauuaaacaguauaugaaacaggugaagaagaacagcuguauaaauugcauaaagcuuagcaauguggguuuuucuagacaaaguuaagcagcaaagcagcuccauuaugagggacccuuggccacgguuucacaggugcagguucugcagaucauggcauguuguccuguucucuggauuauggcucuagaagagauaaugauaaagaagacccaggguggucaguaaaaagguccuacguggugucuauacaauguugcaagugacuaaaaaugaguaaaacuuacaagauauaauuaguagcaugcaacucuucauaaauuugucacuucuuugaagguccuuguuaugaguugaauuuuguucuccgaaaauucauguugaaguccuaaaugcccucagcacgugaccgucuucggaaguagggccauugcaguuguaaucaguuaagauagggucauacuggaguggagugggccccuaaucuaaugugacagaugucuuuauaagaggacggucaugugaagacagauacaggaggaacgccucgugacaacgcagguagggacagggugaagcuucuacaaaacagggaacaccaaagaugagcagccacugccagcaguuagcagagaggccugggacagauccugccucguggcuuuggcuuccagaaggaaccaacccugccccacaccuucaccucagauuucugcucuccagaacugcgagagaguggauuucuguuuaagcaaguuugugguacuuuguuacaacaacccuagcaaacuaauacagccuuaaaaaaaaaaaaaaaaaaaaguaauaggaaaggaauuaaaauauaacgcuaccuugcagccuccaccaaacacuguugccauuugguucuucuccuucuuguucaaccucaggagggggugaaaaaaguccaggcagcuccuggugauagcuaugcaaagcuucauucugcagcaguaaaaguguuuccuagaaguacuaaggcucguuaauugcagccacccuauaaaagaagguccucuuucaugaagagccuguuucucugcaggaagauggggcugaccucagggccuccagcacuuaggcacuuauccauaugucuguaaccauuguugugagguuaguugauaauggcucauuauccucgcuaaaaugaacucguugaaguaugaggccaggccuuauuggaauccuucccuuucccuuucccuucccguuuccuuuucccuuucccuuccccuuccccuuccccgucccuuuagauguagucucccucugucccccaggcuggagugcaauggugcgaucucaguucacugcaaucuccaccucccgggucaagcgauucuucugccucagccuucugaguagcugggauuacaggugcccgccaccacgcucugcuaauuuuuguauuuuuuuuuuuuuuuuuuuuuuuuuuuuuuuuuuuuuuuuuuuuuaguagagauggguuuucaccauauuggucaggguggucucgaacuccugaccucaggugauccguccgcaggugagccacccgccucggccuccuaaagugcugggagaggcacaggcgucagccacagugccuggccuacugucuucucuaaaauggcaucugugcauucaucucagccgccccugcucagauaaaagcaauggcgccuccuuugaaaucugagagacgcagggcccugcccauucugcggaauuccuucucccugcugccugcugugaggaggcccccuuugccacggaaccugaaauuccugccacuggaauuacgcucuggacaagcggcaagauacuccuuucagucccagccacuggguuccugcugcacaggaggccagggugcugugaaccugcucucagccccgggcaaagggaaucucguuaauccagguggccagcgccucuuccucagagcaucugcagugcugcagacagggccucccugcguggggcuucuguccuccacacuguggugcugcugggauguuuucauggggccuuucccuucccgucaccacgugugcuccagaacccggugcauuuggaugaagccacuagauguauaggucagcagcuccacauagaaucaaauuaucaaaugcacacuaccugauccagaauagaucguccugggguaaacacauucacauauucugaauguacaaauggcugucuaguaaacacacuggaacuuccauaauuauuguccuuccagauaauuuuucaagauuauaugcacguauucugccauuccuuuucaagacaacuuuagaacuuccuuuggacagcuacuguaagccaaagggcuugcauuugaauaucuugcaugaagcuaaaucuuuguucaugaaaggcagaauaauuuuauaugccacaaagcugcaguaguguguuagguuuaguagauggcuaagcacuacacuguauuauucuaauccuauuuucacaauuuaacaaaugugagacaccgugcuacuuguacaagagauacaaauuaaggaaucuucaaugaccuuguagccuagaaagaccuuuaguaauucuucuuaaucucccuacagagcuaagugauccagagcugaauuaauccagaauuuaugucuuccuccgccuccggaguagcucuagaaaggucaaacccuuccgagauggagugucuguggggguagguccucuuugcugugugcgauccugugagacagcgggauguccugcaucucugaauuugaagcgaggaguuuuucugcuauguuuggggagagccucacuccccugcucaguagaucagacguguucucuucuuucaccacagcuacaaacaacacacuggcauuguuucccagacacucgacugucccgaugggcauuuggacauggucuaugagaggaauaagcuccagccacuguaguggcucaugggagagggaaauggguagaaauucuuucccaaacugguauuucuaguaaagcacucagccagagccugcagcuguucacuauuccauaucaauucuaaacagcauuuucguuggcaaaagaaaagugagaaaacaacaaagcuugaagccuaaaacuuugggaaaccccuuuccugaauguguuuacuuagggcuuaaaaauaugccuguuuucagaacagaagaacuaauauccauguuuucuaugccgauuuuucagaguacauuuuaaauguaaguacauuuagugauuaaaagggaaaaauacuugaucauuuucuaaacauaaccaaaaucucacuauguaauuguuuuuuccucuauuuaagagcagaauauuucauugcuaccaaaaugcuaguauuuuggagaaaauagaagaacuagaauaaguagucagcaauacaaaacccugcguggaagauguguauuuuggauaggugucaacauguccaagcucucagugacaaacacaggcucauuacaggucugagcaaaugugccacuucucaggaagacaaggcagaucaauguaaaggcagguggcaccugguauggcucagacucgcacgugguucuccacagagcugcucucggcuccuuuggaagagguucaacguugggagcacagguugcuucucuggcccauguuauuccuggagcuacuacuucccagggcagaguucauguuuuucguucauaaauggccuggaaauccuagcauugggccagccauccagaacaguggagcugcaugaucuggucuggggauauuucaaagggaauagaauacugaggcccugugggauggaggcugcuucccgauauugagaacugcaccagacugagcuguguccagaggaagggagaacgucuuucauucacuuaaaacucaccuaacaccugacaccuccaucuuggcaucauccaccuguagccucuagcccucuucaucuguuaagugagaguaacuggcagguuauuuggagagugaagugacaucggcagaguuccagguauggugucugaugcgugaguucgcccccuuucccgguccccuucuccuccauuugacuaauuaucaaagaaagauugcuuuagugaaugagacaguuuagauccauucccuugggaaauuaugguggucagcccuccgcucggucucacuuuuagauaccagaaacuauauguccuuguguuggcagagcuggauugucugucgcccucuggugcaauccugcauuaguaagggaaguguuuuucuggggcguucuaaugaaaagugcuuaagcauuuguuuuggugcccagauaaugugacuguaguuaguauguaguguuuggacuuuuugcucaugcuuuuguuguuguuguugucauugcagaaauaaaauuaaccccuuaaucuuaugcuuaauguacacaccaagugguuugcauauuauacugagaaaauaaaaagauuguuuuagaaaaaccaaaggacaccaacagcucuuuacagccccaaagcacgugucgccagaggucacaggagggguucuuaguuaucagcaagggaaacugaggcuuucucguuuaugcagaaguggaauuuauugaauaauauuaagggggcuaugucgccaaugccacagucacacugcccacacagaacuggccuggcgagguguuacuuugaccaccauugcugggccaggacgcugccaccaaggccgugccccugccagaaacuaaauguggcugccccaucccuggcccuuucugucaguagggucagguucaaacuccuggguagucagcccagcucucauugacucagucugaacagcugccuguucccuagaauccacaugcgcugggacaaugggaaguaucgguagacgcuauggugggaagaugacucuguguccaccaagguucuugggcuggggaauggucugagcauaugacggccucagaccccagccaaccaaagggaaaggucuccccuguacucacgaagccuccacgauguccaucagcacuuucuuccuccguugcaguguaggucagcccuucgcagaugcucacaauucccugauacagccgguugcccuuuguuguguuaaacugaaagaauuucagaguuggggccaggcauggugguucaugccuguaaucccagcacuuugggaggccgaggcgggcagaucacgaggccaggaguucaagaccagccuggccaacauagugaaaccccgucucuacuaaaaauacaaaaauuagcugggcaugguggcguguuccuguaauuccagcuacucgggaggcugaggcagaauugcuuaaaccgggaggcagacguugcagugagcugugaucaugccacugcacuccagccugggcuacagagcaagacucuaucucaaccacaaaaacaaaaacaaaacaaaacaaaaaaaaacucagaguuggagaaggacucggacaaaugucacauuauagaggaggaaaaagacccaggaggcagaaagacuucccugagggccaugaugguaguuagugcaucccuuaaauacaagucuucugcuuccuauuccuguaaauaacuuugcauuuaacauuuuuguacauuaaacguuacugauucauagucaaugauuauggucagcccuccacauccgcagguucugcaucuguagguucaaccaaucguggaccaaauauauucaagaaaaugaaauaaaaauacaacaauaaaaaaguacaaaaaaucgaguacaacaacuauuuacauagcauuuacauuguauuaacuaucauaaguaaucuagggaugauuuaaacuaugugggaagaugugccuagguuauaugcaaauacuccauuuuauauaaagacuugagcauccauggauuuugauauccaaggugggggucuuggaaccccacaaauaccaagggacaacuguguauuauuuucauaacccauuucugccuaguguuccauuaguggaaugcuaaccaugugggaauuauuuauauccuacuguucaaggucaucaccaaggucugauuuuucacacacacacagaauugcaaccuccagcauaaauggggaugaauuuacuacuaacauguaguuuccauccacaaauccaaugucccuaugcuauuuguaacuguggagccaagagaagcuguugaaucauguggugaauaugaucaagaacucaagauuagggauaaaagcaaucauucuguuauuccuuuuuaaaaauuauuagccuguaauuuaaacaucaggaucucauguaauacagaacaauaucuucugacauuuuuacaauacuaguauucuuacaaaacacaguuaggaaguuacaugaagaaaacacgcagacuguguguggcuaaaucuuuaguaccucauuuccauagucuuagagaaaguuuaaauuauauugaaacuuuucucaacugcuaucuuaauguguucaggcugcuguaacaacauaucauucaaacugggugucuuauaaacgauagaaauuuauuucucacaguucuggaggcugagaaguccaauauccaggcagauuccaugucuggugagggccuguuuccugguucauagauggcgccuucucugcguccucacauggcagaaggggugagggagcucucuggggucccuuuuauaaggacacuaaucccauuugugaggauuuucacucucaugaccugcucacuuucuaaaggcaccaccucccaguacucuugcauuggggauuaggcuucaacaugaauuugagggaggcgcaaacauucagaccauagccacuggucaacauuagguaaccugcagugcuuggcugugggaugggaagccuguguuguaaaggacgucugagugggaacaggggucucaagcugccuucacaucuaacgucagcacacuagagauggacauugcagcugcaaccuacugugccuguaaagcauuuagaauuacgccuugcauacacaaagugcucaauaaauguuaacuguuauuaugguugggcaucagccacuuuaauuaucucuuucaauccucauaguaacucuucaacauagguagccuuauuuugcaguugaggaaacuggagcuuagcaaaguuuagugacguugcagagcuagaguucaaacccaagucugacuccaaagugcaucuaucuguguauuugcuuauuuaaccucagacacacagaaucggauuaauuagaguccuugauucagcacacguucucuucauugauccuuacuccuuuauuuuauuuuuuaaugcuauuuuuuguuuguuuguauuuaauaguaagauaaacacugugaacucaccacuuaccucucaccaugagagcgcuggugcccaccuccaccuccgaguuccacauaucccauuacccugccuuccccguccaaggaaaccacugucuggaauccuucgucauucaagccuuuucacaguauggcucuuuccagccuuuuauuucucuacuguuucgcuuggaaacucuacauuucuaagacaguguggugccucugagcucuguggcuuuugcuccugcuagccuuucuucauaaagucuuucagccccacaagugucgcagcuuuucaaagccuuucccauccuuuaagguccuacuuuucuuuuccaugaagucuucucugggccacgaugacuggggaauccucacugucuucugaaguucugcacguacuuacucugcacauagucggcggugagguauucaucacauugaaaucgaguuacaugugguccuguucuauagucaaccaaaacuccugggguaaaaaugcugcuuuucaucuuggcaaucucuauccuaaccagcacagugccucgcugaauauuagaggccugagaauuuucuuuguuuuuuuuucagagugauuuuuuuuucucugcuuuauuuaauacuuugaagcagcacacauuucaguuugcuuuaugcuugauuuuuuuuuauuucuucuaaacaaacgagauacaugugcagaacgugcaggauugacacaaauaauagcuggcagaguguccuaggaaagacuccucagauguuauaaauaauacacaaacaaaaacacacacaaauauuuacugaagacuuuucuugcgcugcaaggcacuggcuguguaaugcagaauaaaaccgacaaaauucuugccaucugggaugugcauguuaugucagcacagggaagagaucaagugugugugcauaggacaucaagaauacaauaaaacaaaguggacaaaaggaagcgaggguggugaacacaggacaccugaaugaaggacagaguuguuggaaaaggaccccugagugcccaagggaggagcuggccuggaguagugagggcaaggugauugcaaaugaggccuuggugauuggaaaugagcucauccccacgucuuauaaauaguucuccaaguuauccgaggcagguuauucuguggcaaagacgccucagcuaacuggaugcagaagagacaacugaauagagccucauggucucggagucuuuuuuuuuuuuuccuagguuauugguguucauuucuuguuuuguuuuuuuuuuuaagacauaucuuuggcauuuuguaccuaccuucuguucuaaauuuugcauuuuuacuacuuucaaguggguggacuuuguugugguggguaguucaagauucaucauacaaaugugauugugcuucgaaacucccaccagucugacgcacgcauggguuuucuggcaacauuugccaucuacagcacucucuuugaucaccuucaucaucuuccaacauuccugccacagucacuucccagaaacuugcuaaucuguaauagaaacccucagauuccuauggugaauuuguaaucaaaagucacauauugauuucaaaaucaauacacacuuuaaaaauaacacuacagauuuagcagcucagggaggaaggaaaccguaaguucaucuggugcagcuacccgucugggaugugaauuccuccucuucaugaaauguuuacauucauaucacagucuaggguuuagugaaccauaaaaagcugaaaguuaaugcaaacaguagucgcccccaaaacauauaccaacugauuuaaaaggagacacagcagauggagauuauugugaaaagaacucuuacuggccaauuuuuuuguuauuuuaaucucugcuuaucccaauucuuuuagcugcauauacugagacacuucacaucuauaauaaacuugguaccagaacacaauucauuccagaccuaacucuuuuagaucauuauaaccgggggaggaaaaaaguuaaaaaggcuuaucuaucuuaagaaguauuucucaguguucgcuacacgucacuuaaucuuuuccaaaauuugacaauauacaaagcaguuuguagugacuuuucauagugacucuacaauaaaaugggccuguccuccuugcuuuuccaaaugcagucaucaucugacaagguuuagcuauuuggggaaguccuugcuugcaaacguaguucuuuugccaaacagguuuggucaaacuguguccccuaguugcacaguuaccccauauuugauuaacaaauagcaaaacagagauaaucucagaaauauucaagagucucaaaccccaaauaaaauauaggcauccuccuguugagucgaauuggcaauuuugauuagcaaggcucaugaagcaguagauauccccucugauccccaucccagugcgagggcacagugaguuguauuuucuaaguauaaacuauucucuagcaguucggcuggaguauugggagcaaaacuguauuuuucuaauauuuucagacuaagacagugucucuguuuuccggacuuuuccguggcuaaugaaggauuuaucagcaauacaaagaaaguucucccaguggguacuccacggggagaggagcuggggucucacuagugcacagccauaaaagacaccacaagcauauuacacgugaagcaggauccgugcccaccacagcaguugucccaggaguuuccuguuugaaugagacacuuuggguggauacugcagggagggagaagcuguguguggccaccacagcuggaagcguggccuggugcccucacagcugucugggagccccuucccgggaacgccggcuuuucccgggugcaccauugcagcuggagccauugucggccgccucgaaaacaugcaguugggcugcucuggcaggcuucuccagcccuccucccaagguuuaccucucuaaaugucaaaagggagagaauacuguauuuguuuuucccucuacugaaauuuauuugugacaucaggcaucacuuucaccuuagucauuuuggcuggauucccauacucaauuaaauauccuuccuuccauauggcccauaggaagagagagaaauuacauguaacuggucuuuccuccucuuuauaaagucugguggcugagcaacuuggccuguacuuccuucaugacccaccaucccaugacugcagggcaguuuuaaacacagcagcuugguuucuauugcacggaagcuggccaacagucacagugugcauuuuucuauugcaccuccuuguguuaacccaaguucacucacagcuguaacuacagaaguuuuucugaaagcaagugaagccauccuucuuuuauugaguuuuugagcuagggucucacucugucacccaggcuggagugcaaugaugugaacauggcucacugcagccuugaccuccuggguucaagugauccuuguacuucaaccuccugaguagcuaggacugcaagcaugugccaccaugcccacgcuuucugauuuuuuuuuguagagacagagucucucuauguugcccaggcuggucuugaaccacugggcucaagugauccuccugccucagccucccggaguccugggauuacaggugugagccaccaugcccagcucauccuuccuuuaaaaccggcagcugggcaauaauacagaugggaccaacuaaguuucucagaccacucagggaagcuagucuugcauagacaaaauauacacccucuuaccugccccaccuuuaaggcugguccccaggguccgcgcucuguccuccagccuccacgcuucccugugacuagccucuguggucaaaggugcuugcugaugcagccucuguacagccuccaugcagugcgugucuuuauguggaggagaccgcccuucuuucagcaguuauugagcaucuacccacucugugccggucauagggcuuagaacugcaugucuggggggaauucugcaaagagagccugaaauaaaggcaaacagugagagacggccaggagaaaccaugagcacugcagugaguaucaagggacaaagcugaaaaaggaagacugaacgcugagcuucaagccauucauuucuaugggccgcgggagcccuugaaagucugugggcaaguuuuggugagauuaagcugguaguucuguucaggacagguugaagggaugagagauuaggacacuuaccaccugaauccugucgcuggcuuuaguuuaaaccacccguaauguagacauccugacuuagaauucccugugcugcuuccuuucugauggaaacagcucugcuaacagagugcaggcugugggagccgagccccguugcaggcagccugcaggccgcaguuuccucggcuuaccacccagcgcuuuucauucggcucagcgcuagggaccucugcuuccacuucucgguguuggaaauugccauuuauuuuugcugucgaugaucuguauugacuuggccugaguaugcgugcacgucucugguggucugaauuauauagaccagaagggugucugaugccgcuuuuauaaaaaauaauaauaauuugaaaggaaaaaugacucacugaagucuggcaaauacagagcccucucucugaaucgacuucucacuuggccauguugaauuccaacuggguguccucagacauuucuaucccaagaucuacuccuggcuuagaaucuguuuuguuuugucuuauuucagcucaugguucuuguucccccagcuuuaugggguauaauuuccauacaauagaauucaacacuuucaaugugugguuggauggcuuuuggcaauuguauacaguuuugcgaucaccccuacacugaagauauagaacacuguuucucgucuggugauugcuggacauugaauucuuuccaguuuucacuguuaugaaucugacuaugauuuuuggcauggauuuguauguagcuauaaaucacuugguaauuuuucagaagaauagcagucuuggggccuggauggcuuauuguggucucaaaaaguuccugaugauaagguugcagccucaugcuucuuuauaagaaugcaguauuacuugcaagggagcuuggguagauaagaaagcaagaaaguccauguggagacccuguccagagagcacagacauggacuaaguuaaaggaugguaaauuagcaaugcccaaaagcacauggaggagauacuuccccuccugacucuauuggugaugcaguuuauuugucugagcuaucugagcaaguuuccucucacuuacgugcuggggacagcagauuccaaugcagaguccuuagagcucaggcuccccucaaccugacgcaucucucaaccauuugucuuaagcugucugaagucagcuucccaucuuggggagguagaagugaaaggguuuccacuuugccaagugagcguauauggggagacugaggguguggaguugaugaugguugugggguggcugacaguguccacagggcuagucuugaggcaggcugacacuggggccagaugggaccacugugccuccuguccccuccaccuucuccuaguccaggaagggaauagcagcagcugcucucaguggggcauucuuuuuccagagccaggccagcccagcagugaucccuugauaaagcaagucaccguuaucagagcaagaacuauacauucacuuaaaacuuuuuuuuuuuuuuaaguguaaaaugggacugcaacaaaaagaaaauugugcuuaggagaaugucccucagaaaauguacuuuaugauugcgaggaauauuugccaaggucuuugggguaggcugagccccuucaccucccuggggacaugcuaggauggcaagagaggaucagacaucucccagggaggcuguguccagccgggcuccuggaguggcguaagucugguugaaccagcacugaacugccugaguccaugugaacgcauugaacuguuaaaccgugucucuggcggccacaucuccgggcuucacccgcugcucuccccuguccugcagguacaaagucaauagucaaccucaguuuugaauguuacaaaauuauuagccucuccauaguucuucccauggcuucucacccaagccuucugcuccucucuccucucugcccaggucucaccagcugcccuugggccaggucacugcagugucugccagcaccacgacaggcaggcuggaggcccaguucucacagaaaagacucgaaagggggcuuuccauccuuuauagucuaccugcuacuuauaggccaccaggacaaaggaucaagguggcaaggcagaaauugcagcacagagcgaauggaaaggcagucacugaagggauucuuuugcuuuuacaaguagauuuuucuuaaacaaucacuguaugaaaacaaaaguacaaaauuauuaaaacaccuggaugaugaauugacaacaagaguuuuucuggaacauccuccugugggcucggggaagacaguuuuuuucuguggugauagauggucaggaaauguagugacauagaagugaaggcauuuuacagagcucaccuuaaucaauggcuuuuucacuuauuaaguuuucuuuuauuuuuuccuucuucaaaaaugacugauaccuuaauuuaugggaauuguuuccaguaaaaauugggacaaugauagugaguggagaauauuuauaugcuauacuuccugucuuccuucaucuuuuauuacugaggauauugacaugaaaacaggaucuuuguauccaaugaguucaucgacggccgauuucccaccagaaauuccaggcuuucugacaucagcgugcauugcucugcaugucacuuggagcaccggcaucuggaaaugaugaaauccugaacaacaaaguuuguuuucaggaagacaaggcaguggggaagggaagggugcuaagcuucagugacugccuacugugugccaggcauuuucaucuuccaucucgauagaaugucuaacugugcucugagaugagaacuauaaauagcuggucagccaaaaguuuucugcuuuuucuuagugaucucaaguguuuccaugacacgugcugcaaccaaauacauuauguguaaauugccaaagaccuguugauuuccaaaccauuauauagucaugggaaugcuuguauaccugaauugucauaaaauugaugagaugcgaagauacagcagaauauaucagauaauucugcagaacucuuauuauggaaaugaaaauaauucaauagagaagucucgauucauaaaagacuaguuuuacucuaaaguaucuaaaagacaugcauuaaaaagacauggcacuguccccgaaacgaucuugcuguguugcauuucaaaugguaccuucauuuugaaacuuugcacauuagcacguucuuuauaauagcaaaaagugggggagugaggaacauuuggugccggaagaaugauuagguaaagcacaccaagcugaaaaaaguauuuuugcagagcguuuucaagagcauggaagaguguuauaauguuaagugaacaacaaaaaaaaaaaaauacagauccaacuauguaaucauuacacauagaaauaaaaaugagcaauaaagccaggaugucagugaggauggaguggagggaauguccuaaaugugcguuggcccaucaucaccucaugcaugaagugaauggaaacauuugguuuauguuuucuggaaugucucauaagccauuguaaccaaaaacuacaccaugaacaaaaagcaaagcaggcccugcaggcccugggugggaagcugaggagguuggcaguuucucaaacucaugucagaugccccucggccacuagacagaaucugcugcuaucuggguucugguugaccagaggccuaaucuggaaucugguucuaaaaaccaauuuuuguuauagggcuugcuggauacaaaucugcaaugagacauugucacaagcaauagcuuaagaaaaacauaaaggaaaaaauaauaauaaguuuuuggaaauaagccuggaaaagcaguuuauugccaucugcuaacucauuugauucuugcaguaacccuaggguagguaugauggugaucucugcuucaaagaugagaaaaucgaggcugccucaggucacuugaccuccucacaggccaguggagacuggcuucagacucgggccuuuggaccucaaggcccuggucuucuuuuguuguuuguuuguuuuuguuuuuguuuguuuguuuuccugagauggaauuuugcucuuguugcccaggcuggaguccaauggcgcaaucucggcucacugcaaccuccgcuuccugggcucaaguaauucugccucagccucccgaguagcugggauugcaagcaugugccaccacacccgguuaauuguguauuuuuaguagagacggguuucuccauguuggucaggcuguucucaaacuccugaccucaggugaucagcccgccuuggccucccaacgugcugggauuacaggcgugagccaccacgaccggccaaggccuuggucuuccuaucgcauuuugacaccuugcucaguacgaugaguaguuaaaaucacugucauuggcuacaugccuacuuuuuauagucacucuacuuauugugguuuuggcuacauccuaguugaacucuagggcuaguguuuauuaaggucuugaucucauauggcauuuguagacaaucgaauguugagugauaagcccugguaacgugauuucucacugcuggcccgugaagccauggaaauguucccauggaaaucaccccauguguggaaugaauggucaguggaacauaggcaucuuucucuccuguccucuagguuuuaaaauaccugaauguccugaaaugcaagaguauccuaagagcacuuuagaaauaucuuugcgguuucuuucuggugugcuuuguggguugggugagguaccguauuccaggacacguggcccuuagagaaacaaauaauuuccuuuccuccugcuucaguguuauugguaaagugggaagguagccccaagacacucagcuccugcacugcauuuggauagaagggcguucaaauuccaccagggacaacuucgucuaacccccuagaauuccucauuuugacccuuggcauacucuauauuuguugaaauacaaaaaaaggaguugaaagugagucuaucuauauguaguagguauaucguguucacuguaaaauuccuuacuguauguuuaaaauuuuucagaauacaaugcugggggaaaccuauggaacagaaguagggaaaaaauucgacaacgcaaagugagagugggaaaccaugugaagcucuguuagaguaucaucacuaaucucuuuuuuccuuauaccuauauucaugaaagcaaauagagaacaauacaauauaguguaacaccguguacccaucacucagcauugcucaaucuuaguuaucauuaugguuauuauuauuauuauuauuugagacaggaccuuguucugucacccaaacuggagugcaauggggugauccuggcucacugcagcucaaccucucgggcucaagugauccucccaccucagccucccaaguagcugggacuacacgugcgugccaccacacccggcuaauuauuuuugguagagacaggguuuugccauguugcucagggaggucucaaacuccuggacucaagcaauccucccaccuuggccaauuuuaauauuuuauuauaguuguuuccauuuuuuguguuuuucauaaauuaaaucuuguaacuauuauauauuucacagaauauuauaaaguuaaagcucccuuugcaucuuucccucuccaauuccauucuuccucucucucuaaaaguaacugcuguccugaauuuaacgaugauuuuuaaagucaucuaggcucucguuuuucuuucuuuuuuuuguuuuuuuuuuuuuuuuuuuuguugcuguuguuguuuguuuguuuuaauugagaaggggucucacucugucacccaggcugaagugcaguggcgcucugugggcucacugcaaccucugccucccaggcugaagugauccuccaaccucagccuccuggguagcagggaccacaagcacgugccaccacaccuggcaauuuuuuuuuuuuuuuuuuguauuuuuggugaagacgaggucuugccauguugcucaggcuggucucaaacuccugagcucaagugauuugccugccuuguccucccaaagugcugggauuacaggcgugagccaccgugccaggccggcucuuguuuuucucuucccccuacaccccaaauaaacacagagcuuuauuccugccucagucaaauugcugcuucaaggccgcaguuuggacacuauguuuuuuagggugugguuuuuuuuuuuuuuuuuuuuagacagaguuucgcucuuguugcccaggcugcagugcaauggcacaaucuuggcucacugcaaccucuaccucccggguucaagugauucucgugccucagccuuccaaguagcugggauuacaggcaugugcuaccaugcccggcuaauuuugucuuuuuaauagagaugggauuucuccauguuagucaggcuggucucaaacuccugaccucagaugauccgcccaccucggccucccaaccugcugggaauauaggcauaagccaccaaacucaacuuauaauuuaugauuaaggcugcagugcaauggcgcgaucuuggcucccugcaaccucugccucccagguucaagugauucuccugccucagccuuccaaguagcuggaaauauaggcacacgccaccacgccuggcuaauuuuguauuuuuaauaaagauagcauuuaauuauguuguccaggcuagucccagacuccugaccucaggugauccacccaccucggccucccaaaguguugggauuauaggugugaaccccuacagcugacccagacaccauguuuuuauggcuggauuuugucuuugcucugguugcggucuuaggcacccuuauaaauagagcuuugaagagaacauuaccaauguauuuuuaaugaggucauguuauaaaauugucgcauaggacuucucaagaaaagacagccucuuccuugcaagauacuuucuuuugcaaagauugagaucauuccacaacaauagaccucuguucauugcuuccuucuuaugcaaaaguggccgucccucccaucagaaggacccccgcuggcacucugucagguagacagaagcauggauagaaggcugguggugagcuccaggugccuucccuauugucucuucucuccuauaaccucguauaaccuuccuggguuuuccugggugcauguuuuuuuguugucauugguguuuugacagcuggcuguccaggcaaggcugcuguguuugagcagagguuugcugaguugagcagggguguggcugcagggccuagccuggccucccaggagcccccgcuccccgugugcccaggucauacccaaacaggagcauuccuuaugcugguccuggacagcguuucuauuaaaggguucuuuguguuaggaauguucagcagagcgccaugagccgggugagaguggaaugagugguuuacccagggcaccucuggacccugggagucacagcuguggaauuuuacuggaguuuucacugcagugcagcccaggguaggacacagagggcuuccacucccuuggagcaugcuaaucuuuccaaaacacucauucgugggcccucauagaagcuccuagggcauuaccaagaaauagcaguccuugaucauauccagugaauucugaaacagugaaggaauuuagaucucauguguccauguugcugagggcguccugggcacagagccugcucgcaucaggccagauuguuuggaguauugccaacuggccuuuuuucuggagaagaaaguacugacgcuacgaagacuucaguguucuccugcaggggacugcaggggacugcaggggacugcaggggacugcaggggaagggaggauuggccugucacuugccaucucucauuucugcgaugcuacagagagggaaggggaggcauacauaugucagaaucuaaauuacagcauguggaaagaccugcccucggggucagagcacaccaggcuggggaggaccuaguuuaaagggauagaagagacauuacuuuagcuccuucucuucaggggcuccauaaugguuuuaaacuguucuuuaaaaucgaaguuuuucuaaucuacuuuugacuuauguauuaaccaagaaccucuuguaaaucuuaagacuauauaguugucaaagacaggcaacuugagguugagucuguugcuaacuaacuuacugacuucgcacaaaucacuuugucuuugggaaccucgcuccccuaucaguaaaacagagaugauugauugauucaaaagcauucacugagcacccacucagcugcgaggcacugccugcauacuugggauaugucagggagugagagaggcaaggaucccuguccacauggagacuucauuccagcagaggagacacacaggaaugagugaauggaauaagcaaauaggguauguacuguaggagcaaacaagggauagaaacaugggagaugggucaggaguguggacucgaguccacagcgcuaaacugucccauugagaaggugaaugaguuaaaagagaucaggaaguuggccaaguagaugcaggggaaaaguguucccuggagagggagcuggccagcugcaugcacaaggccugauggacggcugagccaguggggaagaggaggcagcagcacagucgggaugaacuggcaggugggcuucugcuccagaagagaugcgggagcccugcagguuugagugaagagugcaugguccaacacggucuucagagcaucguuccagcugcugcagguuugagugaagagugcacuguccaacaaggucuucagagcaucauuccaucugcugcagguuugagugaagagugcacuguccaacaaggucuucagagcaucauuccggcugcugcacagggaagagcaucaggggcaagaguugaugcagacaguaauagaugguaauagagucagauacaauugggcaggcaacggcccuuuacagaugacgaagcaucagaaaaguuagggugcaaccauuuguuuucaguuuacaaaaagggaagacgauuaauccccaaaaaggagccugugagcgucagaugaagaauuuaagaaaugaauaauaugggucacaugagacagucucuuucuuuuuauucauuuauuuauuuuuacaaaaaaguauguuucuguguccuucagcacaguuugcaggagcauuuagagcacacccguggaguggcccuuuuaugcuugccaagcaugcugaacaccguaagccacgugugacacaucuuccauggacaugaaagauauguugaucauuuuauugggcuccagucucagcucugccacgaacuggcacugugccuuggaccaagucacuucaucccuuuggguuugcguuugcuccccuggaagguaggggaggggugcagugagcucuggcguucuucuuagacucugcugcagcugcaugagugggucuauggcacagcccccugccugcaucauggcagguuauacacaguaaagagaugaaaggaauuuuucugcuaagggaaguagccccaucugucaggauaguuggcuccauugugucuaacguagguaucuuauaagccuguacacauggcagccaaggggaccuggccgccagagccguaggagaugacccagcacaaugggcugggcaguaaggaagccagacucuggagccagcguggaggugcaggagcucgugaguaugagggcaugaugaggggugcacagaggaaccccugggcuaacaggggcccaggagacaguauuacggcauugggcuuuguauugccggagaccagcacagaucccacaaugcaacgaugccaaaaaacgguagaacugaaaaccccagccagaucaacgcgagaauaaaucucuuuucugcugaaauugauagccuccuaaaaugcuaagacacaugcagcggagaauaaucauuauugaccaugaaauagcuaagaaccagcugagaaaauacagaaggacacacaguaagaaugaaugagaaaacucuuguauagaggauacggucagaguuagcaaccaguugcuucuucauguaaauuaaaucagcggagaaucuaaaaccaucccguagaccacauuuagaggguaggaaggaugcaauggggccaggugggcaggagaugggcuuagcauccaagcaggcuggacucacagcccucugccuggugugugaucucagcacuucuuguaccuuaucuaagccucaaugaagguaauaaaaucaccugccuauaagccugcagugagaauuagaggagcaaauggaugagccucaguccuguguggggucuggcugcucacaaggcaccauggacgccgucuuuaccaucaucacugucgacccggagccaauggugaaagcaggacacaggcaagccccagcguuucccaccauugucuuauuuuuucggcuucaggaagacauuagacuucuaggaagagauuccuuaaagccaggacuagaagguagacuccagauuuuggcuacaaguggcaaauaugucuuguaagaugaauuuuauguacuugugccaagugccauuggaaauaccgaagacugugcaaaaauaaaagacaacaaacagccccaggaacccggagcccucucccagcccagaacauucaccagcucggccaagaguucugcuggguuuucucugggggcuggugcugcuguggacacgacaacccggaacacggagggagggcucagcgcuaggaagggagagggaaugaagaggaguuucccucucuuugcuaauuucuucgucucugggaacauuuccuucaacagaguccugcuuuucucauccucacaccucacugcgccccuccugaacccacuccuuucugaauauggucuacuguccuuccgugacccacaucaccuugguccucucccucauaagcacauccuaggugggccugcccuucacuuacccaucuccuuagaagaaacgugagcucuccaaagggaagggcagaacccugcuuguuggucuuucugcccccagcacuugaccuagagccuugcacugaggacgugccacucaugucugcugaauaaacagccacauuuccagaugacgauguccuuuuccagccaacaucagcucagcgggccuucacguauuuaguuauacuugugccuccgcucaacagggugaggaugcuccuggacacagaaauuagcucugaggcaggaaggaggaaaggggaugcuucugggaggcaaaggcggucaaucagagugagcaccagagacuccguguaccugggaaauacguggguucccacaccagccuuggggagccaggguggggaagagggucuguagagcaaguuuaggaugcagcacaugccaagcuuuucagagucucacagucaggaacagaacucaugcagggaggggagggauuggaaaguaggaggcaaagcagaagccccgaacccaaagacagagccggcgaccggccagagugcagcucugagccucagacaugaggggagaagaaggggaugggguggggggcggucgugaggaaugucguuguccaggcuccacccggcccaccagcuccgcagaggaaggagugggcugggagaggcacacaccagaacagcucuccucggggcaaagcaggcuuucuucccgaacacccaaggcuuuccaaaagguaaacaccauuucccccaagcgaccccaauguuugcugaagcaaaaccucucgugugagccggcgggcggcuucacgacaggcgugagaaggccauggcccugugugggugaggaagcgcagugcggcuccccccugcguggugggacuaagaagagcccccugccacccgaaaggcgcccuaacacuucagagagcggauggcugccgaggguggccaggcuggagcugcggcuucccgcccgaugcauugcagaauguaacuuuccaaaaugcauugcucucaucucagcucagcgugaaaacacaugugugcacacacgcacaugcagccccgcugagcuggguggugaaaagacccuaauuaguucugauuccuuaaggcauguauuuuaaaaagcgugaaaccuauugagaugcuacuuccuagcgcgaauacggggcucuuaaaaguccugauaaaagugaaaauccgaggcgcgccugggaagugggaauguucccuccaacucaggcuuccacggucaugaguaggaaguccucuuccuaaucucaguaucuuaaaaagaagccuugauguuguuacgugauuaccuaaaaggaaugccuuccuccgcggaccggaaggauauuuuuaaaggaaugugaagcuugugacaggaauuaucgauaccuuuggaauuuuuuuuuccaagugacucaggcuuacuugaagccauuaccucggaguuagucagggacugcaugacgccaggccccaacuguuuaaagcagagcgcggcuuagugaaagaaugaaaaaaccgaggauguucuuuguccauuauucucaccgugaugaaugaugcuuguuuuccucuccacuuuaauuagaauguuucuacauuugccaaagaaaauguuggaauggagacaaaaaccugaaauuauaggaacagggcuugauguaauagcuuauuuguaaaggaaacacaacuuguuuggcauuuuauugaaacaggaaguucagaagcuuaguacacacaaguacaacaaauucucaggugcuuguugagucaucuguuguuggaaauagucuccugguaguuuuccccuugauuuacuuuuuaucuucauuuuguuuuuuugaaaguagugaggguaggaaguuacagagagauucaauuagagauuauguguauuuuuaaaaaucagcuaucaagauuaaauaaagcaagcgggaauucucuccuugcucccauauaccaauuuuuguaauuauguacaagaugagggaaaccaaagaaaaacaauaacuugcuucaaugcaauuacuaauucaaaaguaaccauuacucuggggaauuguauuagagauuaacaaagaggaaaaguacugugguuuucuuucucuauguucuauuugcuaggaagcggucaauaaaguaaccuuuuccccacaggagcugguuaauaguucgcuucaugcuaaauaaaaguuacagaaauaucuggagcugaguugcuggagacacagaaaucuucagguuggaauuucuuguccuuuuccaaaggauuaggccaggacauugcugucaaaucugcaaaaccuacucauccuggcaagagugcgguauuuuuaagacucacuagugugcuacuucuaauagugcuuagucagggacccccaggggagugcaagggagagaggguccccagcagggaugccagaccuucucuagcuggccgugggugcuggccuggccaccuguagcccucagcgcacagguggagguguaacugguauuccugugggagugacaguguccaucuuugacauuuaagagccugcuccuucagauacauuuaccauugccaccacuggggauuggggcggcacuggccacccuuggcggcacaucuccagcuuacagcagagucugagugucucuagcauaccucugacugaggcacguuaggcuugugacaucacaucuuccuagguggggcagggacuuuacaauacaugugacaagagaaaaaccuuacagcuuuguauugaaagauuucuuaaguuuuuaguuuauugacuaaauaacacugaacaaaacgauucuacuaugaaacgaaaggauuggaccucugugaggguuguggcaauguuucaauagcugagcaacgcaggaggcacacaggccaucguugggggcagguuggaggccuucaguuccuuuacagcuaugggcucccaucaagggugagugcauugaggagacauugccuagaacuacuggacagacaucucacccaggagacgggagcaugguacuuaacacacuuccaugcaccguucagaaucgcuaaacacagcagugcagaggcagaugacaagggccauuacggggucaccaagggaggaaauagggacuggagcccccaggaaggagagcugaggcucccugugggcugggggcuggcuuuguggcccugcagccagcaccuggagaugagagaccugucccuaggccucccugcagccaccaccuggagacagaguccauagaccucccagcugugcccaccugggcagcugcacuuuccagaggauuauuccugcagcuuccacccucacagcucucagcugucuuugcaggugcaucucuggaaaacaguucucaucagggcacccugugcuucccaguuucuagucauuucccuucucugaagguucuaguucagacucuugagcaaagccuucaagaccucuccuuaaacugcccuccuccucuuccguccagccaccugguugccuccuggcucuuccugcccuaauaccggcugcccguacgggacugcucaccuccugcagggagccggacgucuguggcgaucucccucccgccaugacacccccuaccuguccuccaucauaugggacacacacacacacacacacacaccccuacgcacacccacaccccacaugcacaucauacaugcccaccagaaauacacacaccauacacaccacccacccacaugcacaccauacauacacauacacacaacacagacauuaaauacacaugccacuacacacagugcauaccacacacaacacacaccacacacacacacccaaucacauaccacauauacccacaccacacacacacacacacccaaucacguaccacauauacccacaccacacacacacaagccuuuccuaauuaucuaaaggagaagcuuuucuggaaagcauuccccagagcuucuagagaaauuagugucacccucuuuuaugguuucauaguaauguuuuuauaucaccaguauaaauacuaucauauaaaaaggguaaucaguguaccauaguaauuaauucuuuaaguaugucucuucugcuagaugaugagcuuccugaaugcaggcucugaagaauuuuuucauagcuuuaaauccacugcauggaauagagaaggcucuccauaaacuuccugaguuuaaauggaaucggauuggaaggcaguagcaaggcacaaagugcagugagagccaagcucaggaaaaccaguguccuugagcagaaagacuuaggaagggugcucgcuagcgaggagggaggcaacaaggggccagcccguggggagccuuaagcaccaagagcagggcggugcacacuuugucuggcacgggcuggagcaggagagggaccguccuugcauucugugcggauuucuauggcaaugacauggagggaaaugaagguaggaucaagagucccacugggaaguggccuggcaaccagagguguccgcaggacaccugagccucagcagugucugugaggauaggagggaaagccagaccccagccucucuggggagaaucuggaugcaugcgggaggaauggauggaagggaggguguggggcugaguggcggcggcugggcugugcucucccacucagagagccuuccccaaagcggggaaggcugcuugccuuuugguucauuuccuuucuuuaauacacagcaaauuccuggucacccuuuguuguuggcugguuggguuuguugcuuuccuuguuguuuacaagcuccagguauuugugacagaucuuaucaucuccuucccucuuagucaccucuuggcccaacucugcauauuuuacucuuuuuaacucugcuccuguucugaccuccccacucucggaagcauauuugcuugguguuuucagauuuuauuucauuuuggcuauuuaaagagaugcaauaaacuaaauauggccuggcaagucuggucuuaaaauagaaaauauauauauauguauauuugugugugcaugugugucuguguacauaggcgcaugugugugcccuugagugugcauccguguguguguguguggccgguguacuauaaacccagggcaucagucuccugacgucauugcuugcacuuuuugccauucucccccaaacacuaguuuucagccuguauuuucucaguuuccccaaaaaugauuuuuuaagaaaagucaaaucagaaagugaucagccucuaccgccggacucugcuuuaguauccauccaugucucugaggucuuggggcucauaggaaugugcuuauuuucauagucccauuaacaugaauaguuucagaagggccagcucaguuuugucuucaguuuucucacuggugauugugcagggguggaauggcaauggaaugcauaggggcaugagugaacuuuucgggaugacggaaguacucuauauuuugauugagguguuauuacuucaaugugucaaaaucaucaaaauuuuuacauuucaucauucuuaaauuauaccucaguaaaguugauuuuaaaaguuaaacacauacccuuugcucgaaaaugauccuguagagcguuuaugccuuuauaugaauuuagcuaaugcauucucuccccagggccauuugcauuuuaggauauaacugauaauguggaagguacuagcaaggaaguaugggaugggaaucuggggauggaaguaccuuccugcuuucaguaaguuacauaggcacuccuuauucauaaggcugagcuugguuucagauaaauaaucagaaaguagguugugcaagguuuuaagaagaggauccaaacugggacuuaguaacaaacucugaaacugccacuugcauucucugaacuucacaucaagucaauacucuguaugcuacaauuccaucuuacauuaaaaagcaggucuacuaagggacccgauucccaagaaauaaaugugcuuuuuacaaugcuugauuugcaagucaguuucaaaaauaauuuggugaagauaucagaguuauuuuuacaagauuaaaaaucaguauucaacaaauuauuuuauucacuuugacuuuuuuuuuuuuuaaccugucugugacauaugucuccuuugauccgcacacacacccuggccaguaggaaacaggcacacucugcugguggccucuggauggggacuggagccugaucuuggaccuucccugucucaucuagcucagcccccaugcugucauaggccgcagccaaguggccuuccagguuugcacuggaaggagccacagccccuccauggagccaucccagacacagcuucuccacggagcccuguucucagcccuggaggccggcaaugugcuucacccacugccugccacauuccagccaacagaagaacuuuugaccgagaaguagaaacuaggugauucagaucagaucucuguuguagacuccacuacccuaaugaugaauuuuuaaaauuaaacauucccuaacaaaccuccaagacucuuugcuugggucggucaaaauacaguggaaugugagagcacaugucagaauucuccagccuacguuugcuguuguuguuguuuugagacggagucucacucuaucgcccaggcuggagugcaguggcgcaaacucggcucacugcaaucucugccuuucaggcucgagugauucuccugccucagccuccuaaguagcuaggacuauacgugcgugccaccacgccuggcuaguuuuuguauuuguaguagagacaggguuucaccauguuggccagacuggucucgaauuccugaccucaggggaucugccugccucggccucccaaagugcugggauuacaggugugagacaccacauccagcccagccuacuuuuauacuaugaacaaaacuucuuagaauuaccaacuuaaguacaauagaagcuuuugaaauuagcuggggggaaauugagucucuaaguaaggaggaguaagagcaagaagaucagaaggaaccacagaaucaaacacuuucaaaaggaaagaaaauuaggaaauuguucggugccaucccuucauuucagaggggaagaacuaaggacuagagaagucaggucaccccgacaggacccuaugucccuccuugucgccugaccucucccugugagucucagugguccuggucccacagcaggugcuuggggacccagaaagaggccaggucuccugacacccagccccgcucuuguugggucccugaaucuggaaugguuacucauguugggggaauuuuauauucuuuuuuccaaaaguugauauccagcuagaaucuguccuuccugagagcuugucacugcccuuucucuccucccugccuguacuccuguucgcuugggacucacacuccuugcaaaaaagcuuguuucacccaggggugaguuuuguaacuagagcagggaguccuugccuuucauuccaaugcauuccccaaaagcagaaaaguguuaugcgaugggaguuugcauuuuggaccaaagacuccgcagcaaauaaaucauggaaacgaacaauauguccuuaaaccaagauguaacuguaaaccucuacugucuuaugaaauaacaauacugugcuuugaguagccagaccacauaguagcuggacucuagacucuaagcagggaugaagucaguggcugcugaucugggccuuccccagaaggaugccaagagaucaaguuuuguuuuuaaguucugugaaucacagacauuauuuuuguaaucuuuuuuuuuaugacacagagucucacucugucacccaggcuggagugcaguggcacgaucucagcucacugcaaccuccaccucccagguucaagcaauucucgugccucagacucccaaguagcugggauuacagguguuugccaccaugcccaacuaauuuuuguauuuuuaguaaagauggguuucuccauguuggccaggcuggucucgaaugccugaccucaagugaucuaccccccuuggccccccagaaugcugggauuacaggcaugagccaccaugccuggcuuuguaaaaaauuuuuaaagccaauuugcuuguuuaaaaaacugaauccacacugguaaguuuuguuuuaauaaaaaaauugugaguaaguuguaaagcuuuugauaaguucaguggcuccuguaggcagacaauaaauugcuaagucccaaaguguugcaagauucuggagaguacuuuguucauacuuugaagaauaugccugauuauaaggcaacacaaauuacugaagccuugaaaugaugagguuguuuccauuuacucgcacauaaaauaauauaucuaaaacaucuagcaacucucaaaagaagagaguaaaaagcuuuugagaaaucaaauacaauucauuccaauucaacuugaaaauucccaacaguccguguugcauuuuauacaucuugaaccaaaccauggcuuugaguaaaggcuucauuuaaaaaccuaaccuauauaugguggguguucauguucuauuaaagcaaggucccuguccuaguuggagggaacuucccuagguccggcagcauaaaccagugccugucgaccagggagugucaggaggaugugcugcuuccugcccccucccacacagggagcaaggcugugcugaauggagauauucuaguaaggaggagaguguaugugagaagguguaugugagaagguguggcauccacaacaaaacuaauaaagcaucagcaaccuuaggugaugcgguuuggcuauguccccacccaaaucucaucuugaguucccacauguugugggagguaauugaaucacagggacaggucuuucucaugcuguucucgugauagugaauaagugucauaagagcugaugguuucauaagggggaguuucccugcacaagcucucuucucuuguuugccaccaugugagaugugccuuucaccuuccacuaugagugugaggccuccccagccacauggaacuguaaguccauuaaaccucuuucuuuuguaaauugcccagucuuggguaugucuuuaucagcaguaugaaaacagacuaaugcauuuggaaaccaagaggcugaugguguucaggacacacuguccccauuuauagcaccuuggcauuucagaaaaucgcaaaagcaggaaggccccucucacuuuccccuccuugcccuucuccccuggggcagguuauaagauccucauuugggagagucuuucccaauacuuggaggaaaggaacauccuugucucugaagacacagagcacagagaagaaucagaacaaacaggccuuucucagugaccccaguuuaucaccauuagcucacucccaguuugucuaaucaccuccuccaccacuauccacucuucaucaaaccuaaguacaaaauacccaaguuugccuguuucugugggucuuccuuuccuugugauaacuccugagucacaugaaacacauacuaaauaugugugccuguuuuccucuuguuacucuuuaguuacagggaagggccccagccaugaaccuagcaaugggugaggaaagaaaucuuuccuucccuacugauaugguuuggcugugucccuacucaaaucucaucuugaauuguagcucccucaauucccauguguuaugggagggaaccagugggagauaaucgaaucaugggggcaguuuccccccauacaguucucaugguagugaauaagucucaugagaucugauggugaauaaggggaaaugccuuucacuugcuucccauuuuucucucuugucugcugccauguaagacaugcuguccaccuucugccgugauugugaggccuccccaggcagguggaacugugagaccauuaaacuucuuucucuuuauaaaguauccagucuuggguaugucuauaucagcagcaugaaaacggacuaauacaccuaccaggcccggauuuguuuggcaauaaagugauccauucacgcccaagaaguggguggagcugggaaaggccagaccaaccauuuggaauaguguuuuuugauccacccccaggaggugaggauuggcaggggcugaggggagugcucaccuccagcaaggugagcuggagcccacagcaggacuccagccucagcagaggaacuggagagcaaaccaggaaaggcagacagagcugacucacgugcgagggugggagaggucgcacggccugcccggacccugaugagcugagcacagugaaaacaaugccaggccucaccugcccgugcuuaccggcugguggcaggggggcugagcagguguugagguguucacaggugaguaggagaggaaaggcagacgucggccuaaaggcaaucgcaaggagaaaugcguugagaauuguagcacuguauccaucaaaaaggaagcucaucuuucacugggugucuuucuaauuguuagacuugacacugcauuugcugcccugauuucuuguccuaaccuucaagcuuguuagaacagggacucagggacucuguuuucuucuccugugcucagugcagggcagcaggacucacuugcuaagugcucacugacagauguaagauuauuguuagagauauggacccgcuugcucuucugagccuccgugauucucauucgguccuuugcugucauuagaaucgucuggggagaauuuugucacuccugcuacucuggccaaaccucguauacuucaaucagaaugcucggaguuggggcugcagcaacuggaauuguuucaaacuccccgggugacugcccuagcagucaaguuugagaaccacgggcaugguaaaaucuuuucucagccugagcagcccauuagcuucaccuagggagcuuuaacaaucacuaaugccuaggccucaccacccuccaucccguguucugacuuaauuagcgugggguggggccccuaaaacaacauucuaacagcuucccaggcgaugagaaugcacagcuaggaugagcuucuccucugaagcaugaagacccacagaauacugcagaguugcuggggguggcccugcccaaauucucgccuaaaaccccaacuuucaaugacauuguggaccugcuuucguguuauuauaagguuuacaaauuucuaugccaccuaucagaccauuuuuuaaggaugaaaucaaaguuucuauaaguuguguaguucuuucccugugcauuuuaucguaauauugaaaaacgacagugaaaagcaaccaaggcaucucggcagcaugcugcugacuaguucacgcaguuaccaccaaagcgcauggacgggacccagagcaugagcgugugcccacuaucggggacagaaaccuaccgcguucgaguuuugacauauuucucgcaguuguugaaaacuaugaggcaugaaauccagauuuaugacuuuuuaaaaaguuauuuguggauucccaagacgauuauguucccaucacuuauguagccuuaaaagaaaaaaaccucaaaugaugcuuuaaaaaaauccaaguuuggcgcucauugaguuccagugucaguugucugaaucgccuucagcgaaagucagggggaaaaaauacauuccgccuuccuuuaacugcuaguucgucauggagaacagaaagucccauuugcauguggcuuuuggaaaagcuaagccgggagcgauuauccugaugcgcuuuuacuuuuugcauaaaauaagaauuugaggaggaugucccgggagagugagccacuucucauuucccaggccucgccugccaugcucuuugacaacaucauagauuuuauuuuugccgggaaucucauuaucaaagcaaugccccccgccccccccccacacacagacugccagguaaaccacagagggugaggggggugcaggucaugguugccuuauuacacacccuccucugccaucaccuccuuuuuugucuggauaaguucuuuggcaguucucucaacuuuuauuucugaaacauccugaaacaucucaguauuaaaagcaaggccgauuauauaaacgauacucccaggccugacaacacaugguuuugccugaggccuuuacugccaagagccguaaggacccucuaagucauguucgcuauuuuuacuggccuugagagucuccuugcuuugacauccucuugucuccauugucagacuguuaaaugcucaugcuucugguucucuuaaauagaugcagauguguggggcuggguugccacugagcccucuucucuuuugcaagagcugggaugcagacagaaggcgguuuggaaaacacgagccaccuugauuuuagacaaacucuaaguuacaaucaggugucuucauuuaugacauuuaacuuuuacuuaaccuaaucaagccauguuguuggcuacugauuagaauauccuuuuauaacuuaccuuaaaucucacuacuuguuccaaccaucccaaagucuggcgucaacugucauugcaugcugcucuuuucagccuuucuaguucgacucuuagcaaaagccauaaucuuccuccagucuguuuccuuucugcagugacaaaauugcccagggaaaggaaaaagaacagcaucuaucuucuuucuuuuuagcucccugguuuaaggcuuucuuuucccccaugaugaaaaacuauaaucauucugcuuagaaaguacagaccccuaagcccacuuccaaaagaaggaugcauuuucaagucuguuaucuuuacuuucccagagccugggggucucccaggccagaaguugacagaacugucuucauacacucgagacaacuucaugcccauuuccuuaaaacuaagaacauaagacgcugauuuuucuuccagaaaaaaaaaaaccuuucuuguucuuucaagaacuguuucacggacaguguuucauauuacaaaauugaaacuugggacuuuugaacugcaaauuuagcagaaaaugaauccaugcgcuuguggcuuugcuugucaccucuacucagaugucucccagaccccucuccagcugcaagcugcaggcagaacuguuccucuaaaagaaaacaaacuccuguuuuuccuacuacugcuacugcuucuacuguugcuacacacacacauacacacacacucucucacacacacacucacacacacacacacacacucagaaaacacuucugacaccaaauguauggguuuuuuucaugccaaacaauucugcaguucacugcagacaccagcugaguguccuacaauccaauuguggcaccgccugccuggaguuagcaggugaaggacucagccccgcaagccugccccccuacccaugccaauugcuugucccaaauccccguucuaacugaccagcgguaaaucagggguugccacaacccccuccugggauuuguaacuugcugcagcagcucacaaaacucagagaaacacuuaacauugaccaauucaucacaaacguuauuuugaaaggaugugaaugaacagccagagaagagaugcacagggcccggggccggggagcagggcauacggagcugccaugcccucucagggggcaucaccuccugcaccaggguguguucaaccccaaagcuccugaacccuuuaacgucaggauuuuuuuuuauuuuuuuuuaaagacauagucucacucugucucccaggcuggagugcaguggcgccaucucagcucccugcaagcuccgccucccggguucucgccauucuccugccucagccuccccaguagcugggacuacaggcguccgccaccacgcccggcuaauuuuuuguauuuuuagcggagacgggguuucaccguguuagccaggauggucucggucuccugaccucgugauccacccaccucggccucccaaagugcugggauuacaggcgugagccaccgcgcccggccugacgucgggauuuuuaaggagcuucauuacauaggcaggacugaugaaaucauuggccauugagugaaccccagaccuugcggggguggggcugaaaguuucaacccuccaaagauugggcacguuccucuggcacucggcccccagccuccaggagccaccucauuagcauacacgcagguaggguuggaaagggcuugugauaaaugaugaaggacguucuucugcaucgcucggggaauuccaaggguuuaggggcucacugccaggaacccggggcagaaaccaaauacauauuucucguuauagcacagugucacccccucacucugccuaauuuggugacuagcugccccaucacauucugccuauuuaagccaagccccccuuccccaaggccaaccuccucuccuccacagccagcccacuucccgggcgugauaacucuucugccccagcuggagaguuguucugaggcuuucauccuucuccacgugccgccuggcagugcugcugccugucuuuugagggcuaccccuuucuccauuaccucugcgaccuggcuaguccacauccuccccgacccgugcucuucagcaccggugccugccccgcucagugcauguccucaucccugcagccuccacccugggcuuccugacccccacugcguccggcaccgcugguugcgggccugcuccggcucucucugcccagcuggcuggccugccucuguuccgaccuccccugccuggccugguguucugggcgccuccuccgcucacaucgccgcuucaccugcuuuugcuaucugcacuuuccauguccugcuccuucucccagcugguggugccucugagaagaggacugagaaccgccugugaaccccgcaauuucgugggugugguggaagcaaaggcagagcgugugaguuuagugggcgugcgccacucuuucaagaaguuuuguuacaaaaagaugcaaaggaagugaagagggaagggguuugcagguugggagaaauaacagcauuuguguucuuuguuguugugacgguuuugagccaaaacaugacaaacgggacagaaggaagaccugauggagcguguccuugagaaggcgagaggcaugggguuggccugcugggggaucggccuuccauauggggguuccucuccagcagccugggguucugaggaaggcaggccugcagcaggugccgggugccgggaagcaggagacaucucuguuacuccacuguccucaguggggagccacggcugagcgugagaaagggcuuauaggcugaaggccaggcagacgggaauggccaggcagaggaggggaggacgagccggguagaaacaguggauagaaacacggagggccacacggccaacggucaggggacuggcacaccagccagauucacccgcggcgaugccggugcagagaagcucggcaucugaauuuaacccggguugugguuugacucagucugacguggagagaagggccagggagucacggggggguggugggcugugugcugguuuaggggcugggacauggaggggugaaggcgggagucagucgcauccgcugggcaggggccuggggcugcagacaaggugggagguggcagcuacggaggaagcugcaagggauucugcaguuccccggggagacaggagcccaagggaccggggggugaggggguuggaaggggcaccuguggauguccugagacuuccaggaagugggacaggaucagugauggagauagagacagagucaucagggccgagaggaaugacaguaacagcgagguugaagugggcacccccgucuagcagcacgggguguggagcuggcuuguggacggccagggaacaggacgcuuugagguggcagccaggggcagggaugcuuuugaucgccaagggagaagacuugaugcagaguuucaggagccuccaugacuuccccaucugaagaccuuuuuuacuuuaaugggauugaagugaucaccagaauaguuaauggugugcuccguuccuauuucucugguuuuucuaagguccacaggcugcagacaucguuuguacuucucccuggugccaaagaccaguuaaugccgacuuugaugggcucagugcaggccacauugucacguguaacucuacacugagaauuauuuuagaagguuagacuccuaaaaauguuuuguuuuuccaaaugguggccucugggucugacuucaccucuuuugcaaugaucagcacuaggauaugguuuuggagacgguugugcagagccagggcuuucaccaaagcuuggccgcucggacaggacucacgauggaagacggucaggugccccagguuucagaugccugccuccucccaugcguggugaggggccugccuccuuuauagcuuuccgcugccaggcuggcgccuccuccccucacccccaucuccuccagaggaagaccaacuuaaucaaaucuuaccacaacuacguacugccuccuggaaaaagccugauuucucgcccccucuugucccucccugcguggaggcaggcccuuuguccagugcccauguggcuugguggguggucuuucuaaguuaucagaggacauuagcaaacacacacguccguuggccuaacgcccaaucugcagccagccuuaugaauaaucaacgugacuugucucuguaguucaaugccuauaucugccucucaguuguuauugaagcugggggcaaaaaagauggauuauucauuggaaaccucaaaaccucgacagcugagcuuucuuacacaugccuguguggcccccgugguaucuuaguguucaccuccccauuugcacacaggaagccagucacauuacuggauuccuggugaguuugacuuuucauucugucuugaaucucccucccuuccccaaccccauaccccacccuacuccaucccuuuuucuugggucuuccugaucucaaccccuccaucuguccuccacguugucugcauagugagccuccuaacacacggauccccccauggccuugucugcucagguuucuaagguccccaguaaccacgcucacacugcguaagcacgaacggucugguccacaccucaucacuuggcgugcaugugaauguuuuagcaaguuagcucuugcaauuauugccugccgauccccugggcugcauucacacaugccgugagucuucagacacccaggucucaggaccugaggggcuccugugugcuuuccgugaggaacugucuuucugcucacgacuccaugucacaugccaccaucaggaaguccucccucaaugccccaagccuacucaggcucccacuuuccugcccaugaaauguguguaacuucuaggguguccugagaagcaaagaccaugucccugcauuuuugcauccucagaacuuagccugauacucacaaugaaaugaguucacuuaacgacacaacgaacgaaugugcagguacuucugcagggggugauguggggaugcgugcauugauucuguggcucagcccugaguugggggcaggaggcaggugcugggaggaggauuuuaugucuuaggaagcacaggaaggccuugccaggauccaagaaaaaauggaaaguagaccaauguaagcguuaaaagaacacauuuuaucuuuuaaauguguguacacaguacaguugacuuuuuuguauacaauucuaugaguuuaaacacacauauagauuagcguaaccacuaauuauaagauuguagggaacuggggaaaaaaugcaugcauuaaggaaugauacggcauauuugggggacagagaacaggcuugaugaggacagagucuauuuaaaagagacagugggcaccgcaauuggaggggaaggcggggcaggguuuuagagaaccccugagugcugggcuacaggauucaguaaaguuauugaugagauuggcugcauuguggauucugaaauauuuauuuaauaccucgaggagggugugaguagauugugcugaugaucgcauaacucugacuauacuaagaaccacugaguugcacccagagcuugcauuacugagcgcuuuaccaguuaggaagguuucgcguauuccguacuuuaaaucuaaggugacuugacuguaaggccugcgaguauuuccuggaccacucagaggaagaaugcugugaaugagaacuacagcccuguaagacacguccuguaucauuguugagaugggaaagugcaucuuaagacaguuagcaggccaaggagcgacuuuaaagggugagcucugccuagagggaaaagcgaaugcacuaauugaaauccaacacccugggcuggaguaaaugaaccgucagccacccauggggcuucauuucuuggugauggauaaauagcugggauuccuugaagcuagaagccauggggaaauucuguucugcuuagcuuugucaacaguacagucugccuuaacugacuuggagguaaauagauucggagagugugagcuaaaacccauuaaaucaggugaagacacaaaggcaagcacagccaaugugguuuaaggcaaagcuaaugucccuucggccuuaacugacggacuuuccuagcaguccucacccucugcaacccagggcuccuaggaggagcucauggcagagaaagccuucuggcuucugccacugccuccucaacuacauguauacaucaguguauaugcauggguaugaaaugaacauuuuaugucaccauuagcagaggaaagcuggaacucuuucaaaccccacccaaaauucacucugacuacugagcaguccuguuguuuauuuuggaggccacuuaacccuggagcaguccauaagcuccacuuaauccccucuucuuucaugauuucuuuuaaagagacaucuuggguucuguaggggaacauuugugcuucacuguaaaacuccauuugaggccugcucacggccugccaccuuaucugcuugcagccuucauugcuugggagcuguuuuacagcuucauaaguuguaaauagcugcuggcaaugcaaacgcgcuugucugugggcaggaaaugaauucugucugguagagggaaugcuuccuaccuuguaggaaagccaauauuuuuuguccauuagcaaguuuauaucaguauuccuaaucauuaaauguguucuucggauuguccuuugaaccaguuauagcauuugaguuaaguaaaaugaauacacuguuguuuauuuuauaccuguaugaaaguuauggguuuuuuggugggggggggguguuuuuuuuguuuuuuuuuuuguuuuuuuugagguggaaucucguucugucgcccaggcuggaguacaguggcgcaaucucggcucacugcaagcuccuccucccagguucacaccauucuucugccucagcuucccaaaaguuaugauuuuuaaaaaauuaucuuuuaacauuuuuuagcuagaaacuucugggucaauauauaaauagaugagccugguuauaucugagguuuucacugagguaacaacaaaaauaaaacaacacgaugccaccgagccaucguuccccaacuuacgucuguccccuccacauguccugcacgcacuccuguuucuggggugugugcauguguguguguguguaaagguuugcaaugaaauuagaaucauugguuuuuguuggggguggggaguuguauuguuuugagacagggucucgcucugucacccacgcuggagugaagggucacaaucacaguucacugcagccucaacuuccugggcucaagugauccucccaccucagccucccaaguagcggaaacuauaggcaugugacaccaugccgggcuugcuuaucuaugucugucugucugucugucuaucauccaucuaucuaucuaucuaucuaaucuaucuaucuaucuaucuaucuaucuaucuaucuaucuaucuuucuaucuaucuagauggggucugccuauguugcccaggcuggucucaaacuccugggcuuaagcaauccaacuaccucagccucccaaagugcugggauuacagguguuagccacuuugcccagcugaaguuagaguuuagagcacauugcuguaaauugcgauuaccaaggguauugaaaaauccaugaaaauaauaaacagcaaguugacuucagaauuugugcguuugaggcuuuucgccuugaucuccagguaacacacaggcuccuuggcgagagccaguggugauacaaugagaacaccgccugcugcaucuaauauuugcagcuuagaauucacagcuaacuuuuuaaaauguaccagugugggggaaauggugcuuuauuugcuggauaggaaaauuggccaagaucagaauucugaaggcagugucacagcacaaagaaacuagcuacugaagucacauccuaaacauucgagagguugauuuccuuuucuacugcauuacaaaaagguuuauuuacugcuuauccauauagugagauagagauuagaucucaguuuuugguuaagaacaagcauuaucauaaauguguguguguguugugugugcauuuuacaggauuuuuaaaaauacacagagaauuuuucacaguuguuaacucugguaaaugguggggaaggcaggggugagaacugaucuauuauucauaaucucaaugaugaacaagcuauuuccaaaaauagguggauuauuuaaaauuauuauuauuaggauauuuugggcuucuagaaacaaaaacuuaacaaaaaagucacuuaaagaauuuaggggucuuuuuuucugacaugaaaagaacaaaauaaaggaugauuucaguuugguccgucagugacuuagaaguguuuuucaggacccaaggcuuuccgccuucccacugggccauuuucagcgugucccguggccucugggggcuucagugauccaggcgucacauuagacaugacaguguccagcaaagagaaguauuucugcuuugcaucuguuuauaacagugagaaaaacucccccagaaucccaccagcaauugauucucacguugcauuggccaggauugaggccagcugugccaugcuuagcgcagucauuuguauugcgaucaccgugauuagcucagacccauccugggacuucuccuugggcuugaagacauggccagguggagaucggugccccccagaagaagucuuuguucugccaauaaagaagacacagacaacagugucuaacaggaaaagccccuuuuuacuuuauacccuuccguauugcuucaacaaucaaauacuuuauuuuauuguuugagacagaguccugcugugucgcccaggcuggagcgcaguggcgccaucucugcucacugccaccuccaccucccagauucaagcgauucuccugccucagccucccgaguagcugggauuacaggcgccuaccaaaaugcucggcuaguuuuuguauuuuuaguagagaugggguuucuccauguuggucagaccggucucgaacuccugaccucaagugauccacucaccucagccuccccaagugcugggauuacaggcgugagccacugcgcccagccuuuuuuuucuuuagauagaguguugcucuuauugcccaggcuggagugcaguggcacaaucucagcucacugcaagcuccaccucccggguucacaccauucuccugccucagccucccgaguagcugggacuacaggugcccaccaccacgccuggcuaaucuuuuguauuuuuaguagagacaggguuucaccauguuagccaggaugaucuugaucuccugaccuugugaccugcccgccucagccucgcaaagugcugggauuacaggugugagccaccgugcccggccagauacuuucauaauuaacuuuuugaauguauguguguccuacuuuaaaaugaaagauacucuuucuugauucuauuuccaugcagcuuggccccgugaugcuagggaccauggcuuuuucuugcagugugacucaccauuugccaaagcaaaucucuugccuugcaucagcucagucucuuugucugcaaauuaaaucaguagcccuuuccacugccuaucucgcaggauauagugccaaaaauacucacaaagucaccauccaggaagaaucauuugccccugcugccacugucuccugcaaggcacaugaaagcugcugaggcucgguauuuauuaugcuauaaaauucaacacaaggggagagaacaagcaaauuccaugagcauauauaaguguaucggaucuacuccauugaugcuggagcuauauuuucacaguaggauccucuuuuguuaaauauuacaguaguaggaaaaccuagcagaagaauaguucacuguuucucugauuuugugagugaugugggcuguggaauuuacucuuugcugcucuucccccaaccugcacccuaccccugccuccgaggucagccuugccugcugccccugacugagaggaccccgacgucaccccaccccagguuauacuccucugagaaggucccuucaucccuuccccgaaauacauccccucaaaucucuaauuugugugaaccauuaauuucagauauuguaggaaaaauaagcagggaaaauacgcaaaacaaaacguggauggcacauaacccauagcaucucgcaggguguguacacugaagaagucuuuaccaacccguaguuaggaaaaugcguguucagaauaacugggccuucccgcgguccucugagucaaacagaugaccacacauugccagaaugagaagcagagcagcuucacaucccugcuucugaaauguuucccaacagcucauugaaacaaucucgagacaccucucucccccaaacccagcguguuucgggaauggcucuaggaauucuacuuuugcauugccucacucucccuuuccccguccagaccaugguauuggauuuacagcauuucuuacauccuauaaaaguccuuuucugccaacagccuggagcgcgcuggauugaaugacgcucucccagcacagccggcauuugcagugcauuagaaucuugccgucacuugcacacgucaccaaguuacuuuagugagaguucagccuagcuauggcucugcugugcuaacaguugcuuuucaauauuuuguuugaggcuuuggaauaauucaaaggccuacacuuuuuuuuuucuaauuuguuuccuuggaguuuuacgcauggcuacuucagaaaacgucaguuuuaugucauuaaugucaucaucuucucuggauucucagaauucaaaauucacaggagcauggcagccuuacauucagucuauucuuuucauaaaaaaggaaguaaacugcaacaguucgccuacgcuauggagacuggaguggucccaccucuguaauucuaucucugucugccccacagcugugccgaagcgagugccacuugucugcagggccguaccgcggaacccucuuugccgaccagccagcgauguuugucucgccugccagcagccccccaguggccaagcucugugaacuaguccaccugugcggaggccgggucagccaagucccccgccaggccagcaucgucaucgggcccuacagcggaaagaagaaagccacagucaaguaucugucugagaaaugggucuuagguaagaauccaggcacacagacgcuguggugugguccagaucuguggacagguuuccagggagggcggcgucaggcucacacccccuuccacgcagcuggggcaccuggguugaugucucagccuccagcaucugcccuggcagcgucguguggucacccucggcauucccgcuccuugcuguuagcagacguacaguucacgaggaaaugggaacucuaacuggacuuccccacuugacuucccuggcucgugugaaaaauccaggcuacccaaagccaccccgggccaccccugugggcacagacucuccgggcaccccucuuagacccucccuccccagugccuccuuguccugcuucaggagucccuggcagcgcccggcacuggggcccaagcccccgucccugucaucuccucucccagguacaucucaugaucacuccgucugcucaugugcucaaaggguguuaaaagacgucaaacgacuccaucuuuuauuugacaaagugagcacagugugaccguaaugucccacucuggcguucauggagcugcgccaggcgccgugugcgauucuggggaggaagaggugguaggagcugagcugagaucggaggaggcuggaaccccacgccgugcuaacacacgggcuccaggagacuugcaggugauccccggagaagaggguuaaggaagagugugaagcaaggacggccuggggaaugcggaggaagcaggggcagcgucugugcuagaaauuaccugcccugugguggagucauauguggcgggacaagccuagggcuccacuguggggaaaucccacacccuccuccaugggguugugauaaacauguuaguuugcuugggcugccaucgcaaaauacuacaggcuggguggcuucaaacaacacgcauugucucucaguucuggaggcuggaagucuaagaugggguaucggcagcguugguuuccccugaggccucucuccugggcuugcagacagcugccuucuuccugugaccucacguggccuuuccuccaugcacacacaucccugguaucucuguguguguccaaauguucucuucucuaaggauaccagucagauuggauuagggcucacccaauggcauacuuuuauuugcuuuuauuuauuuuuuugaaacagugucucgcucugucacccaggauggagugcaguagcaugaucacagcuuacugcagccucagccucucuggcugaagugauucuccugccucagccucccaaguagcuggaacuacaggugcacaccacgaugcccagcuuuacuuucuuuuuuuuuuuuuuuuuuuuguagagauggggucucccuauguugcccaggauagucucaaacuccggggcucaagcgauccuccugcuuuggcuucccaaagugcugggauuacaggugugagccacugcacccagccccaguggcaucauuuuaacuugucuuuuucaaggccccaucuccaaauacagucucauccugaguuacugaggguuaagacaucgacauacgaauuuugggcagacacaauucagcccauaacaaugaaucacucuaguuucagccccuggggccaagauccuuacccgacuuuagagguacauccccucucucucucucaaucucucucucucucuccuguucucucauucuuuuucucucucuuugcuuccaucuccuuccauguuuccuauucagucuccuuucuuaguacuuuugcaugucucuaaauccuaaacuucuggcuuuucucaucaucugcucaacauuaucccuuaauagacaaguagauacuguguuuguucaaguuacauucguaucuaacuacggacauuuuacaaguaucuuuuacaugacugauggucauccuuucauauauuuuagaaguguggcaaucaaaaguaauuuuuuacucuggugcagaguaauucaucuuuugccuggaaaccaacuuccaaaaaaaaaaaaaaaaaaaaaaaaaaaaaacuauugauuuuagucacaguccaaaagcuaagaggcuguuuacuuuuuucuaaaugccaagaauauaaccuucaaaacauccuauguucugaaacagagguuguuguuuuguuuuucuggagaaguguauuaucaaaaugccacggacugcagaacagaacugggccugaaagcaugucugggccagcugacggaacugugcacacgauugauauccacagugcauaucaacaggcagucuuuuuggaguuugcaaagcgugugccgugcagugcccgagccugccucugcacucguguuuccagguuggguggcucugacagccccuuccuguggguccugcguccuuguguggagucacgcuugcucggcagcugcucacuuccuccgguuguuuugccgcucggcucucccgcccguggguuuucaggaggcgaaugucuaccugcuuaauccugaggcuucgaucccgcaaagcccuucagaguucucugacuuccaggccugggccacaggccccagccucuuuuucuuuccuccuguaacuuguguccuguuucugauuucucaccaauuaugccaucugccugugcccuugguaacaucuggguauugugugugcugcagaccucacccaugugagacagguccccucacucgccggccaccagaccccaguguagugggcgucuccagcguagugggcgucuccaguguagugggcaucuccaguguaguagaccucuccaguguaccaggccucuccagcccacacucucugagauguaagaucacguaguucucaaguauuuauuggcuuguauuuuucucuuugugaagugaauuccaaucuaguagcugcagcuauguacgaauaaagaaggguuuauuuuucuguccguacauacuucuggcuuuucucacccucugcuaaacauuauccuuuaauagacaaguagauuuuuuuguauuuuucucuuugugaauugaauuccaaucugguagcugccgcuauguacaaauaaaggaagguuuauuuuucuguccauacauacacacguaaaccuacagaacacacaguccagggcauugcguuuccugccucauccagguccaggcuauuugcuuauucucuaaccagaaacaaaucauauacuuuuuuuuuuuuuuuucugagauggagucucgcugugucaccaggcuggagugugcagugaugagaucucagcucacugcaaccuucaccuccuggguucaagugauucuucugccucagccuucccaguagcuggaauuacaggccccgccaccaugcccagguaauuuuuguauuuuuaguagagaugagguuucaccauguuggccaggcuggucucaaacccccaaccucaagugauccuccugccucggccucccaaagugcugggauuacaggcgugagccaccgugccuggccgaaaucaccuauuuucuguggaaugcauuuacuucauguauaaaacagagucauagccuccaccuugcuuaccccacaugcugguuaaaggaggaaacacagagagcgcaaaugcccuguggcaggcguaggcuucuuaaguguggcagauugacgguauccauggauguguccucaucaucccugccccuucgacaaagcacauugugucuuuuggagacuuuuuuuccucccguucauuuccauuauaacaaaugcuucucuggacaauguuucauucucaaaauaucgcaauauugaaaaacuaggaauauaucaaaccauuuuaaagcaccaaaucgaaaaagaaguuauuuuguuuaaauaaauuaaauuaugaaaagacaauacucaaaaaaaaaucaauuaaauuuauucaaacuggaauaucaacugcuuuguaagguagggucccugagcgucuuagaguaauuugagccgggcgugguggcccaugccuguugucuuagcuacgugggagcuuggcuugagcccauaaguucaaggcugcggugagcaacgaucccaccacuguacuccagccuaggcaacagagcaagaccccaucucuaaaaagaaaaaaaaaagaaucauuuuucagugccuuuauauuguuucuguaucuuaacagucuuguuuugcagaugucguaaacucacaggggguggagaaccaggaguuuuuuagccacuaggaaccucucugagaaguuucuuuucuuuuccuuucuuuauuauuauuaguauucuguggccagaggagggaaaggaagguggguacugaaacgacagcucuuccccugggacugcagcauccgagcaccacaguccacccgccagccuuuguuccugcacagucugccucucaagaccaacaacuccauaucuaugacgauaaaaauuguuagugauuauuuuacuuguaagaauuucuuucgaccucagcucugaggugacccucagcucgcccgccaccccagcugccccaccuugcuggcauagaacagggaguggaggugugaagucacucaacagggcucaguauacaaaauguaagccacgccucacucacuugcucccuggagaauuucaucugcgccgcguugccuaauaacgggguuaucggaaagggcaugauuacguucccucuucauucccuggagucuuuuuucccugaaacuguauuguacuugggccaagauucuugaugaaucauucaaccagaaggagaaaugggguuguuguuugguuuuuuuguuuuguuuuuuuuuuuuuuuuugcguuuugagagagcacacuugugggugguugaacauggauaaaaauaaacgggaaaacaaaaaucaaauucccggcccuaggaaauaaaauguuaccuuuaccugauauugauaauacauauuauauuugaaagcauuugcuaaugguugcauuuuccccccaacacucccaugacauauaauucccauuuuauaagucacgaaacgaagacccuggggucugaaggaacuuggcuggggugaggaucacaagcccuuggguggagcucugagcccuggcgcgguccucaagggucugcgacauuugugcuguggucagcucugugcacucuucccucccugcugcuguuaucacgaaaggcuggcuuggccuuucucauaggcguauuuccacucucaggcgcccuuuuauugucugggcuccauucaagugauaagacauacauuuaugcuauugugggaacauaauguaauauucucaacagcauugccaaaaaaaaaaaaaaguuuagccuccgccugauuuucuuauaacuuauaaagaaaauuugguuugaacaugucccaugucgauguuuucaggaaaaagauccgauagcaugcaggccuucucaugcuggccuggcucauucaucguuuccccuaaugacugacugaccagaaaaaugcacgacgcucccauggggccacucgggaggccucaggccuucgggcuuccugauucaguagauaugugaggcuugaucagucaccgcaguccacaucuccauugccucgauaaggaaccagucgcagagaggggaggccaucugcagaagcuguggagaguggcagagaggagagugaggacggggacugcccccuuccagccccucuccuccaaggacggccucauuuuauccccacccagguuuccacacccaggagcucagcaaccgcucagaaaauguuuguggaauucaaagacacaauucagacaauaugaagaauuauuuuuccuuugaguuguucuuaaaacagacgaaaucuaccagcauauaaaugaaugagaacuaaaacuggugggauuugguaaugucgacaucugagauguuuaggcuuuuaaauauauaucucagccaggugcgguggcccaugccuauaaucccagcacuuuaggaggccgaggcgggugggucguuugagcccagcagcucgaguccagccugggcaacaugguagaaucucgucuguacaaaaaaguacaauaauuagcgggcaugguggugcaagccuauaguuccagcuacaugagaggcuaaggugggaggaucaccugagcucagggaggucagugcugcagugagcugugaucaugccauugcacuccagccugugcgacagagugagaaccugucuaaaaauauauauguguuuauauauauauauuuauauaaacauuaguggguuuuaaaaaaaauuaacuaacugcuagcuccuaaaacaguauuuugccauuagcuuuggaaagguuugcucagaaaaugaauuucuaagcacucccuucauugcauuuauuggucaaacuaaugguccuggaugguuaucuuugaaacuuccuaaccuguuggguccccgucguuaaacuuaugccaacagaacuaaacucacuggaugugaauugcaucagagauguaaacauuuaaaagcguauuaaggcugggcgcaguggcucacucccgucaucccagcacuuugggaggccgaagcgggcggaucaugaggucaggagaucgagaccauccuggcuaacacagugaaaccccgucucuauuaaaaauacagaaaaauuagccggucgugguggcaggugccuguagucccagcuacucaggaggcugaggcaggagaaugcaugaacccgggaggcagagcuugcagugagccgagaucacgccacugcacuccagccugggcaacagaguaagacucugucucaaaaaaaaaaaaaaaaaaaaaaaaacauuaaaagcagaccaaaaaaauccuagaauacaggagucagcugucuauucaauucagaauaagaaauauuguagacaaggcaacauuuuauguguauuagaaauguggugguugguuugagaagugaaaccagccauguauaugcugcuccaagcauuuugguuguggcaggaaacuuugaagacuauuuugcuguacaaauucacaaagcccccugcaaacacucccgugcuuggggugaaugcccaagugugucacagcugccuugcagcucugaggaucagaaagguuaauggacauaaaagaaacuucaaagcucaaccuccuaaugggaagcugcccuugguuuuaggcugucuuugcuuacugaccgacuuaauucaugcuuuggguuaugacuguaggagagauuuuccugugucuuuggaguaugcugaacuuguguuucuuuuuguuguugcauauuagacagucaguguugaaacuaaagugaccuaaagugacagagcucauguuaugggcugaauuuugucuccccagaauucauagguugaagccuucccaguccuuagaacaugauuguaucuggagcuagggccuuuaaagacauaaauaagguaacaugaggucauaagggcaaggcccuaauccaauaugacugguguccuuauacgaagaggaagaggccaggcgugguggcuuacgccuauaaucccagcacuuugggaggccagggccggcagaucacuugaggucaggaguuugggaccaguguguccaacauggugaaaccccgucucuacuaaaaaugcaaaauuagcugggcaugguugugggcaccugcaaucccagcuacuugggaggcugaggcaggagaaucccuugaacacaagaggcggaggcugcaguuagucgugaucccaccacugcacuccaaccugugcaacagagcaaaaccccaucucaaaaaaauaaaaauaaaauaaaggaagacaaagaaacaccaaagauauuuuugcacagagaagaguccaagugaggacucagggagaagguggccaucugcaacccgagcagucucccaggaagccucaggagaaacuaaccccugugacaccuuggucuuggacuuccugcccuccagaacugugaaaaaauacaugucugcuguuuaagccacccacccuguggcauuuuguuaugguagccugagcaaacuaguucagcccaaaaugaauucugauaucaccugcagaaaucugcuuuuagacagcaggaaacugagggccucugaguuucuaggccagagucaugcagugaauuacugaaagacccagaaccccaguccuggccccugauuuucaguuuagaaucuuccuugguaagaagcaggaucuuaggcugggcccagcaaguggaaaacucuuuuuuguuuacacagccacugacuguuguggucucagacuguaccacagaaccugguguuccacaaacuuccccaguuuggagcaagagaaaaaaguaguuggaugaaaugaucucauuuuauuuuuuagucaauuuuucuuaaauguuggugcuugaaaacaaauggauggcaguaaaguaauccugaagaacacaggaggaaagaaauaaaagaggcaauaccaaauguuagcaaaauggcagcaaggcaaauaagaggcucagcaauagcaaaaaacugacuucuuuggcugggaaaaacuuauaaauauuaaaaauccugacaauguugaaaaagaaaggcagagauaggguuccaggagaaauacuaagaaugaaauuggagcugucacugcaguuaucguaaggauauuuuaaaaucauaagagagcaugaugaacaauuuaauaccaauaaauuugaaaacagguaagauggaugauuuuuagaaaaauguuaccaaaauugauucaagaaauagaaaaucuaaacaagcucaagcguuaaaaaaauuaaauagguaaaauauguacaucaacugggcacaguggcucacgccuguaaucccaacacuuugggaggcugaaguggacagaucacuugaggucaggaacuagagaccagccugaccaacacggugaaacccugucuuuacuaaaaauacaaaaugagccaggcaugauggggcaugccugugaucccagcuacuugggaggcugaggcaggagaaucgcuugaaccugggagguggagguugcagugagccgagacugugccauugcacuccagccugggcaacuagagcaaaacucuguccuaaaaaaaaaaaacaaaaaaaaaaaacaauuauauaucaacaaaaaaaagaaaauuuuaaaaaguaacaauuugaaaaagucaaauaggcaaucaaaaguauuccuuucaccagccacuaaaaaggcaccuguacaugggaaugguagcaaaaugacagaagaggaaacucuaaccucucauccaacacagaaaccgcuaaaaucaggcagaagcugucugcagagauguugcaggugcucuaaaaggugcucuaaacaaccaccaaaugcauacggcaaccaggcaaaugccugauagaggaaagccaucuucaagcccgcaggaaaguuuuguggcacaugguggcaacccaguucccaguucccaguucccuuccucaagcugcagggagcagaccagacaugaucuguucuagucuagcugauucauaccugaaggauugauccucaucuccaucucacauaacaugcaaggugggcaagagaaagaggugggcacagcucaugaaagccacagagaggcaauuaagguaaaaauagauaaauugcacuauauacaaauuaaagacuucagugcaucaaaggauacagucaacagagugaaaagcaaucuauggaguaggagaaaauauuugcaaauaacggguuaaucuucacaauauauaaagaacuccugcaacucaacaacaaaaaaaaaaccccaguuucaaacugagcaaagaacuugaauaaacauuucuucaaaaaagaugauauaaauguccaauaggcaaaugaaaagaugcuuaacauuacuaaucauuaggaagaugcaaaucaaaaccacaaugagauagcaccucagcaccucacacccauuaugauugcuacuauaaaaaaaaaaaaaacccagaaaauaacaaguguuaguaaggauguggaaaauuggaaccuugugucugccucauguaauguugggaauguaagauauuguagccacgauagaaaacaguguggcaguucaucaaaaaaugaaaaguagaauuacuguaugauccaacaauuccucuucuggguauaugccaaaaaaauugaaagcaggaucucaaaagaauaauuguacauccacauuuauagcagcauuguucacaauagccaaaaggcagaagcccaaguguucaucaguggaugcauaagaaacaaaauguggucuauccauacaguggaauauuauucacccuuaaaaaggaaggagauucugauacauguaacacuguggaugaacuuugaaaacaucauguuaagugaaauaagccagaaaccaaaggacaaauaucauacgacuacacuuauaagaggaacuuagaauagacaaagucacagagacaaacuauaguugaauuaccaaggguggaguaggcaggaagggaguggagaauuauuguuuaauggcuacagagacucaguuuuggauaaugagaacauucuagaaauuaauaguagugauggcugcacagcauugcgaauguacuucaugccacugaaguggacacuuaaaaauagcuaauaugguaaauuuuauguuaugucuaucaaacuuuuaaaggcacccuccacagauaguuuuaguaguaaguuuuaccaaacauuauaaaguuuuacaggaaaaaaaaagaaaucuauucaccucauuuuacaaggcuacauugaucuugaccuaauacugguuuaaaaaacucauuuguaaacaaguacauaaaaaucugaggcugagcgcagugacucaugccuguaaucccaacacuuuggaaggccgaggggggcggaucacaaggucaggagaucgagaccauccuggcuaacacagugaaaccccaucucuacuaaaaauacaaaaaauuagccggccgugguggcacgugccuguagucccagcuacucgggaggcugaggcaggagaaucacuuaaaccugggagaaagagguugcagugagccaagagugcgccauugcacuccagccuaggcaacagagugagacucugucuaagaagaagaaaagaaaaaaaaacucagaaauaagauauuucaucaagucaaauuugguaguguguuuuuaaaacacacacacacauaaccaagugugguuuaaccuaagaaugaaaggauaaaugaauagcauuaagucuucuuuuuucuaauccauuaauuuucuuaguaguguuaaaaagcaguagggaagauucaaugccgaguaaugauuuaaaaaaaaaaaaaacucuucagaaaccaggaauagauaacuuucuuaacuauggagguuaucuauaaaaaacguacaacaaauauugaauggugaaaaccuuaguuuaaggcuuaaaucauguacaagacacacaugaaugcuauuacucuucaacaguguucuaugauuccuagucaagggaauaaaauaaaaaaaaauuacaagaauuauacaggaagggacacauuuuguuugcaugucauacaguugucuacauagaaacaucaaagagagucaauaaacuguuacaacucauucagcaaaauuccucuuuguaagauccacucacugaaaucuuuagcauuuguauacccaaugauaaacaauuauaaaauguaacagaaaacauaguaaauaauaguggauucaaggcuagccauguaauacagguugaacauuccuaauuuuaaucugaaaugcuccgauaucuuaaacuuuuugagugccaaucugucaacacaaguggaaaauuccacaccugaccucaugugacagggcauagucaaagcacaggugcacgacacaguugauuuagcguccccaagggaaaaaaaagacccacccagcccccuucaacuauaguauaacuuuuccaugcacacccaaauucccccacacaagcacgcccacaauguguaauaaaauggcacgugugcaggcuggacgcacccaacgcagauuccccacgauaccucacguggggccgagaacuccaugcauuacucacugugguuuuuugcuuauucucugcagugucauguaaaaauauuacugaaaaugucgaaaaggccugcagaucccccuauguguaacagugaucagaaaaagaggaauaauuuauguuuaucaauagcacaaacagucaacuuguuggaggaacugaacagcaguauaagugugaagcgucuuacagaagaguaugguguugggaugaccaccauacaugaccugaagaaacagaaggauacgcuuuugaaguucuaugcugaaugugaugagcagaaguuaaugaaaaauagaaaaacucuacguaaagcuaaaaaugaagaugugaauaguguauugaaaaacuagaucugaaggcaucacacugaacccgugccacucagugguaggcugaucaugaaacaagcgaagaucuauccugaugaacugaaaauugaagggaacugugaauauucaacaggcugguugcagaaauuuaagaaaugacauggaauucaaguuuuaaagcaucugcagaucacaaggcagcgucgaaacucauugacgaguuugccaagauuaucgcuaaugaaaaucugaugccagaacaagucuguauugcugaugagacaugaccauuugggugcuacugccccagaaagaugcugacuacagcugacgggacagccccuacaggaauuaaggaugccaaggacagaaugacugugcagugcugugcaaaugcagcaggcacgcauaaguguaaaccugcucucaugggcaaaagcuuuuguccgugcuguuuucaaagaguaaauuucuuaccaguccauuauuaugcuaacaaaaaggcauagaucaccagggacaucuuuucugaucgguuuuacaaacacuucguacaggccucuugugcucgcugcagaaaaguuggaccggaugaugacagcaagauuuucuuaugccuugacuacuguucugcucauccuccagcugaaauucucaucaaagauaauauugaugcuguguacuuucccccaaacgugacuucauuaguugagccuguaaccaggguaucuuuagaucaaugaaaaguaaauauaaaaacacugucuugaauugcacgcucgcagcagugaacggagguguagguguagaagauuuucaggagcugagcaugaaggaugccauacaugcuguugccaacgcuugcaacacagugacuaaagacacagaugugcgugccuggcgugaccucuggccuacgacuguguucagugaugaugaugaaccagguggugguuuagaagaauucagcuugucaagugagaagaaaaggaugucugaccuccaaaaaauauaccuucagaguucaucagucagcgggaagaaguacacauuaaugucauuuuuaacauugauaaugaggcuccgguuguucauuucauugacuguuggggaaauagccagaaugguucugaaucaaggugaucgugaugauaccgaccaugaagaugacguuaacacugcagaaaaagcacccguggacagcguggagcucaggugugauggguuaacugaggcccagagcagcgugcauucacaacagaacaagcaaucaugucagcuuauaaaaucaaagaaagaauccuaagacaaaaaagaaagaaaaaaaauuagccgggcauggugacacgugacuauagucccagcugugugggaggcugagguaagagucuugccugagcccaggaguuagaggcugcagugagccgugaucaugccacugcacaccagccugggaaacagcgaggcccugucucaaaaaaacccaaaaaacuaaguaaauauuuuguacaugaaacaaacuuuguguacacugaaccaacagaaaggagcugucgguucuaagaccauuguuaguggugcagauaccauuaaaaagccccccagcagaaugccuccucguccccagaggacccacuuccugggccuguaacugcuucuuauguuccuucucaccuaaaauguaaaaugccgugucccguaagcuuugaaucaaagcacagcaugguugggagagcagaggccugcuguuguuuguuguugcugcuguuguucagcagcugauugcggucucugcugaugccacuggcugcuuagcuccccugagcacguaagucuucacuguguuaauggcaugucuuauuuuuuacugugaaguacuuaugugugaauaaguguaaggaaaugacugcuugguaguagcauauaaauucagagucacgggcaggcacgguggcucacgccuguaaucccagcacuuugggaggccaaggcgggcagaucacuugaggccaggaguucaacaccagccuggccaacauggcaaaaccccaucucuacuaaaaauuacaaaaauuagccgggcgugauggcacaugcauguagucccagcuacuugggaggcugaggcaggggaaucgcuugagccugggagguagagauugcagugagccaagauuucaccacugcacuccagccugugugacagagagacugucucaaaaaaaaaaaaaaaaaagucacagucaggaaugagggugaugccacacaaccacugauuguccacaugggggugagggcugagauagugauaccucugcuuucugaugguuccauguacacagacuuuguuucaugcacaaaauuuguuuguuuauuuuuugaaacagaguuuggcucuguugcccaggcugguguacagugcugcgaucauagcucauugcagccucuaacuccuggccucaagcgaucuucccaccucagccuccguuguagcugggacuacagucaugcugucgcaccuggcaaucacaccagucuaugcacagaacuauuuaaaauacuguauaaaauuaccucuaggcuauguguauaagaugcagaugaaacauaaaugaauuuugguuuuagacucugguccuaucuucaagaucucucauuguccauuccaaaaaugccacccaccaccccccaaaaaaaaucuggaauucaaaacauuucuggucuccagcauuuuggauaagggaaacaccaccuguaauauccuuuuacacauuuccuggaugggaaacagaaguuggugugguaggagucacacauaaacggcagacuuucuugucugugacacauucuuaggauguccuagagaaguaucagcgaugugaaugucuccagucaaauaucagagcagaaagaauauguugagaacugcuguauuauuagacugggcuacuuucuucaaacaacacaugguaucaggucauucauucauuuacccaguagauauuuccuacacacucgucauaugccgagcauauccuaggcacugcagguacagcaacugacaggaauauacagccuuugcccuugugggacuuaacauuuaagagagaagacaggcagcaaacaauuucuuuaaaaauccuucuggugguaaaugcaaugaagaaaacagggugaguauagagaggaggagugagguaggccccuugcaggugaguggcauuugagcugaggcccagaugaugaagagaaggauggacucuuguaggucuauuggacuggcccuuccaggaaugguaagggcugagaggucaggagaagcgguaaguuuagcguggcugaaaugaagggagagaagacaaagcaauaggaaaugaagcuggagaagcaggcagcuucagacaggaccauuccagaccacugacaccuuaacagacaacagcaagaaguuuggguucuguucuaaggauaaauggaagucacagaacgauuuuaagugggaggauuaggcugcgguauauguuuguuuacucuguuuguguuuauuuuuguuuuaauggauacagagucucccaauguugcccaggcugguuuugaacuccugggcucaacggauccuccuaacucggccucucaaagugcugacacauguuuuuuuaauggaagcagagaaagcagucucggaccuuugcagugguucaggugauuagugauggggguuaggaccagggacguaucgauggagguguugugaaguugucauauuuuaaauauacauuucagagccaggugcacucgcugauacauuggauguggcauauuagagaaagaagacucgaagguggcaccuagucuuguguucugagcuuccagaaugaggcaucuagaagccaggacccgggagaagcacggaaggagcagugguuuauucagucugcagaagcagugccuacaggacugcugugugaaagaggacacaugugauaugagcagaugaaaaucacacagcaggcagcucugggcucauuaugagaaacgacucuaggaauauuuguaaccugcugggcucuacugcuaagggcugccuuaagccaugaagccgcagaggcugggugaccaccgucccacagugagggagcugggcaauuccuuaccagaguggagauguggcuagaucuccuagcccuaacaugcuuacuuauuuugauaagcaaagaugaagcucacaugggucccgugugcucuugaacuucuguacauuguaccauuaaccacacuuggaugcuggcaaucgcaguuuuaguuaaauaaagugacuugcccaccauacuauaaaaaauuaauuuugguagcauguugauucuguauccuaaccauaagaccacacagagccauggcuaguaaacuuuagcuugugcguaaaugccugccaagaccugcuaaauacuguugcuuacauuuaaaaaaaaaaaaaaaaauuuuuuuuuuaauuuaaauuucacggagcugcucaagggcaguucagcuuccuauucaucucugucuccaccggccaggacuggcauuacucuaacaucuguccuacggccacauuuuaugggauguuugaggauuauuccuaugaagugacauuggaauuuggggauguggcuauguucagaugccaaauaaacuuggauagaaaucauuuuuccuguguguguuuacaguuaggaacguggggcugugaggggcucccuggacaugacccuggagcugucggcccuuguucaguggucagaugcgcuucagaccucccagagugcugcccgcacacucagucacagccccaugcgcaccucaacgccacugcucagaaguccaguguaauuccucaggcagcauguccuagagcaggccaugagagguguaagguacagacuuuguugugagguuacauguaggcuucuguuccaucuugucucuguuuaaagaucgauacuucuggcagccuuuauccccaccacgauaaauacguggauggaaggauacaugcguggaaggguggauggguggaugguuggauggauggguagacgggugcauggguagauggguagauggguggauggagugauauuugauuucauagucaaagaacucaaacaguagacaaguacacaggguccuccagucuuacaacccuuccuuaacuacaauaaagauagaaguguaucuucuagauuucuuuuaaaaacauauuuaugaauguaaacauauuauggucagguccagugacucacauguauaaucuaacacuuugggaagccaaggugaguggacugcuugaugccgggaguuugagaccagccuuggcaacauagaaagaccgugucccuacaaaaaaaauuuuaaaaguagccuggugucauggcacaugccuguaguccuagcuacucaggacgucaaggugggaggaucacucgaggacaggaauuccaggcugcaguaagccaugaucauaccacugcacuccagucugggcaauggaucaagauccugucucuuuaaaaaaaaaaaaaaacauauuuacauagaaauaaauguauauaaacacagauauuguuuagggauuuguuuuuauauauauuggagaaugacaugcuuuuucaggagcuuuuauuuaacccuaugccuagaagauccuuccagcuuaacacauauacagcuacuucauucuuuuuaaccauugggagguacuguaauuaauuuaugugcuuucuguuauuuucauuguuuugcuauuguauuuacuuauuuauuuuagaaacaagaugucacuauguugcccaggcuggccucaaacucuugggcucaagcaguccucccaccuuagccucccaaguaggcgggacuacaggcaugaacccugcaauacggcuggcuucugcuauuuuaaacucgugugugugugugugugugugugugugugugugugugugcgcgcgcgugugugugugugugcguguguguguguguuuucuaacugaacaaucugaauucaauuuuaagagauuuucuugagcuggaauuauucuaguccgagcccaggcucaugaagauuucuguaaaauacauuccaagcagugaaauuacugugcccuaggauauguguacuuaaauucugauacacaaggcugcagcaauuuacacuauuacuaacgguacauaaaguccuauuuccuauguccuauaaauucccauguccaguacuggacauaacccauauuuucaauauugggugauccgauuaguuaaaaaaauagaucucauuaauuucuaauugccugauuacuaaauuaugaaugagucugaauaucuuagauaggagauuuaucauucgugaauuaccuguccugaucccuuaacuguuuugaaauuggguuauuuauauuuuucacaugguuuuacagcaauguuuacauaauauggacauuaaacuuuuguuguguuauaaaacucugucucuuuagcugugcuuauggugucuuaaguauuaccaaguuuuuaauuuuuaacuauuauuuuuuacaaaauuaaacaccucuuuuccuccauggcaccuacccuugugguuuugcuuagaaaggccuuccucacccucugagcuuuaaaaauaaucucauauucuccuauuuauaguuuuaaaaaauauuuagaccuuuaaugcaugugcauuucacuuacuguauaaugugaggggaccauguuguuuuuaauaacuaauuuauugacacugaccuauauugcccccugugagucaucucuuacauucccacaugguauggguguguuucugguuauucucguccauugaucuguuugucuauucugugcugaccucuauuuuacugcuauaauuguacagacuguuuugauaucugguaugucaaauuuuuucucaucauuucucuuuuuaaaaaucaucuuccuaugcauuuuuuucuuuccuauaaacuuuagaauaaacaugucguuuucuuuuugaaaaguuugaaauuuuuggauuacauugaauuucuagaugaauuuggaaagagcaucauuuuuucugcauuuuuuuaugauuuuucaaaacugacaccuagucagaaaacuaaguguaaaaauugaauccauagaguuuuuacaaccuggaagaaaauacaaauguggcugaaugacuuuaaacccugaguaucggaaaaggcuuccaccuaccuaugacucaaaagccagaugcaauaagacaaaguguugauauaauuugaauacauaagaaauugaaacuuauacauggcaaaaguuugcauaagaaaagucaagccaggugugguggguuaugucuauaaucccagcauuuuggaagacugaggcacaggaagauugcuugagcccaggaguucgagaucagccugggcaacaaagugagacauuggcucuacaaaaaaucaaaacauuaacugggugugguggugcauaccuguagucccggcuaccugggaagcugagucuggaggaucaccugaguccaggagacugaggcugcagugagucauguuugcaccaaugcagucuaaccugcgugacugagcaagacccuaucucaaaaaaagaaaaaauauguaaaucauaauaauaccugcuucacuguuguggagagaauuaaguaguaugccuaguacuaauaauauuguuauaauuauauacaauguuuuuaacuauaucauuucuuauauauauaagcuaucacaaauguuaguguuccucccuucugaaauucaucugagggucccucacugacccaggccuccuggguagaagcacauuuguauugagaagacaacaguuaaauucugggacacuaucuugagcuauaacuaagauaagucauuuuuuucuuccauuucuaaaaauauuuguagauuaaacccauuuuuuucuuuuuuguaccauaccaccaggauagcuuuccaccuuccaucacucaucugugugacuucuuaaguuccuucaaauguaacucuguaauuauaauuauauauucacacaaucauugugauucuuuaauugcaauugauuuaaucuaccuuaucauccaaucggugcugacaguggauuucauuccuuuuuuuuucuaacaguaggaauagaaugcagugcgcuugccaggacugaggaaagagggagggguuguuuccgccagcugccaggaucaccugugcugacccuucagcagcaccugcagcgcuauccugggccaggcgcaacuugugauuuucauaaaauagucgaguuucaaacggaugggacuuuagagcuucuuuaauuugagcuaugaagaacagaguuuuagaaaguaugcuuauucacuuggaauuccauaaaaaauaccuaugcuggguagauaggauagcacggccuaccucucaccacuggugucauaauuaaaacucauauauguauuuacuuauacucugccuuaugccaagaguacuggaaguggugagcuaagauuagaaauucuuggcuccuaugucacagacuggcaagcuucccacccugcccacugaguguccugacacaacgggaacgugcccugcaucuaaugggacauguggcuaccaagcacuugaacuggccagugugacugagaacugaauguuucauuguauugaauuucguuucacguuaauuuaaaaagguaugugugcucuauggacgugggggggccuauggacaacacagcucuuggcuauuuguuuuuaaauauaguuucauguauauacaaacagguuaucacuuuccuauguggcuggcuauuaugaaugcuaaacugcuuuucgcucucucucuagauuccaucacccagcacaaggucugugccccugaaaacuaccuauugucacaaugacagugaccucacuggccuguggugacugcacacagcucgcaaaacugucuuuggauguucaaaugagaaacaaaacugugaagagaaggaacuggcguauacaagaugacuucugauaucauguuugccauguguugugguucuuaagaacucauaggugacuuucugaugacugaaugucuguuucagagacgcuucgggccuuuuuauuuuuauuuuauuuuuuauuuuuugagacggaguccugcccuguuucccaggcuggagugcaauggcacaaucucggcucacugcaaccuccaccucccagguucaagcgauucugcugccucagccuccugaguagcugggauuacagaugugugccaccaugccuggcuaauuuuuguaguuuuaguagagacaggguuucgccauguuggccaggcuggucucaaacgccugagcucaggugaucugucaggccucuucuauagaauuccagucuuugugucuuagucaugaucauaauugaaaggucacagaaccuuugucauuagagcacaguacugccaaauaaagaauggaaau
